United States Patent 11,078,247 (RNA ENCODING A THERAPEUTIC PROTEIN) - sequence listing, part 46

SEQ ID NO: 76802 - RNA, 1878 nt, Artificial Sequence
  derived and/or modified sequence opt5 from TGM6__Homo_sapiens__NP_001241663
auggccggcaucagagugaccaaggucgacuggcagcggagccgcaacggggcugcccaccauacacaagaguaccccugcccugaacugguugugagacggggacaguccuucucucucacgcuggagcuuagccgcgcgcuggauugugaagagauucucaucuuuaccauggaaacaggcccgagagcuuccgaggcccugcacaccaaagccguguuccagacaucugagcuugaacgcggggagggauggaccgcugcccgggaagcucagauggagaagacacugaccgucagccucgccucucccccuuccgcggugauuggcagauaucugcugagcauccggcucuccagccaucgcaaacacucuaauagacggcugggggaguuuguucuucuguucaaccccuggugcgccgaagacgauguguuucucgcuuccgaggaagaacgccaagaauacguccugagcgacucuggaauuaucuucagaggcguggagaagcauauccgggcccagggcuggaauuaugggcaguuugaggaagauauucuuaacaucugucuguccauucucgaccgcagcccuggacaccagaauaaccccgcuacggauguuucuugcagacacaauccuaucuacgugacccgggucauuuccgccauggugaacagcaauaacgacagaggcgugguccaagggcaguggcagggaaaauauggcgggggaacauccccgcugcauuggcgcggcucuguugcgauccugcagaaguggcucaagggccgguacaaacccgugaaguaugggcaauguuggguguucgccggaguccugugcaccgugcuuagaugucugggcauugcuacacgcguugugagcaauuuuaacuccgcccacgauaccgaccagaaucucagcgucgauaaauacguggacucuuucgggcggacgcuggaggaucuuacagaagacuccauguggaacuuucauguuuggaaugagagcugguucgcuagacaggaccugggaccuucuuacaacggcuggcaagugcucgaugccacaccccaggaagagagcgagggggucuuucgcugcggaccugccuccgugaccgcuauccgggaaggcgacguccaccuggcgcacgauggccccuucguguucgccgagguuaacgcugacuauaucaccuggcuguggcaugaagaugagucuagagaacgcguguacagcaauaccaagaaaauugggcgguguaucuccacaaaggccgucggaagcgacucuagaguggauauuacggaccucuauaaguacccggagggcucccgcaaagagcggcagguuuauagcaaggccgugaacagacuguuuggggucgaggcuucuggacggcgcaucuggauuagacgggccggcgggagaugccuuuggcgcgaugaccugcucgagccugcgaccaaacccuccaucgcuggcaaguucaaagugcuggaaccucccaugcuuggacacgaucugcggcucgcccugugucuggccaaucucacaagcagagcucagcgcgugagaguuaaccuguccggcgccaccauccuuuacacacggaagcccgucgcugagauucugcaugagucucacgccgugcgccucgggccucaagaagagaaaagaaucccgauuaccaucagcuauuccaaguacaaggaagaccugacggaggacaaaaagauucugcuugcggccaugugccucgugacaaaaggagaaaagcugcuggucgagaaagauaucacccucgaggacuuuaucaccauuaagcgggcuuaccccggcgccucuggggaaggacugagcccuguguga

SEQ ID NO: 76803 - RNA, 2133 nt, Artificial Sequence
  derived and/or modified sequence opt5 from TGM7__Homo_sapiens__NP_443187
auggaccagguggccacccugagacucgagagcgucgaucugcaauccucucggaacaauaaggaacaccauacacaggagaugggcguuaaacgccuuacggugagacgggggcagcccuucuaccugcgccucagcuuuuccagaccuuuccagucucaaaacgaccacaucaccuuuguggcugaaacaggaccgaagcccagcgagcugcuuggcacccgggccacauucuuucugacccgcguccagccugggaaugugugguccgcgucugauuucacaauugacagcaacucccuccagguuagccuguuuacccccgcuaaugccgugaucggacauuauacgcugaaaauugaaaucucucagggccaagggcacuccgucaccuacccucucggaacauucauucugcuuuuuaaccccuggagcccugaggaugacguguaucugccgucugagauccuccugcaggaauacaucaugagagauuauggcuucguuuacaagggccaugagcgguuuauuaccuccuggcccuggaauuaugggcaguucgaagaggacaucauugauaucugcuuugagauucuuaacaaaagccuguaccaccucaagaauccugccaaggacuguucucagcgcaacgauguggucuacgugugcagaguggucuccgcuaugaucaauagcaacgacgauaauggaguucugcaaggcaacuggggagaagacuauuccaaaggggugucuccccuggaguggaagggcagcguggccauucuccagcagugguccgcucgcgggggacaaccugucaaauacggccaguguuggguguucgccagcguuaugugcacagugaugcggugucugggcguccccaccagagugguuucuaauuuccgguccgcgcacaacguggaccgcaaccuuacgaucgauacauauuacgacagaaaugccgaaaugcugagcacccagaagcgggauaaaaucuggaacuuucaugucuggaaugagugcuggaugauuagaaaggaccucccgccuggguauaacggauggcaagugcuggaucccacaccucagcagaccucuagcggccuuuucuguugcgggcccgcuuccgucaaggccauccgcgaaggagacgugcaccuggcuuacgauacccccuuuguuuaugccgaggugaaugcggacgaggucauuuggcuccugggcgaugggcaggcccaggaaauccuggcucauaacacaucuagcauuggaaaagagaucuccacgaagauggugggcagcgaccaacggcagucuaucaccuccagcuacaaauacccugaaggcucuccggaggaaagagccguuuucaugaaggcuucccgcaaaaugcucgggccccagcgggccagccugccuuuucuugaucugcucgaguccggaggccugagagaccagcccgcccaacuucagcugcaccucgcucgcauuccugagugggggcaggaccugcagcugcuccugcggauccaaagagugcccgauucuacacacccgcgcggaccuauuggccuugucgugcgguucugugcgcaggcccugcuccaugggggcggaacccagaagcccuuuuggagacacacagugcgcaugaaucuggacuucggcaaagaaacccaauggccucugcuucuccccuauagcaacuaccggaauaagcugacggaugagaagcugaucagaguuuccgggauugcugaagucgaggaaacaggacggucuaugcucgugcugaaagacaucugccuugagccuccccaucugagcaucgagguguccgaacgcgccgaggucggcaaggcccucagagugcacguuacccugaccaacacacugaugguggcucuuagcucuuguaccaugguccucgaaggguccggacugauuaauggccagaucgccaaagaucuggggacacucguggcgggccauacgcugcagauucagcuugaccuguauccgaccaaggcuggaccucggcaacuccagguucugaucagcucuaacgaggugaaagagauuaagggcuacaaggauaucuuugucacaguggccggggcccccuga

SEQ ID NO: 76804 - RNA, 1362 nt, Artificial Sequence
  derived and/or modified sequence opt5 from TGOLN2__Homo_sapiens__NP_001193770
augagauucguggucgcccugguucuccugaacguggcugccgcgggcgcugugccccuucuggccaccgagagcgucaagcaggaagaggccggggugcggccuuccgcuggaaauguuucuacacacccgagccucucccaacgccccggcgggucuacgaaaagccauccugaaccccagaccccuaaggacucccccucuaaaagcuccgccgaggcucagacaccugaagauaccccgaacaagagcggagccgaggcgaaaacacagaaggacucuuccaauaagagcggcgccgaggcuaaaacccaaaaggggucuacauccaaaagcggaucugaagcccagaccacgaaggauuccaccagcaaaucccaccccgagcugcagacaccuaaggacucuaccggcaagagcggcgcugaagcccagacacccgaggauuccccuaacagaagcggggcggaggccaaaacccaaaaggacucucccuccaaaagcggaucugaagcucagacgacaaaggaugugccgaauaaaagcggcgccgacgggcagaccccuaaggauggauccucuaaaagcggcgcugaggaccagacacccaaggaugucccuaacaaguccggggccgaaaaacaaacccccaaggacggaagcaauaaaucuggcgccgaggaacagggccccaucgaugggccuuccaagagcggagcugaggagcagaccucuaaagacuccccgaacaaggugguucccgaacaaccuagccggaaggaccauuccaaacccauuucuaauccuagcgauaacaaggagcuucccaaagcggacacaaaucagcuggccgauaagggcaaacucuccccgcacgcuuuuaagacggaaucuggggaggaaaccgaccugaucagcccuccccaggaggaggugaaguccagcgaaccuacagaggaugucgaacccaaagaggccgaagacgaugacaccggaccugaggagggcucucccccgaaggaagagaaagaaaagauguccgggagcgccucuuccgagaaccgcgagggaacacugagcgauucuaccggcagcgaaaaagacgaucucuacccuaauggcuccgggaacggaagcgcugagucuucccauuucuuugccuaucuggugacggcggcuauucuuguggccguccuguacaucgcccaccacaauaagagaaagauuaucgcuuucguucucgaaggcaaacggagcaaggugacacgcagacccaaagccuccgacuaucagcggcuggaccaaaagaucuuuuucccucccucuccgaaccgcaugguguacagcuccgggaaaagauga

SEQ ID NO: 76805 - RNA, 2562 nt, Artificial Sequence
  derived and/or modified sequence opt5 from TGS1__Homo_sapiens__NP_079107
augugcugugagaaguggagcagaguggccgaaauguuccuguuuaucgaggaacgggaggacugcaaaauucucugucugugcucccgcgcuuucgucgaagauagaaaacuuuacaaccugggccucaaaggguauuacauccgggacucuggaaauaacagcggcgaucaggccaccgaggaggaagaagggggauauuccuguggcacagcggaaucucacgacagcaaggggauuggacuggaugaguccgagcuugacucugaagcugagcugaugcgcagcaugggccucccccugcaauuuggcagaaucacggcccauaaagauuucgaaguuuccaugaauacccggaacaaggugaagauuaaaaagaaaaagcaccagaaaaaguaccuggacgagaucgugcaggaaagcuggcgcaaggaguaugaggaagaugacauccucgccucugaugacccuuccagcauugagcaguacgaaaauacaagaaccuaugagcugcaaucuaaaaaggauacagaaaccgagaacccgcccgucgagaauacacuuuccccuaaacuggaaaucaccgagaagugggaaaaauacuggaacgaguacgggggaggccuccuguggcagagcuggcaggaaaagcaucccgggcaggcucuuucuuccgagccuuggaauuuucccgacacgaaagaggaaugggagcaacacuauagccagcuguacugguauuaccucgaacaguuccaguauugggaggcccaaggauggaccuuugacgcuucccagucuugcgauacagacaccuacacaagcaagaccgaggccgaugacaagaacgaugaaaaauguaugaagguggaccugguuuccuucccuagcucuccgauuaugguggauaaugacuccagcggcacgucugauaaagaccauagcgagauccuggaugggauuuccaacaucaagcucaauucugaagaggucacacagagccaacuggacuccugcaccagccacgacggacaccagcagcuuucugaaguguccagcaaacgggagugucccgcgucuggccaguccgagccucgcaacggcgggacaaaugaagagagcaacuccucuggaaacaccaauaccgaucccccugccgaagacagccaaaaguccucuggcgcuaacacaagcaaggauagaccccaugccuccgggacggacggagaugagagcgaagaggacccgccugagcacaaacccucuaagcugaaacggucccaugaacucgauauugacgagaauccugcuagcgauuuugacgauucuggcucccugcuuggguucaaguauggaagcggccagaaauacggcgggauccccaacuuuucucaccgccagguuagauaccuggaaaagaaugugaagcucaaaagcaaguaucuggacaugcggcgccagaucaaaaugaagaacaaacacauuuucuuuaccaaggaguccgaaaagcccuucuucaaaaagagcaaaauccugucuaaggucgagaaauuucucacaugggugaauaagccuauggaugaggaagccucccaagagagcuccucucaugacaacgugcacgacgcgagcaccuccucugauagcgaggagcaggacauguccgucaaaaagggagaugaccugcuugagacaaauaacccggaacccgagaagugccagucuguuagcuccgccggcgaacuggagaccgaaaauuacgagagagauagccuccuggcuacggugccugacgagcaggauugugugacacaagaaguccccgacucucggcaggccgagaccgaagcugaggugaaaaagaaaaagaacaaaaagaagaauaaaaagguuaacgggcuuccucccgaaauugccgccgugccggagcuggcuaaauauugggcgcagagauaccgccucuucucccgguuugaugacggaaucaagcuggauagagagggcugguucagcgucaccccugaaaagauugccgagcauaucgcugggcgcgugucucaguccuuuaagugcgacguuguggucgaugccuucugcggcgugggaggcaauacaauccaauuugcccugaccgggaugcgggucauugcuaucgacauugaccccgugaagaucgcccucgcgagaaacaacgcugaaguuuauggaauugccgauaaaaucgaguucaucuguggcgacuuucugcuucuggccagcuuccucaaggcugauguggucuuucugucuccucccuggggagggccugacuacgccacagcugaaacguucgauauucgcaccaugaugucccccgacggcuuugagaucuuccggcugagcaaaaagauuacaaauaacaucguguauuuccuuccgagaaaugccgauauugaccagguugcgucccucgccgggccuggcggacagguggagaucgaacaaaacuuucugaauaacaaacugaagaccauuacagcuuacuucggcgaucucauccgccggcccgccagcgagaccuga

SEQ ID NO: 76806 - RNA, 5862 nt, Artificial Sequence
  derived and/or modified sequence opt5 from THADA__Homo_sapiens__NP_001077422
augggcgugaagaagaagaaagagaugcaggucgccgcucugaccaucugccaccaggaccuggaaacacucaagagcuucgccgauguugaggggaaaaaccuugcgucccugcuccugcauugugugcagcuuacggacggagugucucagauucacuacaucaagcagauugucccccugcucgaaaaggcugauaaaaauggcaugugcgacccuaccauccaaagcugucuggauauucuggccgggaucuaucucucccugucucuuaagaacccgcugaaaaaggugcucgccagcucccucaauucucuucccgacuuuuuccugccugaggcuaugcauagauuuacaagccggcuccaggaggaacugaacaccacagaucuguacuccuaucgcaaaguuaccgacaauaucagcucuugcauggagaacuucaaucucggacgcgcuuccgugaacaaucugcuuaagaacguccugcacuuucuccaaaagagccugauugaaauccuugaggaaaaucggaaaugugcuggcaaccauauuauccagacacagcugaugaaugaucuccugguggggauucgcguuucuaugaugcuggugcagaagguccaggacuuccagggaaaccucuggaaaaccuccgauagccccaucuggcaaaauaugugcggccugcuuucuauuuuuacgaaggugcuguccgacgaugaccuccugcagaccgugcagagcacauccggccuugccaucauccuguucauuaaaaccauguuucacccuucugagaagaucccccaccucauuagcuccguccugcugagaagcguugacuguacaucugugccugagugguucauguccagcugccggucucucuguugcggggauaucagccaauccgcggugcuguuucuuugucagggaacccuggccaugcucgacuggcagaacggcucuauggggcgcagcggagaagcucugcugcuugauacggcccauguccucuucacacuguccagccagauuaaagagccgacccuggaaauguuucucucuagaauccuggcuuccuggacaaacagcgccauccaagugcuugagucuuccagccccucccugaccgacucucucaauggcaacagcuccauuguugggcggcugcuggaauacguguauacccacugggagcauccucuugaugcgcuccgccaccagacaaagaucauguucaagaaucugcugcagaugcacagacucacggucgagggagccgacuucgugcccgaucccuuuuucguugaacugaccgagucucuucugcggcucgaauggcauauuaaaggcaaguacacaugccugggcugccugguggaguguaucggggucgaacacauucuugcuaucgacaaaaccauccccagccagauucucgaggugaugggagaucaaucccuggucccguaugccagcgaccugcucgagacaauguuucgcaaccauaagucucaccugaaaucccagaccgcugaaagcucuuggaucgaucaguggcaugagacguggguguccccucuucuguucauucucugcgaaggcaaucuggaccaaaagagcuacguuaucgacuacuaucugcccaaacuucucucuuacagcccugagucccugcaauauauggugaaaauucugcagacaagcaucgaugccaagaccgggcaggaacagucuuuucccucccucggaagcuguaacuccagaggcgcccugggggcucuuauggcgugccugcggauugcccgcgcucacggacaccuccaaucugccaccgacacaugggagaaucuggucagcgaugccagaaucaaacagggccugauccaucagcacugucaagugcggauugacacccuuggccugcucugcgaguccaacagaucuacagaaaucguuagcauggaggaaaugcaguggauucaguucuuuaucacguacaaucugaacucccagucucccggggugcgccaacagauuuguagccuccugaagaaacuuuucugccggauccaggaguccagccagguccuguauaagcucgagcaaucuaaguccaaaagagaaccugagaaugaacugaccaagcagcauccgagcgugucucugcagcaguacaaaaacuuuauguccagcaucuguaauucucuuuucgaggcucuguuucccggauccagcuauuccacacgcuucagcgcccucaccauucugggcucuaucgcggaaguguuucacguuccugaggggcggauuuacacagucuaccaacucagccacgauaucgacgugggaagauuccagacccugauggagugcuucacguccaccuuugaagaugugaagauucuugcuuucgaccugcucaugaaacugucuaagacagccguccauuuucaggauagcggcaagcugcaagggcuuuuccaggccgcucuggagcucuccaccucuacaaaacccuaugacugugugaccgccagcuaccugcucaacuuucugaucuggcaggaugcccuuccuuccucucugagcgccuaucugacgcagcaaguugcgugcgacaauggcgaucgccccgccgcuguggucgaacggaacacacucauggugaucaagugccugauggagaaccuugaagaggagguuucccaggccgaaaauagccugcuccaggcugccgcggccuucccgauguacggaagagugcacuguauuaccggcgcucugcagaaacucucucugaacucccuucaacuggucagcgaguggcgcccugugguugaaaagcugcuccugaugucuuaucggcuuuccacaguggucagccccgugauccaguccucuagcccugaggggcugauucccauggacaccgacuccgaaagcgccucuagacuccagaugauccugaaugagauucagccucgcgauaccaacgacuacuuuaaucaagcuaaaauccucaaggagcaugauuccuucgacaugaaagaucugaacgccagcguggucaauaucgacacaucuacggaaauuaagggaaaggagguuaaaaccugcgaugugacagcccagauggugcuugucuguugcuggcggagcaugaaggaaguggcucugcugcucggcaugcugugucagcuucugcccaugcagccgguuccugaguccucugacgggcuccugaccguggagcaagucaaagaaaucggagauuauuuuaagcagcaccuccugcagagcagacaucggggcgcguucgagcuugccuacacaggguuugugaaacugaccgaaguucugaaccgcugccccaaugugucccuccaaaagcugcccgagcaguggcuuuggucuguccuggaagagauuaaguguagcgacccuuccagcaaacucugcgcuacgagacggucugccggcaucccguucuacauucaggcccugcuggcuuccgagcccaagaaaggaagaauggaucuccuuaagaucacaaugaaagaacugauuagccuggccggcccuaccgacgauauccaguccaccgugccccaaguucacgcgcucaacauccugcgcgcucuuuuucgggacacaagacugggggagaauauuaucccuuauguggccgacggagccaaggcugccauucucggcuucaccucucccgucugggcggugcgcaacagcuccacacugcuguucucugcucucaucacgagaauuuuuggggugaagcgggccaaagaugaacacagcaagaccaaucgcaugacaggaagagaguucuuuucccgguucccugaacuuuaccccuuucugcugaaacagcucgagaccgucgccaacacaguugacagcgauaugggcgagccgaaucgccauccuucuauguuccugcuucugcucgugcuggaaagacuguaugcuucccccauggacgggaccagcucugcccucuccaugggcccuuuugugcccuucaucaugcgguguggacacagcccggucuaccauucucgcgagauggcugccagagcgcuugugccuuuuguuaugaucgaucacauucccaacacgauccggacccugcugagcacacucccuuccugcaccgaccaguguuuccgccagaaccauauucacggcacacugcuucaaguguuucaucugcugcaggccuauucugauagcaagcacgggaccaauuccgacuuccagcacgaacugacagauaucaccgucugcacgaaagcuaagcuguggcucgccaagagacagaaccccugccuugugacacgggcuguuuacauugacauccuguuccugcucaccuguugccugaauagaagcgccaaagauaaccaacccgugcuugagucccugggauuuugggaagagguccgcggcaucauuucugggagcgagcucaucaccggauucccuugggccuuuaaggugccgggccugccccaguaucugcagucccucacacggcuugcuauugcggccgucugggcugccgccgcuaaaucuggggaaagagagaccaaugugccuaucagcuucucccaacugcuggaaucugccuuucccgagguucgcagccucacgcuggaggcgcuucuggaaaaguuccucgcugccgccuccggccugggagagaaaggcgugccuccccugcucuguaacaugggggaaaaguuucuucugcuggcuaugaaagagaaucauccugaaugcuucuguaagauucucaagauccugcacugcauggacccgggagaguggcuuccccagacagagcacuguguccaucugaccccuaaagaauuucucauuuggacaauggacaucgccagcaacgagcggucugaaauccaguccguggcgcugagacuggcuagcaagguuauuucucaccauaugcagaccugcguggagaaucgcgaacucaucgccgccgagcuuaaacaauggguccagcuggugauucuguccugugaggaucaccuccccacagaaagccggcuggcugugguugagguccuuaccucuacgaccccucuguuccucacaaacccccauccgauccuggaacugcaggacacccucgcccuuuggaagugcgugcugacacugcuccaguccgaggaacaagcugugagagaugccgcgaccgagacggucacaaccgccaugagccaggagaauacaugucaguccaccgaauuugcuuucugccagguggacgccagcauugcucuggcccuugcccuggcuguucucugcgaucugcugcaacagugggaccagcucgcgccuggccuucccauccugcugggguggcuccugggagagucugaugaccuuguggccugugucgaaagcaugcaccagguggaggaggauuaccuguuugaaaaagcugagguuaacuucugggccgaaacccucaucuucgugaaguaccugugcaagcaccuguuuugucuccuguccaaaucuggcuggagaccuccuagccccgagaugcuuugccaucugcaacggauggucuccgaacagugucaccuccugucucaguucuuuagagagcuuccuccggccgcugaguucgugaagacaguugaauuuacgcggcugcgcauucaagaggaaagaacccucgccugccugcggcugcucgcguuccuggagggcaaagaaggggaggacacacuugugcugagcgucugggauuccuaugcugagucucgccagcucacccugcccagaacagaagccgccuguuga

SEQ ID NO: 76807 - RNA, 774 nt, Artificial Sequence
  derived and/or modified sequence opt5 from THAP10__Homo_sapiens__NP_064532
augcccgccagaugcguggcugcccacuguggcaacaccacaaagagcgggaaaucccuguuccgguuuccuaaggaccgcgcggucagacuccugugggaucgguucguucgcggaugcagagcugacugguacggcgggaaugaucggucugugaucuguagcgaccauuuugccccggccugcuucgauguguccucugucauucagaaaaaccuucgcuuuagccaaagacugcggcucguggcuggagccguucccacgcugcaccgcgugccugcucccgccccuaagagaggcgaggaaggggaccaggcgggacggcuugauacccgcggcgagcugcaggccgcuagacauuccgaagccgcucccggcccugucucuuguacacggccgcgcgccgggaaacaggcggccgcuagccaaauuaccugcgagaaugaacucgugcagacacagccccacgccgacaacccuuccaauaccguuacaagcgugcccacccauugugaggagggaccuguccacaagucuacgcagaucucccugaagagaccccggcacagaagcgugggcauccaagcuaaagugaaggccuucgggaaacgccugugcaacgccaccacacagaccgaggaacucuggucucggacauccagccuguuugauauuuauucuuccgacagcgaaaccgauacggacugggauaucaaguccgagcagucugaccuuagcuacauggcuguccagguuaaagaggaaacauguuga

SEQ ID NO: 76808 - RNA, 945 nt, Artificial Sequence
  derived and/or modified sequence opt5 from THAP11__Homo_sapiens__NP_065190
augcccggcuuuaccugcugugugccugggugcuacaacaauagccacagagacaaggcccugcauuucuauacauucccgaaagaugcugagcuccggcgccuguggcuuaagaacgucuccagagccggaguuucuggcuguuuuagcacguuccagcccaccacagggcaccggcugugcuccgugcauuuucaaggaggccgcaaaaccuacacagugagagucccuaccaucuucccccuccgcggggugaaugaacggaagguugcgagacggccugcuggagccgccgcugcccgcagacggcagcagcagcaacagcagcagcaacagcagcagcaacagcagcaacagcagcagcaacagcagcagcaacagcagcagcaacagcagucuagccccuccgcuucuacagcccagaccgcgcaacugcagccuaaccuugugagcgccuccgcugccguccugcucacgcugcaggcuaccguggacagcucucaagccccgggcuccguucagcccgcgccuauuacacccaccggcgaggaugugaaaccuaucgaccugacaguccagguggaauuugccgcugccgagggggcugccgccgcugcggccgcuagcgaacuccaggccgccaccgcuggacuggaggccgcggagugucccaugggcccgcaacuuguggucguuggggaagagggauucccugauacgggcucugaccacuccuauagccugucuuccgggacaaccgaagaggagcuccugcgcaaacuuaaugaacagagagauauucuggcucucauggaggugaagaugaaggaaaugaagggaagcauccggcaucugcgccugacagaggccaaacucagagaggaacugcgggagaaggacagacuucuggccauggcugugauucgcaaaaagcacggcauguga

SEQ ID NO: 76809 - RNA, 642 nt, Artificial Sequence
  derived and/or modified sequence opt5 from THAP1__Homo_sapiens__NP_060575
auggugcagagcugcuccgccuacggcuguaagaacagauaugacaaagauaagcccgucucuuuccacaaauuuccucugacccggccgagccucugcaaggagugggaagcugccguucgcagaaagaauuucaagcccacaaaguacuccucuaucuguagcgagcauuuuacgccugacugcuucaaacgggaauguaacaauaagcugcuuaaagagaacgcggugcccaccauuuuucugugcacagaaccucacgauaagaaagaggaccuccuggagccccaagaacagcuuccuccgcccccucugcccccucccgugucccaggucgaugcugccaucgggcuccugaugccgccucugcagacccccgugaaucucucuguuuucugugaccauaacuauacaguggaggauaccaugcaccaacgcaagagaauccaucagcuggaacagcaggucgagaaacuucggaaaaagcugaaaacagcccaacagcgcugcagacggcaggagcgccagcucgaaaagcugaaagaggugguucacuuucaaaaggaaaaagacgaugugagcgagagaggauacgucauucuuccuaaugacuauuucgaaauuguggaggugcccgcuuga

SEQ ID NO: 76810 - RNA, 687 nt, Artificial Sequence
  derived and/or modified sequence opt5 from THAP2__Homo_sapiens__NP_113623
augcccaccaacugcgccgcugccggcugugcgacaacguacaauaagcacaucaacauuagcuuccauagauuuccucuggacccgaaacggcgcaaggagugggugagacucguccggcgcaaaaauuucguucccgggaagcacaccuuucugugcuccaaacauuucgaggcuucuuguuuugaucuuacaggacagaccagacggcugaagauggacgccgugccuacaaucuucgauuuuugcacccacauuaagagcaugaaacucaagucccgcaaccugcuuaaaaagaauaacucuuguagccccgccggcccuuccaaucugaaaucuaacaucagcucccaacaggugcuccuggaacauagcuaugcuuucagaaaucccauggaagccaagaagcggauuaucaaacuggagaaggaaaucgcuucucuccgcagaaaaaugaagacaugccugcagaaagagcggcgcgccaccagacgguggauuaaggcgacgugucuugucaaaaaccuggaggccaauuccgugcucccuaaggggaccagcgaacacaugcugccgacagcucuuucuucccugccccucgaggacuuuaagauccuggaacaggaucaacaggacaaaacccugcucagccugaaccuuaagcagacaaaaucuaccuucauuuga

SEQ ID NO: 76811 - RNA, 669 nt, Artificial Sequence
  derived and/or modified sequence opt5 from THAP6__Homo_sapiens__NP_653322
auggugaagugcuguagcgccaucggcugcgcuuccagaugucugcccaacucuaaacucaaggggcugaccuuccacgucuuuccuacagacgagaauauuaaacggaaguggguucuugccaugaaacgccuggaugugaacgcggcuggaaucugggaaccgaagaagggcgacgugcucugcagcagacauuucaaaaagacggauuuugaccgguccgcccccaauauuaaacugaagccuggggucauccccucuauuuucgauagcccuuaccaccuucagggaaaacgcgagaagcugcauuguagaaagaacuuuacccucaaaacagugcccgccaccaauuauaaccaccaucugguuggcgcuuccucuugcaucgaagaguuccaaagccaguuuaucuucgaacacuccuacagcgugauggacucuccuaagaaacugaagcacaaacucgaucaugucauuggggagcuggaggacacaaaggaaucccuucggaaugugcuggaucgcgagaaaagauuucaaaagagccuccggaagaccauccgcgaacugaaagacgagugucuuauuucucaggagacagccaacagacuggauaccuucugcugggacuguugccaggaauccaucgagcaggauuauauuagcuga

SEQ ID NO: 76812 - RNA, 1728 nt, Artificial Sequence
  derived and/or modified sequence opt5 from THBD__Homo_sapiens__NP_000352
augcugggcgugcucguccugggggcccuugcucuggccggacucggcuuccccgcgccugcugagccgcagcccgggggaagccaaugcguugaacacgacuguuuugcccuguacccuggccccgccaccuuccuuaacgcuucccagaucugcgaugggcugagaggacaucucaugacagugcggucuagcguggccgcugacgucauuucccugcugcucaauggcgauggcggggugggacgcagacggcuguggaucggccuucagcugccucccggguguggagacccuaagcgccucggcccgcugagaggguuucaguggguuacgggagauaacaauaccucuuauagccggugggcccgccuugaccugaacggcgcgccccucugcggcccucuguguguggccgucuccgcugccgaggcuacagugcccucugaaccuauuugggaggaacaacagugcgagguuaaagccgauggguuccugugugaguuucacuuccccgcgaccugcagaccgcucgccguggaaccuggagcugccgcugccgccgucagcaucacauacggcacccccuuugcugcgagaggggccgacuuccaggcucugccugugggauccagcgccgccguggcuccccuuggccugcagcucauguguacagcgcccccuggggccguccaaggacauugggcucgcgaggccccgggcgccugggauugcucuguugaaaauggcgggugugagcacgcuugcaacgccauucccggagcuccuagaugccagugucccgccggcgcggcccugcaggcugacgggcgguccugcaccgccagcgcuacgcagucuuguaaugaucuuugcgagcauuuuugugugccuaaccccgaccaaccgggauccuauagcugcaugugugaaaccggcuaccgccuggccgcggaucagcacagaugcgaggacguggacgauuguauccucgaaccuucucccugcccucagcggugugucaauacacaagggggcuucgagugccacugcuaucccaacuacgaccugguggauggagaauguguugagccuguggaccccugcuuucgcgccaauugugaguaucagugccagccgcugaaccagaccuccuaccucugugucugcgcugaaggcuucgccccuaucccccaugagccccacagaugucaaauguuuugcaaucagacagcuuguccugccgauugcgacccgaacacccaggccagcugugaaugccccgagggguacauucuggaugacggauucaucugcacggauauugacgaaugugagaauggcggguucugcuccggagugugucauaaccuuccuggcacauuugagugcaucugugggcccgauucugcucuggcgcggcacauuggcaccgacugcgacagcggaaagguugauggcggggacuccggaagcggcgaaccucccccuucucccacaccgggguccacccucaccccucccgccgugggacugguccacagcggccuucugaucgggauuucuaucgcuagccucugucugguggucgcccugcucgcccugcuuugccaucugcggaaaaagcagggcgcugcccgcgcgaaaauggaguauaagugugcugccccuuccaaggaagugguucuccaacacgugcggacagagagaacgccccagcgccuguga

SEQ ID NO: 76813 - RNA, 3513 nt, Artificial Sequence
  derived and/or modified sequence opt5 from THBS1__Homo_sapiens__NP_003237
augggccuggccugggggcucggagugcuguuccuuaugcacgucugcggcaccaacagaauccccgagagcgggggagacaauuccguuuuugauauuuucgaacugacaggcgcugcccggaaggggucuggacgcagacucgugaaaggcccugacccgagcucccccgcguuucggaucgaggaugcuaaccugauuccucccgugccugacgauaaguuccaggaccuugucgaugccgugcgcgccgaaaaaggcuuucugcuccuggcuucucugagacaaaugaagaaaacgcgggggacccuccuggcccuugagcgcaaggaccauagcggacagguuuucuccguggucucuaauggcaaggcugggacacuggaucucagccugaccgugcagggaaaacagcacguuguguccgucgaagaggcccuucuggcgacaggccaauggaaaagcaucacccucuuugugcaggaggacagagcccagcuguacauugauugugaaaagauggagaacgcugaacuggacgugcccauccagucugucuucacacgggaucucgccuccaucgcucgccugagaauugccaaagggggaguuaaugacaacuuucaaggcgugcuucagaaugugcgguucgucuuuggcaccacgccugaggacauccugcgcaacaaggggugcuccucuuccaccagcgugcuccugacacuugauaauaacguugugaauggaucuuccccggcgauuagaaccaacuauaucggccauaagacaaaggaccugcaggccauuugugggaucagcugcgaugagcucuccucuaugguccuggaacugcggggacuccgcaccauugugacgacacugcaggacagcaucagaaaaguuaccgaggaaaauaaggagcuugcuaacgaacugcggagacccccucucuguuaccacaauggcgugcaauaucgcaacaacgaggaguggacagucgauuccugcaccgaaugucauugccagaauagcgugaccaucuguaaaaaggucucuugccccauuaugccuuguuccaacgccacagugcccgacggggagugcugcccgcgguguuggccuagcgauucugcugacgauggauggagccccugguccgaauggacgucuugcagcaccuccuguggcaauggcauccagcaaagagggcgcagcugcgacucucugaacaaucggugugagggauccagcguucagacaagaaccugccacauucaggaaugugauaaacgcuucaagcaggacggcggguggucucacugguccccuuggagcuccugcucugugacauguggagacggcgucaucacccggauuagacuuugcaacagccccagcccccaaaugaaugggaaaccuugugagggcgaggcccgcgaaacgaaggccugcaagaaagaugcuugcccgaucaacggaggcugggggcccuggucuccuugggacaucuguagcgugacaugcggaggcgggguucagaagcgguccagacuguguaauaaccccaccccucaguuuggaggcaaagauugcgugggggacgucaccgagaaucagauuuguaacaagcaagauugccccaucgacggcugucucagcaauccgugcuucgcgggagugaaauguacaucuuacccugauggcuccuggaagugcggggccugucccccuggauauagcggcaacgggauucagugcaccgacguggaugaaugcaaggagguucccgacgcuuguuucaaucauaacggagaacaccgcugcgagaacacagauccuggcuacaauugucugcccugcccgccucgguuuacggggucucagcccuucggccagggagucgagcaugccaccgccaacaaacaaguguguaagcccagaaauccuugcacagacggcacccacgauuguaacaaaaaugcuaagugcaacuaucuggggcacuacuccgacccgauguaccggugugaaugcaaacccggauaugccggcaaugggaucauuuguggagaggacacagaucucgacggcuggccuaacgaaaaucuggugugcgucgcgaacgcuaccuaccauugcaagaaggauaauugucccaaccuuccuaauagcgggcaggaggacuaugauaaagacggcaucggagaugccugcgacgaugacgaugacaacgauaagauccccgacgaccgcgauaauuguccuuuucacuacaaccccgcccaguaugacuacgauagagacgaugugggcgaccggugcgauaacuguccguauaaucauaacccugaccaggcugauacggacaauaacggggagggagaugccugcgcugccgacauugacggcgaugggauccugaaugaaagagacaacugucaauacguuuacaauguggaucagcgcgacaccgauauggacggagucggcgaucagugcgacaacuguccccucgagcacaauccugaucaacuggacucugauagcgaccggauuggcgauacaugcgacaacaaucaggacaucgaugaagacgggcaucagaacaaucuggauaacugucccuaugugccgaaugcgaaccaggccgaccacgauaaagacggaaagggcgaugcuugcgaccacgaugacgauaacgacgggauuccugaugacaaagacaauugcagacuuguucccaacccugaucaaaaggacuccgauggagacggccgcggggaugccuguaaggacgauuucgaccaugauagcgugcccgacaucgaugacauuugccccgagaaugucgacaucucugaaaccgauuuuagacgguuccagaugaucccucucgacccgaaaggaacaucccagaacgaucccaauugggugguucgccaccagggcaaggagcuggugcaaaccgucaacugugacccuggccuggcugugggguacgaugaguuuaaugccguggacuucagcggaacguuuuucauuaacacagaaagagaugacgauuaugcgggcuuugucuucggguaccaguccucuagccgguuuuauguugugauguggaaacaggugacccaguccuacugggacacaaaucccacccgcgcccaaggauauucuggccucagcgucaaggugguuaacuccaccacagggccuggagagcaucugagaaaugcucuuuggcacacgggcaacacccccggccaggugcggacacuguggcacgauccucgccauaucggguggaaagacuucaccgccuacagauggcggcucucucaccgcccgaagacaggauucauuagagucgugauguacgaaggcaaaaagaucauggcugauagcgggcccauuuaugacaagaccuacgccggaggccggcuggggcuguuuguuuucucccaggagaugguguuuuucagcgaccuuaaauaugaaugcagagauccuuga

SEQ ID NO: 76814 - RNA, 3519 nt, Artificial Sequence
  derived and/or modified sequence opt5 from THBS2__Homo_sapiens__NP_003238
augguguggagacugguccuccuggcccuuuggguuuggcccagcacccaggcuggccaccaagacaaggauacaacguucgaccuguuuuccaucucuaacauuaaucggaaaaccaucggggccaagcaguuccgcggaccugauccgggcgugcccgcguacagauuugugcgguucgacuauauuccucccgucaacgcugaugaccucagcaaaaucacaaagauuaugcgccagaaagagggguuuuuccugaccgcccagcuuaagcaagauggaaaguccagaggcacacugcucgcccuggaagggccuggacugucucagcggcaguuugagaucgugagcaauggccccgcugacacccucgaucugacauacuggaucgacggcacccgccauguugugucccuugaagaugucgggcuggccgacucucaguggaaaaacgugacgguucaaguggcuggagagaccuauagccuccacgucggcugcgaucugauugacuccuucgcccuugacgaaccuuuuuacgagcaucugcaggcggagaagucuagaauguauguggccaaagggucugcucgggaaucccacuuccgcggacuccugcagaaugugcaucuggucuuugagaacagcguugaagauauccucucuaagaaaggcugucagcaagggcagggagccgagauuaaugcuaucuccgagaacacagaaacccugagacuuggcccgcacgugacaaccgaguacgugggccccagcucugaacggcgcccugaggucugcgaaagauccugugaggagcuggggaauauggugcaggaacucagcggacugcacguucuugugaaccaacuguccgagaaucucaagcgggucucuaacgacaaucaguuccugugggaacugauuggcgggcccccuaagacgcgcaacaugagcgccugcuggcaggauggaagauuuuucgcggagaaugaaacaugggugguugacuccuguaccacaugcaccuguaaaaaguucaaaaccaucugccaucagauuacaugucccccggccacgugcgcuagcccuucuuuuguggagggcgaguguugccccuccugccuccacagcgucgauggggaagagggauggucuccuugggccgaauggacccaauguagcgugacaugcggcuccggcacccagcagcgggggagaucuugugacgucacaagcaauaccugccugggacccuccauccagacgcgcgcuuguagccuuucuaagugcgauacacggaucagacaagacggcggguggucccauuggagccccuggucuuccuguagcgugaccugcggaguuggcaacauuacccgcauccggcuguguaacuccccugugccgcagaugggcgggaaaaacugcaagggaucuggcagagagacaaaagccugucagggggcccccugcccuauugauggacgcuggagccccugguccccuuggucugcuugcaccgucacaugugcgggcgggauccgggaaagaacgcgcgugugcaauagccccgagccgcaguauggaggcaaggccuguguuggggacgugcaagagcggcagaugugcaacaagagauccuguccugucgauggcugccucagcaaucccuguuucccuggagcucagugcagcuccuuucccgacggcagcuggucuuguggguccugcccugugggauuccugggcaacgggacccacugugaagaccuugaugagugcgcccuggugcccgacauuugcuuuagcacaucuaaaguuccgcgcugugucaauacccagccuggauuccacugccuccccugucccccucgguacagaggcaaccaaccggugggggugggccuggaagccgcuaagacagagaaacaggucugcgagcccgaaaauccuuguaaggauaaaacccauaacugccacaagcaugccgaguguaucuaccugggacacuuuagcgaccccauguauaagugcgaaugucagacgggcuacgcgggggauggacucaucugcggcgaggacuccgaucuggacggguggccuaaucuuaaccuggugugugcuaccaaugccacauaucauugcauuaaagauaacugcccccaccucccuaauagcggacaagaagacuucgauaaggacggcaucggggaugccugugacgacgaugacgauaacgacggcguuaccgaugagaaagacaacugccagcugcuguuuaauccccggcaggcugauuacgacaaggaugaggugggagaccgcugugauaacugcccguauguccacaauccugcccagauugacacagauaacaauggcgaaggggacgcuuguucuguggacaucgauggagacgauguuuucaacgagagagacaauugccccuacguguauaacaccgaucaacgggacacggauggcgacggggucggagaucauugugacaauugcccucuugugcacaaccccgaucagacagacguugacaaugaucucgugggcgaccagugugauaacaaugaagacauugaugacgauggccaucagaacaaucaagacaacugcccguacaucuccaacgccaaucaggcggaucacgacagagaugggcagggagacgccugugauccugacgacgauaacgacggcguccccgaugaccgcgauaauugccggcugguguuuaacccugaccaggaggaucuggacggggauggaagaggcgacaucugcaaagaugacuucgauaaugacaacauucccgacaucgaugacgugugucccgaaaauaacgcuauuagcgagaccgauuuucgcaauuuccaaauggucccucucgacccgaaggggacaacccagaucgaucccaacuggguuauuagacaccagggaaaggagcuggugcaaaccgccaauuccgacccuggcaucgcugugggcuucgaugaauuugggucugucgacuucagcggaacauuuuacgugaacacggaucgggacgaugacuaugccggcuucguuuuuggguaccaguccucuagccgcuucuauguggucauguggaaacaggugacccagacauacugggaggaccaacccaccagagcguauggauacuccggcguuucucuuaagguggucaauagcacaaccgggacgggagaacaucugcggaacgcccucuggcacacaggcaauaccccuggccaggugcgcacccuguggcaugaucccagaaacauuggguggaaagacuauacagcuuaccgguggcaccugacccaucgcccuaagacaggauacaucagaguucuugugcacgagggcaaacaggucauggccgauuccgggccgaucuaugaccagacguacgcuggaggccggcucgggcuguuuguguucagccaagaaaugguguauuuuucugaucugaaguacgagugccgcgacauuuga

SEQ ID NO: 76815 - RNA, 2511 nt, Artificial Sequence
  derived and/or modified sequence opt5 from THBS3__Homo_sapiens__NP_001239537
auggagacccaggaacugagaggcgcccucgcucugcuucugcucugcuucuuuacaagcgccucccaagaccuucaggugaucgaucugcugacggucggggagucucggcagaugguugcgguggcugaaaagauucgcaccgcccuccugacagccggagacaucuaccugcucagcaccuucagacugcccccuaaacagggcggggugcuuuuuggacuguauucccggcaagauaacacacgcuggcucgaggcuucugucgugggcaagauuaauaaaguuaccaacgcccugcacagcauccuuggggaacagacaaaggcucuggugacccagcucacgcuguucaaucagauucuggucgagcucagagacgauauccgggaccaagugaaagagaugucccugauccgcaacaccauuauggaaugucagguuugcggauuucaugagcagagaucucacuguagcccgaaucccugcuuccggggcguggauuguauggaagucuacgaguauccuggcuaccgcugcgggcccuguccucccggacuucagggcaacgggacacauugcuccgacaucaaugagugugcccacgcggauccuugcuuuccgggaagcucuuguauuaacaccaugcccggcuuccauugcgaagccugcccuagaggguauaagggaacacaaguguccggcgugggcaucgacuacgcucgggccagcaagcaggucuguaaugauauugacgagugcaacgaugggaauaacggaggcugugaccccaauucuaucugcaccaacacgguuggguccuuuaaauguggaccuugccgccugggcuuccucgggaaucagagccaaggaugucugcccgcuagaacaugccacucuccggcccacuccccuugucauauucacgcgcauugccuuuuugaacggaacggcgccgugagcugucagugcaacgugggcugggcugggaauggaaacgucugcggcaccgacacagauaucgacggguaucccgaucaggcccugccuuguauggacaauaacaagcacugcaaacaggauaauugucuccugacccccaacuccggacaagaggacgcugauaaugacggcgugggggaucagugcgacgaugacgccgacggcgauggaaucaagaacguugaagacaauugucgccuguuccccaacaaagaucagcaaaauucugacaccgauagcuuuggcgacgccugcgauaacuguccuaaugugccgaacaaugaccagaaggauacagacgggaacggagagggcgaugcuugcgacaacgaugucgacggggacggcauucccaauggacucgauaacuguccuaaggugcccaauccucugcagacggacagagaugaggacgggguuggcgaugcgugcgacuccugucccgaaaugagcaacccgacccagacagaugccgacucugaucuugugggagacgucugcgauaccaaugaggacuccgauggcgacgggcaccaggacacaaaagauaacugcccucaacugcccaauagcucucagcucgacagcgauaacgacggacugggcgaugaaugugacggggaugacgauaaugacggaaucccugauuacgugcccccuggccccgacaacugccggcuugucccgaauccuaaccagaaggacuccgaugggaauggcgugggagacguuugugaggaugacuucgauaacgacgcuguggucgauccccuggacgugugccccgaaucugccgagguuacccucacggauuucagagccuaccagacagugguccuggacccugagggcgaugcucaaauugacccgaauuggguggugcugaaccaggggauggaaaucguucagaccaugaacagcgaucccggacucgccgucggcuauaccgcguuuaaugggguggacuucgagggaacauuucaugugaacaccgucacagacgaugacuacgcuggcuuccuguuuuccuaucaagauagcgggcgcuucuacgugguuauguggaaacagacggaacagaccuauuggcaggccacaccuuuucgggccguggcucaacccggccuucagcugaaggccgucaccucuguguccggaccuggcgagcaccucagaaaugcucuguggcauacagggcacacccccgaccagguucgccugcuuuggacggauccucggaacgugggauggagagacaaaaccagcuaccgcuggcagcuccugcaucggccccaagucggcuauauuagagugaagcuguacgaagggccgcagcucguugccgauucuggagugaucaucgacacauccaugcgcggcggccggcugggggucuucuguuuuagccaggagaauauuaucugguccaaccuucaguacagaugcaaugauaccgugccugaggacuucgaacccuuucgccggcaacugcuccagggaagaguguga

SEQ ID NO: 76816 - RNA, 2886 nt, Artificial Sequence
  derived and/or modified sequence opt5 from THBS4__Homo_sapiens__NP_003239
augcuggcccccagaggcgcugccgugcuccugcuucaccugguccuccagcgguggcuggcggcuggggcccaagccaccccucagguuuucgaccuucugccgagcuccucucagcgccucaaccccggagcucugcugccugugcucacagaucccgcccugaaugaccuuuacgugaucagcacguuuaagcugcagaccaaauccucugcuacaauuuucggccucuauagcuccaccgauaacucuaaguacuuugaguucacagucauggggagacugaauaaagccauccuucgguaucugaagaacgacggaaaagugcaucucguuguguuuaauaaccugcaacuggcggauggccgcagacaccggauucuccugcgccuuagcaaucugcagagaggggccggaucccucgaacuguaccuugacugcauccaggucgauagcgugcauaaccugccucgggcuuucgccggccccucucagaagccugagaccauugaacuccgcacauuucaaagaaagccgcaggacuuccuggaggaacugaaacucguugugcggggcucccuguuucaggucgcuagccuucaggauuguuuccugcaacagucugagccccucgccgcgaccgggacgggagacuuuaaucgccaguuccugggccaaaugacccagcuuaaccagcugcucggggaggugaaggaucugcugagacagcaagugaaagaaacauccuuucuccggaauaccaucgccgagugccaggcuuguggaccucugaaguuccagagccccacaccuucuaccgucguucccccggccccucccgcuccucccacgagacccccucgccggugcgacuccaacccguguuucagaggcgugcagugcacagauagccgcgacggguuucaauguggacccugcccugaaggcuauaccggcaaugggaucacauguauugacguggaugagugcaaauaccaccccuguuauccuggaguccauugcaucaaccuuucccccggcuuccggugcgacgccuguccggugggguuuaccggaccuaugguucagggcguggggauuucuuucgccaagagcaauaagcaggucugcaccgauaucgacgaguguagaaacggagcuugcgugcccaacuccauuuguguuaauacacugggcagcuaccgcugcggcccuuguaaacccggguacacgggagaucagauccggggcugcaaggcggaaagaaacugucgcaauccugagcucaaccccugcucugugaaugcccaauguauugaagaacggcagggggacguuaccugcgugugcggagucggcugggcuggggauggcuauaucuguggaaaagacguggauaucgacuccuacccggaugaggagcugccuugcagcgccagaaacuguaagaaagacaauugcaaguauguucccaacucuggccaggaggacgccgaucgcgacgggauuggagaugcuugugacgaagaugccgacggcgaugggauccugaaugagcaggacaacugcgugcuuauucacaaugucgaucaacggaacagcgacaaagauaucuuuggagacgcgugugauaauugccucuccgugcugaacaaugaccagaaggacacagauggcgacgggagaggcgaugcuugugacgaugacauggauggagacggcauuaagaacauccuggauaacugccccaaauucccuaaucgcgaccagcgggauaaggacggggauggaguuggcgacgccugugacucuugcccggaugugagcaaccccaaucaauccgacgucgauaacgaccucgugggggauagcugcgacaccaaucaggauucugacggagauggccaccaggacuccacagauaacuguccuaccgugaucaauagcgcccagcuggacacggacaaagaugggauuggcgacgaaugcgaugacgaugacgauaacgacggaauccccgaucuuguuccucccggcccugacaauuguagacugguccccaacccggcucaagaggauucuaauuccgacggggugggagauauuugcgaaagcgacuuugaccaggaucaggugaucgaccggauugaugucuguccugagaacgccgaggugacacucaccgacuuccgcgcuuaccagaccguugugcuggaucccgaaggcgacgcccaaaucgauccuaauugggucgugcugaaccaggggauggagaucguucagacaaugaacuccgaccccggacuugcggugggcuauaccgccuuuaauggggucgauuucgaaggcacauuucaugugaacacgcagaccgacgaugacuacgcuggauucauuuuuggcuaucaagauucuagcuccuucuacguugugauguggaagcagacagagcagaccuacuggcaagccacaccguucagagcugucgccgaaccugggauccagcucaaagcggugaagucuaagaccggacccggcgagcaucugcggaauagccuguggcacacgggggacaccuccgaccaggugagacuccuguggaaagauagccgcaacgucggauggaaggacaaaguuucuuaucggugguuucuucagcacagaccucaagugggcuacauucgcgugagauucuaugagggcuccgaacuggucgccgauagcggggugacaaucgacaccacaaugcggggaggccgccucggggucuuuugcuucucucaggagaauauuaucugguccaaccugaaguacagauguaaugauaccauucccgaagacuuucaggaguuccagacgcaaaacuuugaucgguucgacaauuga

SEQ ID NO: 76817 - RNA, 1140 nt, Artificial Sequence
  derived and/or modified sequence opt5 from THEG__Homo_sapiens__NP_057669
augggcgacagcagacggcgcucccuggggaaccagcccucuagcgaggccgcuggaagauccgaacgggagcaagauggcgacccucgcgggcuccagucuagcguguacgaauccagacgggucaccgauccggagcgccaggaccuggauaaugccgaacuuggacccgaggacccugaggaagaacugcccccugaagagguugcgggcgaggaguuccccgagacacucgauccuaaggaagcucugucugagcuugaaagagugcuggacaaagaucucgaggaggacaucccggaaauuagccggcuguccaucagccagaagcugcccucuacgaccaugacaaaagcccgcaagagacggcgcagacggcgccucauggagcuggccgaaccuaaaauuaacuggcaagugcuuaaggauagaaaggggcggugcggaaaaggcuaugcuuggaucucccccuguaagaugagccugcacuuuugccucuguuggccuucugucuacuggaccgagagauuccuggaagacacaacccuuacaauuaccgugcccgccguuucccgccggguggaggagcugagcagaccgaaacgcuuuuaucucgaauacuauaauaacaaucggacgaccccugucuggcccaucccuagaucuucccuggaguaccgcgcuagcucccggcugaaggaacucgccgcgcccaaaaucagagauaacuucuggucuaugcccaugagcgaggugucccagguuagccgcgccgcucagauggccgugccuucuucccggauucugcagcuuagcaagccgaaggcucccgccacacugcucgaagagugggacccuguccccaaaccuaagccccaugugucugaccacaauagacugcuucaucuggcgcgcccgaaagcccaaagcgauaagugcgugccugaccgggaucccagaugggagguccucgacguuaccaaaaaggugguggcuuccccucggaucauuucucuggccaaacccaagguccgcaagggccugaacgaaggguaugauagacggccucucgcuagcaugucccugcccccgccuaaagccagccccgagaagugugaccagcccagaccuggacuuuga

SEQ ID NO: 76818 - RNA, 723 nt, Artificial Sequence
  derived and/or modified sequence opt5 from THEM4__Homo_sapiens__NP_444283
augcugagaagcugcgccgcucggcuccgcacccugggcgcccuuugucugcccccuguggggagacggcucccgggauccgagccccgcccugaacugagaucuuucagcuccgaggaagucauccuuaaggacugcucuguucccaacccuagcuggaauaaagaucugcggcuccuguuugaccaguucaugaagaaaugugaggauggcuccuggaagcgccugcccucuuacaaaagaacaccuacggaauggauucaagacuuuaagacccacuuccucgauccgaagcugaugaaagaggagcagaugagccaggcgcagcuuuuuacacgguccuucgacgaugggcugggauuugaauaugugauguucuacaacgacaucgagaagcgcauggugugccucuuucaaggcgggcccuaucuggaaggaccucccggcuucauucauggcggggcuaucgccaccaugauugaugccacagucggaaugugugcuaugauggccggcgggaucgugaugaccgcuaaucuuaacaucaauuacaaaagaccuauuccccugugcagcguugugaugaucaacucucagcucgacaaggucgagggacggaaauuuuucguguccuguaauguucagagcguggaugagaagacacuguauucugaagccaccucccuguuuauuaagcucaacccggcgaaaagccugacguga

SEQ ID NO: 76819 - RNA, 744 nt, Artificial Sequence
  derived and/or modified sequence opt5 from THEM5__Homo_sapiens__NP_872384
augaucagacggugcuuccagguggccgcucgccugggccaccauagagggcuccuggaggcgccccggauucuuccucgccugaacccggccagcgcuuuuggauccucuaccgacagcauguucuccagauuucuccccgaaaagacagaucugaaagacuacgcccuuccuaaugccucuugguguagcgauaugcugucccucuaucaagaguuccuggaaaagacgaaaucuagcggcuggaucaagcugcccuccuuuaaaagcaaccgggaccacauucgcgggcucaagcugccuucuggacuugcugucuccagcgauaagggcgacugcagaaucuucacccgguguauucagguugaggggcagggauuugaauacgugaucuucuuucagcccacacagaaaaagucugugugccuguuccaaccuggcuccuaucucgagggcccgcccggguuugcccauggaggcagccuggcugccaugauggaugagaccuucucuaaaacagcguuucuugccggggaaggacuguucacccucucccugaauauccgcuucaagaaccugauuccugucgacagccucgugguuauggauguggaggucgacaaaaucgaagaucagaagcuguacauguccuguauugcucacucuagagaccagcaaacaguguaugccaagagcuccggcguuuuucuucagcugcagcucgaggaggaaagcccccaguga

SEQ ID NO: 76820 - RNA, 627 nt, Artificial Sequence
  derived and/or modified sequence opt5 from THEM6__Homo_sapiens__NP_057731
augcugggccuccugguggcccuucuggcucucgggcuggccgucuucgcgcuucuggacguuugguaccucgugagacugcccugcgcugugcugcgggcccgccuccugcagccuagaguccgggaucuucuggccgagcaacgcuuuccgggaagagugcuccccagcgaccuggaucuucugcuccacaugaacaaugcucgguaucugcgcgaagccgacuucgcuagaguugcccaucugacccgguguggcgugcucggggcgcugcgcgagcuuagagcccacacaguccuggcugccuccugcgcucggcaucgcagaucucuccggcugcuugaaccuuuugaggugcgcacgagacugcucggaugggaugaccgggccuucuaccuggaagcgagauuuguuagccugcgcgauggcuucgugugugcccuccugcgguuuagacagcaccuucuggggaccucccccgagcgcgucgugcagcaucucugccagcggagaguggagccucccgaacugccugcugaccuucaacacuggaucucuuauaacgaggccagcucccagcugcuccgcauggaaucuggacugagcgaugucacaaaggaccaguga

SEQ ID NO: 76821 - RNA, 1791 nt, Artificial Sequence
  derived and/or modified sequence opt5 from THEMIS2__Homo_sapiens__XP_011540747
auggagcccgugccucugcaggacuucgucagagcccucgauccggcuagccugccccggguucuucgcgugugcuccggcguguacuuugaaggguauuucaccccucugaacacaccccaaucuuacgagacgcucgaagaacuggucagcgccaccacacaguccucuaagcagcuuccuaccuguuuuaugagcacacacagaaucgugaccgaaggacggguugugacagaggaccagcugcucaugcuggaggcggucgugaugcaucugggcauucgcuccgcuagaugcguucucgggauggaaggacaacaggugauccugcaccuuccccugucucagaaaggcccuuucuggaccugggagccgagcgcuccccggacgcuccugcagguccuucaagauccugcccugaaggaccucgugcugaccugucccacacugccuuggcauucccucauucugcgcccccaguaugaaauccaggccauuaugcacaugagacggaccaucgugaaaaucccgagcacacuugaggucgauguugaggacgugaccgccucuucccgccaugugcacuuuauuaagccucugcuccugagcgaaguccuugcuugggaggggcccuucccucugucuauggaaauccucgaggugcccgaaggaagacccauuuuucuguccccuuggguuggcagccugcagaaaggccaacggcucugcguguacgggcuggccucuccgcccuggcgcguccuugcguccagcaagggaagaaaggugccucggcacuuccugguuuccggcggguaucagggaaaacuccgcagacggcccagagaguuuccuacggccuacgaucugcuuggcgcuuuccagcccgggcgcccgcugcggguggucgccacaaaggacugugagggagaaagagaggaaaauccugaguuuaccucucucgcugugggcgaucgccuggaaguccugggccccgggcaagcccauggagcgcagggcagcgacguggauguucucgugugccagcggcuguccgaccaggccggggaggaugaggaagaggaauguaaagaggaagcugagagcccugagagaguccuucugcccuuccacuuuccuggaucuuucguggaagagauguccgacagccgccgguauucucucgccgaccugacagcucaauucagccugcccugcgaaguuaagguggucgccaaagauaccucccauccgaccgacccucuuacaucuuuucucggccugagacuggaggagaagaucacggaacccuuccucguggugagccuggauuccgagcccgggauguguuuugaaauuccuccgcgcuggcuugaccugaccguugucaaggccaaaggacagcccgaucucccugagggcagccugcccaucgcuacaguggaggagcugaccgacacauucuacuaccggcuuagaaagcucccugcgugcgagauucaggcucccccuccccgcccgccuaaaaaccagggccugucuaagcaacggagacacuccagcgaagggggagugaaaucuucccagguccugggccuccagcagcacgcccggcugcccaagccuaaagccaagacccuucccgaguuuaucaaggaugggagcuccacguauucuaaaaucccggcccaucgcaagggacacagaccugcuaaaccccaacggcaggaccuggaugacgaugaacaugacuacgaggaaauucucgagcaguuccagaagacaaucuga

SEQ ID NO: 76822 - RNA, 1926 nt, Artificial Sequence
  derived and/or modified sequence opt5 from THEMIS__Homo_sapiens__NP_001010923
auggcccugagccucgaggaguucgugcacucccuggaccuuagaacccugccccggguccucgaaauccaggcuggcauuuaccuggaagggucuaucuaugagauguuuggaaacgaaugcuguuucagcacaggcgagguuauuaagaucacggggcuuaaagugaagaaaauuaucgccgagaucugcgaacaaauugagggaugugaaucccugcagccuuuugagcucccgaugaauuuccccggccuguuuaagaucguggcggauaaaaccccuuaccugacaauggaggaaauuacccgcacaauccauauugggcccucuagacucggacacccuugcuucuaucaucagaaggacaucaagcuggagaaccuuauuaucaaacagggcgaacaaaucaugcugaauagcgucgaggaaauugauggcgagaucaugguguccugugcuguugcccggaaccaccagacccauucuuuuaaucucccccugagccaggagggggaguucuacgaaugcgaagacgagcgcauuuauacacuuaaggaaaucguggaguggaaaauuccuaagaacagaacccggacggucaaucugaccgauuuuuccaacaaaugggacagcacaaauccguuccccaaggauuuuuacggaacccucauccugaagccuguguaugagauccagggcguuaugaaauuccgcaaggacauuaucagaauccugcccucucucgauguggaagucaaagacauuacagauuccuacgacgccaacugguuucugcaacuucugagcaccgaggaucucuucgaaaugacgucuaaggaguucccuauugugacagaagugaucgaggcucccgaggggaaucaucugccgcaguccauccuucagccuggaaaaaccauugucauccacaagaaauaccaggccagccggauucuggcuucugaaauccgcuccaacuuucccaagagacacuuccucauuccuacaagcuauaagggcaaauuuaagcggcgccccagagaguuccccaccgccuacgaccuggaaaucgcgaaauccgagaaggagccucugcacguuguggccaccaaggcuuuucauucuccgcacgacaaacucagcuccgugagcgucggggaucaauuccuggugcaccagucugaaacaacggagguucuuugugaaggaauuaagaaaguggucaaugugcuggccugcgagaagauccucaaaaaguccuaugaagcugcccugcuuccccuguacauggagggcggcuuuguugaggugauccaugacaaaaagcaguauccuauuagcgaacucuguaagcaauuccggcugcccuuuaacgucaaagugucuguccgcgaucugagcaucgaggaagacgugcucgcggccaccccugggcugcagcuugaggaagauauuacagacuccuaccugcucaucucugauuucgcuaaucccaccgagugcugggagauuccgguuggaagacugaacaugacagugcagcuggucagcaacuuuucccgggacgccgaaccuuuccuugugagaacccucguugaggaaaucacggaggaacaguauuacaugaugcgccgguacgagagcucugcuucccaucccccucccagaccucccaagcacccgagcguggaggaaacaaaacugacccugcucacccuggccgaggaacgcacagucgaucuuccuaagucucccaaacggcaccauguggacaucaccaagaagcugcaccccaaucaagccggccucgauuccaaagugcugauugggagccagaacgaccugguugacgaggagaaggaaagauccaaucgcggagcuacagcgaucgccgagacguuuaaaaacgaaaagcaccagaaauga

SEQ ID NO: 76823 - RNA, 897 nt, Artificial Sequence
  derived and/or modified sequence opt5 from THG1L__Homo_sapiens__NP_060342
auguggggcgccugcaaggugaaaguccacgacagccuggcuaccaucuccauuacacucagacgguaccugcgccuuggggccacgauggcgaagucuaaauucgaguauguuagagauuuugaagcugacgauaccugucuggcccauugcuggguggugguccggcucgacggacgcaacuuccacagauuugccgagaagcauaauuucgcuaaacccaacgauagccgggcccugcagcuuaugacaaagugugcucaaaccgugauggaggaacuggaagacaucguuauugccuacggccaguccgaugaguauucuuuuguguucaagcgcaaaacaaauugguuuaagagacgggcgagcaaauucaugacccacgucgccucccaguuugcuucuagcuacguguucuauuggcgcgacuacuuugaggaucagccucuccuguauccgcccggguucgacggaagaguuguggucuacccuuccaaccaaacacugaaggauuaccucagcuggcggcaggccgacugccauaucaauaaccuguauaauaccguguuuugggcucuuauucagcagucuggccugacgcccgugcaagcccaggggcgccuccagggaacccuggcggccgauaaaaacgaaauccuuuucuccgaguucaauaucaacuacaauaacgaacugccuauguauagaaagggcacaguccucauuuggcagaagguugacgaggugaugaccaaagagaucaagcugcccacagaaauggagggcaaaaagauggcugugacccggacgcgcacaaaaccugucccgcugcacugugacauuaucggggaugccuuuuggaaggaacaccccgagauucucgacgaagauagcuga

SEQ ID NO: 76824 - RNA, 1494 nt, Artificial Sequence
  derived and/or modified sequence opt5 from TH__Homo_sapiens__NP_000351
augcccaccccugacgccacaacgccgcaggcuaagggcuucagacgggccgugagcgagcuggaugcgaaacaagcugaagccaucaugucuccccgcuuuauugggagacggcagucccucaucgaggacgcccgcaaggaaagagaggcugccgucgcugccgcggccgcugccguuccuagcgaacccggagauccucuggaggcuguggccuucgaggaaaaagagggcaaggcggugcuuaaccugcucuuuucuccccgggccaccaaaccuuccgcucugagccgcgccgucaagguguucgaaacauuugaggcuaagauucaccaucuugagaccagaccggcccagcggccccgcgccgggggaccucaccuggaauacuucguuagacucgaggugcggcgcggcgaccuggcugcgcugcucuccggggucagacaggugucugaagauguucggagccccgccggaccuaaagugcccugguuuccgcgcaaggucuccgagcuggacaaaugccaucaccuugugacaaaguucgauccugaccuggaucucgaccaucccggcuuuagcgaucaaguguauagacagcggagaaaacugaucgcugaaauugccuuccaguaccgccacggcgacccuaucccccgggucgaguauaccgccgaggaaaucgcuacauggaaggagguuuacaccacgcuuaaggggcuguaugccacccacgcguguggagaacaucucgaggcuuuugcccugcuggaaagauucucuggcuaccgcgaggauaauauuccccagcucgaggacgugucccgguuucugaaagaaagaacaggguuccaacuucgcccuguggccggacugcucagcgcucgggacuuccuggccucucuugcuuuuagagucuuccagugcacccaguauauccgccacgccuccagcccgaugcauucucccgagccugauuguugccacgaacugcucggccacgugcccaugcuggcggaccggacauuugcccaguucucccaagauauugggcuggcuagccucggagccuccgacgaggaaaucgagaagcugucuacccuuuacugguuuacgguugaguucggccuguguaaacagaacggcgaagugaaggcuuacggggccggacuccugagcuccuauggcgagcuucugcauugccucagcgaggaaccugagauuagagcguuugaucccgaagccgcugccguccagccguaccaagaccagacauaucagucuguguacuucguuuccgagagcuuuucugaugcuaaagacaagcugcgcagcuaugccucccggauccagagaccuuucucugugaaauuugaucccuacacccuggccauugacguccucgauagcccucaagcugugcggcgcucccuggaagggguccaggacgagcuugacacacuggcgcacgcccucagcgcuaucggauga

SEQ ID NO: 76825 - RNA, 2232 nt, Artificial Sequence
  derived and/or modified sequence opt5 from THNSL1__Homo_sapiens__NP_079114
augcugcacuucaacagaugccaucaccucaagaaaaucacccagaaguguuuuagcuccauucaugugaaaacagacaagcacgcccaacgguuccugucucgcacguuugcucuugccgagcugagaaaaagcugguacuccacccauucucucgucggcgauaagaauaucauucugauggggcccccuggagcgggcaagacaaccguugggcggaucauuggacagaaacuuggcugcugugugaucgacguggaugacgauauccuggaaaagacauggaacaugagcgucuccgagaaacuccaggacguggggaaugaacaguuccuggaggaagagggaaaggcuguucugaacuuuucugccagcggcuccgugauuagccucaccggcucuaauccgaugcacgaugccuccauguggcaccugaaaaagaacgggaucauugucuaucuugacgugccccugcucgaucugaucugccgccuuaagcugaugaaaacagacagaauuguuggacaaaauagcggcaccucuaugaaggaucuccugaaauuccggcgccaguacuauaagaaaugguacgacgcuagaguguuuugugaguccggggccagcccugaagaggucgcugauaaggugcugaacgccaucaaacgguaucaggacguggacucugaaacguucauuuccacccgccaugucuggcccgaggauugcgagcagaagguuagcgcgaaguuuuucuccgaagccgugaucgagggacucgcuucugacggcgggcuguuugugccugccaaagaguuccccaaacuuagcuguggagaauggaaaucccuggucggcgcuacauacguggaaagagcccaaauccuccuggagcggugcauucacccugcggauaucccggccgcucgccuuggcgagaugauugaaaccgccuauggggagaauuuugcuuguagcaagaucgcccccguuagacaucugucuggaaaccaguucauucucgaacuguuccacggcccuacaggguccuuuaaagaccugagccuccagcugaugccccacaucuucgcccauugcaucccucccucuuguaauuacaugauucuuguggcuaccagcggagauacgggcuccgcgguccugaacggguuuucucggcucaauaagaacgacaagcagcgcaucgccgugguugcuuucuuuccggagaauggagugagcgauuuccaaaaagcccagauuaucggcucccagagagaaaacggcugggccgucgggguggagagcgacuuugauuucugccaaacagcuauuaagcggaucuuuaacgacucugauuucaccggauuucugacagucgaguacggcaccauccuuuccagcgccaauucuauuaacugggggagacugcucccucaggugguuuaucacgcguccgcuuaccuggaccuggugagccagggauucaucuccuuuggcucucccgucgacgugugcauuccuaccgggaauuucggcaacauccucgccgccguuuaugcuaaaaugaugggcauucccauccgcaaguucauuugugccagcaaucagaaccaugugcugacagauuuuaucaaaacgggacacuacgaccuucgggaaagaaagcuggcucaaaccuucucccccucuaucgauauucucaagagcuccaaucuggagcgccaucugcaccuuauggccaacaaagacgggcagcucaugacagaacuguuuaaucggcuggagagccagcaccauuuccagaucgaaaaggcgcucgucgagaaacugcaacaggauuuuguggccgacuggugcucugagggagaaugucuugcugccauuaacuccaccuauaauacaagcggcuacauccuggauccucacaccgcuguggccaagguugucgcggacagagugcaggauaaaacgugcccggugauuaucucuuccacagcccauuauagcaaguucgcucccgccaucaugcaggcucucaagauuaaagagaucaacgaaaccucuagcucccaacuguaccugcuugggagcuacaaugcccucccuccccugcacgaggcccugcucgagcgcaccaagcagcaggaaaagauggaguaucaggucugugcugcggacaugaacgugcugaagucucacguugaacaacuugugcagaaucaguuuauuuga

SEQ ID NO: 76826 - RNA, 1218 nt, Artificial Sequence
  derived and/or modified sequence opt5 from THNSL2__Homo_sapiens__NP_001231605
augugguacgugagcaccagaggcgucgcccccagaguuaacuucgagggggcucuguuuuccggauaugccccugacggcggacucuucaugccggaggaacugccccagcuugaucgcgggacacugugccaauggucuacgcucagcuacccuggccuggugaaggaacuuugugcgcuguuuaucggguccgagcuccugcccaaagacgaacugaaugaucucauugacagagcuuucucucgguuucgccacagagaggugguccaucugagccggcuucgcaacggacugaaugugcucgagcuguggcacggcguuaccuaugccuucaaggaucuuucccugucuugcacaacccaguuucuccaguacuuccuggaaaaacgggagaagcaugugacagucgugguuggcaccagcggggacacaggauccgccgcuaucgaaagcgugcagggcgccaaaaacauggauauuaucguccugcucccuaaggggcacuguaccaagauucaagagcugcagaugacgaccgugcuuaaacagaaugugcaugucuuuggaguugagggcaacucugacgaacuggaugagcccaucaagacaguguucgcugacguggccuuugucaaaaagcacaaucucaugucccugaacagcaucaauuggucucgggugcuuguucagauggcgcaccauuucuuugccuauuuccaaugcaccccuucccuggauacacacccgcucccccugguggaagucgugguuccuaccggggcugccggaaaccuggcugccggcuacauugcgcagaaaaucggccuccccauucgccugguggucgccgugaauagaaacgacaucauucaucggacgguccagcagggggauuucagccuuucugaggcugugaaguccacacuggccagcgcuauggacauccaaguuccuuauaauauggaacgcguguuuuggcuccuguccggaucugacagccaggucaccagagcccuuauggagcaguucgagcggacacaauccgugaaccugcccaaggaacuccacagcaaaugggagcgccaggauuacgaaaagauggccguuauggagugugacggcugcuguguggaacugugccuggggaauuguggaccgagacggggcucugucaccgauauuccugggaccgcuauggugagaggaggcggcuga

SEQ ID NO: 76827 - RNA, 1974 nt, Artificial Sequence
  derived and/or modified sequence opt5 from THOC1__Homo_sapiens__NP_005122
augagccccaccccuccgcuguucucccuccccgaggccagaacacgguuuacgaagucuacccgcgaagcucugaacaauaaaaacaucaagccucuucugagcacauucucccaggugcccggcucugagaaugaaaagaagugcacccucgaccaagccuuuagagggauucuggaggaagagaucauuaaccacagcuccugugagaauguccuugcgaucauuucucuggcuaucggaggcguuacagaagggaucugcaccgccagcacaccuuucgugcuccugggagaugugcuggacugucucccccuggaucagugcgacaccauuuuuacguucgucgagaaaaacguggccaccuggaaguccaauacauuuuacagcgcuggcaagaacuaucuucugcggauguguaaugaucuccugcgcagacuuucuaaaucccagaacaccguuuucugcgggcggauccagcuguuucucgcccgccuguucccucugagcgaaaagucuggacucaaucugcaaucccaguuuaaccuugagaaugugacagucuucaacaccaaugagcaggaaagcacgcugggccagaaacauacagaggacagagaagagggcauggauguggaagagggggagaugggagacgaagaggcuccgaccacauguucuauucccaucgauuacaaccucuaucggaaguuuuggucccugcaagacuacuuccgcaacccuguucagugcuaugagaaaauuagcuggaagaccuuccuuaaguacuccgaggaagugcuggccgucuuuaaaucuuauaagcucgaugacacccaggcgagccggaaaaagauggaggagcugaaaacaggcggggaacacguguacuucgccaaguuucugacguccgagaaacucauggaucugcagcuuagcgacucuaauuucagacgccauauccugcuccaauaccugauucuuuuucaguaucugaagggacaggugaaguucaaauccagcaacuacguccucaccgacgaacaaucucuguggaucgaggauacaaccaagagcguuuaucagcugcucuccgaaaaucccccugacggcgagagauuuucuaaaaugguggagcacauccugaacacagaagagaauuggaacagcuggaagaaugaagggugucccuccuucgugaaagagcggaccagcgauacgaagccgacacgcauuaucagaaagcggaccgcuccugaggacuuucuuggaaaaggccccaccaagaaaauucugaugggcaacgaagaacucacaagacuguggaaucugugcccugauaacauggaagccuguaagucugagacccgcgaacauaugcccacacuugaggaguucuuugaagaggcuaucgaacaggccgaccccgagaauauggucgaaaacgaguacaaagcggugaauaacuccaauuauggguggcgggcccucagacugcuggcucgccggagcccucacuucuuucagccgacgaaccaacaguucaagucucuccccgaguaccuggaaaacaugguuauuaaacuugccaaagagcugccucccccuuccgaagagaucaagaccggagaagaugaggacgaggaagauaaugacgcucuccugaaagagaacgaaagccccgaugugagacgcgacaagccggucacaggcgagcagaucgagguguucgccaauaaacugggggaacaguggaagauucuugccccuuaucucgagaugaaggacuccgaaauccggcaaauugagugcgauucugaagacaugaaaaugagagcuaagcagcugcugguugcguggcaggaucaggagggagugcacgccacccccgagaaccucaucaaugcucugaacaaaagcggccuuuccgaccuggccgaaucucucacaaaugauaacgagaccaauagcuga

SEQ ID NO: 76828 - RNA, 4782 nt, Artificial Sequence
  derived and/or modified sequence opt5 from THOC2__Homo_sapiens__NP_001075019
auggccgcugccgcgguggucguucccgcugaauggaucaagaacugggaaaaauccggcagaggggaguuccugcaccucugccggauucuguccgaaaauaagucucaugacagcuccaccuaccgcgauuuucagcaagcccuuuaugagcugucuuaccacgugaucaaaggaaaccucaagcaugaacaggccagcaaugugcuguccgacauuucugaguucagagaggauaugccuagcauccuugcugacgucuuuuguauucuggauaucgaaacaaacugccucgaggaaaaauccaagcgggacuauuucacgcagcuggugcuggccugucucuaccugguuagcgauaccgugcuuaaggagcgccuggacccggagacacucgaaucucugggccuuaucaaacagucccaacaguuuaaucaaaagagcgucaaaauuaagaccaaacuguucuauaagcagcaaaaguuuaaccuccugagagaggaaaaugagggguacgcuaaacugaucgccgaacucggacaggaucugucuggcuccauuacaagcgaccuuauccuggagaacauuaagucucucaucgggugcuucaaucuggaucccaaccgggugcuugacguuauucuggagguguuugaaugucgcccugagcacgaugacuucuuuaucucccuccuggaaagcuauauguccaugugcgagccccagacccugugucauauccucggauucaaauuuaaguucuaccaggaaccuaauggcgagacacccucuagccuguacagagucgcggccgugcuucugcaauucaaccucauugaccuggaugaccuuuaugugcaucugcucccugcugauaauugcaucauggacgagcacaaacgggaaauugccgaggcuaagcagaucguccgcaaacugaccaugguugugcuguccagcgaaaagauggaugagagagaaaaggagaaagagaaggaagaggaaaaaguggagaagccgcccgacaaccagaaacucggccugcuugaggcccugcucaagauuggggauuggcaacacgcgcagaauaucauggaccagaugccucccuacuaugccgcuucucacaagcugaucgcccuggcuauuuguaaacuuauccauauuacgaucgaaccucucuaccggcgcgucggagugcccaagggcgccaaaggguccccgguuaacgcccugcagaacaagagagcuccuaaacaagcggagagcuuugaagaucugcggcgcgacguguucaauauguuuugcuaucucggaccccaccugucucacgauccuauucuuuucgccaaggucgugagaaucggcaagagcuuuaugaaagaguuccaguccgacgggucuaagcaggaagacaaagagaagaccgagguuauccugagcugucuccuguccauuacagaucaggugcugcuucccagccucucucugauggacugcaacgcuugcauguccgaggaacuguggggaauguuuaaaaccuuccccuaccaacaucgguauagacucuacggccaguggaagaaugaaacauacaacagccacccucugcuugucaaggugaaagcccagaccaucgaucgcgccaaguauauuaugaaacggcugacgaaggagaaugucaaaccgucuggcagacagaucgggaagcucucccauagcaaccccacaauucuguuugacuacauccugucccaaauucagaaauaugauaaucuuaucaccccugugguugacucucucaaguaccugacaagccugaacuaugaugugcucgcuuacuguaucauugaagcccuggcgaaucccgagaaggagcgcaugaaacacgacgauaccaccaucuccucuuggcuucagagccuggcuuccuucugcggagccgucuuucggaaguauccuauugaccucgccggccugcugcaguacguggcuaaccaacuuaaagccggaaagagcuucgaucuccugauccugaaagaaguugugcagaagauggcugggauugagaucacagaagagaugacgauggaacagcucgaggccaugaccggcggggagcaacugaaggcggaaggaggcuacuuuggccagaucagaaauacaaagaagucuucccagcgccuuaaagacgcccugcucgaucaugaccuggcucugccccuuugucugcucauggcccagcaacggaacggggucauuuuccaggagggaggcgaaaagcaccugaaacucguggggaagcuguaugaccagugccacgauacccuugugcaguucggaggcuuucuggcuagcaaucucucuacagaggacuacaucaagagaguuccguccauugauguccuguguaacgaguuccauaccccucacgacgccgcguuuuuccugagccgccccauguaugcccaucacaucucuagcaaauacgaugaacuuaagaaauccgagaaggggagcaaacaacagcacaaggugcauaaguauauuacgucuugcgaaauggugauggcuccuguccacgaggccgugguuucccugcaugugagcaaagucugggacgauaucagcccccaguuuuacgcuacauucuggucucucaccauguaugaccuggccgugccucacaccagcuacgaacgggagguuaauaagcucaaagugcagaugaaggccaucgaugacaaccaagagaugcccccgaacaaaaagaaaaaggaaaaggagagauguacagcucugcaggauaaacuucuggaagaggaaaagaaacagauggagcauguccaacgcgugcuccagcggcugaagcuggagaaagacaauuggcuucuggcgaaguccaccaagaacgaaacaauuacgaaauuucuccagcugugcaucuucccuagauguauuuuuagcgccaucgaugcuguuuacugcgcccgguucguggagcucguccaccagcaaaagacccccaauuuuagcacacugcuuuguuaugaccgcguguucuccgacauuaucuacaccguggccucuugcacagaaaacgaggcuagcagauauggccgguuucugugcuguaugcuggaaaccgucacgagauggcacuccgaucgcgccaccuacgagaaagagugcggaaauuaucccggcuuccucacaauccugcgggcgaccggguucgacggaggcaacaaggcugaucagcuugacuacgaaaauuuuagacauguugugcacaaauggcauuauaagcugacaaaggccagcgugcacugucucgagaccggggaauacacgcauauucgcaacauccugauuguccucacaaaaauccugccuugguacccgaaggugcuuaaucugggacaggcccuggagagacggguucacaaaauuugccaggaggaaaaggagaaacgccccgaucucuaugcucuggccaugggcuacucugggcaacuuaaguccagaaagagcuauaugaucccugaaaacgaguuccaccauaaagaucccccuccccggaaugcgguggcuucuguccagaacggcccuggaggcgggcccuccucuucuuccauuggaagcgccuccaagagcgacgaaucuagcaccgaggagacagacaaaucccgcgaaagaucucaguguggcgugaaggccguuaauaaagcuagcuccaccaccccgaaggggaacucuagcaauggaaacuccggcucuaacagcaauaaggccgugaaagagaacgauaaggaaaaagggaaggagaaagaaaaggagaaaaaggagaagacgccugcuacaacccccgaagcccggguccugggcaaagacggaaaggagaaaccuaaggaggaacgccccaauaaagaugaaaaggcgagagagacaaaggagcggaccccgaaauccgacaaggaaaaagagaaguuuaaaaaggaagagaaggccaaagacgagaaguucaaaacaaccgugccuaacgcugaaagcaagucuacgcaggagcgcgaaagagagaaagaacccucccgggagagagauaucgccaaggagaugaaaagcaaagaaaauguuaagggcggggagaaaacaccugugucuggaucccucaagagccccgucccccgcuccgacaucccugaaccggagcgggaacagaaaagacgcaagauugauacccaccccucuccuagccauuccagcaccgugaaagacucucugaucgagcucaaggaguccagcgcuaagcuguacauuaaccacacacccccuccccuuucuaaaagcaaggaacgggagauggauaaaaaggaccuggauaaauccagagaacgcucucgggagagagaaaagaaggacgagaaagaucgcaaggagcggaaaagagaccacagcaauaacgaucgggaagugccuccggaccugaccaagcgcagaaaagaggaaaauggcacaaugggggucuccaagcauaagucugagagccccugcgaguccccuuaucccaacgaaaaagauaaggagaaaaauaagagcaaaucuuccggaaaggaaaagggcagcgacuccuuuaaaucugagaagauggacaaaaucagcuccgggggcaagaaagaaucucggcacgauaaggagaaaauugagaagaaggaaaaacgcgacagcuccggaggcaaggaggagaaaaagcaucacaaaagcucugauaagcauagauga

SEQ ID NO: 76829 - RNA, 2052 nt, Artificial Sequence
  derived and/or modified sequence opt5 from THOC5__Homo_sapiens__NP_001002878
augagcuccgaaucuagcaagaaaagaaagcccaaagugauccgguccgacggcgccccugcugaagggaagcgcaacagaucugauaccgagcaggaaggaaaauacuauagcgaggaagccgaggucgaccugcgggauccgggccgcgacuacgagcucuauaaguacacaugccaagaacugcagagacuuauggcggagauucaggaucugaagucccgcgggggaaaagacguugcuaucgaaauugaggagcggagaauccagucuugugugcacuucaugacgcucaagaaacugaaucggcuugcccauauucgccugaagaaaggcagagaucaaacccacgaagccaagcagaagguggacgcuuaucaucuccagcugcagaaccugcucuacgaggucaugcaucugcaaaaagaaaucacaaagugccuugaguuuaaaagcaagcacgaagagaucgaucuggugucccucgaggaguucuauaaagaagcucccccugacauuagcaaggccgaaguuaccaugggggauccccaccagcagacacuggcccggcuugacugggagcuggaacagcgcaaaagacucgcggagaaguaccgggagugucugucuaauaaggagaaaauccugaaggaaauugaagugaaaaaggaguaccucuccagccugcaaccucgccuuaacucuaucaugcaggccucccugcccguccaggaauaucucuuuaugccuuucgaucaagcucacaaacaguacgagaccgccagacaucugccgcccccucuuuaugugcuguuuguucaggcuacagccuacggacaggcgugcgacaagacccucagcguggccauugagggcucugucgacgaagcuaaggcccuguucaaacccccugaggauucccaagacgaugaaagcgacuccgaugcugaggaggaacagacgaccaagcggagacgccccacacugggcgugcagcucgacgauaaacggaaggagaugcugaaaagacacccgcuuucugugaugcuggaccucaaguguaaggaugacagcguccugcaucuuaccuuuuauuaccugaugaaucucaacaucaugacaguuaaagccaaggugaccacggccauggaacugauuacaccuaucuccgcuggggaucugcucagccccgacucugugcuguccugccuuuauccuggagaccacggcaaaaagacccccaaucccgcgaaccaguaccaauucgauaaagucgggauccugacacucagcgacuacgugcuggagcugggacacccuuaucuuuggguucagaagcucggcgggcugcauuuuccgaaggaacagccccagcaaaccgugauugccgaucacucucugagcgcuucccauauggagaccacaaugaaacuccugaagacgcgcguccagucucggcuugcccugcacaaacaguucgccagccucgagcauggaaucgugccuguuaccuccgacugucaguaccuguuucccgcuaagguggucagcagacuggugaaaugggucacaguggcccacgaagauuauauggagcuucacuucaccaaggacauuguugaugcgggccucgcuggcgacacaaaucuguacuauauggcccugaucgaacgcgggaccgccaaacuccaagcugccgugguccugaacccuggauacucuuccauucccccgguguuucagcuuugccugaauuggaagggcgagaagacgaacagcaaugaugacaacauccgggcuauggaaggggagguuaauguguguuauaaagagcucugcggaccuuggcccucucaucagcugcugacaaaccaacuucagagacucuguguccugcuggauguguaccucgaaaccgagucccacgacgauagcguggaaggcccuaaggaguucccccaggagaaaaugugccugcgccuuuuccgggggccuuccagaaugaagcccuuuaaauacaaccauccgcagggauucuuuucucaccgcuga

SEQ ID NO: 76830 - RNA, 891 nt, Artificial Sequence
  derived and/or modified sequence opt5 from THOC6__Homo_sapiens__NP_001135822
auggagagagccgugccccuggcugucccucucggccagaccgaaguuuuccaagcccugcagcggcuucacaugacaaucuuuagccaguccgugucuccgugcgggaaguuccuggcggcuggaaacaauuacggccagauugccaucuuuagccucuccucugcccugagcuccgaggcuaaagaagagucuaagaaacccguggucacguuccaagcccaugacgggccuguguauagcaugguuuccaccgaucgccaccuucugagcgcuggagacggcgaagugaaggccuggcucugggcggagaugcugaaaaagggguguaaggagcuguggagacggcagcccccuuaccgcacaucucucgaaguccccgagauuaacgcccugcuucuggugccuaaagaaaauucccucauccuggcuggaggcgauugccagcuucauaccauggaccuggagacaggcaccuuuacaagaguucuccgggggcacaccgauuauauucauugucuggcccugcgcgagagaagcccggaagugcucucuggaggcgaggacggggcuguccggcugugggaucuucgcacggccaaggaagugcagaccaucgagguguacaaacacgaagagugcuccagaccccacaacggacgguggaucggcugucuggcgacagacagcgauuggauggucugcgggggaggcccugcccucacccuguggcaucuuagaucuuccacacccaccacgauuuucccuauccgcgcuccccaaaagcacguuacauuuuaucaggaccuggugcucaccgccgcuggcaauagcugucggguggaugucuucacaaaccugggguaccgcgccuuuucccugucuuucuga

SEQ ID NO: 76831 - RNA, 1134 nt, Artificial Sequence
  derived and/or modified sequence opt5 from T__Homo_sapiens__NP_001257413
augagcucccccggcaccgagucugccgggaagucucugcaguacagaguggaccaccuccuguccgcugucgaaaacgagcuucaagccggaucugaaaaaggcgauccuacagagcgggaacugcgcguugggcucgaggagagcgaacuguggcuuagauucaaggagcugacgaaugaaaugaucgugaccaaaaacggacggcgcauguuuccggugcucaaggucaauguguccggccuggaccccaacgcgauguauucuuuccugcucgauuuuguugcugccgacaaucauagauggaaauacgugaacggggagugggucccuggaggcaagcccgagccucaggcccccagcugcguguauauucacccugauuccccgaauuucggcgcucauuggaugaaggcccccguuagcuuuucuaaagugaagcugacaaacaaacuuaaugggggaggccagaucaugcugaacucccuccacaaguacgaaccucggauucauaucguccgcgucgggggaccccagagaaugauuaccagccacuguuucccugagacacaauuuaucgcugugaccgccuaucagaaugaagagaucacagcgcugaaaauuaaguacaaccccuucgccaaggcuuuucuugacgccaaagaacggucugaucacaaggagaugauggaggaaccgggcgacucccagcagccuggguauagccaaucuuacuccgauaauagccccgcuugccuguccaugcuccagucucaugacaacuggagcucccugggaaugccugcccaccccagcaugcugcccgugucucauaaugcguccccuccgaccagcucuagccaguaccccucccucuggucuguuagcaacggcgccgugacgccuggcucccaggcugccgcugugagcaacgggcugggagcccaauucuuucgcggcucucccgcccacuauaccccucuuacacaccccgucuccgcuccgagcagcuccgggagcccucuguacgagggagcggccgcugccaccgauaucguggacucccaguaugaugccgcugcccagggcagacucauugcgucuuggacacccguuagcccucccuccauguga

SEQ ID NO: 76832 - RNA, 2070 nt, Artificial Sequence
  derived and/or modified sequence opt5 from THOP1__Homo_sapiens__NP_003240
augaagcccccugccgcuugcgccggcgacauggcggaugcugccagcccguguuccguggucaacgaccugagaugggaucucucugcccagcaaaucgaggaacggacccgcgagcugauugaacagacaaaaagaguuuacgaccagguggggacgcaggaguucgaagaugugagcuaugaguccacccuuaaggcucuggccgacgucgaggugacauacaccguucaacggaauauccucgauuuuccccagcacgugucuccuagcaaagacauucgcacagcuuccaccgaagccgauaagaaacugucugaguucgacgucgaaaugagcaugagagaggauguguaucagcggaucguuuggcuucaggagaaggugcaaaaggacucccugcgccccgaagcggccagauaccucgagcggcugauuaaacugggacgcagaaacggccuccaucugccucgggaaacacaggagaauaucaagcgcaucaaaaagaaacuuagccugcucugcauugauuuuaacaagaaucugaacgaagacaccacguuccuucccuuuacccugcaggagcucgggggacugccugaggacuuccuuaauucucucgaaaagauggaggauggcaaacugaaggucacacuuaaauauccgcacuacuuuccccugcucaagaaaugucaugugccugaaaccagacggaagguggaggaggcuuucaacugccgcuguaaagaagagaauugcgccauccugaaggaacuugucacacugagagcucagaagucccggcuccugggguuucacacccaugccgacuauguucuggagaugaacauggcgaaaacgagccaaacaguggccaccuuccucgaugaacuggcucagaagcugaaaccccugggagagcaggaaagagccgugauucucgagcugaagcgcgcugagugugaacggagaggccuuccuuuugacggccgcauccgggccugggauaugagauacuacaugaaucaagucgaggaaacacgcuauugcguggaccagaaccugcucaaagaguacuuccccguucagguggucacccacgggcugcugggaauuuaucaggagcuccugggccuugccuuucaccaugaagagggggcuucugcguggcacgaagaugugcggcuguacaccgccagagacgcugccuccggagagguugugggcaaguucuaucucgaucuguacccgcgcgaagggaaguauggacaugccgcuuguuucggccugcaaccuggcugccuucggcaggacgggagcagacagaucgccauugcggcuauggucgccaauuuuacaaaacccacggccgaugcuccuucucuccugcagcacgacgagguggagaccuacuuccacgaauuuggacaugucaugcaccaacuguguucccaggccgaguucgcuauguuuagcggcacacauguggaacgcgacuucguugaggcccccucccagaugcucgaaaacugggugugggagcaggagccccugcuucggaugucuagacacuaccggaccgggagcgcggucccucgcgaacugcucgagaagcugaucgaauccagacaagccaauacaggacuguuuaaccuucggcagaucgugcucgcuaaaguugaucaggcccugcauacccagacggacgcugauccggccgaggaauaugcgagacugugccaagagauucucggcgugcccgccacaccugggaccaacaugcccgcuaccuucggacaccuggccggcggcuacgacgcucaguauuacggguaucuuuggagcgaggucuacucuauggauauguuucacacacgcuucaagcaggaaggagugcucaauuccaaagugggcauggacuaucggagcugcauccugagaccugggggaucugaggaugccagcgccaugcugcgcagauuucugggccgggaccccaagcaagaugcuuuccuucucuccaaggggcugcagguuggcggaugugaaccggagccucaggucugcuga

SEQ ID NO: 76833 - RNA, 1482 nt, Artificial Sequence
  derived and/or modified sequence opt5 from THPO__Homo_sapiens__NP_001276932
auggaucccccuauccagauuuucagcguggucugcguuggcgggggaguggacccgggccccgggagaggaucccgggaggaaaaggccucucugccuggcgcuuuuaccagcgugugguggcuccccucccugaucgggcaaaaauggccucgccaggccuacgaccuucugcucuggagaggaugugcgcccccuccgcacgucuuccugcccauuugcucuccugagggcugucuucugugcacaugggugcucgaacccuuuagcacgcggaucgauuccucuccucuggcucgccugugucccacccuccugugcccggagguucaggaaccuaagcccccucccuggccccaggagggcuucagaggggaggccccuaaccgggaaccgcgccaacccgacacacccgccagaauggagcuuaccgaacugcuccugguggucaugcuucugcucacagcucggcugacccugagcucccccgccccucccgcuugugaucuccgcgugcugagcaaacuucugagagacucucauguucuccacucccggcugagccagugcccggaggugcauccucuucccacaccuguccugcuccccgccguggauuuuucucugggagaguggaagacccagauggaagagacgaaagcgcaggacauucugggcgccgugacccuccugcuugaaggggucauggcugcccgcggacaacugggcccuacaugucucuccagccugcuugggcagcugucuggacagguuagacuccugcugggcgcucuccagucccugcuuggcacccaacugcccccgcaggggcggacaaccgcccacaaggauccuaaugcgaucuuccucagcuuucagcaucugcugcgcggaaaggugagauuccuuaugcucgugggcggguccacgcugugcguccggagagccccucccacaaccgcugugccuucucgcacaagccugguucucacccugaacgagcuuccgaaucggaccuccggacugcucgaaacaaacuuuacggccagcgcuagaaccacaggcucugggcugcugaaauggcaacagggauuccgcgccaagauccccggccuucucaaucagaccucccggagccuggaccagauuccuggcuaucugaacagaauccacgagcuccugaaugggacacgcggacuuuuucccggcccuucucggagaacccugggggcccccgauauuagcuccggaacgucugacacaggcagccucccucccaaccugcaaccgggguacuccccuagccccacccacccucccaccggccaguauacacuguucccgcuuccucccacccucccuacacccgugguccagcugcauccccugcucccugauccgucugcucccacgccuacccccacauccccucugcuuaauaccagcuacacacacucucagaaccugucccaagagggauga

SEQ ID NO: 76834 - RNA, 1356 nt, Artificial Sequence
  derived and/or modified sequence opt5 from THRA__Homo_sapiens__NP_001177847
auggagcagaagcccagcaaaguggaaugcggcuccgacccugaggaaaacucugccagaagcccggaugggaagcggaaacgcaagaauggacaauguucccugaaaaccucuaugagcggcuacauccccuccuaucucgacaaggaugagcagugcgucguuuguggggacaaggcuacaggauaccacuauagaugcauuacgugugaaggcugcaaaggguucuuucggcgcaccauccagaagaaccugcauccuacauacucuuguaaauaugauagcugcugugugauugacaagaucaccagaaaucagugccaacuuugucgguucaaaaagugcauugccgugggaauggcgauggaucugguccucgacgauuccaagcgcguggcuaaaagaaagcugaucgagcagaaccgggagcgcagacggaaagaagagaugauccgcagccuucagcagagacccgaaccuacacccgaggagugggaccugauucacaucgccaccgaagcccaucggucuacaaaugcucaaggcucccacuggaagcagcgcagaaaauuucucccugaugacauuggccagagcccgaucguuucuaugcccgauggggacaagguggaccuggaggccuucuccgaauuuaccaaaauuaucacgccugcuauuacccgggucguggauuucgccaagaagcugcccauguuuagcgagcucccuugcgaagaccagaucauccugcuuaaaggauguugcauggagauuaugucucugagagcggccguucgcuacgaucccgaguccgacacacucacccugagcggcgaaauggcugugaagcgggagcaacuuaaaaacgggggacugggcgucguguccgaugccaucuucgaacucgggaagucucugagcgcuuuuaaucuggacgauacagagguggcccuccugcaggcgguccuucugauguccaccgacagaagcggacuccuguguguugauaaaauugaaaagucucaggaggccuaucuucuggcuuucgagcauuacgugaaccaccgcaagcacaauaucccgcauuuuuggccuaaacuccugaugaagggcccccaagugcggcagcuggaacagcagcucggcgaggccgggucccugcaaggaccuguccuucagcaccagagccccaaaucuccccagcaaagacugcucgaacugcuucaucgcagcggcauucugcacgcucgggccgugugcggggaggacgauuccucugaagccgacagcccuuccagcucugaggaggaaccggagguuugugaagaccucgcuggaaacgcggccucccccuga

SEQ ID NO: 76835 - RNA, 1386 nt, Artificial Sequence
  derived and/or modified sequence opt5 from THRB__Homo_sapiens__NP_001239563
augacccccaacagcaugacagagaauggccugacggccugggacaagccuaaacacugcccggauagagaacaugacuggaagcucguggggauguccgaggcuugucugcaccggaaaucucauagcgaacgcagauccacccuuaagaacgagcagucuagcccccaccugauccaaacaaccuggacauccucuauuuuccaucucgaucacgacgaugucaaugaccagagcguuuccagcgcccagaccuuucagacagaagagaaaaagugcaagggauacaucccuucuuaucuggauaaagacgagcuuuguguggugugcggcgauaaggcgaccggguaccacuaucgguguauuacgugcgaaggauguaaaggcuucuuucgcagaaccauccaaaagaaccugcaucccuccuacagcugcaaauaugaggggaagugugucauugacaaggugacacggaaucagugccaggaaugucgcuucaaaaagugcaucuacguuggaauggcuaccgaucucgugcuggacgauucuaaaagacuggccaagcggaaacucaucgaggagaaccgcgaaaagagacggcgcgaggaacugcagaaauccauuggccacaagccugagcccacagacgaagagugggagcuuaucaagaccgucacggaagcccauguggcuacaaaugcccaaggcagccacuggaaacagaagagaaaauuucugccugaggacauugggcaggcuccgaucguuaacgcccccgaaggaggcaagguggaucucgaggcguucucucacuuuaccaaaauuaucaccccugccauuacacgggucguggacuucgcuaagaagcugcccauguuuugcgaacuuccuugugaggaucagaucauccugcucaaagggugcuguauggagauuaugucccugcgcgccgcugugagauaugaccccgaaagcgagacccugacacucaauggagaaauggccgucacgcggggccaacugaagaacgggggacuuggcguuguguccgaugcgaucuucgaccugggcaugucucucagcuccuuuaaucuggaugacaccgagguggcccuucugcaggcuguccuccugaugagcucugauagaccggggcuggccugcguggaacgcauugagaaauaccaggacuccuuccuccuggcuuuugagcauuacaucaacuaucggaagcaccauguuacacacuucuggccuaaacuucugaugaaggugaccgaucucagaaugauuggagccugucaugccagccgcuuccugcacaugaaggucgaaugccccacagagcuuuuuccuccccuguuccucgaaguguuugaggacuga

SEQ ID NO: 76836 - RNA, 441 nt, Artificial Sequence
  derived and/or modified sequence opt5 from THRSP__Homo_sapiens__NP_003242
augcaagugcugaccaagagauaccccaaaaacugccuccugacagucauggaccgguaugccgcugagguucacaauauggaacagguggugaugaucccuagccuucugcgcgauguccagcucuccggccccgggggacaggcccaggcggaggcuccggaccuguacacguauuucaccaugcuuaaggccauuuguguggauguugaccauggccugcucccuagagaagaguggcaagccaaaguggcugggucugaagagaacggaacagccgagaccgaagaggucgaagaugagagcgcuuccggcgagcuggaccuggaagcccaguuucaccuccauuucucuagccugcaccauauccuuaugcaccugacagagaaggcgcaggaagugacccggaaauaccaggagaugacagggcaaguuugguga

SEQ ID NO: 76837 - RNA, 2559 nt, Artificial Sequence
  derived and/or modified sequence opt5 from THSD1__Homo_sapiens__NP_061146
augaagcccaugcugaaagacuucagcaaccuccugcuugugguccugugcgauuacguucucggcgaggccgaauaucugcuucugagagagccugggcacguggcucucuccaaugacaccguguacgucgauuuucaguauuucgacggagccaacggcacacugcggaaugugucuguucugcuccuggaagcgaacacgaaucaaaccgugacaaccaaguaccuucugacaaaccagagccaggggacccucaaauuugaguguuucuauuuuaaggaagcuggagauuacugguucacaaugaccccggaggccacggacaauuccacccccuuuccuuggugggagaaaucugccuuccugaaggucgaauggcccguguuucauguugaucuuaaccgcagcgcuaaggccgcugagggcacauuccagguggggcuguuuaccucccaaccucucugccccuucccugucgacaaaccgaauaucgugguggaugucauuuuuacaaacucucugcccgaagccagacggaauagccgccagccucuggagaucagaaccuccaagcggacggagcucgcgcagggacaguggguugaguucggcugugcuccccugggcccugaagccuaugugacagugguccuuaaacugcucgggcgcgacagcgugauuaccucuacaggacccaucgaucuggcccaaaaguucggcuacaaacuuguuauggugccggaacugaccugcgaguccggggucgaagugaccguucucccucccccuuguacauuugugcagggagucgugacggucuucaaggaggcucccagauaccccggcaagcggaccauucaccuggccgagaacagccugccucucggggaacgcagaacaaucuuuaauugcacccuguucgacaugggcaaaaacaaguauuguuuugauuucggaaucucuucccggagccauuuuucugcgaaagaggaaugcaugcuuauucagcgcaauacagagaccuggggccuguggcagccguggucccaauguagcgccacgugcggggacggagugagagaacggcgcagaguuugucucacauccuuccccucuagcccugugugccccggcaugucccuggaggcuagccuuugcucucuggaggaaugugccgcuuuucagccuuccagccccucuccgcuccagccucaagggcccgucaagagcaacaacaucgugaccguuaccggaauuucccugugccuguucaucauuaucgccacagugcucauuacccuguggcggagauuuggccgcccugccaaauguucuacacccgcucggcacaauagcauccauuccccuagcuucagaaagaacucugacgaggaaaauaucugcgagcuuuccgaacagcgcgggagcuuuucugauggaggcgacggccccacgggguccccgggagauaccggcauuccucugacauaccggagaagcgggcccgugcccccugaggacgaugcguccggaucugagagcuuccaguccaacgcccagaaaaucauuccgccccucuucucuuaucgccuggcucaacagcagcugaaggaaaugaagaaaaagggccuuaccgagacaaccaaagucuaccacgugagccaguccccucucacggacaccgccaucgaugccgcucccagcgccccucuggaccuggaaucucccgaggaggcggcugccaauaaguuucggauuaaauccccuuuccccgaacaaccggccguuagcgcuggggagagaccucccucucgccucgaucugaacgucacacaggccuccugugcuaucagcccuucucagacccuuauccgcaagagccaggccagacacgugggcucccgcggaggccccagcgaacggucucaugcgagaaaugcccacuuucggcgcacagcuuccuuccaugaggccagacaagcucggccguuuagagaacgcagcauguccacccugacgccucggcaggcccccgcguauucuagcagaacacggaccugcgagcaggccgaggacagauuccggccucagucccgcggggcucaccucuuucccgaaaagcuggagcacuuccaagaagccucuggaacaagaggcccccugaacccucuuccgaaaagcuacacccucgggcagccccugcggaagccugaucugggagaccaucaggcuggccucguggccgggauugagcgcaccgaaccccacagagcccggcgcggcccuucccccucucauaaaagcgucuccagaaagcaaagcucuccuaucuccccgaaagacaauuaucagcgggugagcucucugucccccagccagugucgcaaggauaagugccagucuuuuccuacacaccccgaguucgcuuuuuacgacaacacguccuucggacuuaccgaggcggaacaaagaaugcuggaucucccuggcuacuuugggagcaaugaggaagacgagacaaccuccacacugagcguugaaaaacuggugauuuga

SEQ ID NO: 76838 - RNA, 1977 nt, Artificial Sequence
  derived and/or modified sequence opt5 from THSD4__Homo_sapiens__NP_001273358
auguucgugagcuaccugauccucacccugcuucacguccagacagccguucuggcuagacccggcggggaguccauuggaugcgacgauuaucucggcucugacaaggugguggauaaauguggggucugcggaggcgacaacacggggugucaagugguuagcggaguguuuaagcaugcccugaccucccuuggcuaccaccgggucguggaaaucccugagggcgcgacaaaaauuaauaucaccgaaauguauaagucuaacaauuaccuggcucuccgcagcagauccgggcggucuauuaucaacggaaauugggccaucgaucgcccgggcaaauaugaagggggaggcacaauguucaccuacaagagacccaacgagauuagcuccacagccggggagagcuuucuggcugagggaccuaccaaugaaauccuggacguuuauaugauucaucagcagcccaacccuggcgugcacuacgaguacgucaucaugggcacgaaugccauuucuccccaggugccuccgcaucggcgccccggggaaccuuucaacggacaaauggugaccgagggcagaucccaggaggaaggggagcagaagggacggaaugaagagaaagaagaucuccgcggcgaggcucccgagauguuuacaagcgaaucugcccagaccuucccugucagacaccccgaccgguuuuccccgcaccgcccugauaaccugguucccccugcgccccaacccccuagacggagccgcgaccauaauuggaagcagcuugggacaaccgagugcucuacgacauguggaaaaggcucccaguauccgaucuucagaugcgugcaccggagcacccaugaagaggcccccgaauccuacugugauucuagcaugaagccuacacccgaggaggaaccuugcaacauuuuucccuguccggcuuucugggacaucggcgagugguccgaaugcagcaaaaccugugggcugggaaugcagcacagacaagugcucugccgccaggucuaugccaaucggucucugaccgugcagccuuacagaugccaacaccuugagaagcccgaaacaacguccaccugucagcugaagaucugcagcgaguggcagauucgcacagauuggaccucuuguagcguuccuugcggcguggggcagcggacaagagacgucaaauguguguccaacaucggagacguuguggaugacgaggaaugcaacaugaagcuccgccccaaugauauugagaacugugacaugggcccuugcgcuaaaucuugguuucugaccgaauggagcgagcgguguuccgccgagugcggggcgggcgucagaacgcgcagcguggucuguaugacaaaucaugugucuucccugccccucgaaggaugcggcaacaaucggccggccgaggcuaccccuugcgauaacgggcccuguaccggaaagguugaaugguucgccggcagcuggucucaaugcuccaucgagugugggagcggaacacagcagagagaagugauuugcguccgcaaaaaugcugacaccuuugaggugcuggaucccuccgaguguucuuuccuugaaaagccuccgagccagcaauccugccaccugaaacccuguggcgccaagugguucucuacagaguggagcaugugcuccaagagcugucaagggggcuuucggguuagagaagugcggugccucucugacgauaugacgcuguccaaccuuugugacccucagcugaaacccgaggaacgcgagagcugcaauccucaggauugcguccccgagguggacgaaaacuguaaggacaaauauuacaauugcaacgugguuguccaggccagacucuguguguauaauuacuacaagaccgcuugcugugcgucuugcacacggguggccaacagacagaccggauuccugggcucccgcuga

SEQ ID NO: 76839 - RNA, 4974 nt, Artificial Sequence
  derived and/or modified sequence opt5 from THSD7A__Homo_sapiens__NP_056019
augggccugcaggccagacggugggcuagcgggucccgcggagccgcgggccccagacgcggggugcuccaacugcuuccucugccgcucccccugccucuucugcuccugcugcuccugcggcccggagcuggcagagccgccgcucagggggaggccgaagcuccuacccuuuaccuguggaagacaggacccuggggccggugcaugggcgacgagugugggccuggaggcauccagacgcgcgccgucuggugcgcgcacguugaaggguggaccacacuccauaccaacuguaaacaggccgagagaccgaauaaccaacagaauugcuucaaggugugugauuggcacaaagaacuguaugacuggcggcuuggacccuggaaccagugccagccugugauuucuaagagccuggagaaaccccucgaguguaucaagggcgaagaggggauucaaguccgcgaaaucgcuugcauucagaaggauaaagacaucccugccgaggauaucauuugugaguacuuugaacccaagccgcugcuggagcaggcuugccucaucccuugucagcaagacugcauuguguccgaguucucugccuggagcgaaugcuccaaaacauguggaucuggccugcagcauagaacccggcacguuguggcgcccccucaguuuggcgggagcggaugccccaaucuuacagaguuccaagucugucaguccagccccugcgaagccgaggaacugcgcuauucucuccaugugggcccuugguccaccuguagcaugccgcacucuagacagguucggcaggcucgcagacgggggaagaacaaagagagagaaaaggaucgcuccaagggagugaaagaccccgaggcccgggaacugaucaagaaaaagagaaaucgcaaccggcaaaauagacaggagaacaaauacugggauauucagaucggcuaucagacgcgcgaggucaugugcauuaauaagaccgggaaagcugccgaccuuagcuuuugucaacaggaaaagcugccuaugacauuccagucuugcgugaucaccaaggagugucagguguccgaauggagcgaguggucccccugcucuaaaacaugucacgauauggucagcccugccggaacccggguuagaacgcgcacaauccggcaauuucccauuggcuccgaaaaggagugcccggaguucgaagagaaagaaccuugccucagccagggcgacgggguggugcccugugcuaccuacggauggagaacaaccgaguggaccgagugccgcgucgauccucugcugucucagcaggacaagcggagaggcaaccaaacagcgcucugugggggaggcauccagacgcgggaaguguauugcguucaggccaaugagaaccugcuuucccaacugagcacccauaaaaauaaggaggcuucuaagcccauggaccucaaacuguguacagggccuauucccaacaccacacagcuuugccacaucccguguccuaccgaaugcgaagugagccccugguccgccuggggccccuguacguacgagaacugcaaugaucagcagggaaagaaaggcuuuaagcugcgcaaaagacggauuacaaacgagccuaccgggggaucuggcgucaccgggaauuguccgcaucuccuggaagccauccccugcgaggaaccugcuugcuacgacuggaaggccgugagacugggaaacugugagcccgauaauggcaaggaaugcgggccuggcacacaaguucaggagguggucuguaucaacagcgacggagaggaaguggaucgccagcucugccgggacgcgauuuuccccaucccugucgcuugugaugcccccugcccgaaagacugugugcuguccaccuggagcacauggucuuccugcagccacacguguucuggcaagaccacagaggggaaacagauuagagcccgcuccauccuugcuuaugccggagaagagggcgggauuagaugcccuaauagcuccgcucugcaagaaguucggucuuguaacgagcaccccugcaccguguaccauuggcagacaggaccuuggggccagugcaucgaggauaccagcgucuccucuuuuaauacgaccacaaccuggaacggggaagccagcuguuccgugggcaugcagacacgcaagguuaucugcgugagagucaaugugggacaagugggccccaaaaaguguccggagagccuccggccugaaaccguucgccccugccugcugccuuguaagaaagacugcauugucacgcccuauucugauuggacauccugucccagcucuugcaaggagggggacuccagcaucagaaaacagucucggcaccgcgugauuauccagcuuccugcgaacggaggcagagacuguaccgauccgcucuacgaggaaaaggccugcgaggcuccccaagccugucagagcuaucgguggaaaacacauaaguggcgcagaugccagcuggugccuugguccguccagcaagacagccccggggcucaggaaggaugcggcccugggcggcaggccagagcgauuaccugucgcaaacaggauggcggacaagccggcauccacgagugccugcaguacgcugggcccgugccugcccucacccaggcuugucagauuccgugccaagacgauugucagcugacaucuugguccaaguucagcuccugcaauggagacuguggcgccguucggacgagaaagcgcacccuuguggggaaaucuaagaaaaaggaaaaaugcaagaacagccaucuguauccccucaucgagacacaguacuguccuugcgauaaguacaaugcccagcccgucggaaacugguccgacuguauccugccugagggcaaaguggaaguucugcuuggcaugaaggugcaaggggauauuaaagagugcggacagggcuaucgguaccaggcuauggcgugcuaugaccaaaacgggagacucgucgaaaccucucgcuguaauagccacggauacaucgaggaagccugcauuauccccuguccguccgauugcaagcugucugaguggagcaacuggucccgguguagcaaaucuugcggcuccggggugaagguuagaagcaaguggcugcgcgagaaaccuuauaauggaggccggcccugucccaagcucgaccacgugaaccaggcucaggucuacgaaguggugccuugccauucugauuguaaucaguaucugugggucacagagcccugguccauuugcaaaguuaccuuugugaacaugagagaaaauuguggcgagggggugcaaacgcggaagguccgcugcaugcagaacacagccgacggaccuagcgaacacguggaggacuaccuuugugauccggaggaaaugccccugggcucuagaguuugcaaacucccuugccccgaggacugugugaucuccgaaugggggccuuggacccagugcguccugcccuguaaucagagcuccuuccggcaacgcagcgccgauccgaucagacagccugcugacgagggacggucuugccccaacgccguggagaaggaaccuuguaaucugaacaagaauugcuaccauuaugauuacaacguuaccgacuggagcacaugucagcuuuccgagaaagcggugugcggcaaugggauuaagaccagaaugcucgauuguguccgcucugacggaaaaagcguggaucugaaguauugcgaagcucugggccucgagaaaaacuggcagaugaacacauccuguaugguugaaugccccgugaauugccaacugucugacuggagcccuugguccgaguguucucagacgugcggccuuaccgggaagaugauccggagacgcacagucacccagcccuuccaaggagauggccggccguguccuagccugauggaccaguccaaacccugccccgugaagccuuguuacagauggcaguaugggcaguggagcccgugccaagugcaggaggcccaguguggagaaggcacacgcacccggaacauuucuugcgucguuuccgaugggagcgccgacgacuuuucuaaggugguggaugaggaguucugugcugacaucgaacucauuaucgauggaaauaaaaacaugguccuggaagaguccugcagccagcccuguccuggcgacugcuaccugaaggauugguccucuuggagccuuugccaacucacgugugugaauggcgaggaccugggguuuggaggcauccagguuagaucccgccccgugauuauccaggaacuggagaaccagcaccucugcccugaacaaaugcuggagaccaaaagcuguuaugaugggcagugcuacgaauacaaguggauggccucugcguggaaaggauccagcagaacagucuggugucagcggucugacggcauuaaugugaccgggggaugccuuguuaugagccagcccgaugcugaccgcuccuguaacccuccgugcucucaaccccacagcuauuguuccgagacaaagaccugccauugugaggaaggcuacacagaggugaugucuagcaauuccacccuggaacagugcacgcucaucccugucgugguccugcccacaauggaggauaagagaggcgacgugaaaaccagccgggccguucacccuacccagcccucuuccaacccggccgggcgcggaagaacaugguuccugcaaccuuuuggccccgacgggcggcuuaagaccuggguguauggagucgcugccggcgcuuucgugcugcucauuuuuaucguuagcaugaucuaccuggccugcaaaaagcccaaaaagccucagagacgccagaauaaccggcucaagccccugacgcuugcguaugauggggacgccgauauguga

SEQ ID NO: 76840 - RNA, 501 nt, Artificial Sequence
  derived and/or modified sequence opt5 from THYN1__Homo_sapiens__NP_001032381
augagcagaccccggaagcgccuggcuggcaccuccgggucugacaaaggacucagcggcaagagaacaaaaacggagaacuccggggaagcucuggccaagguggaggauucuaauccucagaaaaccagcgcgacaaagaacugccuuaagaaucuguccucucacuggcucaugaaaagcgaaccggagucccggcuggaaaagggagucgacguuaaauucagcaucgaggaucuuaaggcucaacccaaacagaccacauguugggacggcgugcgcaacuaccaggccagaaauuuucugcgggccaugaagcucggggaggaggcuuucuuuuaucauucuaacugcaaggaaccuggaauugccggccugaugaaaaucgugaaggaagccuaccccgaucacacccaguucgagaaaaauaacccucauuaugaccccuccagcaaggaggauaauccuaaauggucuaugaagucccugauucucuuuuga

SEQ ID NO: 76841 - RNA, 1128 nt, Artificial Sequence
  derived and/or modified sequence opt5 from TIA1__Homo_sapiens__NP_071320
auggaggacgaaaugcccaagacccuguacgugggcaaccucagcagagaugucacagaggcccugauccuucagcuguucucccaaauugggccuugcaaaaauuguaagaugaucauggacacggcuggaaacgauccguauugcuuuguugaguuccacgaacaucggcacgccgcggcugcccucgccgcuaugaauggccgcaaaauuauggggaaggaagugaaagugaacugggccaccacacccucuagccagaagaaggacaccuccaaucauuuucacgucuucgugggagaucugucuccugagaucacaaccgaggacauuaaagcugccuuugcgcccuucggcagaaucagcgaugcccggguugugaaggacauggcuacagggaaauccaagggauacggcuuugucucuuucuuuaacaaaugggaugccgaaaaugcuauccagcagaugggcgggcaauggcuuggaggccgccagauuagaaccaacugggccacgcggaagccucccgcgccuaagagcaccuaugaguccaauacaaaacagcugagcuacgacgaagugguuaaccagucuuccccgagcaauuguaccguguauugcgggggagucacaucuggccucaccgagcaacugaugcgccagacguucucccccuuugggcagaucauggagauuagaguguucccugauaagggauacagcuuugugcgguucaacucucaugaauccgccgcucacgccaucgucagcguuaauggcacaaccauugagggccacguggugaaauguuauugggggaaggaaacacuggacaugaucaaccccguccagcaacagaaucagauuggauacccucaacccuacggccagugggggcagugguauggaaacgcucagcaaaucggccaguacaugccgaacggguggcaagugccugccuauggaauguacggccaggccuggaaucagcagggcuucaaccagacccaguccucugcucccuggauggggccuaauuauggaguucaaccuccccagggccagaacgggagcaugcuccccaaucagccguccggauaccgcguggcgggcuaugagacccaauga

SEQ ID NO: 76842 - RNA, 348 nt, Artificial Sequence
  derived and/or modified sequence opt5 from TIAF1__Homo_sapiens__NP_004731
augagcucccccucuagcccuuucagagagcaguccuuucugugcgccgcuggcgacgccggggaagagucucgggugcaaguccucaagaacgaaguucgcagaggaagcccggugcugcuuggcuggguggagcaggcguacgcugauaaaugugucugcgggcccuccgccccucccgccccuacacccccuucucugagccagcgggugauguguaaugaccucuucaagguuaacccguuucagcugcaacaguuccgcgcugaucccuccaccgccagccuucugcucugcccuggaggccuggaccacaaacugaaucucagagggaaggcuuggggauga

SEQ ID NO: 76843 - RNA, 1179 nt, Artificial Sequence
  derived and/or modified sequence opt5 from TIAL1__Homo_sapiens__NP_001029097
augauggaggacgauggccagcccagaacccuguacguggggaaccucagccgggacgucacagaaguucugauccuucaacuguucucccagauuggaccuugcaagucuuguaaaaugaucacggagcagccggauagccgcagagucaauuccucugugggcuuuagcgugcuccagcacaccuccaacgaccccuauugcuucguggaauuuuacgagcaucgggaugccgcugccgcgcuggcugccaugaaugggcgcaagauucuuggaaaagaaguuaaggugaacugggccacaaccccuucuagccagaaaaaggacacauccaaucacuuccaugucuuugugggcgaucugagccccgagaucaccacagaggacauuaagucugcuuucgccccuuuugggaaaaucuccgaugcuagaguugugaaggacauggccaccggaaaaagcaagggcuauggcuucgucucuuuuuacaacaaacucgaugcggaaaaugccaucgugcacaugggagggcaauggcugggcgggcggcagauucgcacgaacugggcuaccagaaagcccccugccccgaaguccacacaggagaauaacaccaaacaacugcgguucgaagacguggucaaucagagcucucccaagaacuguacaguuuauugcggaggcaucgcuuccgggcucaccgaucagcugaugcgccagacguuuagcccuuucggacaaauuauggagaucagaguguuucccgagaaaggcuacuccuucgugcgguucucuacacaugaaagcgccgcgcacgccauugucuccgugaauggcaccacaaucgaggggcacguugugaaguguuauuggggaaaagaaagcccugacaugaccaagaacuuucagcaggucgacuacucucaauggggccaguggucccagguguacgggaauccccagcaauauggacaguacauggcuaacggcuggcagguuccgccuuaugggguguacggacagcccuggaaccaacagggcuucggcgucgaucagagcccuucugccgcuuggaugggaggguuuggcgcccagccuccccaagggcaggcucccccgcccgugauuccucccccuaaucaggccggauauggcauggcgagcuaccagacccaauga

SEQ ID NO: 76844 - RNA, 4776 nt, Artificial Sequence
  derived and/or modified sequence opt5 from TIAM1__Homo_sapiens__XP_005261095
augggcaacgccgagagccagcacguggaacaugaguucuacggggaaaagcacgcuucccugggaagaaaacauaccucucggagccuccgccugucccacaagacaagacggacgcgccaugccucuagcggcaaagucauccacagaaauuccgagguuucuacccggagcuccagcacacccucuauuccucaaucccuugcggaaaacgggcuggagccguuuagccaggacggaacccucgaggauuucggcucucccaucuggguggaccgcguggauauggggcugagaccugucuccuauacagacagcucugugacccccuccguugauagcuccauugugcuuacagcugccucuguccagagcaugccugacaccgaagagucccggcuguacggagaugacgccacguaucucgcugaaggcggccgcagacagcacagcuacaccucuaaugggcccacauuuauggagaccgccuccuucaagaaaaagcggagcaagucugcugauaucuggcgcgaggacagccuggaauuuucccugucugaucucagccaagagcaucugacauccaacgaagagauucuuggaagcgccgaagagaaagacugcgaggaagcgagaggcauggagacccgggccucuccucgccagcuguccacgugucagagagcuaauagccucggggaucuguaugcccagaagaacucuggagugacagcuaauggcgggccgggauccaaauucgccggcuacugccggaaccuuguuagcgacauccccaaucuggcgaaccacaagaugccucccgccgcugccgaagagaccccucccuauuccaauuacaacacacucccguguagaaaaucucauugccugagcgaaggcgcuaccaauccucaaaucucccacucuaacagcaugcaggggcgccgggccaagaccacacaggacgugaaugccggagagggcuccgaguuugcugauagcgggauugaaggagcgacgaccgacacagaucugcucucuagacgcuccaacgccaccaacagcucuuacucccccacaaccggccgggcuuucgucgggagcgacucuggaagcuccagcacgggcgaugccgccagacagggcguguaugagaauuuucgccgggaacuggagaugucuacaaccaacuccgaaagccuugaggaggcuggguccgcccacucugacgaacaaagcuccggaacccugucuagcccuggccaguccgauauccuccugacagcggcucaggggaccgugagaaaggccggagcccuugcugucaaaaauuuccugguucauaagaaaaacaagaaaguggagucugccacacgccggaaguggaaacacuacugggugagccucaagggcuguacgcuguuuuucuaugaauccgacgggagaagcggcauugaucauaauucuauccccaagcacgcugucuggguggagaacuccauuguucaagccgugcccgagcauccuaaaaaggacuuugucuucugccugagcaauucucucggagaugcguuccuguuucagaccacaucccagaccgaacuugagaacuggaucacagccauucacagcgcuugugccaccgcuguggcccgccaccaucacaaagaagacacgcugcggcuccugaagucugagaucaaaaagcuggaacagaagaucgacauggaugagaaaaugaagaaaaugggcgagaugcaacuguccagcguuaccgacuccaagaaaaagaagacaauucucgaucagaucuucgugugggaacagaaucuggagcaguuucaaauggaccuguucagauuucggugcuaccucgcgagccugcaagggggagaacuuccgaaccccaaacgccugcucgccuucgcuucuagaccuaccaaggucgccaugggccggcuggggauuuuuagcguguccucuuuccaugcucuggucgccgccagaacaggagagaccggcgugcgccggagaacgcaggcuaugagccgcuccgcgucuaaaagacggagccgcuuuuccucucuuugggggcucgauacaaccagcaagaaaaagcagggcagacccuccaucaaucaaguuuucggagaaggcacagaggccgugaagaaaagccuggaggggauuuuugacgauaucgucccugacggaaagcgggaaaaagaggugguucugcccaacgugcaccagcacaauccggauugugacaucuggguccaugaauauuucaccccuucuugguuuugccuccccaacaaucagccugcucugaccguggugcgccccggcgauacagccagagacacgcuugagcugauuuguaagacccaccagcucgaucauuccgcccacuaccugcggcugaaauuccuuaucgaaaacaagaugcaacucuauguuccucagcccgaggaggacauuuacgaacugcuguacaaagagaucgaaauuugcccgaaggucacacagagcauccauaucgagaagucugacaccgcugccgauacauauggguucucccucagcuccguggaggaagacggaauuagaagacuguacgugaacucugucaaagagaccggccuugcgagcaagaaagggcugaaggcuggcgaugaaauccucgagauuaauaaccgggccgccgacgcucuuaauuccagcaugcugaaagauuuucuuucucaaccuucccucggacugcuggugcgcacguaucccgaacucgaggagggcguugaacugcuugagucucccccucacagaguggacgggccggccgaucugggagaaagcccccucgcguuccugacaagcaacccuggccacucccugugcucugagcaggggagcuccgcugaaaccgcccccgaggagaccgaaggaccugaccuugagucuagcgaugaaacagaccauuccagcaagucuaccgagcaggucgccgcuuuuugucggucccuccacgaaaugaaucccagcgaucaguccccuucuccccaagacagcacaggcccgcagcuggccacgaugagacagcuguccgaugcugacaagcuccgcaaagugaucugcgagcugcuugagaccgaacggacauacguuaaggaccugaacugucucauggagagauaucugaaaccucugcagaaggaaaccuuccuuacacaagaugagcuggacgugcucuuugggaaucugaccgagauggucgaguuccagguggaauuucucaaaacgcuggaagauggcguucgccuugugcccgaccuggagaagcucgaaaaggucgaucaguucaaaaaggugcuguuuucucugggaggcagcuuccuuuacuaugccgaccgguuuaaacuguacuccgcguucugcgccagccauaccaaggugccuaaaguccucguuaaggcuaagacagauaccgccuuuaaggcuuuccuggacgcccagaaccccaaacaacagcacucuuccacacucgagagcuaccugauuaaaccgauccagcgcauucuuaaguauccucugcuccugcgcgagcuguucgcccuuaccgaugcugaaucugaggaacauuaccaccuggacguggcgaucaaaacaaugaauaagguggccucccacaucaacgagaugcagaaaauucaugaagaguuuggggcugucuucgaucagcucaucgccgagcagaccggagaaaagaaggagguggccgaccugagcaugggcgaccuccugcuucacacgacaguuauuuggcugaaucccccugcuucucuggggaaauggaagaaagaacccgagcucgccgcguuuguguucaagaccgcugucgugcugguuuauaaagauggaagcaagcagaagaaaaagcuggugggcucccaucggcuuucuaucuacgaagacugggaucccuuuagauuccgccacaugauuccuaccgaggcccuccaaguccgggcccuggcuagcgccgacgcggaggcuaacgccgugugugaaaucguucacgugaaauccgagagcgaaggcagaccggagcgggucuuucaucucugcuguuccucucccgagagccgcaaggauuuccugaaagccgugcacuccauccuuagagacaagcaucggcgccagcugcugaagacagaaucucucccuagcucccagcaguaugugcccuuugggggaaaaagacugugcgcucuuaagggcgcccggccugcuaugucuagagccgucagcgcgcccuccaaaagccuggggcgccggagacgccggcucgccagaaaucgcuucaccauugauucugacgcuguuuccgccagcucuccugagaaggaaucccaacagccgcccggaggcggggauacggaccgguggguggaggaacaguuugaucuggcucaguacgaggagcaagacgauaucaaagaaacagacauucucagcgacgaugacgaguucugugaaucugugaagggagccuccgucgauagagaccugcaggagcgccuucaggccaccagcaucucccagagagaacggggccgcaagacacuggauagccacgcuucuagaauggcgcaacugaaaaagcaggccgcucucagcggcauuaacgggggacuggaguccgccucugaggaagugaucuggguucggcgcgaggacuucgccccuagcagaaaacuuaauaccgaaaucuga

SEQ ID NO: 76845 - RNA, 5106 nt, Artificial Sequence
  derived and/or modified sequence opt5 from TIAM2__Homo_sapiens__NP_036586
augggcaacagcgacucccaguacacccugcaagggucuaagaaucacagcaacacaaucacgggagccaaacagauucccugcucccucaagaucagaggcauucaugcuaaagaggaaaagucucugcacggguggggacauggcagcaauggggccggauauaaaucccggucucuugcgcgcagcugucugucccacuucaagagcaaccagccuuacgcuucuagacucggcggcccgaccugcaaggugucccggggggucgccuauagcacacaucgcaccaaugcccccggaaaagauuuucagggcaucucugcugccuucuccacagagaacggguuucacagcguuggacacgaacuggcugacaaucauauuaccucuagagauuguaacggccaccuucugaauugcuacgggcggaacgaguccaucgccagcacaccucccggagaagaccgcaaguccccuagagugcucaucaaaacccugggcaagcuggauggcugucuccggguggaguuccauaaugggggaaaccccucuaaagucccugcggaggacugcagcgaaccggugcaacugcuucgcuauucccccacgcuggccagcgagaccucuccuguucccgaagcuagacggggcuccagcgccgauucucucccuagccaccgccccuccccgacagacucuagacugcggagcuccaaggggagcucucuuuccagcgagucuuccugguacgauagcccuuggggaaaugcuggcgagcuguccgaagccgaggggucuuuucucgcgcccggaaugccugaccccagccugcacgccuccuuccccccuggcgaugcuaagaaaccguuuaaccagucuagcucccugagcucucuccgcgaacuguauaaggacgccaaucuuggcucccugagccccucugggauuagacucuccgaugaguacaugggaacccaugcuagccugucuaaccgggugagcuucgccuccgacaucgacgucccuagcagaguggcccacggcgaucccauucaguacucuuccuuuacacuuccuugucgcaaacccaaggcuuucguugaagacaccgcgaaaaaggauagccugaaagcccggaugagacgcaucuccgacuggacggggucucucagccggaagaagagaaaacugcaggagccgcgcuccaaggagggaucugauuauuuugacagccgguccgauggccugaacacagacgugcaagggucuagccaggcuuccgccuuccucuggagcggcggaucuacccagauucugucccagagaagcgaaucuacacaugccaucggcuccgauccucuucgccaaaauauuuacgagaacuuuaugcgggaacuggagaugagcagaaccaauaccgaaaacaucgagacaucuacggagaccgcugaauccagcuccgagagccucucuagccuggaacagcuugaccugcucuucgagaaagaacagggggucgugcgcaaggccggauggcuguucuuuaaaccccuggugacaguccaaaaggagcggaagcucgagcugguugcgagacggaaauggaagcaguauugggugacccuuaaaggcugcacacugcucuucuacgaaaccuaugggaagaauuccauggaucagucuagcgcuccucgcugugcccuguuugccgaggacuccaucgugcagucuguccccgaacacccuaaaaaggagaacguguucugccugagcaauuccuuuggagacguuuaccuuuuccaagcuacgucucagacagaucucgagaacugggugaccgccguccauagcgcuugugccucccuguuugcgaagaaacacggcaaggaagacacccugagacuccugaaaaaucagacaaagaaccuucugcagaaaauugauauggacagcaagaugaagaaaauggccgagcuccaacugucugugguuuccgaucccaagaaucggaaagcuaucgaaaaccagauucagcagugggagcaaaaucuggaaaaguuccacauggaccuuuuuagaaugcgcugcuaucucgccagccugcaggggggcgagcugccgaacccuaaaucucuccuggcugccgcgucccggcccagcaagcuugcccugggaagacucggcauccuguccgugucuagcuuccaugcucuggucugcucccgcgaugacagcgcccuuagaaaacggacccucucucugacacagcgcgggagaaauaagaagggaauuuuuuccagccugaaaggccucgauacgcuggcucggaaggggaaagagaagcgccccucuaucacccagguggacgaacuucugcacaucuacggaagcacagucgauggcgugccuagagacaacgccugggagauucaaaccuacguucauuuccaggauaaccacggggugacagucggcaucaaaccggaacaccggguggaggacauucucacccuggccuguaagaugcgccagcuggaacccucccauuauggacuucaacucagaaagcugguugacgauaauguggaguacugcaucccugcucccuaugaguacaugcagcagcaggucuaugacgaaauugagguguuuccucugaacguguacgauguucaacucacgaaaaccggcucugucugugacuucggguucgcggugacagcccagguggaugaacggcagcaccugagccgcaucuuuaucuccgacguccuucccgauggacuggcuuauggcgaggggcucagaaagggaaaugaaauuaugacccugaacggcgaggccgugucugaccuggaucuuaaacagauggaggcccuguucagcgaaaaguccguugggcucacacugaucgcucggccucccgacaccaaagccacgcucugcacaagcuggucugauuccgaccuguuuagcagagaucaaaagucccuucugccgccucccaaucagucucagcuccuggaggaauuccuggacaacuuuaagaaaaauaccgcgaacgacuucagcaaugugccugauauuacaaccggccuuaagcgcucccagaccgacggaacacuggaucaagucucucaucgggagaaaauggagcagacguuuagaagcgcugaacagaucaccgcccucugucgcuccuucaacgacagccaagccaauggcauggaggggccccgggaaaaccaggauccgccucccagaccucuggcucgccaccucucugacgccgaucggcugagaaaggugauucaggagcuuguugacacagaaaaauccuacgugaaggaucugagcugccucuuugagcuguaccuggagccccuucagaaugaaaccuuccugacacaagacgagauggaaucucucuuuggaucccugcccgagaugcucgaauuccagaaggucuuucuggagacccuugaggauggcaucagcgcgucuagcgacuucaacacgcuggaaacaccuucccaguuccgcaaacugcucuuuucucuggggggaagcuuccuuuauuacgcugaccauuuuaagcuguauuccggcuucugugccaaucacauuaaagugcagaagguucucgagcgggccaaaaccgauaaggcuuuuaaagccuuccuggacgcuagaaacccgaccaagcaacacagcuccacacucgaaucuuaccugaucaagcccgugcagcggguccuuaaauauccucugcugcucaaggagcuggugagccuuaccgaucaggaauccgaggagcauuaccaccugacagaagcccucaaagcgauggagaagguggccucucauaucaacgaaaugcagaaaauuuaugaggacuacggcacggucuuugaucaacugguugcugagcagagcgggaccgaaaaggaggugacagaacucuccaugggagagcugcuuaugcacucuaccgugagcuggcugaaucccuuccugucccucggcaaggcccgcaaagaccuggaacuuacagucuuuguguucaagagagcuguuauccugguguacaaagagaacugcaagcucaaaaagaagcugccuagcaauucucggcccgcccauaacuccaccgaucucgacccuuuuaaauuccgcuggcugauuccgaucagcgcccuucaggucagacuggggaaucccgcuggaacggagaacaauucuauuugggaacugauccacaccaaguccgagaucgaaggccggccugagacaauuuuccagcucuguugcagcgauucugaauccaaaaccaacaucgugaagguuauuagaagcauccugcgcgagaauuuucggagacacauuaaaugugagcuuccccuggaaaagacaugcaaggaccgccucgugccucugaaaaaccggguccccguguccgcgaagcuggccagcucuagaagccucaaaguucuuaagaauuccucuagcaacgaguggaccggggaaacaggaaaaggcacccugcuggauuccgacgagggcucucucagcuccgggacgcaaucuagcggaugcccgacagcugaaggccgccaggauuccaagagcaccucuccugggaaguauccccaucccggacuggccgacuucgccgacaaucuuaucaaagaguccgauauccugagcgacgaggaugacgaucaccggcagaccgugaagcaaggcucuccuacaaaagacauugaaauccaguuucagagacuccgcauuuccgaggaucccgacguccauccugaagcugagcagcaaccggggcccgagagcggagaaggccagaagggcggggagcagccuaaacuggugagaggacacuucugucccaucaagcggaaagccaacuccaccaagcgcgauagaggcacgcugcucaaggcgcagauucggcaccaaucucuugacagccaguccgaaaaugcuacaaucgaucugaacagcgugcuggagcgcgaauuuucuguccagucccucaccagcguugugucugaggagugcuucuacgaaacagagagccaugggaaauccuga

SEQ ID NO: 76846 - RNA, 2139 nt, Artificial Sequence
  derived and/or modified sequence opt5 from TICAM1__Homo_sapiens__NP_891549
auggccugcaccggccccagccugccuuccgcuuucgacauccucggggccgcgggacaggauaagcugcuuuaccugaaacacaagcucaaaacaccgagacccggcugucaagggcaggaccugcuucaugcuauggugcugcucaagcugggacaggagacggaagcccggauuucucuggaggcccucaaagcugaugccgucgcucgccugguugccagacagugggcgggcguggacagcaccgaagauccugaggaacccccugacguguccugggccgucgcucggcuuuaucaucugcucgccgaggagaagcugugccccgcuucucuucgcgauguggccuaccaagaagcgguuagaacacugagcucccgggacgaucaccgccucggggagcugcaggacgaagccagaaaccgguguggaugggauaucgcuggcgacccuggcucuauucgcacccugcagagcaaucucgggugccugccgcccuccagcgcccuuccuucuggaacaagaucccugccccggccuaucgauggcgugagcgacuggucucagggguguucccuccgcagcaccggaucucccgcuucccuggccagcaaccuugagauuucccaaucuccgacaaugccuuuucugagccuccacagauccccgcauggcccuagcaagcugugcgacgauccccaggccucucugguccccgagccugugcccgggggaugucaggaacccgaggaaauguccuggccucccagcggcgagaucgcuucuccucccgaacucccgagcuccccucccccuggccugcccgagguugcgccugacgccaccucuacggggcuucccgauaccccggcugccccugagacaagcaccaauuaucccguggaaugcacagagggauccgccggcccccagagccugccucucccgauccuggaacccgucaaaaacccuuguucugugaaggaccaaacgccccuucagcuguccguggaggauaccacaagcccuaauaccaaacccugcccucccacaccgaccaccccugaaacaucucccccucccccgccucccccucccuccagcacgcccuguuccgcucaccucaccccuucuagccuguucccguccucucuggagagcuccagcgagcagaaguuuuacaacuucgucauucuccacgcccgggcggacgaacauaucgcucugcgcguuagagagaaacuugaagcccugggggugcccgauggagccacauuuugcgaggacuuccaagugccuggcagaggggaacucucuugccugcaggaugcuauugaccacuccgccuuuaucauucugcuucucaccagcaauuucgauugucggcugucucugcaucaggucaaccaggcuaugauguccaaucucacacgccaaggaagccccgacugcgugaucccuuuucugccccuugagucuagcccugcccagcuguccagcgacaccgcgucucuccuguccggccugguucggcuugaugagcacagccagauuuucgccagaaagguggcuaacacguuuaagccgcaccgccuccaggcccggaaagcuauguggagaaaggaacaagacacacgcgcccugcgggagcagucccagcaucuggauggcgaaagaaugcaggcggccgcucucaaugccgcuuauucugccuaccugcaaagcuaucuuuccuaccaggcccagauggagcagcugcaagucgcuuucgggucucacaugagcuuuggaaccggcgcgcccuacggggcccgcaugccuuucggaggccaggugccccucggggcuccucccccguucccuaccuggcccggcuguccccagccucccccucugcaugccuggcaagccggaacaccgcccccucccuccccucagcccgcugccuuuccgcagucucugccuuucccccagagcccugcguuucccaccgcuuccccugcucccccgcaaagcccuggccuucagccccucaucauccaccaugcccagaugguucagcuggggcugaacaaucacauguggaaccaacggggaucucaggcccccgaggacaaaacacaggaagccgaguga

SEQ ID NO: 76847 - RNA, 708 nt, Artificial Sequence
  derived and/or modified sequence opt5 from TICAM2__Homo_sapiens__NP_067681
augggcaucggaaagagcaaaauuaacuccugcccccugucucucagcugggggaagagacacuccguggacaccucuccuggcuaccaugagagcgauuccaaaaagucugaagaccugagccuuuguaaugucgccgagcacuccaacacaacggaagggccgaccggaaaacaggagggcgcucaaagcguugaagagauguucgaggaagaggccgaagaggagguguuucugaaguucgugauccuccaugcggaagaugacacagaugaggcucugcggguccagaaucuucugcaggacgauuuugggauuaagcccggaaucauuuucgccgaaaugccuugcggccgccagcaccuccaaaaccuggacgaugccgugaauggcucugcuuggaccauccugcuccugacagagaacuuucuuagagacaccugguguaauuuccaguuuuauacaucccugaugaacagcguuaaucggcagcauaaauacaacucugugauccccaugcgcccucucaauaacccccugccuagagaacggaccccguucgcccuucagacgauuaaugcucuggaggaggaaucccgcggguuucccacccaagucgagagaaucuuccaggaaagcguguauaagacacagcagaccauuuggaaagagacacggaacaugguucaacgccaguuuaucgccuga

SEQ ID NO: 76848 - RNA, 5733 nt, Artificial Sequence
  derived and/or modified sequence opt5 from TICRR__Homo_sapiens__NP_689472
auggcuugcugucacaaagugaugcugcuccuggauaccgcuggcggggccgcgagacauagccggguccgcagagcugcccuucggcugcucacauaccuguccugccgcuucggacuugccagaguucacugggcuuuuaaguucuuugauucucagggcgcccggagccgccccuccagagugucugacuuccgggagcuggggagccgcuccugggaagauuuugaggaggaacuggaagcuagacuggaggaccgggcccaucugccuggaccggcgccccgcgccacgcacacccauggcgcucucauggagacacugcuugauuaucaaugggacagaccugaaaucaccucucccacaaagccuauucugcggagcuccgggcgcagacuccuggauguggagagcgaagccaaggaggcugaggccgcgcuuggaggccuggucaacgccguguuccuccuggcucccuguccucacucucagcgggaacugcuccaguuuguuuccggcugcgaggcccaggcucaaagacugccgcccaccccuaaacaggugauggaaaaacuucugcccaagcgcguccgggaggugaugguugccagaaagaucacauucuacuggguggacaccacggaauggagcaaacucugggagucuccugaucaccugggguauuggaccgucugugagcuucugcaucacggaggcgggacagugcuccccuccgaauccuuuucuugggacuucgcccaggcuggagagaugcugcugcgcuccggcauuaagcucagcuccgaaccgcaucugucuccuuggaucagcaugcuucccaccgaugcgacacugaaucggcuccuguacaacuccccugaguaugaagccagcuuucccagaauggaggggaugcuuuuccugcccguggaggcuggaaaagaaauucaggagaccuggacggucacacucgaaccucuggccaugcaccaacgccacuuucagaagccgguucggaucuuccugaaaggcucuguggcccaguggucccuccccaccagcucuacacugggcaccgacagcuggaugcuuggguccccugaggaaucuaccgcuacacagagacuccucuuccaacagcuggugagccgccugacggccgaggagcuucaucucgucgcggauguggaccccggagaaggccggccucccaucaccgggguuauuuccccgcugagcgcuucugccaugauccugacagugugcagaaccaaggaggccgaauuucagcgccacguccuccaaacagcuguggccgacuccccucgggauaccgcuagccuguucucugacguuguggauuccauucuuaaucagacgcaugacagccuggccgauacagcguccgccgcuucucccgucccugagugggcccagcaggagcucggacacaccacccccuggagcccugcuguggucgaaaagugguuucccuucuguaacaucuccggcgccucuagcgaccugauggaguccuuugggcugcuucaagcggccagcgcuaauaaagaagagucuuccaagacagaaggagagcucauucauugccuggccgagcuguaccagagaaaaagccgggaagagucuaccaucgcucaccaggaagauuccaagaaaaagcgcggcgugccgagaacaccuguucggcagaaaaugaacacgauguguagaagccucaagaugcugaauguggcccgccuuaacgucaaggcccaaaaacugcaccccgacggcucucccgauguggcuggggagaagggaauccagaaaaucccuagcggccggaccguugacaagcucgaagauagagggcgcacacugagauccagcaaaccgaaggacuucaagaccgaggaggaacugcuuucuuauauccgggagaauuaccagaaaacaguggcgaccggagaaauuaugcucuacgccugcgcucgcaacaugaucuccacggucaagauguuucugaaaagcaagggcaccaaagagcuggaagugaauugucucaaccaggugaaguccucucugcuuaagacaagcaaaucccugagacaaaaucucgggaagaaacuggacaaggaggauaaaguucgggagugccagcugcaggucuuccuucgccucgaaaugugccugcagugucccucuauuaacgagagcaccgacgauauggaacaagugguggaggaggucacagaccugcucagaauggugugccugaccgaagauuccgccuaucuugccgaguuucuggaagagauccuccggcuguacauugacucuaucccuaagacgcugggcaaucuuuauaacagccugggauucguuaucccccagaagcucgcuggcgugcugccuacagacuuuuucuccgacgauagcaugacccaggaaaacaaaucuccccuccuguccgucccuuuucuuagcucugcccgcagauccgugagcgggucucccgaguccgacgagcugcaagaacuccggacacgcagcgcgaagaaaagacggaagaaugcucugauuagacauaaauccaucgccgagguuagccagaaccugcgccagauugaaaucccgaaggugucuaaacgggccaccaagaaggagaauagccacccugcuccccagcaaccuucccagcccgucaaagauaccgugcaggaaguuacaaaggugagacgcaaccuuuucaaucaggagcugcucucuccgagcaaacggucccugaagagaggacucccucgcucucauagcgucuccgccguggacggccuggaggauaaacuugacaacuucaagaagaauaaaggguaccacaagcugcucacgaaaucuguggcggaaacccccguccacaagcaaauuagcaaacggcugcugcauagacagaucaagggacgcuccagcgacccuggccccgauaucgggguuguggaggaaucucccgagaagggcgacgaaauuucccuucggagaagcccucggaucaaacagcugucuuuuucccgcacacacagcgcuuccuucuauucugugagccagccgaaguccagaagcguccaacgggugcauucuuuucagcaggauaaauccgaccaacgcgagaacagccccguucagucuauuagaagcccuaagucccuccuguucggagccaugucugagaugaucagccccuccgaaaaaggcucugcccggaugaagaagagaagccgcaauacccucgauuccgaggugccugcugccuaccagacacccaaaaagagccaccagaaaucucuguccuuuagcaagaccacgccucggagaauuucccauacaccgcaaacaccccuuuauaccccugaacgccugcagaaaucucccgcuaagaugaccccuaccaaacaggccgcguucaaggagagccugaaggacuccucuagccccgggcacgauuccccgcucgacagcaaaaucacaccucagaagcggcacacgcaagccggagagggcaccucucuggaaacaaaaacccccagaacacccaagcgccaggggacccagccucccggauuucuuccuaacuguacguggccgcauuccgucaauagcucucccgaguccccuagcugccccgcuccucccaccucuagcacagcccagccgcggagagaaugucugaccccuauucgcgauccccucagaacaccuccccgggcugccgccuucaugggcaccccucaaaaccagacacaccagcagccccaugugcugcgcgcugcgagagccgaggaaccggcucaaaaacucaaggacaaggccaucaaaaccccuaagcggcccgggaauagcacgguuacaucuuccccucccgugaccccgaaaaagcuguuuaccagcccccuuugcgaugucagcaaaaaguccccuuuccgcaagucuaaaaucgagugucccagcccuggcgagcuggaccagaaggaaccccagauguccccuucuguggccgcuagccuguccugcccgguucccucuacaccucccgagcucagccaaagagccacccuggauacggugccucccccgccucccuccaaagucggaaagcgguguagaaaaacaagcgacccccgccggucuauuguggaaugccagccugacgcguccgcuacccccggcguggggacagccgauagcccugccgcuccgaccgacucuagagaugaccagaagggacuuucccugagcccccagucuccucccgagcgccggggcuacccugggcccggacucagauccgauuggcacgccagcuccccgcugcucaucacaagcgacaccgaacaugucacgcugcuuucugaggcggagcaccacggcauuggggaucugaaguccaacguucuguccguggaagagggcgaaggacuccggaccgcugacgccgagaaaucuagccugucccauccuggcauucccccuucucccccuagcugugggcccggauccccgcuuaugccuucucgcgaugugcacugcacaaccgacggcagacaaugccaggccagcgcucagcuggauaaucuccccgccuccgcuuggcauagcacagacucugccagcccccagaccuacgaagucgagcuggagaugcaagcgagcgggcucccuaagcugcggauuaaaaagaucgacccgucuuccagccuugaagccgagccccuguccaaagaagagucuagccugggagaggaauccuuucucccugcucugagcaugccccgcgccucuagaucccuuagcaagccugagcccacguaugugucuccucccuguccgcggcugagccacuccacaccuggcaagucucgcggccagaccuacaucugccaggcuuguacacccacccacgggccuagcuccacccccucuccguuccagacagauggaguuccuuggacgcccagccccaaacauuccggcaagaccacaccugacauuaucaaagauuggcccagacggaagcgcgccguggggugcggagccggcuccucuagcgggagaggagaagucggcgcugaccucccuggcagccugucccugcucgagucugaagggaaagaucacggacuugagcugagcauucaucggaccccgauccuggaggacuuugaacucgagggcgugugucaacugcccgaucaguccccucccagaaacucuaugccuaaggcggaagaggccagcuccugggggcaguucggacuuagcucucgcaaacggguucugcucgcuaaggaagaggccgacagaggcgccaagcgcauuugcgaucugcgggaggacuccgaagugagcaaaucuaaggaggggucccccagcuggucugcuuggcaacugccuuccacaggagaugaagaggucuucgugagcggcucuaccccgcccccuagcugugccgucagauccugccucagcgcguccgcccuucaggcccugacgcagucuccccugcucuuucagggcaaaacaccuagcucccaaucuaaggacccccgcgaugaagacguggacguucugccgagcaccguggaggauuccccuuucucucgggccuuuagcagacgccggcccaucuccagaaccuauacacgcaagaaacuuauggggaccuggcuggaggaccucuga

SEQ ID NO: 76849 - RNA, 555 nt, Artificial Sequence
  derived and/or modified sequence opt5 from TIFA__Homo_sapiens__NP_443096
augaccagcuucgaggacgccgauacagaagagacggugaccugccugcagaugacagucuaccaccccggccaacuccagugugggaucuuucaguccauuucuuucaacagagaaaagcugccuagcuccgagguugugaaauuuggacgcaauucuaacaucugccauuauaccuuccaggacaagcaagugagccggguccaguuuucccuucagcuguucaaaaaguuuaauucuagcgugcucuccuucgaaauuaaaaacaugagcaagaagacaaaucugaucguugauucuagagagcuuggcuaccugaacaaaauggaccucccguaucgguguauggugcgcuuuggggaguaccaguuccugauggaaaaggaggauggagaaucccuggaguuuuucgagacccaauuuauucucagccccagaucucugcuucaggaaaauaacuggccuccccaccggccuauccccgaguauggcacauacucccugugcagcucucaguccagcuccccuaccgaaauggacgagaaugaaucuuga

SEQ ID NO: 76850 - RNA, 1578 nt, Artificial Sequence
  derived and/or modified sequence opt5 from TIGD2__Homo_sapiens__NP_663761
augcugggcaagagaaaacgggugguccucaccaucaaggacaaacuggauauuaucaagaaacuugaggaagggauuagcuucaagaagcuguccguuguguacggaaucggcgagucuacagugcgcgacauuaaaaagaacaaagaaagaaucaucaauuaugccaacagcuccgaucccacgucuggggucagcaagcggaaauccaugaagucuagcaccuacgaggaacucgaccgcgugaugauugagugguuuaaucagcaaaagacagauggaaucccuguuuccggcaccauuugcgcuaaacaggccaaguucuuuuucgacgcgcuggggauggagggagauuuuaacgcuagcucuggcuggcuuacaagauucaaacagcggcacggcaucccgaaggccgccgggaaaggaaccaagcugaaaggcgacgaaacagcugcccgcgaguuuuguggguccuuccaggaauuuguggagaaggagaaucuccaacccgaacagauuuauggagcugaucagaccggccuguucuggaagugccugccuagcagaacgcucacccuggagacagaccagucuaccuccgggugucggagcucucgcgaaagaaucauuaucaugugcugugccaacgcgacaggacuucauaaacugaaucucugcgucgugggcaaggccaaaaagccccgggcuuuuaaaggcaccgaucuguccaaccuuccuguuacguacuauagccaaaagggggccuggaucgagcaguccguguuccgccagugguuugaaaaguacuucgucccccaggugcaaaaacaccugaagucuaaaggacuccuggagaaggcugugcugcuccuggacuucccuccggccagacccaaugaggaaaugcuuagcuccgaugacggccggauuaucgucaaauaucugccucccaacguuacaagccucauucagccuaugucucagggggugcuggcgaccgugaagcgcuacuacagagccggacuucugcaaaaguauauggacgagggcaaugaucccaaaaucuuuuggaagaaccucacaguccuggacgcuauuuacgaagugucccgggccuggaauaugguuaaaagcucuaccaucaccaaggcuuggaaaaagcuguucccggggaacgaggaaaauagcggaaugaacaucgaugagggcgccauucucgccgcuaaccuggcgacagugcuucagaauacggaggaaugugagcaugucgacaucgaaaacauugaucagugguuugacuccagaucuagcgauuccagcugccaggugcugaccgacucugaguccgccgaagaucaaacaaaggcugccgagcagaaaccuagcucuaagucccgcaaaaccgagcucaaucccgaaaagcacaucagccauaaagccgcucuggaguggacagaaaaccuucuggacuaucucgagcagcaggaugacaugcugcuguccgacaagcucguucugcggagacuucgcaccauuauccggaaaaagcaaaagauccagaauaacaaaaaucacuga

SEQ ID NO: 76851 - RNA, 735 nt, Artificial Sequence
  derived and/or modified sequence opt5 from TIGIT__Homo_sapiens__NP_776160
augagauggugccugcuccugaucugggcccagggccuucggcaagcuccccuggccucugggaugaugaccggaacaauugagacgaccggcaacaucuccgcggaaaaagggggaucuauuauccuccagugucaccugagcuccacaaccgcucaggugacacaggucaauugggagcaacaggaccagcuucuggccauuugcaacgccgaucucggcuggcauaucucuccuagcuucaaggaccgcguugcuccggggcccggacugggccugacccuccagucccugacagugaaugauaccggcgaauacuuuuguaucuaucacacguacccugacgggaccuauacaggaagaauuuuccuugaggugcuggaaucuagcgucgccgagcauggcgcucgguuucaaaucccccuccugggggccauggcggccacccuugugguuauuugcacagcugugaucgucgugguugcccugacccgcaagaaaaaggcucuccggauucacuccguggagggagaucugagacgcaaaagcgccggccaggaagaguggucuccuuccgcgcccagcccuccggggucuuguguccaggccgaagcugcccccgcuggacugugcggcgagcagagaggcgaggacugugccgaacuccaugauuacuucaacgugcuguccuaucggagccuugggaauugcagcuuuuucacggagacaggauga

SEQ ID NO: 76852 - RNA, 1053 nt, Artificial Sequence
  derived and/or modified sequence opt5 from TIMD4__Homo_sapiens__NP_001140198
augagcaaggagccccugauccucuggcugaugauugaguucugguggcuuuaccugaccccugugacauccgaaacggucguuaccgaagugcucggccacagagugacacugccgugccuuuauucuagcuggucccauaacucuaauagcauguguugggggaaagaccagugccccuacuccggauguaaggaggcccugauccggaccgauggcaugcgcgucacaucuagaaaaagcgcuaaguaucggcuccaagggaccauuccucgcggagacgugucccugacaauccugaaccccagcgaaucugauuccggcguuuacugcuguagaauugaggugccugggugguuuaaugacgucaaaaucaacgugcggcucaaucugcagcgcgccagcaccacgacccacagaacagcgaccacaaccacgcggcgcacaaccacaaccucucccaccacaacgagacagaugaccacaaccccugcugcccuuccgacaaccguugugacgacacccgaucugaccaccggaacaccucuccagaugaccacaaucgccgucuucacgaccgcuaacacaugccugucccuuacccccagcacacugccugaggaagccaccggccuccugacgcccgagccgucuaaggaaggcccuauucugaccgcugaguccgagacagugcuccccagcgacuccuggucuagcguggaauccaccagcgccgauacaguccugcuuaccucuaaggcguccgacacggccguuccugagcaaaauaaaacaaccaagacagggcagauggauggaauccccaugagcaugaaaaacgaaaugcccauuucucagcugcucaugaucauugcuccuagccugggcuuugugcuuuucgcccuguuuguggcuuuccuccugcgggggaagcugauggagaccuauuguucccagaaacauacccgccucgacuacaucggagauucuaagaauguccugaacgacgugcaacacggcagagaagaugaggacgggcuuuuuacacuguga

SEQ ID NO: 76853 - RNA, 3627 nt, Artificial Sequence
  derived and/or modified sequence opt5 from TIMELESS__Homo_sapiens__NP_003911
auggaccugcacaugaugaacugcgagcuccuggccaccuguagcgcucuuggcuaccuggaaggggauacauaucauaaggagcccgacugccucgaauccgugaaagaucugaucagauaccuucggcacgaggacgaaacgcgcgaugucagacagcaacugggagccgcgcagauucuccagucugaccugcugccuauccucacccagcaucaccaagauaagccgcuguucgacgcuguuauucggcuuauggugaaucugacacagcccgcccuccuguguuuuggcaaccuuccuaaagagcccagcuuccgccaucacuuucuucaggugcucaccuaucugcaggccuacaaggaggcuuucgccuccgaaaaggcuuuugggguccugucugagacacucuaugaacugcuucaacugggaugggaggagagacaggaagaggauaaucuccugaucgaacggauucuucugcucgugcgcaacauccugcacguuccugccgaccuggaucaggagaaaaagaucgacgaugacgcgagcgcccaugaccagcuccugugggcuauucaccuuuccggccuggaugaccuccugcuuuuccuggccucuagcuccgcugaagaacaauggagccuccaugugcuggagaucgucucucugauguuuagagaucagaaucccgaacagcucgccggggugggacaaggccggcuggcgcaggagcgcuccgccgacuucgcugaacuugagguucugagacagcgggaaauggccgagaaaaagacccgcgcucuccagagaggcaaccggcacagccgcuuugggggaucuuacauugugcaaggccugaaauccaucggggagagagaucugauuuuccacaagggacuucauaaucuccggaacuauagcucugaccugggcaaacagccuaagaaggucccgaaaagacgccaggccgcccgggaacuguccauccagagacgcagcgcucucaaugugcggcuguuucuuagagauuucugcuccgaguuucuggaaaacuguuacaaucgccucauggggucugugaaggaccaucugcugcgggagaaagcgcaacagcacgaugaaacauacuauaugugggcccuugcuuucuucauggccuuuaacagagccgcuagcuuccgccccggacucgucuccgagacccugagcguucggacguuucacuucauugagcagaaucugaccaacuacuaugaaaugaugcucacagacagaaaggaggccgcgucuugggcucgccggaugcaucuggcccuuaaagccuaccaggaacugcucgcuaccgugaaugagauggauaucuccccugacgaggccgugagagaaagcucucggaucauuaagaacaacaucuuuuaugucauggaguaccgcgaacuguuccuggcucuuuuuagaaaauucgacgagcggugccaaccccgcagcuuucucagagaucugguggaaacaacccaccuguuccucaagaugcuggagcgguuuuguagaucccgcggcaaucuuguugugcagaacaagcagaaaaagagacggaaaaagaaaaagaagguccuggaccaggccauugugucuggcaauguuccuagcucccccgaggaaguggaggcggucuggccggcccucgcugaacaacugcagugcugugcccagaacagcgagcugucuauggauuccguggucccuuucgacgcugccagcgaagugcccguugaggagcaacgcgcggaagccauggugagaauccaggauugccuucucgcugggcaggccccucaggcucugacgcugcuccggucugcccgcgaggucuggcccgaaggagacguguuuggcucccaagauauuagccccgaggaagagauccagcugcuuaaacagauccuguccgccccucucccgagacagcaagggcccgaggaacggggagcugaggaagaggaggaagaggaagaggaagaggaggaggagcugcagguugugcaggucucugaaaaggaguucaauuuccuggacuaucuuaaacgcuuugcguguagcacaguggugagagccuacguucugcuccugcgguccuaccagcaaaacucugcucacaccaaucauugcauugucaagaugcuccaccgccuggcccaugaucuuaaaauggaagcccuccuguuccagcugagcguguuuugccuguucaacagacuucuguccgacccugcugccggcgcguauaaggagcucgugacauuugcuaaguacauccuggggaaauucuuugcccucgccgcugucaaucagaaggccuucguggagcugcuguuuuggaaaaacaccgcgguugugcgggaaaugaccgagggauauggcagccuggaugacagaucuuccagccgccgggcucccacauggucuccugaagaggaagcccaccucagagagcuguaccuggccaauaaggaugucgagggccaagacgugguugaagcuauucuugcccaccugaacacggugccccgcacccggaaacagaucauucaucaccucguccagauggggcuggcugacuccgugaaggauuuccagagaaagggaacacauaucguucucuggaccggcgaccaagagcuggaacuucagcgccuguuugaggaguuccgggauagcgacgaugugcuggggcacaucaugaaaaauauuacagccaagagaucucgcgcgcggaucgucgacaaacuccuggcccuuggacugguggcugaaagacgggagcucuauaagaaacgccagaagaaacuggccagcuccauucucccgaacggcgcugaaagccugaaggauuuuugucaggaggaccuugaagaggaggaaaaucugccugaggaagauucugaggaagaggaggaagggggcuccgaggccgaacaagugcagggaagccugguccucuccaacgagaaccugggccagucucuucaucaggaaggguucagcaucccccugcucuggcugcaaaauugccucauuagagccgcugacgaucgggaggaggacggauguucccaggcgguuccucuggugccccuuaccgaagagaacgaagaggccauggagaaugaacaguuccagcaacugcugcgcaagcucggcgugagaccucccgcuucugggcaggagacguuuuggcggaucccggccaaacugagcccuacacagcuuagacgcgccgcugccucccugucucaacccgaagaggaacagaagcuccagcccgagcugcagccuaaagucccgggagagcaaggcagcgaugaggaacacugcaaggaacaccgggcgcaggcucucagagcccugcuucuggcccauaaaaagaaggcugggcuggccucccccgaggaagaggacgcggugggcaaagagccucucaaggcugcccccaaaaagcgccagcugcuugacagcgaugaggaacaggaagaggacgaaggacggaacagagccccugagcugggcgcucccgggauucagaaaaagaagcgcuaccaaaucgaggaugacgaagaugacuga

SEQ ID NO: 76854 - RNA, 273 nt, Artificial Sequence
  derived and/or modified sequence opt5 from TIMM10__Homo_sapiens__NP_036588
auggacccccugagagcccagcaacucgcugccgagcuggaaguggagaugauggcggauauguacaaccggaugaccagcgcuugccaccgcaagugugucccuccgcauuauaaagaagccgagcuuuccaagggcgaaucuguuugccuggacagaugugugagcaaauaccucgauauccacgagcggauggggaagaaacugacagagcuuuccaugcaggacgaggaacugaugaagcgcgugcagcagucuagcggacccgccuga

SEQ ID NO: 76855 - RNA, 516 nt, Artificial Sequence
  derived and/or modified sequence opt5 from TIMM17A__Homo_sapiens__NP_006326
auggaggaauacgccagagagcccugcccuuggcggaucguggacgauuguggcggggcuuucaccaugggaacaauuggcgggggaaucuuucaggccauuaagggcuuccgcaacagcccggucgggguuaaucacagacugcggggaucccucacggcgaucaaaacccgcgcuccccaacugggcggcucuuuugccguguggggagggcuuuucagcaugauugacugcuccauggugcaggucagaggcaaggaagauccuuggaacucuaucacaagcggggcccugaccggagcuauccucgccgcucggaauggccccguggccaugguuggguccgcggccaugggaggcauucugcuugcucugaucgagggcgccgggauucuccugacacgcuuugcuucugcccaguucccuaacggaccccaguuugcggaagacccuagccaacugccguccacccagcuccccagcucuccuuucggcgauuauagacaguaccaguga

SEQ ID NO: 76856 - RNA, 747 nt, Artificial Sequence
  derived and/or modified sequence opt5 from TIMM21__Homo_sapiens__NP_054896
augaucugcaccuuccugagagccgugcaguacacagagaagcuccaccggagcuccgcuaaacgccugcuucugcccuauauuguccucaacaaggccugucugaaaacggaaccuucucuuagaugcggccugcaauaccagaagaaaacccuccggccgcgcuguauccuggggguuacacagaagaccauuuggacacagggacccagcccuagaaaggcgaaagaggacggcuccaagcaagugucugugcaucggagccagcgcgggggaaccgcuguccccacaucccagaaagugaaggaagccggcagagauuuuaccuaucugaucguuguccucuucgggauuucuaucacgggaggccuguuuuacaccaucuucaaagagcuuuuuagcuccagcucuccuuccaagauuuauggccgggcccuggaaaagugccgcagccaccccgaggugaucgggguguucggagagucuguuaaaggcuacggggaagugacaagacggggacgcagacagcauguccgguuuaccgaguaugugaaggacggccucaaacacacaugugugaaguucuacauugaaggguccgagccuggaaaacaaggcaccgucuacgcucagguuaaggagaauccgggcagcggggaauaugauuuucgcuacaucuucguggagauugaaucuuaucccagacggacgaucauuaucgaggacaacagaucccaggaugacuga

SEQ ID NO: 76857 - RNA, 585 nt, Artificial Sequence
  derived and/or modified sequence opt5 from TIMM22__Homo_sapiens__NP_037469
auggccgcugccgcgcccaacgcuggcgggagcgccccugagaccgccggauccgcugaagccccgcugcaguacucucuccugcuucaauaucuggugggcgacaagagacagccccggcuccuggagccugggagccuuggaggcauccccuccccugcuaaaucugaggaacagaagaugauugaaaaagccauggagagcugcgcguucaaggccgcucuggccugugucgggggauuuguucucggcggcgcuuucgggguguuuacagccggaaucgauacgaaugugggcuucgaccccaaagauccuuaccgcaccccgacagcgaaggagguccugaaggacauggggcagagaggaauguccuaugccaaaaacuuugcuauugugggcgccauguucucuugcaccgaaugucugaucgagagcuaccgggggacauccgauuggaagaauagcguuauuucuggaugcaucaccggcggcgcuaucggguuucgcgccggacucaaagccggcgcuauuggguguggaggcuucgcggccuuuuccgcugccaucgacuauuaccugagauga

SEQ ID NO: 76858 - RNA, 630 nt, Artificial Sequence
  derived and/or modified sequence opt5 from TIMM23__Homo_sapiens__NP_006318
auggagggcgggggaggcagcgggaacaagaccacaggaggccuggccggguucuuuggagcuggcggcgccggguacucccacgcggaccucgcuggagugccccugacgggcaugaauccucuuucuccguaucugaacgucgaucccagauaccucguucaggacaccgaugaguucauccugccuacaggggccaauaaaacccggggacgcuuugaacuugccuucuuuacaauuggcgggugcuguaugaccggagcugccuucggcgcuaugaacggccugagacucgggcugaaggaaacacaaaauauggccuggagcaaaccccggaacgugcagauccugaauauggugacccgccagggagcgcucugggccaacacgcugggcucccuugcucugcucuauucugccuuuggggucauuaucgagaagaccagaggagcugaagacgaucugaauacaguggccgcgggcaccaugacagggaugcuuuacaaaugcaccggaggccugcggggcauugcccgcgggggacucacgggccugacacugaccagccucuaugcucuguacaacaauugggagcauaugaaggggucccuucugcagcaaucucucuga

SEQ ID NO: 76859 - RNA, 1359 nt, Artificial Sequence
  derived and/or modified sequence opt5 from TIMM44__Homo_sapiens__NP_006342
auggccgcugccgcgcugagaagcggcuggugccgguguccccgcagaugccucggguccggaauccaguuccugucuagccacaaccuuccucauggcuccaccuaccaaaugcggcgccccgggggagagcugccgcucucuaagagcuauuccucuggcaauagaaaaggguuucugagcggacuucuggacaacgugaagcaggaacucgcuaaaaauaaggagaugaaagaauccauuaagaaguuccgggaugaggcccgcagacuggaagagagcgacguccugcaggaggcccggcgcaaauacaagacaaucgaaucugagacgguuagaaccuccgaagugcuccggaaaaagcugggcgagcuuacaggcaccgugaaagagagccugcacgaagucucuaaguccgaucucgggcgcaagauuaaagagggaguggaagaggcugccaagacagcuaaacagagcgccgaaucuguuuccaagggcggggagaaacugggaagaaccgcggccuuucgggcucuuagccaaggcguggaguccgucaagaaagaaaucgacgauucugugcuggggcagacaggaccuuaucgcagaccccagcggcucagaaagcgcaccgaguucgccggcgacaaguuuaaagaagagaagguuuucgaaccuaacgaggaggcucugggcgugguccugcauaaagauagcaagugguaccagcaauggaaagacuuuaaggaaaauaacgugguguucaaucgguuuuucgagaugaagaugaaauaugaugaauccgacaacgccuuuauuagagcgagccgcgcccucacggauaaggucaccgaccugcuugggggacuguucucuaaaacagagauguccgaaguucucaccgagauccugcggguggaucccgcuuuugacaaggacagauuccuuaaacagugugagaaugauaucauuccuaacgugcuggaagccaugaucagcggcgagcucgacauucugaaggauuggugcuacgaagcuacauauucucagcuggcccacccgauccagcaagccaaggcucucgggcugcaguuccauagccgcauucuugacaucgauaaugucgaccuggcgaugggaaaaaugauggagcagggccccgugcucauuaucaccuuucaagcccagcugguuauggugguccggaacccuaagggggaggugguugaaggagaucccgacaaagugcuuagaaugcuguacgucugggcucucugucgcgaucaggacgagcugaauccuuacgccgccuggcggcugcucgauaucuccgcuucuagcacggaacagauucuguga

SEQ ID NO: 76860 - RNA, 1371 nt, Artificial Sequence
  derived and/or modified sequence opt5 from TIMM50__Homo_sapiens__NP_001001563
auggccagcgcucugucccucggcaacaagugcgaccccuuccugagaugugugcuuugccgcgggggaggcgcccugcaggggccucggggaagaggcccggaugacuuugagucucaacucagcccucccggguccgcgcggcgccuggucagaucuaaacgggcuuguggaaaucccccugaugccuucggccuuagccgcgccuccguucaucccccucugccgagagugucuaucggcugcagcuccgggcccggacgggcuaagcgcgaaagagugggcggggccgcuuggcggcagcgcaaaauggccgcgagcgccgcugucuuuucuagacuccgguccggacugcgccugggcagcagagggcucuguacccggcuggccacaccucccagacgcgcuccugaccaggccgcggagauuggaucucggggcuccacgaaggcccagggcccccaacagcagccggggagcgaaggaccuucuuacgcuaaaaagguggcccuuuggcuggcuggccuccugggggccggaggcaccguuuccguggucuauaucuucgggaacaaucccguggaugagaacggagccaagauuccugacgaauuugauaaugaccccauccuuguucagcaacugagacgcacauacaaauauuucaaggauuaccggcagaugauuaucgagcccaccagcccuugccuccugccggacccccugcaggagccuuauuaccagcccccuuauacacucgugcuggaacuuaccggcguccugcuccaccccgaguggucccuggcuacaggcuggagauuuaaaaagcgcccggggaucgaaacccuuuuccaacagcuggcgccucucuacgagauugugaucuuuacgucugagaccggaaugacagccuucccccugauugauagcguggacccucacggcuuuaucuccuaccggcuguucagagaugcuacccgcuauauggacgggcaucacgucaaagacauuagcugucucaaccgggaucccgccagaguugugguggucgacugcaagaaggaagccuuucgccugcagccuuacaauggaguggcccuucggcccugggauggcaacucugacgauagaguucugcucgaccuguccgcuuuccuuaaaacaaucgcgcugaaugggguggaggauguccggaccgugcucgaacauuaugcucuggaggacgauccgcuggccgccuucaagcaacgccagagcagacucgaacaggaggagcagcaacggcuggcugaacuuucuaaaagcaacaagcagaaucuguuucucggcucccugacgucuagacuguggccucgcagcaaacagcccuga

SEQ ID NO: 76861 - RNA, 294 nt, Artificial Sequence
  derived and/or modified sequence opt5 from TIMM8A__Homo_sapiens__NP_004076
auggacagcuccucuagcuccucugccgcuggccugggggccguggauccccagcuccaacacuucaucgaggucgaaacccagaagcagagauuucagcaacugguucaucagaugacagagcuuugcugggaaaaauguauggacaagccuggaccgaaacuggauagccgggcggaggcuugcuucgugaacuguguggaacgcuuuauugacacgucccaguucauccucaauagacuggagcagacccaaaagucuaaacccgucuuuagcgagucccuuagcgauuga

SEQ ID NO: 76862 - RNA, 297 nt, Artificial Sequence
  derived and/or modified sequence opt5 from TIMM8B__Homo_sapiens__NP_036591
augagaaagcacagcugccggaaaguggccucccugcgcagaaccauggcugagcucggcgaagccgacgaggcggaacugcagcggcuugucgcugccgagcaacagaaggcccaguucacagcucagguucaucacuuuauggaacuguguugggauaaaugcguggagaagcccgggaaccgccucgacucuagaacggagaauugucugagcuccugcguggaucgguucaucgacaccacacuugccauuaccucucgcuuugcucaaaucguccagaaaggaggccaguga

SEQ ID NO: 76863 - RNA, 858 nt, Artificial Sequence
  derived and/or modified sequence opt5 from TIMMDC1__Homo_sapiens__NP_057673
auggaggugcccccuccggcccccagauccuuccugugccgggcucucugucuguuuccucgcgucuucgccgcggaagcuguuaccgccgacagcgaggugcuugaagagagacagaagcggcugcccuacgugccugaacccuauuacccugagucuggcugggaucgccucagagagcuguuugggaaagacgaacaacagcggaucagcaaggaucuugccaacauuugcaaaacagcugccacggcuggaaucauuggcugggucuaugggggaaucccggccuucauucacgcgaagcagcaguacaucgagcaaucccaggccgaaaucuaucauaaucgcuuugacgcugugcagucugcccacagagcugccacccggggcuucauucgcuacggguggagauggggauggcggacagcgguuuuugugaccaucuucaacacagucaauaccagccugaacguguaucgcaauaaagaugcccucucccauuuuguuauugcuggcgccgugacaggcucucuguucagaaucaacgucgggcugcggggacucguggcuggcgggauuaucggagcccugcuuggcacccccgucgggggacugcucauggccuuucagaaguacagcggcgagacggugcaagagcgcaagcagaaagacagaaaggcucugcacgaacuuaaacuggaggaauggaagggccggcuccagguuaccgagcaucugccugagaaaauugaauccagccugcaggaggaugaacccgagaaugacgcgaagaagaucgaagcccuccugaaccuuccuagaaaucccucugugaucgauaaacaagacaaggauuga

SEQ ID NO: 76864 - RNA, 624 nt, Artificial Sequence
  derived and/or modified sequence opt5 from TIMP1__Homo_sapiens__NP_003245
auggcccccuucgagccucuggcuagcggcauccuccugcuucuguggcucauugccccguccagagcgugcaccugugugcccccucacccccagacagcuuuuugcaauucugaccuggucauccgggccaaguucguugggacgccugaagugaaucaaaccacacuuuaccagcgcuaugagauuaaaaugaccaagauguacaaaggauuucaggcccugggcgaugcugccgacaucagauucguguauacacccgcuauggaaagcgucuguggguacuuucaucggucccacaaccgcucugaggaguuccucauugccggaaagcugcaggauggccugcuccauaucaccacaugcagcuuuguggcgccuuggaacucccugucucuugcccaaagacggggguucaccaaaacguauaccguuggaugugaagagugcacaguguuuccgugucugagcauccccugcaagcuccaguccggcacccacugucuguggacagaccagcuucugcagggcagcgaaaagggguuccaaucucgccaucucgcuugccugccuagagagcccggacuguguaccuggcagucccuccggagccagauugccuga

SEQ ID NO: 76865 - RNA, 663 nt, Artificial Sequence
  derived and/or modified sequence opt5 from TIMP2__Homo_sapiens__NP_003246
augggcgccgcugccagaacccugcggcucgcgcuggggcuucugcuccuggcuacacuucugcgccccgccgacgccugcagcuguuccccugugcacccgcagcaggcuuucugcaacgccgaugucguuaucagagcuaaggccgugucugagaaagaaguggacagcggaaaugauauuuacggcaaccccaucaagcggauucaauaugagaucaaacagauuaagauguuuaaagggccugaaaaggacaucgaguucaucuacacggcgcccuccucugccgucuguggagugagccucgauguuggcgggaagaaagaauaucugauugcuggaaaggccgagggcgacggcaaaaugcauaucacccugugcgauuuuauugugccuugggacacacucuccaccacacagaagaaaucucugaaucaccgcuaccaaauggggugugagugcaagaucaccagaugucccaugauuccuugcuauaucagcuccccggaugaaugucuuuggauggacugggucacagagaagaacauuaauggacaucaggcuaaauucuuugccugcaucaagcggagcgauggcucuugugcgugguaccgcggggccgcucccccuaaacaggaguuccuggacaucgaagaucccuga

SEQ ID NO: 76866 - RNA, 636 nt, Artificial Sequence
  derived and/or modified sequence opt5 from TIMP3__Homo_sapiens__NP_000353
augacccccuggcugggccucaucgugcugcuugggagcuggucccugggagacuggggcgccgaggcuugcacauguucuccuagccacccgcaggaugccuucugcaacuccgacauugucaucagagcgaagguuguggggaaaaagcucgugaaagaaggacccuuuggcacgcuggucuacaccauuaagcaaaugaaaauguaucggggguucacaaagaugccucaugugcaguacauccacaccgaggcuucugaaagccuuuguggacugaagcucgagguuaauaaauaucaguaccugcugacaggccgcguguaugauggcaagauguacaccgggcucugcaacuuugucgaaagaugggaccagcugacacuuucccaacggaaaggacugaauuaucgcuaccaucucggcuguaacugcaagauuaaaucuuguuacuaucugcccugcuucgugaccagcaagaaugagugucuuuggacggauaugcuguccaacuuuggguacccuggauaucagagcaagcacuacgccugcaucagacagaaaggcggguauuguucuugguaccggggaugggcucccccugacaaguccaucauuaaugccaccgauccguga

SEQ ID NO: 76867 - RNA, 675 nt, Artificial Sequence
  derived and/or modified sequence opt5 from TIMP4__Homo_sapiens__NP_003247
augcccggcagcccuagaccggcccccuccugggugcugcuccugcggcuucuggcucuccugcgcccucccgggcuuggagaggccugcucuugugcgccugcucacccccagcaacacaucugccacagcgcccuggucauuagagccaagaucuccucugaaaaaguugugccugcuagcgccgacccggcugauaccgagaagaugcuccgguacgaaauuaaacagaucaagauguucaaaggcuuugagaaggugaaggacguccaguauauuuacacacccuucgauuccucucuguguggggugaaacuggaagccaacagccagaagcaauaucuccugacgggacagguucuuuccgacggcaaaguguuuauccaucugugcaauuacaucgagccuugggaggaucucagccugguccagcgcgaaucucuuaaccaccauuaucaccugaauugugggugccagauuaccacauguuacaccgugcccugcacaaucuccgcgccuaacgagugucucuggaccgacuggcugcuggaaagaaagcucuauggauaccaagcccagcacuacguuugcaugaaacauguggauggcacauguagcugguaucggggccaucugccccuucgcaaggaguucgucgacauugugcagccguga

SEQ ID NO: 76868 - RNA, 1431 nt, Artificial Sequence
  derived and/or modified sequence opt5 from TINAG__Homo_sapiens__NP_055279
auguggaccggcuacaagauccugauuuucagcuaucucacaacggagaucuggauggaaaaacaguaccugucccaaagagagguggaccuugaagccuauuuuacccggaaccacacaguccugcaggggacccgcuucaagagagcuauuuuucagggacaguacugccggaauuucggcuguugcgaggaucgcgacgauggguguguuacagaauuuuaugccgcgaacgcucucugcuacugugacaaauucugcgauagagaaaauucugacuguugccccgauuauaagagcuuuugucgggaggagaaagaguggccuccgcauacccaacccugguacccugaaggaugcuucaaggacggccagcacuacgaggagggguccgugaucaaggaaaacuguaauucuugcacaugcagcggacagcaguggaaauguucccaacaugugugccugguccgcucugagcuuauugaacaggugaacaagggcgauuauggcuggaccgcccagaauuacagccaguuuugggggaugacgcuggaggacggauucaaauuuagacucggcacccugcccccuucccccaugcugcucagcaugaacgaaaugacagccucucugccugcuaccacagaucuuccggaguucuuuguugccuccuauaaguggcccggguggacccacggaccucuggaccaaaagaauugugcugccagcugggcguucucuacggccuccguggcugccgaucggaucgcuauccagagcaagggccgcuacacagccaaccucucuccccagaaucugauuuccugcugugcgaagaacagacaugggugcaauagcggauccaucgaccgggccuggugguaucuucgcaaaagaggccuggucucucacgcuuguuacccucucuucaaggaccaaaacgccaccaauaacggcugcgcuauggccagccgguccgaugggcgcggaaaaagacacgccacaaagcccuguccgaacaauguggagaaaagcaaccggauuuaucagugcucuccucccuacagaguuuccagcaaugaaaccgagaucaugaaggaaauuaugcagaacggcccugugcaggcuaucaugcaaguccgcgaggacuuuuuccauuacaaaaccgggauuuaucggcacgugacaucuacgaauaaggaaagcgagaaguacagaaaacugcagacccaugcggugaagcugacaggauggggcacccuccgcggggcccagggacagaaagagaaguuuuggaucgcugccaacuccuggggcaaaucuuggggcgaaaauggguauuuccggauccugagaggagucaacgagagcgauauugaaaaacuuaucauugccgcuuggggccaacugacauccagcgacgagcccuga

SEQ ID NO: 76869 - RNA, 1356 nt, Artificial Sequence
  derived and/or modified sequence opt5 from TINF2__Homo_sapiens__NP_001092744
auggccacaccccugguggcuggcccugccgcgcucagauucgcugccgccgcuagcuggcaagucguucgggggcgcugcguggagcacuuuccgagagugcuggaguuccuucggucccugcgcgccgucgcucccggacucgugagauaccggcaucacgaacgccuguguaugggccuuaaggccaaaguuguggucgaacugauccuccaagggagaccuugggcccaggugcugaaggcgcugaaccaucacuuucccgagucuggaccuauuguucgggaccccaaagcuaccaagcaggaucuccgcaaaauccuggaagcccaggagacguucuaucaacaggugaagcagcuuagcgaggcuccugucgaccuggccuccaagcuccaggaacuggagcaagaauacggcgagccguuucuugcggccauggagaaacugcuguucgaauaucugugccagcuggagaaggcucuccccaccccucaggcccagcaacugcaggaugugcuuucuuggaugcagcccggggugagcauuacauccucucuggcuuggagacaauacggagucgacaugggcuggcuccugccugaauguagcguuaccgauuccgugaaucuugccgagcccauggaacagaacccgccucagcagcaacggcuggcccuccauaauccccugccuaaagcuaagcccggcacacaccucccccaggggccuagcucucgcacccacccggagccccucgcgggaagacauuuuaaccuggccccucuuggccggcgcagagugcagucccagugggcuagcacaagagggggacacaaagagcggcccaccgucaugcuguucccuuuucgcaaucucggcucucccacgcaagugaucuccaagccggaaagcaaggaggaacaugccauuuauaccgccgaccuggcuauggggacacgggccgcgucuaccggaaaauccaagagcccuugccagacacuuggcggcagagcucugaaagagaaccccguugaucucccugccaccgaacagaaggagaauugucuggacugcuacauggauccccugcgccucucccugcuuccuccccgggccagaaaaccgguguguccucccucucugugcagcuccgucaucacgaucggggaccucgugcuggauagcgacgaggaagagaacggacagggcgaagggaaggagucucuggaaaauuaucagaaaacaaaguucgauacccuuauucccacacucugugaguaccugccuccguccggacacggcgcuauccccguuagcucuugcgacugucgcgacagcucccggccucuguga

SEQ ID NO: 76870 - RNA, 1974 nt, Artificial Sequence
  derived and/or modified sequence opt5 from TIPARP__Homo_sapiens__NP_001171646
auggagauggaaaccacagagcccgaaccugacugcgugguccagccgcccagcccucccgaugacuucuccugucaaaugagacugucugagaagaucacgccucucaaaaccugcuuuaagaaaaaggaucagaaacggcugggcacagggacccuucgcagccugagacccauucucaacacacugcuugaauccggaucucuggacggcguuuuccggagccgcaaucaguccaccgaugagaacucucuccacgagccuaugaugaagaaggccauggaaaucaauagcuccuguccgcccgcugagaacaauaugagcgugcugauuccugacagaacaaacgugggggaucagauccccgaagcccauccuucuaccgaggcgcccgagcgggucgugccgauucaagaccacuccuuuccuagcgaaacgcugucuggaaccguugcugauuccacacccgcccauuuccagaccgaccuccugcacccugugagcucugauguccccacaucccccgacugccuugauaaagugaucgacuacguuccuggcaucuuucaggagaauagcuucaccauucaguauauccuggacacguccgauaagcucucuacagaacuguuucaagacaaaagcgaggaagccucccuugaucugguguucgagcucgucaaccagcugcaguaccauacccaccaggagaaugggauugaaaucuguauggacuuucugcaaggaacaugcauuuauggccgcgauugucucaagcaccauaccgugcugccguaccacuggcagaucaaaagaaccacaacgcagaaguggcaaagcguguucaacgacucucaggagcaucuugaacgguuuuauugcaaucccgagaacgaucgcaugagaaugaaguacggcgggcaggaguucugggcugaccugaaugccaugaacgucuaugaaaccacagaguuugaucagcuccggcgccuguccaccccucccagcucuaauguuaacagcauuuaccacacaguguggaaauucuucuguagagaccacuuuggauggcgggaauacccugaguccgugauccgccuuaucgaagaggcuaacucuagaggccugaaggaaguccgguucaugauguggaauaaccauuauauucuccacaauagcuuuuucagacgcgagaucaaacggagaccccuguuucgcuccugcuucauucugcucccguaccugcaaacccuugggggagugccuacgcaggcgcccccuccccuggaggccacaucuagcucccagaucauuuguccugauggcguuaccagcgccaacuuuuaucccgaaaccuggguguacaugcauccgucucaggacuucauccaagucccuguguccgcugaggacaagagcuaucggaucauuuacaaucucuuucacaaaacaguucccgaguucaaguauagaauccugcagauucuucgcgugcagaaccaguuucugugggaaaaauacaagcggaagaaagaguacaugaauagaaagauguucgggcgcgaucggaucauuaacgaaagacaucucuuucacggaaccucccaagacgucguggauggcaucugcaaacacaauuucgacccccgcgucugcggcaagcaugccacaauguucgggcagggaucuuauuuugcuaaaaaggccagcuacucccacaacuucucuaagaaaagcuccaagggcgugcauuuuauguuccuggcgaaaguucugacggggcgguauaccaugggaagccacggcaugagacggccuccgcccgugaauccugggucugucacauccgaucucuacgacagcuguguggauaacuuuuucgagccccagaucuuuguuauuuucaaugacgaucagucuuauccuuacuuugugauccaauaugaagaggucuccaacaccgugagcauuuga

SEQ ID NO: 76871 - RNA, 603 nt, Artificial Sequence
  derived and/or modified sequence opt5 from TIPIN__Homo_sapiens__NP_001276915
augcugaucagacacauggagcauugggcccaccgccucuuccccaagcugcaguuugaagacuucauugaucggguggaguaccuuggcagcaaaaaggaaguccaaaccugccugaaaagaauccggcucgaccugccuauucuucaugaggauuuuguuuccaacaaugacgaaguggcugagaacaaugagcacgaugugacaucuacggaacuggacccguuccucaccaaccugagcgaguccgaaauguuugccucugagcugagccgcucccucacagaggaacagcagcagagaaucgagcggaauaagcaacuggcgcuugaacgcagacaggcuaaacugcucucuaacagccagacccuggggaaugauaugcuuaugaacacaccccgggcccauaccgucgaggaagugaauacagacgaggaucagaaggaggaauccaacggacugaaugaggacauucucgauaacccuuguaaugacgccaucgcuaacacccugaaugaagaggaaacgcugcucgaucagagcuucaagaacguucaacagcagcuggacgccaccucucgcaacaucacagaggcuagauga

SEQ ID NO: 76872 - RNA, 537 nt, Artificial Sequence
  derived and/or modified sequence opt5 from TIPRL__Homo_sapiens__NP_001026970
augaugauccacggcuuccagagcucccauagagacuuuugcuucgggcccuggaagcugaccgccucuaaaacacacauuaugaaaagcgcugauguggagaagcucgccgacgaacugcauaugccuucccuuccggagaugauguuuggagauaacguccugcggauccaacacggcucuggguucggaauugaauuuaaugcgacggacgcucuccgcuguguuaacaauuaccagggcaugcugaagguggccugcgccgaggaauggcaggagagcagaaccgagggggaacauuccaaagaggugaucaagcccuaugauuggacauacaccacagacuauaagggaacccuucugggcgaaucucucaaacugaaggucgugccuacaaccgaucacauugacacggagaaacugaaggcucgggagcagaucaaauucuuugaagagguucuccuguucgaagaugagcuucacgaccauggcgugagcucccugagcgucaagauccccgggggaggccaccucuga

SEQ ID NO: 76873 - RNA, 1035 nt, Artificial Sequence
  derived and/or modified sequence opt5 from TIRAP__Homo_sapiens__XP_005271456
augcagaagcccggcuggcaagggcugggaccucaguggacccagggccucccgagacccgccagcccugcugccgggcugugcccccgggugucccgcgucuggacaggaccuggcgggguuggaggcgcggugagacgggcugcccuucccgagucuggcgccugugcucuccuguucccugccgaaccggcucagagcgcccaacccuccucucagcuggggccucgcgcgggauggcuucugcacgaggugaaaacgggcagcccucccuccucucccuuuaccaacgccuggagccauggggcuuccuucgacccgcacgccauggcuagcucuacaucccucccugcccccggaagcagaccuaagaaaccccugggcaagauggcggauugguuucggcagacccugcucaaaaagcccaagaaacgcccuaauucuccggaauccacaagcucugacgccucccagcccaccagccaagauuccccucugcccccuucucuuagcuccgucacaagccccucucugccgccuacccaugcuuccgacagcgggucuagcagaugguccaaggauuacgacgugugcguuugucacucugaggaagaucucguggccgcucaggaccuggucagcuaucuugagggauccacggccagccugcggugcuuccuccagcugcgcgaugccacccccggcggcgcuaucgugucugagcugugucaggcgcucuccagcucucauugcagaguucugcuuauuacaccuggguuucugcaagaccccugguguaaauaccagaugcuccaggcccugaccgaagcuccuggagccgagggcugcacaaucccccuucuguccgggcucagccgggccgcuuauccgccugaacugcgcuucauguacuauguggauggaagaggccccgacgggggauuucggcaagucaaggaggccgugaugcgcuguaaacugcuccaggagggcgaaggcgagagagauuccgcgaccgugucugaccugcuuuga

SEQ ID NO: 76874 - RNA, 5247 nt, Artificial Sequence
  derived and/or modified sequence opt5 from TJP1__Homo_sapiens__NP_003248
augagcgcuagagcugccgccgcuaaguccaccgccauggaggaaaccgccaucugggagcagcacacggugacccuccaucgggcucccggcuucggguuugggauugccaucucuggcgggagagacaacccucacuuccaaagcggagaaacauccauugucaucucugauguucucaaaggcgggccggcugagggacagcugcaggaaaaugacagaguggccauggugaacggcgucagcauggauaauguggagcaugcguuugccguucagcaacuucggaaguccggcaaaaacgcuaagauuaccaucagacgcaagaagaaggugcagauccccgucucucggccugaccccgagccugugagcgauaaugaagaggacuccuacgaugaagagauucacgaccccagaagcgggagaucuggaguugugaaccggcgcuccgagaaaaucuggccuagagaucggagcgccucucgcgaaagaucccugagcccgcggucugaccgcagauccgucgcuagcucccagcccgccaagccuacaaaagugacccucgugaagucucggaaaaaugaggaauacggccugagacuugcgagccauauuuucgucaaggagaucucccaggauagccuggccgcucgcgacgggaacauucaagaaggagauguugugcucaagaucaauggcacagugaccgagaacaugucucugacggacgccaaaacccugauugagcgguccaaggggaaacucaagauggucgugcagagagacgaacgcgcuacacugcuuaauguucccgaucugagcgacucuauccacagcgccaacgccuccgagcgggaugacaucucugaaauucagagccucgcuuccgaucacagcggaagaucucaugaccgcccuccccggagaucccgcagccggucuccggaucagagauccgagccuagcgaccacucccgccauucuccccaacagccuagcaauggcucccugcggucuagagaugaggaacggaucagcaaacccggcgcgguguccacccccgucaagcacgccgacgaucacacaccuaaaaccguggaggaaguuacgguggagcgcaacgaaaagcagacaccgagccuucccgagccuaagcccgucuacgcucaaguggggcagccugacgucgaccugcccgugucuccguccgauggaguucucccuaauagcacccaugaagacggcauucugagacccucuaugaaacuggugaaguuucggaaaggggauuccgucggacucagacuggccggcgggaacgacgugggaaucuucguugccggcgugcuugaggauagcccugcugccaaggagggccuggaagagggggaccagauucuccgcgucaacaauguggauuuuacaaacaucauccgggaagaggcggugcuguuccuucuggaccuccccaaaggagaggaaguuaccauucuggcucagaagaagaaagaugucuauagacgcaucguggagucugacgugggcgauagcuuuuacauuagaacccacuucgaauaugagaaggaauccccuuacgggcugagcuuuaauaaaggagaggucuuccgggugguugacacacucuauaacggcaagcuggggucuuggcuugccauccgcauuggcaaaaaucauaaggagguggaaagaggaaucauccccaacaagaaucgggccgagcaacuggcuuccguccaguacacgcucccgaaaaccgccggcggggaucgcgcugacuuuuggagauuccggggacugcgcagcuccaagagaaaccuucggaaaucucgcgaagaccugagcgcccagccugugcagacaaaguuccccgcguacgagagaguugugcuccgggaagccggcuuucugagacccgucaccauuuucgggccuaucgcugauguggcccgcgagaaacuggcucgggaggaaccggacauuuaucaaaucgccaaguccgagcccagagaugcgggaacagaccagcgcucuagcggcauuauccggcuccacaccauuaagcagaucaucgaucaggacaaacaugcccugcuugauguuacgccuaaugcuguggacagacugaacuacgcccaaugguaucccauugucguguuucucaauccugauuccaagcagggggugaaaacaaugcgcaugcggcugugccccgaaucuagaaagagcgcucgcaaacuguacgagcggucccacaaacuucgcaaaaacaaucaccaucucuucaccaccacaaucaaccugaauagcaugaacgacggcugguauggagcccugaaggaagccauucagcagcaacagaaccagcucgucuggguuucugagggcaaggcugauggggcgaccuccgacgaucuggaccuucacgacgaucggcugagcuaccucucugccccuggauccgaguauagcauguacucuacagacucccgccauacgagcgauuacgaagacaccgauacagagggcggggcuuauaccgaccaagaacuggaugagacacugaaugacgaggugggaacaccucccgaauccgccaucacgagaagcucugagccugugcgggaagauagcuccggcaugcaccacgagaaccagaccuaucccccuuauucuccccaggcccagccgcaaccuauucaucgcaucgacagccccggguuuaaaccugcuucccagcagaaggccgaagcgucuagccccguccccuaccuuuccccugagacaaauccggcuucuagcaccuccgccgugaaccacaauguuaaccucacaaaugugagacuggaggaacccaccccugcccccagcacgucuuauuccccucaggcugauagccugcggacacccucuaccgaggccgcgcauaucaugcucagagaccaagaaccuucccugagcucccacgucgacccgacaaaaguguaccgcaaggaucccuauccugaggaaaugaugcggcagaaccauguucuuaaacagcccgcugugucucacccuggccacagacccgacaaggagccgaaucugaccuacgagccucagcuccccuacgucgaaaagcaagccagccgcgaucuggagcagcccaccuaucgguacgaauccagcucuuauacagaccaguucuccagaaacuacgagcaucgccugcgguaugaagauagagugccuauguacgaggagcaauggagcuauuacgacgauaaacagcccuacccuucucgcccgcccuuugacaaucagcacagccaggaucuugacuccagacaacauccugaagagucuagcgaacggggauauuucccccgcuuugaggagccugcgccccucuccuacgauucuagaccgcgguaugaacaggcuccucgcgccagcgcucugagacacgaggaacagcccgccccuggcuacgacacgcaugggcggcugagacccgaggcgcagccucaccccuccgccggaccgaagccugcugaaagcaaacaauauuucgagcaguacucucgcuccuaugagcagguuccgccccaaggcuuuaccagccgggccgggcacuucgaaccucuccauggagcugccgccgugccgccccugauuccuuccucucaacacaagcccgaggcccuuccuagcaacacaaaaccccugccuccgcccccuacccagacagaagaggaagaggaucccgcgaugaagccucaguccguccucaccagagugaagauguuugagaauaaacgcucugccagccuggaaacgaagaaagacgugaacgacacaggcuccuucaagcccccggaggucgcuagcaaaccuucuggggcccccaucauuggccccaagccuaccucccagaaucaauucagcgaacaugauaagacccuguaccggauccccgagccucagaaaccgcagcuuaagcccccugaagacauuguuagaucuaaccacuacgaucccgaggaggacgaagaguauuaccggaaacaacucuccuauuuugaucgccgcagcuucgaaaacaagccucccgcccacaucgcugccucucaucugagcgagccggcgaaaccugcucacucccagaaucagucuaacuuuagcuccuacagcuccaagggaaaacccccugaggccgacggcguggaucggucuuucggggaaaagcgcuaugagcccauccaggccacaccucccccgccuccccugcccagccaauacgcucagccuucccagccggugaccucugccagccuccauauucacuccaagggagcgcauggcgaaggaaauucugucagccuggacuuucagaacucccuugugagcaaacccgauccucccccuucucaaaauaagcccgcuacauucagaccucccaaccgggaggacacggcccaggccgcuuuuuauccgcagaaauccuucccugauaaggcccccguuaauggaaccgaacagacacagaaaaccgugacacccgcuuacaaccgcuuuacccccaagccguacacgagcucugccagaccuuucgagcggaaguuugagucccccaaauucaaucacaaccugcuccccagcgaaaccgcgcacaagccugaccugucuuccaaaacacccaccagcccuaagacacuggucaaaucccauagccuugcccagccgcccgaguuugauucuggcguggaaaccuucagcauccacgcugagaagccuaaguaucagauuaauaacaucuccacaguucccaaagccauuccugugucucccagcgcugucgaagaggacgaggacgaagauggccauaccguggucgccacggcccgcgggaucuucaauuccaacggaggcgugcugucuagcaucgagacagggguuuccauuaucauuccucaaggagcuaucccggaaggcguggagcaggaaauuuacuuuaaggucuguagagacaauucuauccugcccccucuggauaaagagaagggggagacccuccugagcccccuugugaugugcggaccucacggccugaaauuccucaagcccguugaacugcggcugccgcacugugacccuaagaccuggcagaacaaaugccuucccggcgaucccaacuaucuggugggggcgaauugugucuccgugcucauugaccauuuuuga

SEQ ID NO: 76875 - RNA, 3063 nt, Artificial Sequence
  derived and/or modified sequence opt5 from TJP2__Homo_sapiens__NP_001163885
auggaggaacugaucugggagcaguacaccgugacacuccaaaaggacagcaaaagaggcuucgggauugccgucuccggaggccgggauaacccccacuuugaaaauggggagacgucuaucguuauuagcgacgugcugccuggaggcccggcugaugggcuucugcaggaaaacgaccgcguggucauggugaauggaacccccauggaggauguucuccauuccuucgccgugcagcagcugagaaagucuggcaaagucgcggcuaucgugguuaagcggccucgcaaagugcaagucgccgcccuucaggcuagcccuccccuggaccaggaugacagagccuuugaggugauggaugaguucgacggccgguccuuucgcucuggguauagcgaaagaucccggcucaacagccacggaggccgcucuagauccugggaagauagccccgagcgggggcgcccucaugagagagcucggucucgcgaaagagaccugucccgggauagaagccgcggacggucucuggagagaggccucgaccaggaccacgcccgcacacgggauagaucccgcgggcggagccuggaaagaggacuugaccaugauuucggcccgucccgcgaccgggauagagaccgcucucggggcagaagcauugaucaagacuacgagcgggcguaucaccgcgccuacgaucccgacuaugaaagagcuuacuccccugaguaucggagaggggcccgccacgaugcucggagcagaggaccccgcucuagaucccgggagcauccucacagccgcucucccagcccggaaccuagaggccggcccgggccuaucggagugcugcucaugaagucccgcgccaaugaggaauacggccugagacuugggucucagaucuuugucaaggagaugacccggacaggacuggcgaccaaagacggcaaccuccaugaaggcgacauuauccugaagauuaaugggacaguuaccgagaacaugagccugacggaugcccgcaaacucaucgagaaguccagaggaaaacugcagcuuguggugcugcgggacagccagcaaacccucauuaauauccccucucugaacgauuccgacagcgaaauugaggauaucucugaaaucgaguccaaucgcagcuucucccccgaagagagacggcaccaguacucugacuaugauuaccacagcuccucugagaaacuuaaggaaagaccuagcucccgcgaggacacaccgagccggcugucuagaaugggcgcuacccccacaccuuuuaaguccaccggggauauugccggaacggucgugcccgaaacaaacaaggagccucgcuaucaggaggaucccccggcuccucaacccaaagccgccccucggaccuuccucagacccagcccugaagacgaggcuaucuacggccccaauacaaagaugguucgcuuuaaaaagggggacucugugggccugcggcuggcgggaggcaacgaugucgggauuuucguggccggaauccaggaaggcaccuccgcugagcaggaagggcuccaggagggagaccaaauucugaaaguuaauacccaggacuuuagaggccuugugcgcgaggaugccguccuguaucuccuggaaaucccgaagggggagauggugacaauccuugcccagagccgggcugacgucuacagagauauucuggccugcggccggggagacucuuucuucauccgcagccauuuugaaugugagaaggaaacgccucagucccucgcguucaccagaggcgagguguuucggguuguggauacacuguaugacgggaaacugggaaacuggcucgcuguccgcauuggcaacgagcuggaaaaggggcuuauccccaauaaaagcagagccgagcaaauggccucugugcagaacgcucagcgggauaaugccggagacagagcugauuucuggcgcaugcggggccagagauccgggguuaagaaaaaccugcgcaagagccgggaagaccucaccgccguggucuccgugucuacaaaguuucccgcguacgagagagugcugcugcgcgaagccggcuucaaacggccuguuguccuuuuuggaccgauugcugauaucgccauggagaagcucgcuaaugagcugcccgacugguuccaaaccgccaaaacggaaccuaaggaugcgggcagcgagaaauccacagggguggugagacugaacaccguccgccagaucauugaacaggacaagcacgcccuccuggacgugacccccaaggcuguugaucuucugaauuacacacagugguuuccuaucgugauuuucuuuaaccccgacucuagacaaggagucaaaaccaugcggcagcgccucaauccuacaagcaacaaguccucuagaaaacuguucgaucaggccaauaagcugaaaaagacgugcgcucaucuuuuuaccgccacaaucaaccucaauagcgccaacgacuccugguucggcagccugaaggauaccauucaacaccagcagggggaggcuguguggguuucugagggaaaaauggaaggcauggacgaugaccccgaggaucggauguccuaucugacagcgaugggggccgacuaccucagcugugauucucgccugaucuccgacuucgaagacaccgauggcgagggaggcgcuuauacggacaaugaacuugaugagccggccgaggaaccucuggugagcucuauuaccagauccagcgagcccguccagcaugaagagaucgaaaucgcccaaaagcacccugacauuuacgcugugcccaucaaaacacacaagccggauccugggacaccccagcauaccuccagccggccucccgagccccagaaagccccuucuagaccguaucaggacacccgcggaagcuacggcuccgaugcggaggaagaggaauaucggcaacagcucucugagcacagcaagagaggguacuacggacaguccgcucgcuaucgggacacggaacuguga

SEQ ID NO: 76876 - RNA, 2760 nt, Artificial Sequence
  derived and/or modified sequence opt5 from TJP3__Homo_sapiens__NP_001254489
auggaggaacugaccaucugggagcagcacacagccacgcucagcaaggaccccagacggggcuucgggauugcuaucuccggaggccgcgauagaccugggggaucuaugguggucagcgacguugugccgggcgggcccgccgaaggacggcugcaaaccggcgaucauauugugauggucaacggcguguccauggagaaugcgacaucugcuuuugccauccagauucuuaaaaccugcacaaagauggccaacaucaccguuaaacgcccuagacggauccaucugcccgcuacaaaggccagcccuuccucucccgggcgccaggacagcgaugaagacgauggaccucagagaguggaggaggucgaccaaggccggggguacgauggagacuccagcucuggcuccgggcgcagcugggaugaaagaucucggcgcccgagacccggacggcgcggcagagcuggcucccacgggcggagaagcccuggaggcgggucugaggccaauggacucgcgcugguguccggcuucaaacgccuuccccggcaggacguucagaugaagccugucaagagcgugcuggugaaaagacgcgauuccgaagaguuuggggugaagcucggaucucagauuuucaucaaacacauuaccgacagcggccuggccgcucggcauagaggccugcaagagggggaccucauccugcagauuaacggagucuccagccagaaucuuucucugaacgauacgcgccggcucaucgaaaaguccgagggcaaacugagccuucugguucucagagaccgcgggcaguuucuggugaauauucccccggccgugucugauagcgacuccucuccucuggaagauaucagcgaccucgcuuccgagcugagccaagcgcccccuucucacauucccccucccccgcggcacgcccagagaucccccgaagccagccagaccgauucuccugucgagagcccccgccuucggagagaguccuccguggacucucggacaaucagcgaaccugaugagcaacgcuccgaacugcccagagagucuagcuaugacaucuaccggguuccguccagccagucuauggaagauagaggauauuccccugacacccgcgugguccgguuccucaagggcaagagcauugggcugagacuugcuggcggaaacgacgugggcaucuuuguuucuggggugcaggccggaucccccgcugauggccaggggauucaagagggagaccagauccugcaggucaaugaugugccuuuccagaaccucacacgcgaggaagccguccaauuucugcugggccugcccccuggggaggaaauggagcucgugacccagagaaaacaggacaucuucuggaagaugguucagagccgggugggcgauucuuuuuacauucgcacgcauuucgaacuugagcccagcccgccuuccggacugggcuuuacaagaggggacgucuuccacgugcucgauacccugcaucccggacccggccaaagccacgcccgcgggggacacuggcuugcuguucggaugggcagagaccugcgggagcaggaacgcgggaucauuccuaaucagucuagagcggagcagcucgccucccuggaagcugcccaacgggccgugggcgucggaccgggcagcuccgcugggucuaacgcccgcgcggaguucuggagacugcggggacucagacgcggcgcuaaaaagacaacccagcggagcagagaggaucuguccgcccuuacccgccaggggcgguaucccccuuacgaaagaguggugcugcgcgaggccucuuuuaaacggcccguugucauccucggaccuguggcugacauugccaugcaaaagcugacagcugaaaugcccgaucaguucgagaucgccgaaacggugagcagaaccgacuccccuucuaaaaucauuaagcuggauacaguccgcgugaucgcggagaaggacaaacaugcccuucucgacguuacccccagcgcuauugagcggcugaauuaugugcaguacuacccgaucgucguguuuuucauuccugaauccagacccgcccugaaggcucuccggcaguggcuggccccugcgagccgcagaucuacacggcgccuuuaugcccaagcucagaaacugagaaagcacuccagccaucucuuuaccgccacgaucccccugaacggcacaucugauaccugguaccaggagcugaaagcuauuauccgggaacagcaaaccagaccgaucuggacagccgaggaccagcuugaugggucccucgaagacaaucuggaucugccucaccauggccucgccgacagcucugcugaucuguccugugacagccgcguuaacuccgauuaugagaccgacggagagggcggggcguacacagauggagaaggcuauacggacggggagggaggccccuacaccgauguggacgacgaaccucccgcccccgcucuugcccggagcucugagccuguccaggccgaugaaagccaguccccgagagaccgcggccggauuucugcucaccaaggggcccagguggauagcagacacccccagggacaauggcgccaggacuccaugcggacauaugagagagaggcgcugaagaagaaauucaugcgcguucaugaugcugaaucuagcgacgaggauggcuacgacugggggccugccaccgaucucuga

SEQ ID NO: 76877 - RNA, 705 nt, Artificial Sequence
  derived and/or modified sequence opt5 from TK1__Homo_sapiens__NP_003249
augagcugcaucaaccugcccaccgugcucccuggcuccccgucuaagacaagagggcagauucaagucauccugggacccauguucagcggcaaauccacggagcuuaugcggcgcguuagacgguuucagauugcccaguacaagugucuggugaucaaauaugcuaaggacacccgcuacucuagcuccuucugcacacacgauagaaauaccauggaagcccucccugcgugucugcuucgggacguggcucaggaggcccugggggucgccgugauuggaaucgaugaaggccaauuuuuccccgacaucguugaguuuugcgaagcuauggccaacgcugggaaaacagugauugucgccgcgcucgauggaaccuuccagcgcaagccuuuuggcgccauccugaaucuggugccccucgcugagucuguugugaagcugacagccgucuguauggagugcuucagagaagcugccuauaccaaacggcuuggcacggagaaggaaguggaggugauugggggagcggacaaauaccauagcgucugucgccugugcuauuuuaagaaagccuccggccagccugcugggccggauaacaaggagaauugucccguuccuggaaagcccggcgaagccguggcugccagaaaacucuucgccccucagcaaauccugcagugcagccccgcuaacuga

SEQ ID NO: 76878 - RNA, 705 nt, Artificial Sequence
  derived and/or modified sequence opt5 from TK2__Homo_sapiens__NP_001166114
augggcgccuucugccagagacccagcuccgacaaggagcaagaaaaagagaagaaaucugugaucugugucgaagggaacauugcuagcggaaagaccacaugccuggaguuuuucuccaaugccacggauguugaagugcucaccgagccugugucuaaauggcggaacguccgcggccacaauccgcuggggcuuauguaccaugacgcgagcagauggggacugacacuccagaccuaugugcagcugacaaugcuugaucggcacacccgcccccagguuuccucugugagacugauggagcggagcauccauuccgcucgcuacauuuuugucgaaaaccucuauagaagcggcaagaugccugagguggacuacguugugcugucugaaugguucgauuggauccugcggaauauggacgucuccguggaucucauuguguaucugcgcacaaaccccgagaccuguuaccaaagacuuaagaaacggugccgcgaggaagagaaggucaucccucuggaauaucucgaggccauccaccaucugcacgaagaguggcuuauuaaagggagccuguuucccauggccgcuccuguucucgugaucgaggccgaccaccauauggaaagaaugcuggagcuguucgaacagaaucgggaucgcauucucacgccggagaacagaaagcacugucccuga

SEQ ID NO: 76879 - RNA, 1872 nt, Artificial Sequence
  derived and/or modified sequence opt5 from TKT__Homo_sapiens__NP_001128527
auggagagcuaccacaagcccgaccagcaaaaacugcaggcccucaaggauaccgcuaacagacugcggaucuccucuauucaggccacaacggcggcuggcagcgggcauccuaccuccugcuguucugccgccgaaaucauggcugugcuuuucuuucacacaaugcgcuauaaaagccaggacccgagaaauccccauaacgaucgguucguccuguccaagggacacgccgcuccuauucucuacgccguuugggcggaggccggcuuucuggcugaagccgagcuucugaaucuccgcaaaaucucuagcgaccuggaugggcaucccgugccuaagcaggcuuucaccgacguggccacaggaucccugggccaagggcucggagcggccugcggcauggcuuauaccggcaaguacuuugauaaagccagcuauagagucuacugucugcuuggggacggagaacugucugagggcuccgugugggaggcuauggccuucgccagcauuuauaagcucgauaaccugguugcuauccuugacaucaaucggcuggggcagucugaucccgcgccucuccagcaccaaauggacauuuaccagaaacgcugcgaagccuuuggauggcacgcuaucauuguggauggccauuccgucgaggaacuguguaaggccuucgggcaggccaaacaccagccgacagcuaucauugccaagaccuuuaagggaagaggcaucacgggcguggaggacaaagagagcuggcaugggaagccccugccuaaaaacauggcggaacaaauuauccaggagaucuacucucagauucaauccaagaaaaagauccucgcuacacccccucaggaagacgcccccagcguugauauugccaauauccggaugccgucccugccuucuuauaaagugggagacaagauugcuacccgcaaggccuacggccaggcucuugccaaacuggggcacgcgagcgauagaaucaucgcccucgacggagauaccaagaacuccacauucagcgagauuuuuaaaaaggaacaccccgaccgguucaucgagugcuauauugcugagcagaauauggucucuaucgccgugggcugugcuacccgcaacagaacggugccuuuuugcuccacauucgccgcguucuuuacccgggccuucgaucaaauucgcauggcugccaucagcgaaucuaauaucaaccugugugggagccauugcggagucuccauuggcgaggacggccccucucagauggcucuugaagaucuggccauguuuagaagcguucccacauccaccguguucuacccuagcgacgggguggccaccgagaaagcugucgaacucgcggccaauacaaagggaaucuguuuuauucggacgucuagaccggagaacgcuaucauuuauaauaacaacgaggauuuccaggugggccaggccaagguugugcugaaauccaaggacgaccaagucaccgugaucggggccggaguuacacugcacgaagcucucgccgcggcugagcugcuuaaaaaggagaaaauuaauauccgcgugcuggaucccuuuaccaucaagccucucgaccggaagcugauucuugauagcgccagagccacaaaaggccgcauccugaccgucgaagaccauuacuaugaagggggcauuggagaggcugugucuuccgccgucgugggcgagcccgggaucacgguuacacaccucgcggugaaccgggucccuagaagcggaaagcccgcugaacugcugaaaauguucggcauugaucgcgacgccaucgcccaggcugugcgggggcucaucaccaaggccuga

SEQ ID NO: 76880 - RNA, 1773 nt, Artificial Sequence
  derived and/or modified sequence opt5 from TKTL1__Homo_sapiens__NP_001139405
auggccgacgcugaggccagagcggaauuucccgaggaagcucggccugaucgcggcacccuucaggugcuccaagacauggccagcagacugcggauccacuccauucgcgccacaugcucuacgagcuccgggucuagcuccgagaucaugucuguccuuuucuucuacauuaugagauauaagcagagcgauccggaaaaccccgacaaugaucgguuuguucuggcuaaacgccucuccuucguggacguggccaccggauggcugggccaggggcuuggagucgcuuguggcauggccuacacagggaaguauuuugauagagcgagcuaccggguguucugccugaugucugacggagaguccagcgagggcucuguuugggaagccauggcuuuugccuccuauuacagccucgauaaccugguggcuaucuucgacgucaaucgccugggccauucuggggcccucccugcggagcacuguauuaacaucuaucagagacggugcgaagccuuuggauggaauaccuacgugguugauggccgcgacguggaggcucugugucaagucuucuggcaggccucccaggugaaacauaagcccacagcuguggucgccaaaaccuuuaaggggagaggaacaccuagcaucgaggaugccgaauccuggcacgcuaagcccaugccucgggagcgcgcggacgccauuaucaaacuuauugaaucucagauccaaaccagcagaaaccuggacccgcagcccccuauugaggauucccccgaaguuaauaucacggacgugcggaugaccagcccucccgauuacagagugggcgacaagauugcuacacgcaaagccugcgggcucgcccuggcuaagcugggauaugccaacaaucgggucgugguucuggauggcgacaccagauacucuacauucuccgagaucuuuaacaaagaguauccggaacgcuucaucgaguguuucauggcggaacagaauauggugagcgucgcucucggcugcgccucucgggggagaaccauugccuuugcuagcacguucgccgcuuuucugacacgcgccuucgaucauauccggauuggaggccuggcggaguccaacaucaauauuaucgggucucacuguggagugagcguuggcgacgauggggccucccagauggcucucgaagacaucgccauguuuagaaccauuccuaagugcacaaucuucuaccccaccgaugcugugagcaccgagcacgccgucgcgcuggccgcuaacgccaagggaauguguuuuauucgcacaacgcggccugagaccauggugaucuauacaccccaagaaagauucgagauuggccaggcuaaaguccuucgccauugcgugucugacaagguuaccgugaucggcgccgggaucacagucuacgaagcccuggcugcggccgacgagcucuccaaacaggauauuuuuauccgggugauugaccuguucaccaucaagccccuugauguugcuacgauugugagcucugccaaagccacagaaggaagaaucauuaccgucgaggaccacuauccucaaggcgggaucggagaggcugugugcgccgcgguguccauggauccggacauccagguucauagccuggcugucuccggcgugccccagucuggcaagagcgaggaacuccuggauauguacgggauuuccgcccggcacaucauuguggccgucaaauguaugcugcucaauuga

SEQ ID NO: 76881 - RNA, 1881 nt, Artificial Sequence
  derived and/or modified sequence opt5 from TKTL2__Homo_sapiens__NP_115512
augauggccaacgacgcuaagcccgaugugaaaaccguccagguucugagagacacagccaaucggcuccgcauccacagcauuagagcgacgugcgcuuccggcucugggcaacugaccagcuguugcuccgccgccgagguggugucuguccuuuucuuucauacaaugaaguacaaacagaccgauccugaacacccggacaacgaucgguucauccugagccgcggacaugcugcccccauucucuaugcugccuggguggagguuggcgacaucuccgaaucugaucugcuuaaucugagaaagcuccacagcgaccuggagcggcauccuacaccccgccugccuuuuguggaugucgcgaccgggucccucggacagggccuggggacagccuguggaauggcuuacaccggcaaauaucuugacaaggccagcuacagaguguucugccugaugggcgauggggaaucuuccgagggaagcguuugggaggcuuuugccuucgcgucucacuauaaccucgacaaucugguggccgucuuugaugugaaccggcuuggccaguccgggcccgcuccucuggaacacggagccgacauuuaccaaaauuguugcgaggcuuucggcuggaacacguaucucguggacgggcaugaugucgaagcccugugucaggccuuuuggcaggcuagccagguuaagaauaaaccgaccgcgaucguggccaagacauucaaaggacgcggcauccccaacauugaggacgcugagaauuggcacggcaagccugugcccaaagaaagagccgaugccaucgucaagcugauugagucucaaauccagaccaacgaaaaucucauuccuaagucccccguggaggacagcccgcagaucuccauuacagauaucaaaaugaccucuccucccgcuuacaagguuggggacaaaaucgccacgcagaagacauacggacuggcgcuugcuaaacugggccgggccaacgaacgcgugauuguccucagcggggauaccaugaacuccacauuuagcgagaucuucagaaaggagcauccugaacgguuuauugagugcaucauugccgaacaaaauauggugucuguugcucugggaugugccacccgcggcagaaccaucgcuuucgccggggcguucgccgccuuuuucacacgggcuuuugaccagcuuagaaugggagcuaucucccaggccaacauuaaucugaucggcagccacugcggcgugucuacgggggaggauggagucagccaaauggcgcucgaagaccuggccauguuccgcuccauucccaacuguaccguguuuuaucccucugaugcuaucagcacagagcacgccauuuaccuggcugccaauaccaaaggcaugugcuucauccggacaucccagccugagaccgccgucaucuauacgccgcaggaaaacuuugagauugggcaggcuaaggugguuagacauggagugaaugacaaggucacagugaucggcgcggggguuacccuccacgaagcccuggaggcugccgaccaucuuagccaacagggcauuucugugcgcgucaucgaucccuucaccauuaaaccucuggacgccgcuacaaucauuuccagcgccaaggcgaccggaggccgggugaucacaguggaagaucacuacagagaagggggaaucggcgaggcuguuugcgccgccgucucucgcgagcccgacauucucgugcaucagcuggcuguguccggggucccucagcggggaaaaacgagcgagcuucuggauauguuuggcaucuccaccagacacauuaucgccgcggugacacucacccugaugaaguga

SEQ ID NO: 76882 - RNA, 1485 nt, Artificial Sequence
  derived and/or modified sequence opt5 from TLDC1__Homo_sapiens__XP_005256131
augcugcccggcaacagagagggggccgcucucgaacggagcccuugggccgcgggaccggaccgcaccgcucccggcuccccugccggggaguucugccagaucucuggacaaaugggcaauagcagaucccggguggggcgcucuuuuuguagccaguuccugcccgaggaacaggccgaaauugaucagcuuuuugacgcucuguccucugauaagaacagcccuaaugucuccagcaaaucuuucucccucaaggcccugcaaaaccacguuggagaggcccuucccccugagauggugacaagacuguacgacggcaugcggcgcguggaucucacgggcaaagcuaaggggccgagcgaaaaugucucucaggagcaguuuaccgcguccaugagccaucugcugaaaggaaacucugaagagaagucccucaugaucaugaagaugauuagcgccacagagggccccgugaaagcuagagaaguucagaaguucaccgaggaccuggugggguccgucgugcacguucuuucucaucggcaagaacugcgcggauggacaggcaaagaggccccugggcccaauccuagagugcagguccucgcugcccagcugcuuagcgauaugaagcugcaggacggaaaacggcuccugggcccccaauggcuggauuaugacugcgaucgcgcggugaucgaagacuggguguuuagagucccgcacguugccauuuuccucuccguggugaucuguaagggcuuucugauccuuugcagcucucuggaucucaccacacuggucccugagcgccagguggaccaggggcggggauucgaguccauucuugacguucugagcgugauguacaucaacgcucaacuccccagagaacagcggcauagauggugucugcuguuuucuagcgagcuccacggccacuccuucucucagcugugcgggcauauuacccaccgcggaccuugugucgccgugcuugaagaucaugacaagcacguuuuuggcggguucgcuagcugcuccugggaggugaaaccccaguuccaaggagauaaucgguguuuucuguucagcaucugccccucuauggccgucuauacgcacaccggcuacaacgaccauuauauguaccucaaucacggccagcagacaauuccuaacgggcugggaaugggcgggcagcauaauuauuuuggacuuuggguggaugucgacuucggcaaggggcacuccagagccaaaccgaccuguacaaccuacaacagcccccaacugucugcucaggaaaauuuucaguucgauaagauggaggugugggcgguuggcgacccuuccgaggaacagcucgccaaaggaaacaagagcauccuggaugcugaccccgaggcccaagcccugcucgaaauuuccggccauucucgccacagcgaggggcugcgggaagugccugaugacgaguga

SEQ ID NO: 76883 - RNA, 2343 nt, Artificial Sequence
  derived and/or modified sequence opt5 from TLE1__Homo_sapiens__NP_001290032
auguucccccagagcagacacccuaccccgcaucaagccgcuggccagcccuuuaaguucacaaucccugagucccuggaccggauuaaagaagaguuucaguuccuccaggcccaauaccacucucugaagcuggaaugcgagaaacuggcgagcgaaaagacggagaugcagcgccauuaugugauguacuaugagauguccuacgggcucaacaucgaaaugcacaaacagaccgagauugcuaagagacugaauacaaucugugcccaggucauucccuuucuuucucaagaacaucagcagcagguugcccaagcuguggagcgggccaaacaggugaccauggcugagcugaacgccaucaucggaguccgcggccucccugggcugcccccuacacagcaacagcugcaggcgcagcaccucagccacggacauggcccgcccgugccucugacaccccacccuuccgggcuucaacccccgggcauuccuccccugggaggcucugccgggcuccuggcucuuagcuccgcccugagcggacagucucaucucgcuaucaaggaugacaagaaacaccacgaugccgaacaucacagagaccgggagccuggcaccuccaauagccugcugguucccgauucucuccgcgggaccgacaagagacggaacggacccgaguucuccaaugauauuaaaaagcgcaagguggacgauaaagacagcucucauuaugauuccgacggcgauaagagcgacgacaaccuggucguggauguuuccaaugaagacccuucuagcccgagagcgucccccgcccacagcccucgggaaaacgggaucgauaaaaaucgccuucugaagaaagacgcuucuuccagccccgccucuacggcuagcuccgccucuagcaccucccucaagagcaaagagaugucucugcaugagaaggccuccacaccugugcuuaagagcucuacccccacaccgagauccgauaugccuacccccggaacgagcgcuacaccuggccugcggcccggccucgggaaaccucccgcgauugacccgcuggucaaccaggccgcugccggacugcgcaccccucucgccgugcccggccccuacccugcuccguuugggauggugccccacgccggaaugaauggcgaacugacauccccuggggcggcuuaugccucucuucacaacaugagcccccagauguccgccgcugccgcugccgcggccgucguugcuuacggaagaucuccuauggugggcuucgaucccccuccccauaugcgggugccgaccaucccucccaaucuggccggcauuccugggggaaagcccgcuuacagcuuucacgucaccgccgacggccaaaugcagccggugccuuuucccccugaugcgcucaucgggcccggaauccccagacaugcccgccagauuaacacacugaaucacggcgagguugugugcgcugucacgaucuccaacccuacccggcacguguauacagggggcaaaggauguguuaaggugugggacauuagccauccgggcaacaaaucucccgucucccagcuugauugccugaauagagacaacuacauccgcagcuguaagcuccugccugacgggugcacccugauugugggaggcgaagccucuacacucuccaucugggaucuggcugcccccaccccucggaucaaggccgagcuuacgagcucugcucccgcguguuaugcccuggcuauuagcccugacuccaaagucugcuucagcuguugcucugaugggaauaucgccgugugggaccuccacaaccaaacacugguuagacaguuccagggacauaccgauggcgccuccuguauugacaucagcaaugaugggaccaagcuguggacaggcggacuugacaacaccgugcgcuccugggaucuccgggaaggcagacagcugcaacagcacgacuuuacaucucagauuuucagccugggguacugcccgacgggagaguggcucgcugucggcauggaguccucuaauguggaaguucugcaugugaacaaacccgauaaguaucaacuucaccuucacgagagcugcguccucucccugaaauucgccuacugugggaagugguuugugucuaccggaaaggacaaucugcuuaacgcguggcgcacaccuuauggcgcuagcaucuuccaguccaaagaaucuagcuccgugcucagcugcgauaucucuguugacgacaaguacauugucaccggguccggcgauaaaaaggccacaguguacgaggugaucuauuga

SEQ ID NO: 76884 - RNA, 2121 nt, Artificial Sequence
  derived and/or modified sequence opt5 from TLE2__Homo_sapiens__NP_001138233
auggugcagagcagacugaccgccacauccgcuucucaagacagccccgccuccggccuccagacgccucugcagucugggcagccguucaaguuuagcauccuugagauuugcgaucggaucaaagaagaguuccaauuucugcaggcgcaguaccacucccucaagcuggaaugugagaaacuugcuucugaaaagaccgagaugcagcgccauuaugucauguacuaugagaugagcuacggacugaacauugaaaugcacaaacaagccgagaucguuaagagacucuccggcauuugcgcccagaucauccccuuccugacacaggaacaucagcaacaggugcugcaggcuguggagcgggccaagcaagucaccgugggggagcucaauagccugauuggacagcagcagcuucaaccucugucucaccaugcucccccuguuccccucacaccucgcccggccggccuggucgggggauccgcgaccggccuucuggcccucagcggcgcucuggccgcucaggcccagcuggcggccgcugugaaagaagacagagccgggguggaggcugaaggaucucggguugagcgcgcccccuccagaagcgccucuccuuccccgccugaaagccucguggaggaggaacggcccuccggccccgggggaggcgggaagcagcgcgcugaugagaaagaaccuucuggacccuaugagagcgacgaagauaaguccgacuacaaccuggucguggaugaggaccaaccuagcgagccucccucucccgcgacaaccccguguggcaaagugcccaucugcauuccugccagacgggaucuugucgacucccccgcuagccuggccucuagccucggcuccccucugccccgcgccaaggaacuuauccugaaugaucucccggcuucuacgccugccagcaaguccugugacagcucucccccucaggaugcguccacccccgggccuagcucugcuucccaccugugccagcuggccgccaaacccgcuccgagcacagacuccguugcccucagaucuccucugacccuuagcucccccuuuacaaccucuuucagccugggaucccacagcacgcucaacggcgaccugucugugcccuccagcuaugugucucuucaucuguccccucaggucagcucuagcgugguuuacgggcgguccccggugauggcuuuugagagccacccccaucuccgcggaucuuccgucagcuccucucugccuagcauucccggcgggaagccugccuacuccuuccacgugucugcggauggacaaaugcagcccguuccuuuucccagcgacgcccuggugggcgcuggcaucccgagacacgcccggcagcuccauacacuggcucacggggaagucgugugugccgucaccauuuccggaucuacacagcauguguauaccggcgggaaaggaugcguuaaggugugggaugucggccaaccuggggcgaaaacccccguggcccagcuugacugucugaauagagauaacuacauccgcagcugcaagcuccugccugacggccggucccugaucguuggaggcgaggcuagcacacuuucuauuugggaucucgccgcucccacgccgagaaucaaagccgaacugaccuccagcgccccugcuuguuaugcgcuggccgugucucccgacgcuaaggucugcuucuccugcuguagcgaugggaauauuguggugugggaccuccagaaccaaacaaugguucgccaguuucagggacacaccgauggcgccucuugcaucgacauuuccgacuacgggacacggcuguggaccggaggccuugauaauacggucagauguugggaccugcgcgaggggcggcagcuccaacagcaugauuucagcucccagaucuuuagccugggccacugcccuaaccaggacuggcuggccgugggaauggagucuagcaauguggaaauccuucacgucagaaagcccgagaaauaucaacuccaucugcacgaauccugugugcugucucucaaguucgcuagcugcguucagggcgugguccugucccccgagcuuuga

SEQ ID NO: 76885 - RNA, 2310 nt, Artificial Sequence
  derived and/or modified sequence opt5 from TLE3__Homo_sapiens__NP_001098662
auguacccccagggcagacacccugccccgcaucaacccgggcagccuggauucaaguuuaccguggcugagagcugcgaccggaucaaagaugaguuccaguuucugcaggcccaauaucacucccucaaggucgaauacgacaaacuggcgaacgaaaagacagagaugcagcgccauuauguuauguacuaugaaaugucuuacggccuuaauauugagaugcacaaacagacggagaucgcuaagagacugaacaccauucucgcccagaucaugcccuuccugagccaagaacaucagcaacagguggcccaggcuguggagcgggccaagcaggucacaaugaccgaacuuaaugcuauuaucgggcagcaacagcugcaggcccagcaccucucccacgcgacacauggaccucccgugcaacugccuccgcaccccucuggccugcagccucccgggaucccucccguuaccggaagcuccucuggccuccuggcccuuggcgcucuggggagccaggcccaucucacagugaaagaugagaagaaccaccacgagcuggaccaucgcgaaagagaguccagcgcuaauaacucugucuccccgagcgaaucucuucgggccuccgagaaacaccgcggaagcgcggauuauucuauggaagccaagaaaagaaaggcugaggagaaggacucccugagccgguacgauuccgacggcgauaaaucugacgaucucgugguugacgugagcaaugaagauccugccacgccccgcgucuccccugcucauagcccucccgagaacgggcuggacaaggccagaucucugaaaaaggacgcccccaccuccccggcuagcguggcgucuagcuccucuacccccagcuccaaaacaaaggaucucggacacaaugacaaaagcucuaccccuggccugaaguccaacacacccaccccucggaaugaugcccccacgccggggacaagcaccacaccuggacuucgcucuaugcccggcaagccucccggcauggacccuauugcuuccgcccugagaacccccaucagcauuaccuccucuuacgccgcuccguuugccaugaugagccaucacgaaaugaacgggucccucacaucuccuggagcguaugcuggccugcacaauaucccuccccagaugagcgccgccgcugccgcugccgcggccgcuuacgggcggucccccauggugagcuucggagccgucggcuuugauccgcaucccccuaugcgcgcuacggggcuucccucuucccuggccagcauuccuggaggcaaacccgcguauucuuuccacguuuccgccgacggccaaaugcagccugugcccuuuccgcaugaugcucucgccgggccuggaauccccagacacgcucggcagauuaacacccugagccacggcgagguggucugugccgugacaaucucuaauccuaccagacauguuuacacagggggaaagggcugcgugaaaaucugggacauuagccagcccggguccaagagcccgaucucucaacuggauugucucaaccgcgacaacuauauucgguccugcaaacugcuuccugauggcagaacccugaucgucggaggcgaagccagcacgcucacaauuugggaccuggcuucccccaccccucgcaucaaggcggagcuuaccucuagcgcccccgcuuguuacgcccuggccaucucccccgacgcuaaggugugcuucucuuguugcagcgaugggaauauugccguuugggaccuccacaaccagacacuggugcggcaguuucagggacauaccgauggcgcguccuguaucgacauuucucacgaugggacaaaacuguggacgggaggccucgacaauaccgucagaagcugggaucugcgcgaggggcggcaacuucagcagcaugacuucacaucccaaaucuuuagccugggcuauugcccuaccggagaauggcucgcugugggcauggagucuuccaacgucgaagugcugcaccacacaaagccggauaaauaccagcugcaucuucacgagagcuguguucucucucugaaguucgccuacugcgggaaaugguucguguccaccggaaaggacaaucugcucaacgccuggagaacgcccuauggcgcuagcauuuuucagucuaaggaauccagcuccguccugagcugcgauaucucugccgacgauaaauacaucgugaccgggagcggagacaagaaagcgacaguuuaugaggugauuuacuga

SEQ ID NO: 76886 - RNA, 2418 nt, Artificial Sequence
  derived and/or modified sequence opt5 from TLE4__Homo_sapiens__NP_001269677
augaucagagaccugagcaagauguacccccagacccggcacccugccccgcaucaacccgcucagccuuucaaauuuacaauuuccgagucuugcgaucgcaucaaggaagaguuccaguuucuccaggcccaauaucacagccugaaacuugaaugugagaagcuggcguccgaaaagacggagaugcagagacauuacgugauguauuacgagaugucuuauggccucaacauugaaaugcacaagcaggcugagaucgucaagcggcugaaugccauuugcgcccagguuauccccuuccuuagccaagaacaucagcaacagguggugcaggcugucgagcgcgccaaacaggugaccauggcugagcugaacgccaucauugggcagcaacuccaggcgcagcaccugucccacggacauggccugccuguuccccucacaccucacccgucugggcugcagcccccugccauucccccuaucggaagcuccgcuggccuucuggcccucagcucugcucuugggggacaaucccaucugcccaucaaggacgagaaaaagcaccacgauaaugaccaucagagagaucgggacagcauuaaaucuuccagcgugucuccguccgccagcuuucgcggcgcggagaagcacagaaacuccgccgauuacucuagcgaauccaagaaacagaagaccgaggaaaaagagaucgcugcccgguaugacagcgauggcgagaagucugacgauaaucuggucguggacguuuccaacgaagauccuagcucuccccgcgggagcccugcucauucccccagagagaauggacucgacaaaacacggcugcugaagaaagacgcccccauuucuccugccagcaucgcuuccucuagcuccaccccgagcucuaaguccaaggaacucagccugaaacgcgauaugggcaaacuuuccgagacaagacugucugaagacgagcaguguacccucgggcugcaacggugguucugccgccuuugguuuaugaacgagaaaagcacgacccccguguccaagucuaauacaccuacccccagaacagaugcgccuacccccggaagcaacuccacgccgggccugcggccuguccccgggaaaccucccggaguggacccucucgccagcucucugagaacacccauggcugugccguguccuuaccccacccccuucggcaucgucccucacgccggcaugaauggggaacugacauccccgggagccgcuuacgccggccuccauaacauuagcccccagaugucugcggcugccgccgcugccgcugccgcggccgcuuaugggcgcuccccuguugugggauuugauccccaccaccauaugcgggugccugccauucccccuaaucugaccggcauccccgggggaaagccggcuuacagcuuccacgucucugccgacggccagaugcagccugugcccuuuccucccgaugcgcuuaucggcccggggauuccuagacaugcccgccaaaucaacacccugaaucacggagagguugugugcgcugucacaaucagcaaccccacgcggcacguguauaccggcgggaagggauguguuaaagugugggacauuucccauccuggcaacaagagccccgucucucagcucgauugccugaauagagacaacuacauccgcuccugucggcuucugcccgaugggagaacacucauugugggcggagaagccagcacccuguccaucugggaccuggcugccccuacaccgcgcauuaaagccgagcucaccucuagcgcucccgcgugcuaugcccuggcuaucuccccugacucuaaggucuguuucagcugcugcuccgauggcaauaucgccgugugggaccuucacaaccagacgcugguucggcaguuucaagggcauacagauggagccucuuguauugacaucagcaaugauggcaccaaacucuggaccgggggacuggacaacacagugagauccugggaucugcgcgaaggccggcagcuucagcaacacgacuucaccagccagauuuucucucucggguacugccccacaggcgaguggcuggcugucggaauggaaaauuccaacguggaaguucugcaugugacgaagccugauaaguaucagcuccaucugcacgagagcuguguccuuucucugaaauuugcccacugcggcaagugguucguguccaccgggaaagacaaucuccugaacgcguggagaacacccuacggagcuagcaucuuucagucuaaggaauccagcuccgugcugagcugugauauuucuguugacgauaaauacaucgucaccggcagcggggacaagaaggccacaguguaugaggugauuuacuga

SEQ ID NO: 76887 - RNA, 1719 nt, Artificial Sequence
  derived and/or modified sequence opt5 from TLE6__Homo_sapiens__NP_001137458
augaccagcagagaccagccccggccuaagggcccgcccaaauccacaucuccuugccccgggaucagcaacuccgagucuagcccuacgcugaauuaccaaggcauucucaaccgccugaagcaguuccccagauuuuccccucacuucgccgcugaacuugagucuaucuauuacagccugcauaaaauucagcaggauguggccgaacaccauaagcaaaucggaaauguccuccagauuguugaguccuguagccagcugcagggguuucaaucugaagagguguccccggcggagcccgcuagcccuggaacaccccaacaggugaaagacaagacccuucaggaaucuuccuucgaggauaucauggccacccggagcucugacuggcugcgcagaccucucggcgaagauaaccagcccgagacacagcuguuuugggacaaggagccgugguucuggcacgauacccugacagaacagcucuggcggaucuuugccgggguccaugacgagaaagcuaagccucgcgauagacaacaggcccccggacugggccaggaauccaaagcuccuggcagcugcgaccccgggaccgaucccuguccugaggacgccuccacgccgcggcccccugaagcgucuagcuccccucccgagggaagccaggaucgcaauaccucuuggggcgugguucaagagcccccggggagagccucccgguuccuucagagcauuucuugggacccugaagacuuugaggaugcuuggaagcgccccgacgcccugccuggacagagcaaaagacucgcugugcccugcaagcuggaaaagaugcggauccuugcccacggcgagcugguccucgcgacagccauuuccucuuucacccgccacguguuuacaugugggagacggggaaucaaaguuuggagccugaccggccagguggcugaagauagauucccugagucccaucugcccauucaaacgccgggcgccuuucuccgcacaugccugcuuagcucuaacucccggagccugcucaccgggggauauaaucuggcuucugucuccgugugggaccuugccgccccuagccugcacgugaaggagcagcuccccugugcuggccugaacugccaggcgcuggaugccaaucucgacgcuaaccuggccuucgccuccuucacaucuggggucguuagaaucugggaucuucgcgaccagagcguggugcgggaucugaaaggauaccccgacggcgucaaguccauugugguuaaaggguauaauaucuggaccggaggcccugaugcuugucucagaugcugggaccaacgcaccaucaugaagccgcuggaauaccaguuuaaaucucagauuaugagccuuucccauagcccccaggaggacugggugcugcucggcauggccaacgggcaacaguggcugcagucuacauccggaagccaacggcacauggucggccagaaggauucugugauccuguccguuaaguucagcccuuuugggcaguggugggcgucugugggaauggacgauuuccucggcgucuauagcaugcccgcugggacgaaaguguuugaagucccugagaugucccccgugaccuguugcgacguuagcucuaauaacagacugguggucacaggcuccggagaacacgccagcguguaccagauuaccuacuga

SEQ ID NO: 76888 - RNA, 2157 nt, Artificial Sequence
  derived and/or modified sequence opt5 from TLK1__Homo_sapiens__NP_001130026
auggacgagcugcacagccucgaucccagacggcaggaacugcuugaggcccgcuucaccggcguggcuuccgggucuacaggaagcacgggcuccugcucugucggggccaaggcgagcaccaacaaugaauccucuaaccauagcuuuggaucccugggcagccucucugacaaagaguccgaaacaccugagaagaaacaaagcgagucuuccagagggcggaagcgcaaagcugaaaaucagaacgagagcucucagggaaaguccaucggcggcagagggcacaagauuagcgauuacuucgaauaucagggaggcaauggguccucuccgguucggggaaucccucccgccauucgcagcccccaaaacucccauagccacucuaccccuuccagcucugugagacccaauagcccuuccccgacagcccuggcuuuuggcgaccaucccaucgugcagccuaaacagcuuucuuucaagauuauccagaccgaucugacaaugcucaaacuggccgcucuggagagcaacaagauccaagaccucgagaaaaaggaagggcggauugaugaccugcuucgcgccaauugugaucugagacggcagaucgacgagcagcagaagcuccuggaaaaauacaaggagcgccuuaacaaaugcauuuccaugagcaagaaacugcucaucgaaaagucuacccaagagaaacuguccagcagagagaagucuaugcaggaucggcugcgccucggacacuuuacgaccgucagacacggcgcguccuucacagaacaguggaccgacggcuuugccuuccaaaaucuggugaagcagcaggaguggguuaaccagcaacgggaagauauugagagacagcgcaaacuucuggcuaagcggaaacccccuacagccaauaacagccaggcucccuccaccaauucugaaccgaagcagcgcaaaaacaaggccgugaacggggcggagaaugacccuuuugucagacccaaccucccucaacugcuuacgcuggccgaguaucaugaacaggaggaaaucuucaagcuccggcugggacaccugaaaaaggaggaagcugagauucaggccgagcucgaaagacuggagcgcgugcggaaucuucauaucagagaacugaaacgcaucaacaaugaggacaacagccaguuuaaggaucaccccacacucaaugagcgguaccugcuucugcaccuccugggcagagggggauucuccgaaguuuauaaggcuuuugaccuguacgagcaacgcuaugccgccgugaagauucaucagcucaacaagucuuggcgggaugagaaaaaggaaaauuaccacaaacaugcuuguagagaauaccggauccacaaggagcuggaccauccccgcauugucaaacuuuaugauuacuucagccuggacaccgauacauucugcaccgugcucgaguauugugaaggcaacgaccuggauuuuuaccugaagcagcacaaacuuauguccgagaaagaagcgagaagcaucgugaugcagauugucaaugcccuccgguaucugaacgagaucaagccuccgaucauucacuacgaccugaaacccgggaauauccuccugguugauggaaccgcuugcggcgaaauuaagaucacagacuucggccuuucuaaaauuauggacgaugacuccuaugggguggauggaauggaccugacgagccaaggcgccgggaccuacugguaccucccucccgaguguuuuguggucggaaaggagccucccaaaaucucuaacaagguggauguuugguccgugggcgucaucuucuuucagugccuguaugggagaaagccguucggccauaaucagagccaacaggacauucugcaggaaaacacaauccuuaaagccaccgaggugcaguuuccuguuaagcccguggucucuagcgaagcuaaagccuucauucgccggugucucgcguacagaaaggaggaucgcuuugacgugcaccaacuggcuaacgauccuuaucugcucccccauaugagacgguccaauagcucuggaaaccugcacauggccggccuuacagccuccccuacgcccccgagcuccucuaucauuaccuacuga

SEQ ID NO: 76889 - RNA, 2319 nt, Artificial Sequence
  derived and/or modified sequence opt5 from TLK2__Homo_sapiens__NP_001271262
augauggaggaacugcacagccucgaccccagacggcaggagcugcuugaagcccgcuucaccggcgugggggucuccaagggaccucugaacucugagagcuccaaucaaucucucugcagcguuggcucccugucugauaaagaaguggagacaccggagaagaaacagaacgaccagagaaaucggaagcgcaaagcugaacccuacgagacgagccaggggaagggaaccccuagaggccauaagaucuccgauuauuuugaguucgccgggggaagcgcgcccggcacaucuccuggccgguccgugcccccugucgcucgcagcucuccgcaacacucccuuagcaacccccugccuagacggguggagcagccccucuacgggcuggacggaucugccgccaaagaggcuaccgaggaacaguccgcccugccuacacucaugagcguuaugcuggcuaagccccgccuugauaccgaacagcuggcccaaagaggcgcggggcucuguuuuacauucguguccgcccagcaaaauucuccgagcuccaccggaagcggcaacacggagcauucuugcuccagccagaaacagauuucuauccagcaccggcagacccaaagcgaccugacaauugaaaagaucuccgcucuugaaaauucuaaaaacagcgaucuggagaagaaggaagggcgcauugacgaucuccugagagccaauugugaccugcggcgccagaucgaugagcagcagaaaaugcucgaaaaguauaaagagagacugaaccggugcgucaccauguccaagaaacuucugaucgaaaagagcaaacaagagaagauggcuuguagagacaagucuaugcaggaucgccuccggcugggacauuuuacaaccgugagacacggcgccuccuucacggagcaguggacagacggcuacgcguuucagaaucuuauuaaacaacaggaacgcaucaacagccagcgggaggaaauugagagacagcgcaagaugcuggccaaacggaagccucccgcuauggggcaagccccucccgcuaccaaugaacagaaacagagaaagucuaagacaaacggagccgagaaugagacccccuccagcggcaacaccgaacucaaagacacagccccugcucugggggcgcacucccugcuccgccugacgcuugccgaguaucaugaacaggaggagaucuucaagcugcggcucggacaccugaaaaaggaagaggcugaaauucaagccgagcuugaaagacuggagcgcguucggaaccuccauaucagagagcugaaacggauucacaaugaagauaacucucaguuuaaggaccacccgacccugaaugaucgcuaccuccugcuucaucugcucggcagagggggauucagcgagguguauaaggccuuugaccugacagaacagcgguacgucgcugugaaaauccaccaacugaacaagaauuggagagaugagaaaaaggaaaacuaccauaaacacgccugccgcgaguaucggauccauaaggagcuugaccaccccagaauugugaagcucuacgauuauuucucccuggacaccgauucuuuuuguacaguccuggaauacugcgagggcaaugaccucgauuucuaucugaaacagcacaaacuuaugagcgaaaaggaggcgcgcuccaucauuaugcagaucguuaacgcucugaaguaccucaaugaaauuaaaccucccaucauccauuaugaccugaagccuggcaacauucugcuugugaaugggaccgccuguggagagaucaaaauuacggacuucggccucagcaagaucauggaugacgauucuuacaacuccguggacgggauggagcugacaagccagggagccggcaccuacugguaucugcccccggaaugcuuugucguggggaaggagccucccaaaauuucuaauaagguugaugugugguccgucggcgugaucuucuaccaaugucucuauggaagaaaaccuuuuggccacaaccagagccagcaggacauccugcaagaaaauaccauucuuaaggcuacagagguucaguuucccccuaaacccguggucaccccggaggccaaggcuuucauccggcgcugccuggccuacagaaaggaagaucggauugacgugcagcagcucgcgugcgauccuuaucugcugccccauauccgcaaaucugucagcacauccagccccgccggggcugccauugcuucuacguccggagccagcaacaacuccucuagcaauuga

SEQ ID NO: 76890 - RNA, 1179 nt, Artificial Sequence
  derived and/or modified sequence opt5 from TLL1__Homo_sapiens__NP_001191689
augggccuggggacccucagccccagaaugcugguguggcuugucgccuccggaaucguuuucuacggcgagcugugggugugcgcugggcucgacuaugauuacacauuugacggaaacgaagaggauaagacggaaaccauugacuauaaagauccuuguaaggccgcgguguucuggggcgacaucgcucuggaugacgaggaucuuaauauuuuucagaucgaccggacaauugaucugacccaaaacccguucgggaaucucggacacacaaccggcggccugggggaccaugccaugucuaaaaagcgcggagcccuguaccagcucaucgauagaauccggcgcauuggcuuugggcuggaacagaacaauacagucaaaggaaaggugccccuucaguucagcggccaaaacgagaagaauagaguuccucgggcugccaccucccgcacggagagaaucuggcccgggggagugauuccuuaugucaucggcggcaacuuuaccgggucucagcgggcuauguucaaacaggccaugcgccacugggaaaagcauacaugcgugaccuuuauugagagaagcgacgaagaguccuacaucguuuucacauaucggcccuguggaugcuguucuuacgugggccgcagagggaauggaccucaggcgauuagcaucggcaaaaacugcgacaaguuugggaucgucgugcacgagcugggacaugugauuggcuucuggcacgaacacacccggccggaucgcgacaaucaugucacgaucauuagagagaacauccaacccggccaggaauacaauuuucucaaaauggagccuggggaaguuaacucccugggagagcgguaugauuucgacagcauuaugcacuacgccagaaauacauucucucgcggcauguuucuugauaccauccugcccucccgggacgauaacgggaucagaccugcuauuggacagcgcacacggcucagcaagggcgacaucgcccaggcuagaaagcuguaucgcugucccgccugcggggagacccugcaagaaucuaacggcaaucucuccagcccgggauucccuaacggcuaccccucuuauacccauuguauuuggcggguguccgugacaccuggggagaaagucguguuuagccugugcuga

SEQ ID NO: 76891 - RNA, 3048 nt, Artificial Sequence
  derived and/or modified sequence opt5 from TLL2__Homo_sapiens__NP_036597
augcccagagccaccgcucugggcgcccucgugagccugcuucugcuccugccucuuccgcgcggggcgggaggccugggggagcggcccgacgcuacagccgauuacuccgaacucgacggagaggaaggcacggagcagcaacuggaacacuaucaugauccuugcaaggccgcugucuucuggggagacaucgcccuggaugaggacgaucucaaacuguuucacauugacaaggcuagagauuggaccaaacagacaguuggggccaccggccauucuacaggcgggcuugaggaacaggcgagcgaguccucucccgacaccacagccauggauaccggaacgaaggaagcuggcaaagacgggcgggagaacaccacacugcuccacagcccuggaacccugcaugccgcugccaagacauucagcccccgcgugagacgggcgaccacgucucgcacagagagaaucuggccuggcggggugauuccguacgucaucggaggcaauuuuaccggcagccagcgggccauuuucaagcaagcuaugcgccacugggaaaaacacacaugugugaccuuuaucgagagaaccgaugaagaguccuucaucguuuuuagcuaucggacaugcggguguugcucuuacgugggacgcagaggcgggggaccccaggccauuuccaucggcaagaacugugacaaauucgggauugucgcucaugaacuuggacacgugguuggcuuuuggcaugagcacacgcggccugaccgcgaucagcacgugaccaucauuagagagaauauccagcccggccaagaauauaacuuccugaagauggaggccggggaagucagcucucucggagagacauacgacuuugauuccauuaugcauuaugcccggaauaccuucagcagaggcguguuucuggacacaauccugccucgccaggaugacaacggggugcggcccaccaucggacagagaguccgccucucucagggcgauauugcucaagcgcggaaacuguacaagugcccggccuguggggaaacgcuucaggacacaaccggcaauuucuccgcuccuggauuccccaacggcuacccuagcuauucccacugcguuuggagaaucucugugacccccggggagaagauugugcugaauuuuacaagcauggaucucuucaaaucccgccuguguugguacgacuaugucgaggugcgggauggauacuggagaaaggcuccccuucugggccgcuuuugcggggacaaaaucccugaaccgcucguuagcaccgacucucggcuguggguggaguucagauccagcucuaacauucugggaaagggcuuuuucgccgccuaugaagccacaugugggggcgauaugaauaaagacgcgggacagauccaaagccccaacuacccugaugacuaucgccccuccaaggagugcgucuggcggaucacggugucugaaggcuuucauguugggcucaccuuccaggcuuuugagauugagagacacgauagcugcgccuacgacuaccuggaagugcgggauggaccuacagaggaauccgcccuuaucggccauuucuguggguaugagaaacccgaggacgucaaguccucuuccaaucgccuguggaugaaguuugugagcgauggaucuauuaacaaagcuggcuucgccgcuaacuuuuucaaggaagucgacgagugcuccuggccggaucacgggggcugugaacacagaugcgugaauacccucggaagcuacaaaugugccugcgacccuggcuaugagcuggcggccgauaagaaaaugugugaaguugcuugcgggggauucaucacaaaacuuaacggcaccauuacgucccccggguggccuaaggaguaccccaccaauaagaacuguguguggcaggucguggccccugcucaguaucggaucucucugcaauuugagguuuucgaacucgagggaaaugacgugugcaaguacgacuuugucgaagugagaagcggccugucccccgaugccaaacugcaugggcgcuucuguggcucugagacaccggaagugaucaccagccaguccaacaauaugcggguugaguuuaagagcgacaacacagucucuaaaagaggauuccgcgcgcacuuuuucuccgauaaggacgagugcgccaaggauaauggcgggugccagcaugaaugugugaacaccuuuggaagcuaucucugcagaugucggaauggcuacuggcugcacgagaacgggcacgacugcaaagaagcuggaugugcccauaagauuucuuccguggagggcacgcuugcuagcccuaauuggcccgauaaauaccccucucgcagagaaugcacauggaacaucagcuccaccgccggccaccgggucaagcugacauucaaugaguuugagauugaacagcaucaagagugugccuaugaccaccucgaaauguacgaugggccugacagccuggcuccgauccugggacgcuucugcggcucuaaaaagcccgauccuaccguggcguccgggagcuccauguuucuuagauucuauucugacgccagcguucagcggaagggauuccaggcugugcauuccaccgaguguggcgggcgccucaaagccgagguccagacaaaggaacuguacucucacgcccaauuuggagauaacaauuaucccagcgaggcuagaugcgacugggugauuguugccgaagacggcuacggcguggagcugacguuccggaccuuugaagucgaggaggaagcggauuguggguaugacuacauggaggcuuacgauggauaugacuccucugccccucgccucggcagauucugcgggagcggaccccuggaagagaucuacuccgccggcgauagccuuaugauucgguuuagaacagacgauaccaucaacaaaaagggguuccacgcucgcuauacaucuaccaaauuucaggacgcccugcauaugaagaaauga

SEQ ID NO: 76892 - RNA, 7626 nt, Artificial Sequence
  derived and/or modified sequence opt5 from TLN1__Homo_sapiens__NP_006280
augguggcccugagccucaagaucuccauuggcaacgucguuaaaaccaugcaguucgagcccucuacaaugguguacgacgcuugcagaaucauucgggaacgcaucccugaggccccggcggggcccccuagcgauuuuggacuguuccuuuccgacgaugaccccaagaaaggcauuuggcuggaagcugggaaggcccucgauuauuacaugcugagaaauggagacacgauggaguaucggaaaaagcaacgcccucuuaagaucagaaugcuggauggcaccgugaaaacaaucauggucgacgauucuaagaccgugacagacaugcucaugaccauuugugcccggaucgggauuacaaaccacgaugaauacagccugguucgcgagcugauggaggaaaaaaaggaggaaaucaccggaacgcucagaaaagacaagacccugcuucgggaugagaagaaaauggagaagcugaaacagaagcuccauacagacgacgaacugaauuggcuugaucacggccgcacccugagagagcagggcguggaagagcaugaaacacuccugcugcggcgcaaauuuuucuauuccgaccagaacgucgauucuagagaccccgugcaacucaaucugcuuuacguucaggcucgggaugacauucugaacgggagccacccuguguccuuugauaaggccugcgaguucgcuggauuucagugucagauccaauucggcccgcauaaugagcagaaacacaaggccggguuucucgaccugaaggauuuccuucccaaagaauaugucaagcagaaaggagagcgcaagauuuuucaggcgcacaaaaacugcggccaaaugagcgaaaucgaggccaaggugagauacgugaagcuggcucggucucucaaaaccuacggggucuccuucuuucugguuaaggaaaaaaugaagggaaaaaauaagcuggugccuagacuccugggcaucacgaaggagugugugaugcgcgucgacgagaaaacaaaggaagugauucaggaguggaaccuuaccaauaucaaacggugggccgcuagccccaagucuuucacacuggauuucggcgacuaucaggacggguacuauuccguucaaaccaccgaaggagagcagauugcccagcucaucgcgggcuacauugauaucauccugaaaaagaagaaaagcaaggaccauuuugggcuugaaggagaugaggagucuacaaugcuggaagacuccgugagcccuaaaaaguccacgguccuccagcaacaguauaacagagugggcaaaguugagcacgggucuguggcccugcccgcuauuaugcgcagcggagccuccggcccggaaaauuuccaggucggcagcaugccucccgcucagcaacagaucaccucugggcagaugcaucggggacacaugccuccccugacauccgcccagcaagcccucaccggcacaauuaacagcucuaugcaggcugugcaggcggcccaggcuacccuggaugacuuugauacgcuucccccucuggggcaagacgccgccagcaaggcuuggagaaaaaauaagauggaugaguccaagcacgagauccauucucaggucgacgccauuacagcgggaaccgcuagcgugguuaaccucaccgccggcgauccggccgaaacagacuacaccgcuguggggugcgccgucacaacgaucuccagcaaccugaccgagaugucucgcggcgugaaacugcuugcugcccuccuggaagaugagggaggcuccgggcggccccugcuccaggcggccaagggacuggcuggcgccguuagcgaacuucugagaucugcucaaccugccuccgcggagccccgccagaaucuccugcaggccgcugggaacgugggacaggccagcggcgagcugcuucaacagaucggggaauccgacacagacccucacuuccaggaugcucucaugcagcuggccaaagccgucgcuucugcggccgcugcccuggugcucaaggccaaaagcguggcucaacggaccgaggacuccggccugcagacacagguuauugccgcggcuacccagugugcccuuucuacgagccaacuggucgccugcaccaaggugguggcucccacaaucuccagcccggucugucaggaacagcucguggaggccggaagacugguugcgaaggcuguggaaggcugcgucucugccucccaagccgcuaccgaggaugggcagcugcuucgcggagugggcgccgcugccacagcgguuacccaggcccucaaugagcugcugcagcaugugaaagcucacgccacgggggcuggaccugccggccgguaugaccaagccacagauaccauucucacagucaccgaaaacaucuuuagcucuaugggggacgcuggcgagauggugagacaggcgcggauucuggcccaggcuaccuccgaucuuguuaaugccaucaaggccgacgcugaaggagagagcgaucuggaaaacucucgcaaacuccugagcgccgcgaagauucuggcugacgccacagccaaaaugguggaggcugccaagggcgcggcugcccaucccgauuccgaggaacagcaacagagacuucgggaggccgcugaagggcucagaauggccacgaaugcugccgcgcagaacgccaucaagaaaaagcugguccagcgccuggagcacgcugccaaacaagcugccgccagcgcuacccagacaaucgcggccgcucagcacgccgccucuaccccuaaggcuuccgccggaccccagccucuccuggugcaaagcuguaaagcgguggcugagcagauuccccuucugguccagggcguucgggggucccaagcccagccggacucuccuagcgcccagcucgcucugaucgccgcgucccagucuuuccugcaacccggaggcaagaugguggccgcugccaaggcuagcgugcccacaauucaggaucaggccuccgcuaugcagcuuucucaaugcgccaaaaaucuggggaccgcgcucgccgaacugagaacggcugcccagaaggcucaggaggccugcggcccucucgaaauggacagcgcccuguccgucgugcagaaccuugagaaagaccugcaagaaguuaaggcugcggcccgcgauggaaaacucaagccgcugcccggcgagacaauggagaaauguacccaggaccuggggaauagcaccaaggcugugucuuccgccaucgcccagcuucugggagaagucgcucaaggcaacgagaauuacgccgggauugcggccagagauguggcuggaggccuccggagccuggcccaggcugcccgcggcguugcggcccucacaucugacccugcugugcaggccaucguccuggauaccgcuuccgacgugcuugauaaggccagcucucugaucgaagaggcuaaaaaggccgcggggcaucccggagacccugaaucccagcaaagacucgcccagguugcuaaagccgugacacaggcucugaaccggugcgucagcugucugcccggccagcgcgauguggacaaugcccuuagagccgugggggaugcguccaagcggcugcucagcgacucucugccucccagcacgggaaccuuucaagaggcucagucccgccucaacgaggccgcugccggccugaaccaggccgcuacagaacuuguccaggccucuagagggaccccgcaagaccuggcgcgggccagcggacgcuucggccaggauuuuuccacauuccuggaggcuggcguugaaauggccgggcaggcuccuucucaggaggacagagcccaaguggugagcaaucucaaaggaauuuccaugucuagcuccaagcugcuucuggcggccaaggcucucagcaccgaucccgccgcuccuaaccugaaaucucagcucgccgcugccgcgcgggccgucacggacuccaucaaucagcugauuaccaugugcacacaacaggcucccggccagaaggaaugugauaacgcccuuagagagcuggagaccgugcgcgaacugcucgagaauccgguucagccuaucaacgacaugagcuacuuugggugccuggauucugugauggaaaauuccaaaguccuuggagaggcuaugacaggcauuagccaaaacgccaagaaugggaaccugcccgaguucggagacgccaucuccaccgcgucuaaagcucucuguggcuuuacagaagccgccgcucaggccgcuuaucuggugggcguuagcgauccuaauucccaggccgggcagcaaggacucguggagcccacccaguucgcgcgggccaaccaggcuauccagauggccugccaaagccugggcgaacccggguguacgcaggcucagguccuuucugccgcgacaauuguggccaagcacaccuccgcucugugcaauagcuguagacuggccucugcucgcaccacaaacccuaccgccaagcggcaauucguccagagcgcuaaagagguggccaauuccacggcgaaccucguuaagacaaucaaagcccuggacggagcuuuuaccgaagagaacagagcccagugccgcgccgcuacagccccgcuucuggaggcgguggauaaucucucugcuuucgccagcaaccccgaauuuuccucuauuccugcccagaucagccccgagggccgggcugccauggaaccuauugucaucuccgcuaagaccaugcuggagagcgccgggggacucauccaaacagcgagagcccuggcugugaauccccgcgacccuccgucuugguccguucuugccggccauagccggaccguguccgauucuauuaaaaagcugaucacgagcaugagagacaaggcucccggccagcuggaaugcgagaccgccauugcggcccucaacuccugucugcgggaccuugaucaggcuucucuggccgcugucagccagcaacucgccccucgcgaggggaucucccaggaagcccugcacacacagaugcugaccgcugugcaggagauuagccaccucaucgaaccccuugcgaaugccgcuagagccgaggccucucaacugggacauaaagugucccagauggcucaguacuucgaaccucugacacucgccgcgguuggcgcugccagcaagacccugucucacccccaacagauggcccuucuggaccagacgaaaacacucgcugaguccgcccugcagcugcucuauaccgcuaaggaggccgggggaaacccgaaacaagcggcccauacacaggaagcucuugaggaagccguccagaugaugaccgaggcuguggaggaucugaccacaacgcugaaugaagccgcgagcgccgcuggcguggucgggggaaugguggacucuauuacccaggccaucaaccaacucgaugagggcccuaugggcgaacccgaggggagcuuuguugacuaccagacaaccauggugcggacagcuaaggccaucgccgucaccgugcaggaaaugguuacgaaguccaauacaucucccgaggagcugggaccucuugcuaaccagcugaccagcgauuauggccgccucgcguccgaagccaaacccgcugccguggccgcugagaaugaagagauugggagccacaucaagcauagaguccaagaacugggacacggcugcgccgcgcuggugaccaaagcuggggcccuccaguguuccccuucugacgccuacacaaagaaagagcuuauugagugcgcucggagaguuagcgaaaaggugucccacguccuggccgcucugcaggccggaaaccgcggcacccaggcguguaucacagccgcuucugccgugagcggcauuaucgcugaucucgacacgaccaucauguucgccacagcggggacccugaaucgggagggaacagaaaccuuugccgaucauagagagggcauucuuaaaacggcuaaggugcuggucgaagacaccaagguucucgugcaaaacgccgcugggucccaggagaaacuggcccaggccgcucaaucuagcguggcgacaaucacccgccuggccgaugucgugaagcucggagcugccucccuuggcgccgaggacccggaaacacagguugugcugauuaaugcugucaaagacguggccaaggcgcugggggaucucaucagcgcuaccaaagccgccgcuggaaagguuggcgacgaucccgccguguggcagcugaagaacucugcuaaagucauggugacaaacgucacgucccuucugaagaccgugaaagccguugaggacgaagcgacaaagggcacccgggcccucgaggcuaccacagagcacauuagacaggaacuggccguguucugcagcccugagcccccugcuaaaacgucuacccccgaagauuuuauccgcaugacaaaggggaucaccauggccacagcgaaggccguggcugccggaaauuccugucggcaagaggacgucauugcuaccgccaaccugagcagacgcgcgaucgccgauaugcucagagcuugcaaagaagccgcuuaucauccggagguugccccugacgugcggcuucgcgcccugcacuacggcagagagugugcuaauggguaccuggaacuccuggaucaugugcuucugacgcuccagaagcccucuccugagcugaaacagcagcugacaggacacuccaagcgggucgccggcagcgugaccgaacucauucaagcggcugaggccaugaaagggaccgaauggguugaccccgaggauccuacagugaucgccgagaacgaacuucugggcgcugccgcggcuauugaggccgccgcuaagaagcuggaacagcucaaaccccgcgccaagccgaaagaggcugacgaaucccugaauuucgaggagcagauccuugaagccgcgaagagcauugccgcugccaccucugcucuggucaaagccgcgagcgccgcucagagagagcucguggcccaaggaaaggucggcgcuaucccugccaacgcccuggacgaugggcaguggucccagggacugaucucugcugcccggaugguggcggcugccacaaauaaccucugcgaagccgcuaaugccgcgguucaaggccacgcuagccaggagaaacuuauuuccucugccaagcagguggccgcuagcaccgcccagcugcuggucgcuuguaaggugaaagccgaccaagauuccgaggcgaugaagagacuccaggccgcugggaacgccguuaaacgcgcuucugacaaucuggugaaggccgcgcagaaagccgcugccuuugaagagcaggaaaacgagacggucguggugaaggaaaagaugguuggaggcaucgcucaaauuaucgccgcccaggaggagaugcuucggaaagaaagagagcuggaagaggcucgcaagaaacucgcccagauucggcagcaacaguauaaguuccugcccagcgaacugagagaugagcauuga

SEQ ID NO: 76893 - RNA, 7629 nt, Artificial Sequence
  derived and/or modified sequence opt5 from TLN2__Homo_sapiens__XP_011520408
augguggcccucagccucaagaucugcgugagacacuguaacguugugaaaaccaugcaguucgaacccuccacagcuguguacgacgccugccgggucauucgcgaaagagugccugaggcgcaaacgggccaggcuucugauuaugggcuguuucuuagcgacgaagauccccggaagggaaucuggcuggaggccggccgcacccucgacuacuauaugcugagaaauggggauauucuugaauacaaaaagaaacagcggccccagaagauccgcaugcuggacggauccguuaagacagugauggucgaugacucuaaaaccgugggcgagcuccugguuacaauuuguagcagaaucgggaucaccaacuaugaggaauacucccugauucaagagacaaucgaagagaagaaagaggaaggaaccggcacgcucaagaaagaucggacccugcuucgcgacgagagaaagauggaaaagcugaaagccaagcuccauacagaugacgaucugaauuggcuugaccacucucggaccuuccgcgagcagggcguggacgaaaacgagacacugcuccugagacggaaauuuuucuauagcgaucagaaugucgacucccgcgauccugugcagcugaaccuccuguacgugcaagcuagagacgauauucuuaaugggagccaucccgucucuuuugagaaggccugcgaguucggaggcuuucaggcucagauccaguucgggccucacguugagcauaaacacaagcccggauuucuggaccucaaagaguuccugccuaaggaguacauuaagcaacggggcgccgagaaacggaucuuucaggagcacaagaacuguggggagauguccgaaauugaggcgaaagugaaguaugugaaacuugcccgcagccugcggaccuacggagucucuuucuuucucgugaaggaaaagaugaaaggcaagaauaaacugguucccagacugcucggcaucacgaaggauuccgugaugcgcgucgacgagaaaacaaaggaagugcugcaggaguggccccuuaccacaguuaagcggugggcugccagcccuaaaucuuucacccuggauuucggggaguaucaagaauccuacuauagcgugcagaccacagagggagaacagaucucccagcucauugcuggcuacaucgacauuauccugaagaaaaagcaaucuaaagauagauuugggcuugagggagacgaggaaagcacgaugcuggaggaauccgucagccccaagaagucuaccauucuccagcagcaguucaaccgcacaggcaaagccgagcauggguccguggcgcugccugccgucaugcggagcggaucuagcggccccgaaaccuuuaaugugggcuccaugccgucuccucaacagcagguuaugguggggcagaugcacagaggacauaugcccccucugacaagcgcucaacaggcccucaugggcaccaucaacacguccaugcacgcuguccagcaggcccaagacgaucugagcgagcuugacucucugccgccccucgggcaggauauggccucccgcguguggguucagaauaagguggacgagagcaaacacgaaauccauucucaagucgaugcuauuacagcgggaaccgccuccguggugaaccugaccgcuggcgacccugccgauacagacuauaccgccguugggugcgcuaucacaacgauuagcuccaaucugaccgagaugucuaagggcgucaaacuucucgccgcgcugauggaugacgaagugggaagcggcgaggaucugcuccgggcugccagaacacuggccggggcuguguccgaccuucugaaggccguccagccgaccucuggagaaccccgccagacagugcucaccgcugccggcagcaucgggcaggcguccggagaucugcugcggcaaauuggcgagaacgagacggacgaaagauuccaggacguucuuaugagccucgccaaagcuguggccaacgcugccgcgaugcugguccugaaggccaagaauguggcucagguugccgaggauaccgugcuccagaaccgggucaucgcugccgccacacaaugugcucugucuaccucccagcuuguggcgugcgccaaaguugugagcccuacaaucucuucccccgucugucaggaacagcugauugaggcugggaagcucguggaccgcagcguggaaaauugcgucagagccugucaagccgcuaccacggauucugagcugcugaaacagguuagcgccgcggcuuccguggugagccaggcccuucacgaccuccugcaacauguccggcaguuugccucuagaggcgagccuaucggacgcuacgaucaggcuacagacaccauuaugugcgugacagaauccaucuucagcuccaugggcgaugccggggagaugguucggcaggcgagagugcuggcucaagccaccucugaccucgucaacgccaugcgcagcgaugcugaagccgagauugacauggaaaauuccaagaaacugcuugcugccgcgaagcugcucgccgauucuaccgcuagaaugguggaagccgcuaagggagccgccgcuaaccccgagaaugaagaccagcagcagcggcugcgcgaggcggccgaaggccugagaguugcuacaaacgccgccgcucaaaaugccaucaaaaagaaaauugugaaccggcuugaggucgcggcuaagcaggccgccgcugccgcgacgcagaccaucgcugccagccagaaugccgcuguguccaacaaaaauccggccgcucaacagcagcucguucagucuugcaaggccguggcggaucacaucccucaacugguccagggggugcgcggaagccaggcccaagcugaggaccuguccgcccagcucgcucugauuaucagcucucagaacuuucuucagcccggcuccaagauggugagcucugccaaagccgcugucccuacaguuuccgaccaagcggccgcuaugcagcugagccagugugccaagaaucucgccaccucucuggcugaacugagaacagccucccagaaagcgcaugaggcuugcgggcccauggaaauugauagcgcccuuaacaccgugcaaacgcugaagaacgagcuccaggacgccaaaauggcugccguggaaucccagcugaagccucuccccggcgagacacuggagaagugugcgcaggaucuuggaagcaccucuaaagccgucggcagcuccauggcucaacugcugaccugcgccgcucaggggaaugaacacuacacaggaguggccgcucgggagaccgcccaggcgcugaagacacuggcccaagcugcccgcggcguugcugccucuacgaccgacccggccgcugcgcacgccaugcuugauagcgcuagagacgugauggaaggguccgccaugcugauccaggaggccaaacaggcucucauugccccuggagaugcggaacggcagcaacgccuggcccaggucgcuaaggccgugucucauagccucaacaauuguguuaacugccugcccggccagaaagacguggaugucgcucuuaaguccaucggggagucuagcaaaaagcugcucguggacucccugcccccuagcacaaagccguuccaggaggcccaaucugaacugaaucaggcggccgcugaucuuaaccaguccgccggcgaggucgugcacgcuaccagaggacagagcggcgaacuggccgcugccucugggaaauuuuccgacgacuucgaugaguuucucgacgcgggaaucgagauggccggccaagcucagacaaaggaagaucagauucagguuaucgggaaucugaaaaacauuagcauggccuccucuaagcuccugcuugcugccaaaagccuguccguggaccccggagccccuaaugcgaagaaccugcucgcugccgcugcccgggccgucaccgagagcaucaaucaacugauuacgcuuuguacccagcaggcucccggccaaaaggaaugcgauaacgcccugagagagcucgaaacagugaaaggcaugcuggacaauccuaacgagcccguuucugaucucuccuauuucgacuguaucgagagcgugauggaaaauucuaagguccugggggagagcauggcgggaaucucccagaacgccaaaaccggcgaucuuccugcuuuuggggaaugcgugggaauugccucuaaggcucuguguggccugacagaggccgcggcccaggcugccuaccucguggggaucagcgaccccaacucccaggcuggacaucaaggccugguugauccgauucaguucgcccgcgcuaaucaggccauccagauggcgugccaaaaccuugucgacccuggcucuagccccucccaggugcugagcgccgcuaccauuguggccaaacacacaucugcucucugcaaugccugucggaucgccuccagcaagaccgcgaacccugucgcuaagagacacuucgugcaguccgccaaagaaguugccaauucuacggcuaaccuggugaagacaaucaaagcccucgauggggacuuuagcgaggacaaucgcaacaagugccggauugcuaccgcgccccugaucgaggccgucgaaaaucuuaccgccuucgcuuccaacccggaguuugugucuauuccugcccagaucagcuccgaaggaagccaagcucaggagcccauucugguuucugccaaaacaaugcuggaauccagcucuuaucucaucagaaccgcgcgcucccuggccauuaauccuaaggauccgcccacguggagcgugcuugcuggccauucucacacagucagcgacuccaucaagucucugaucaccagcauucgggauaaagccccugggcagagagagugugacuacuccaucgauggaauuaaccgcugcauccgggacauugagcaagcuagccucgccgcugugucccagucucuggccacaagagaugacaucagcguugaagcgcuccaggagcagcugaccuccgugguccaagaaaucggccaucuuauugauccgaucgccacagcugccagaggggaagccgcucagcugggacacaaggugacccagcuggccucuuauuucgagccccucauucuggcggcugugggcgucgccagcaaaauccuugaccaucagcaacagaugacgguucuggaucagaccaagacacucgccgaauccgcucugcagaugcuguacgccgcuaaagagggcgggggaaauccuaaggcccaacacacccacgacgcgauuacagaagccgcucagcucaugaaggaggccguggaugacaucauggugacccuuaacgaagcugccucugaggucggccuggucggcgggaugguugacgcgaucgccgaggcuaugagcaaacuggaugaagggacgcccccugagcccaaggggacauuuguggacuaucagaccacagucgugaaauacuccaaggccauugcuguuaccgcccaagaaaugaugaccaaaagcgugacaaauccugaggaacucggaggccuggccucucagaugacguccgauuacggccaucuugcuuuccaggggcagauggcggccgcuaccgccgagccggaggaaaucggauuucaaauucgcacaagaguccaggaccugggccacggguguaucuuccucgugcagaaggccggagcucugcaggucugccccaccgauagcuauacaaaacgggagcugauugaaugugcccgcgcggugaccgagaagguuucucucgugcuuuccgcucugcaagccggcaacaaggggacgcaggccugcaucacagcugccaccgcugugagcggaauuaucgccgaccuggauaccacaaucauguuugcgaccgccggcacacucaacgcugaaaauucugagacguucgccgaccauagagagaacauucugaaaaccgcuaaggcccuugucgaagauacaaaacugcucguuuccggcgcggccagcaccccugacaagcuggcucaggccgcucaguccagcgccgccacaaucacccaacuggcugagguggugaaacucggggcggccucucuuggaagcgaugaccccgaaacgcaggucgugcugauuaaugcuaucaaggacguugccaaggcccuguccgaucucauuucugcuaccaaaggcgccgcgagcaagccuguggacgaucccuccauguaccagcugaaaggggcugccaaggucauggugacaaacgucaccucucuucugaaaacagugaaggccguugaggacgaggcuacccggggaacaagagcccucgaagcuacgaucgaguguaucaagcaggaacugaccguguuucaaagcaaagaugucccggagaagacauccucuccugaagagagcauucgcaugaccaaaggcaucaccauggccacagcgaaggccguggcugccggaaauuccugccggcaggaggacguuauugcuacggccaaccugagcagaaaagcggugucugauaugcucaccgccuguaagcaggcuuccuuccaccccgacgucagcgaugaagugcgcacacgggcccuuagauuuggaaccgagugcacacugggcuaucuggaccuccuggaacaugugcuuguuauccugcaaaagcccaccccugaguucaaacagcagcucgcugccuucucuaagcgcgucgccggcgcugugacggaacugauucaggcggccgaggcuaugaaagggacagaguggguggaucccgaagacccuaccgucaucgccgagaccgaacugcucggagccgcugccuccaucgaggcggcugccaagaaacuugaacaacugaagccgcgggccaaacccaagcaggcugaugagacacuggacuuugaggaacagauucucgaggccgcuaagagcaucgccgcggccaccuccgcucugguuaaaucugccagcgcugcccagagagaacuuguggcgcaaggcaaggugggguccauuccugccaaugcugccgacgauggacaguggagccagggccugaucucugcugcccgcauggucgcggccgcuacauccagccucugcgaggccgcuaacgccucugugcaggggcacgccagcgaggaaaaacugauuuccucugcuaagcaaguugccgcgagcaccgcucagcugcucguggccuguaaagucaaggccgaccaggauuccgaggcuaugagacggcuucaagccgcgggaaaugcugugaagcgcgccucugacaaccugguuagagccgcucagaaagccgcuuucggcaaggccgaugacgaugacguggucgugaaaacgaaguuugugggcgggaucgcgcagauuaucgccgcucaggaagagaugcugaaaaaggaacgggagcucgaggaagcccgcaagaaacuggcucaaaucagacagcagcaguacaaguuccuucccacagagcugcgggaagaugagggauga

SEQ ID NO: 76894 - RNA, 2436 nt, Artificial Sequence
  derived and/or modified sequence opt5 from TLR10__Homo_sapiens__XP_011512064
augagacugauccggaacauuuacaucuucugcagcauugugaugaccgccgagggcgacgcucccgaacucccugaggaacgcgagcugaugacaaauuguuccaacaugucucuuagaaaggucccggccgaucugacgcccgcgaccacaacccucgaccugagcuauaaucuucuguuucagcuccaauccucugauuuccacagcguuuccaaacugcgggugcugauccucugccauaaccgcauucagcagcuggaccuuaagacauuugaguucaauaaagaacugagauaccucgaucugucuaacaaucggcuuaagagcgugaccugguaucugcucgcugggcugcgcuaccuggaccucuccuuuaacgauuucgacacaaugccuaucugugaggaagccggaaauaugagccaccuggagauccuuggccugucuggggccaaaauucagaaguccgauuuucaaaagaucgcucaucuccaccugaacaccgucuuccuuggauuuagaacgcugccccauuaugaagagggcagccucccuauucugaauaccacaaaacugcacaucgugcuccccauggacaccaacuucuggguucugcuucgggaugggauuaagacaucuaaaauccuggagaugaccaauauugacggaaagucccaguuugugagcuacgaaaugcagcgcaaccucucucuggagaaugccaaaacguccguccuucugcucaacaagguggaucugcugugggacgaccucuuccugauccuucaguuuguuuggcacacaagcguggaacauuuccaaaucagaaacgucaccuucggcggcaaggcuuaucuggaucacaauuccuuugacuacucuaacacagugaugcggaccauuaaacucgagcaugugcacuuccgcgucuuuuacauccagcaggauaagauuuaucugcugcuuaccaaaauggacaucgaaaaucucacaauuagcaacgcccagaugccucacaugcuguucccgaauuaccccacgaaguuucaauaucugaacuucgcgaauaacauccucaccgaugagcuguuuaaaagaacaauccagcuuccucaucugaagacccucauucugaaugggaacaaacuggagacacuuucccucguuagcugcuucgccaauaacacgccccuggaacaccuggaccucucucagaaucugcuucaacauaagaacgaugagaauuguuccuggccugaaaccguggugaacaugaaccugagcuacaauaagcucucugacagcgucuuucggugccugcccaaauccauccagauucuggaucuuaacaauaaccagauccagacagugccgaaggagaccauucaccucauggcucugcgcgaacugaauaucgccuucaacuuucucaccgaccugccuggauguucucauuucagcagacuuuccguucugaauaucgagaugaacuuuauucucagccccucucuggauuucgugcaauccugccaggaggucaaaacacugaaugcuggccggaacccuuucagauguaccugcgaacuuaagaauuuuauccagcucgagacauauagcgaagugaugaugguuggguggucugacuccuacacgugugaguauccccugaaccugcgcggaacccggcucaaagacgugcaccuucacgaacuuagcugcaauacagcccugcucauugucaccaucguggucauuaugcuggugcugggccuugcgguugccuucugcugucugcauuuugaucuccccugguaccugagaaugcucgggcagugcacacaaaccuggcaccgcgugcggaagacgacccaggagcagcugaagagaaacguccgcuuccaugcuuuuaucuccuacucugagcacgacagccuuugggugaaaaaugaacugauuccuaaccucgagaaggaagauggauccauccugaucugucuguaugagucuuacuucgacccgggcaaaagcauuuccgagaacaucguuagcuuuauugaaaagucuuauaaauccaucuucgugcuuagccccaauuuuguccagaacgaguggugccacuacgaguucuauuuugcccaucacaaucuguuccaugaaaacucugaucacauuauccucauccugcucgaaccuauucccuuuuacuguaucccuacacgguaucauaagcugaaggcucugcuggagaaaaaggccuaccucgaguggcccaaagacagacgcaagugcggccuguucugggccaaucugcgggcugcgauuaacgugaaugugcuugccaccagagaaauguacgagcugcaaacauucaccgaacucaacgaggaaucccgcgggagcacgaucucucugaugcggacagauugucucuga

SEQ ID NO: 76895 - RNA, 2361 nt, Artificial Sequence
  derived and/or modified sequence opt5 from TLR1__Homo_sapiens__NP_003254
augaccagcaucuuccacuuugccauuaucuucaugcugauucuccagauccggauucaacuguccgaggaaucugaguuucuuguggacagaagcaagaacggccugauccauguccccaaagaucucucccagaagacaacgauccugaauauuucucagaacuacaucagcgaacuuuggaccuccgacauucugucucucagcaaacugcgcauccugauuaucucccacaauagaauccaguaucucgauaucagcguuuucaaguuuaaccaagagcuggaauaccuugaccugucucauaauaaacucgugaagaucuccugccacccuacagugaaccugaagcaucuugaucugagcuucaaugcuuuugacgcccucccgauuuguaaagaguucgggaacaugucucagcugaaguuucugggacucuccaccacacaccuggagaaaagcucuguccuucccaucgcgcaccugaauauuuccaaggugcuccugguucuuggcgaaaccuauggggagaaagaagauccugagggacugcaggacuucaacacagagagccuccauaucguguuucccaccaauaaggaguuccacuuuauucuggaugucuccgugaagacgguugcuaaccuggaacucucuaauaucaaaugcgugcuggaagacaacaaguguagcuacuuccuuuccauccuggccaaacuccagaccaauccuaagcugagcaaccuuacacugaacaauauugagaccacauggaacucuuucauccggauucuccaacuggucuggcauaccacggugugguauuuuuccaucagcaaugugaaacugcagggccagcucgauuuccgcgacuuugauuacucugggacaagccugaaggcccuuuccauucaccaggucguuucugacguguucggauuuccccaaagcuauaucuacgaaaucuucuccaacaugaauauuaaaaacuuuaccgugagcggcacaagaaugguccacaugcugugcccuucuaagaucuccccguuccuccaucuggacuuuagcaauaaccugcuuaccgauaccguguucgagaauuguggccaccucacagagcuggaaacgcugauucuccagaugaaccagcugaaggagcuuucuaaaaucgcugaaaugaccacacaaaugaagucccugcagcagcucgacauuagccaaaauuccguuucuuacgaugagaaaaagggggacugcagcuggaccaaaucccugcugucucuuaacaugagcuccaauauccucacagauaccauuuuucggugucugcccccucgcaucaaggugcuggaccuccauagcaacaagaucaaaucuauucccaagcaggucgugaaacuggaagcccuucaggagcugaauguugcuuucaacucccucacggaucugccuggaugcggcagcuuuucuucccugagcgugcuuaucauugaccacaacucugucagccaucccuccgccgauuucuuccagagcugucagaagaugagaucuaucaaagcgggggacaauccguuucaaugcacaugugagcucggagaguucgugaagaacauugaucaggucuccagcgaagugcuggaaggcuggccugacuccuauaagugcgacuaccccgagucuuaucgggggacccugcucaaagauuuucacaugagcgaacuguccugcaauaucacccuucugaucguuacaauuguggccaccaugcucguccuggcugugacaguuacgucucuguguagcuaccuugaccucccuugguaucugcgcauggugugccaguggacccagacaagacggcgcgccagaaacaucccccuggaggagcuccaacggaaucugcaguuccacgcuuuuauuuccuacucuggacaugauagcuucugggucaagaacgaacuucugcccaaucucgagaaagaaggcaugcagaucugucugcacgagcgcaacuuugugccuggcaaguccauuguggagaauaucauuaccugcauugaaaagagcuauaagucuaucuucguucuguccccgaacuuuguccagagcgaguggugucauuacgaacuuuacuucgcccaccacaaucuguuucaugaggggucuaacucccucauucugauccuccuggaacccauuccucaauauagcauccccucuuccuaccacaaacuuaaaagccugauggcgagacggacauaucucgaguggccuaaggagaaauccaagagaggacuguucugggccaaucugcgcgcugccaucaacauuaaacuuaccgaacaggcuaagaaauga

SEQ ID NO: 76896 - RNA, 2355 nt, Artificial Sequence
  derived and/or modified sequence opt5 from TLR2__Homo_sapiens__XP_011530518
augccccacacccuguggaugguguggguccucggcguuaucauuagccuguccaaggaggaaucuagcaaccaggccucccuuucuugcgacagaaaugggaucuguaaaggaagcuccggcucucugaacagcauuccuuccgggcucacagaggcugucaagagccuggaucuuucuaauaaccggaucacguacauuuccaauagcgaccugcaacgcugcgugaaccuccaggcccuggugcugaccucuaauggaaucaacacaaucgaagaggauuccuucagcucucucggcucccuggaacaucuugaccugagcuauaauuaccucuccaaccugucuagcuccugguuuaaaccgcuuagcucucugaccuuccucaaucugcuggggaaccccuauaagacacucggagagaccucccuguuuagccaccuuacaaaacugcagauucucagagugggcaauauggauaccuucacgaagauccagcggaaggacuuugcgggccugaccuuccuugaggaacuggagauugaugcuucugaccuccaaagcuacgaaccuaaaucccugaagucuauccagaacguuagccaucugauucuccacaugaaacagcauauccugcuucuggagauuuuuguggaugucacauccagcguggagugucucgaacugcgcgacaccgaucuugacacauuccacuuuucugagcuguccaccggggaaacgaauagccucaucaagaaauucacauuuagaaacguuaagaucaccgaugagucucuguuccaggugaugaagcugcucaaccaaauuuccggacugcuugaacuggaguuugacgacugcacacucaauggcgucgggaacuuccgggccagcgauaaugaccgcgugaucgaucccggaaaaguggagacccugaccauuagacggcugcacaucccucgcuucuaucucuuuuacgaccuuuccacacuguauucucugacggaaagagucaagcggauuaccguugagaacagcaaaguguuccucgugcccugucugcuuucccagcaucugaagucucucgaauaccuggaucugagcgagaaucuuauggucgaagaguaccucaaaaacuccgccugcgaggacgcuuggccuagccugcagacacugauccuccgccagaaucaccuggccucucuugaaaagaccggcgagacacugcucacccugaaaaaccugacgaauaucgauauuuccaagaacagcuuucauucuaugccggaaacaugucaauggcccgagaagaugaaauaucuuaaucucuccagcaccagaauccacucugugaccgggugcauuccuaagacacuggaaauccuggacguuagcaacaauaaccucaaucuguucucccuuaaccugccccagcucaaagagcuguacauuagccggaacaagcugaugacccuuccugaugcuucucuccugcccaugcugcucgugcugaaaaucucccgcaaugccaucacaacguuuagcaaggagcagcuugacuccuuccacacccugaagacacucgaagcgggaggcaacaauuuuauuuguucuugcgaguuccugagcuuuacccaagaacagcaggcccuggcuaaaguccuuaucgauuggccggccaacuaucugugugacuccccuucucaugugagaggccagcaaguucaggacgugcggcucagcgucuccgagugccacagaacagcucuggugucugggaugugcugugcccucuuccugcuuauucugcucaccggaguccugugccaucgcuuucacggccugugguacaugaagaugaugugggcguggcuucaggccaaacggaagcccagaaaagcuccuagccgcaauaucuguuaugaugccuucguguccuacagcgagcgggacgcuuauuggguugaaaaccugauggugcaggagcucgaaaauuuuaacccucccuucaagcugugccuccauaagagagauuucauucccgggaaauggaucauugacaauaucaucgauucuauugagaagucccacaaaacggucuuugugcugagcgaaaacuucguuaagucugagugguguaaauacgagcuugacuuuucccacuuccgccuguuugaugaaaauaacgacgccgccauccucauucugcuggagccgaucgaaaagaaggcuauuccccaacgguucugcaaacuuagaaagaucaugaauaccaaaacauaccuggaguggccuauggaugaagcgcagcgcgagggauuuugggugaaccuccgggccgcuaucaagagcuga

SEQ ID NO: 76897 - RNA, 2715 nt, Artificial Sequence
  derived and/or modified sequence opt5 from TLR3__Homo_sapiens__NP_003256
augagacagacccugcccugcaucuacuucuggggcgggcuccugccuuuuggaaugcuuugugccagcuccacaacgaagugcaccgugucucacgaggucgcugacuguagccaucugaaacucacacaaguuccggaugaccugcccaccaacauuacagugcuuaaucugacccacaaccagcuccggcgccugccugccgcgaauuucacaagauauucccagcugaccucucucgaugugggcuuuaacacgaucagcaagcuggaacccgagcuuugccagaaacugccuaugcucaagguccugaaucuucaacauaacgaacugucccagcucucugacaaaaccuucgcuuuuuguacaaaucugaccgagcugcaccucaugagcaacuccauucagaagaucaagaauaaccccuucgugaaacagaagaaucugauuacacuugaucugagccauaacgggcucucuuccaccaaacugggaacgcaaguucagcuugaaaaucugcaggagcuccugcugagcaacaauaagauccaggcccucaaaucugaggaacuggacaucuuugccaacuccagccuuaagaagcuggagcucucuuccaaccaaauuaaagaguucagcccuggcugcuuucacgcuaucgggcggcuguucggacuuuuucugaauaacgugcagcucggcccgucccugacagaaaagcugugucucgagcuggccaauaccucuauucgcaaccuuagccuguccaauagccagcucucuacaaccuccaacaccacauuccugggccugaaauggacgaaucuuaccaugcucgaucugagcuacaacaaucugaacgucguggggaaugacucuuuugcuuggcucccccaacuggaauauuucuuccuugaguacaacaauauccagcaccuguuuagccauucccuccacggacuguucaacguuagauaucugaaucuuaagcggucuuuuacaaaacagagcauuucccucgccagccugccuaagaucgaugacuucucuuuucaguggcugaaaugccucgaacaucugaacauggaggauaacgacauucccggcaucaaguccaauauguucaccgggcuuaucaaccugaaguaccucagccugucuaauuccuuuacaagccugcgcacccuuacgaacgaaacauucgugucccucgcgcacucuccucugcacauucugaaucucaccaaaaacaagaucagcaaaauugaguccgaugccuuuucuuggcugggacaucuugagguccuggaccucggccugaaugaaaucgggcaagagcugaccggacaggaauggagaggccuugagaacauuuucgaaaucuaucucagcuacaauaaguaccugcagcugacacggaacuccuuugcucucgugcccagccugcagcgccuuaugcugagacggguggcccucaaaaaugucgacucuuccccgagcccuuuccaaccccugcgcaaccugaccauccuugaucugucuaauaacaauauugcuaacaucaacgacgauaugcucgagggccuggagaagcucgaaauucuggaccuucagcacaauaaccuggccagacucuggaagcaugcgaauccugggggacccaucuauuuucugaaaggccugucccaccuucauauucugaaccucgagagcaauggguucgaugaaauccccguugagguguucaaggaccuguuugaacucaaaaucauugaucugggacuuaacaaucugaacacacucccugccucuguguucaauaaccaggucagccugaagucccugaaucuucagaaaaaccugaucacgagcguggagaagaagguuuuuggcccggcuuuccggaaucucaccgagcuggacaugcgcuuuaaccccuucgauuguacaugcgaaucuauugccugguuugugaauuggaucaacgagacccacacaaacauuccugaacucuccagccacuaccuguguaauacgcccccucauuaucacggguuccccgucagacuuuuugacaccuccucuugcaaagauagcgcuccguucgagcuguuuuucaugaucaacaccuccauucugcucaucuuuaucuucauugugcugcuuauccauuucgagggauggcggauuucuuuuuacuggaauguuagcgugcacagaguccugggcuucaaggaaaucgaccgccaaacagagcaguuugaauaugccgccuacauuauccacgcuuauaaagacaaggauugggugugggagcauuucuccucuauggaaaaagaggaccagagccucaaguuuugccuggaggaacgggauuucgaggcgggcgucuuugaacucgaggccaucgugaacuccauuaagagaagccgcaaaaucauuuucguuaucacccaccaucugcuuaaggacccucuguguaaacgguuuaaggugcaccaugcuguccagcaagccauugaacagaaucuggauucuaucauccucguguuccuggaggagauucccgacuacaaacuuaaccacgcccugugccucagacgcgggauguuuaagucccacuguauccugaauuggccuguucagaaagaacggauuggagcuuucagacauaagcuccaaguggcccugggcagcaagaacucuguccacuga

SEQ ID NO: 76898 - RNA, 2400 nt, Artificial Sequence
  derived and/or modified sequence opt5 from TLR4__Homo_sapiens__NP_003257
auggagcugaacuucuacaagauccccgacaaucucccuuuuagcaccaaaaaccuggaucuuuccuucaauccgcugagacaccucggcucuuauagcuuuuucuccuuucccgaacuucaggugcuugaccugucucggugcgagauucaaacaaucgaagauggggccuaccagagccucucccaucugucuacgcugauucucaccggaaacccuauccagagccuggcucuuggcgccuucuccgggcugagcucucuccagaagcuggucgcgguugagacaaaucuugcuucccuggaaaacuuucccauuggacaccucaaaacccugaaggagcugaauguggcccauaaccucauccagagcuucaaacugccugaguauuuuucuaaucuuacaaaccuggaacaccucgaccuguccagcaauaagauccaaucuauuuacuguaccgaucuucgcgugcugcaucagaugccccuccugaaccugucccucgaccugagccuuaauccuaugaacuucauccagccgggcgccuuuaaggagauuagacugcacaaacucacacugcggaauaacuucgauucccuuaacgucaugaagaccugcauccaagggcuggcuggacucgaagugcaccgccugguucugggcgaguuuagaaaugagggcaaccucgaaaaauucgacaagucugcccuggaggggcuuuguaaucugacgauugaagaguuccggcucgcuuaucuggauuacuaucuggacgauaucauugaccuuuuuaacugccucaccaaugugagcuccuucagccuggucucugugacaaucgaacgcguuaaagauuuuuccuacaacuucggauggcagcaucuggagcucgugaauuguaaguuuggccaguuccccacccugaagcugaaaagccugaagagacucacauuuaccucuaacaaagggggaaaugccuucagcgaggucgaccugccuucccuggaauuucuugaccucucucggaacggccugagcuucaaggggugcuguucccagagcgauuuuggaacgacaucucugaaauaccucgaccuguccuucaauggcgugaucaccaugagcucuaacuuucuuggccuggagcaacucgaacaccuggauuuccagcauuccaaucugaagcagaugagcgaguucuccguguuucuuucucuccgcaaccugauuuaucuggacaucagccacacacacaccagagucgcguucaaugggauuuuuaacggacucuccucucuggaaguucuuaaaauggccggcaacagcuuccaagagaauuuucugcccgauaucuucaccgagcuccggaaccugacauuucuggaccuuucccagugccagcucgaacagcugagcccuacggcuuucaauucucuguccagccuccaagugcugaacaugucucauaauaacuuuuucucccuugauaccuuucccuacaagugucugaauagccuccaggugcuggacuauucucugaaccacauuaugacaagcaagaaacaggagcuucagcauuucccguccagccuggccuuucucaaucugacccaaaacgauuucgcuugcacaugugaacaccagucuuuccuccaguggaucaaggaccagcgccaacugcuugucgagguggaaagaauggagugcgccaccccuuccgauaaacaggggaugcccguucugagccucaauaucacgugccagaugaacaagacaauuaucggaguguccguccugucugugcugguugugagcgucguggcgguccuuguguacaaauuuuauuuccaucugaugcuccuggccggcuguauuaaguacgggcggggagagaauaucuaugacgcuuuuguuauuuacuccucucaggacgaagauugggugcgcaacgagcucgucaagaaucuggaagagggcgugccucccuuccaacuuugccugcacuacagagacuuuauccccggcguugccaucgcugccaacauuauccacgagggguuccauaaaagccggaaggugauugucguggugucccagcacuuuauccagucuagaugguguauuuucgaauaugagaucgcccaaaccuggcaguuucucagcucccgcgcuggaauuaucuucaucguucugcagaaagucgaaaagacccugcuucggcagcaaguggagcuguacagacuccugagccgcaacacauaucucgaaugggaggauucugugcugggccggcauaucuuuuggagacgccuucggaaagcgcugcuggacgggaaguccuggaauccugagggaaccgucggcacagggugcaacuggcaggaagccacgagcauuuga

SEQ ID NO: 76899 - RNA, 2577 nt, Artificial Sequence
  derived and/or modified sequence opt5 from TLR5__Homo_sapiens__XP_006711569
augggcgaccaccuggaucuccugcuuggggugguccugauggccggacccguuuucggcaucccuagcugcuccuuugacgggagaauugcuuucuaccgguuuuguaaccucacccaggugccgcaagugcugaauacaacggagcgccuucugcucucuuucaacuauaucagaaccgucacagccagcuccuuucccuuccuggaacagcugcagcuccuggagcuuggaucucaguacaccccucugacaauugauaaggaagcguuucggaaucuccccaaccugcgcauccuugaccugggcagcuccaaaauuuauuuccuccauccugaugcuuuucaagggcuguuccaccuguuugagcucagacuguacuucugcggacuuucugacgccgugcugaaggauggcuauuuucggaaucucaaagcccugacccgccuugaccugagcaagaaccagaucagaucccucuaccugcaucccagcuucggcaaacucaauucucucaaguccaucgauuucagcucuaaccagauuuuucugguuugugaacacgagcuugagccucugcaggggaagacacucuccuucuuuagccuggcugccaauucucuuuauucccgggugagcgucgacuggggaaaaugcaugaacccguuccgcaauauggugcuggaaauccucgauguuuccggcaacggguggaccguggacauuacgggaaauuuuucuaacgcuaucagcaagucccaagccuucagccugauucuggcgcaucacaucaugggcgccggguuuggauuccacaauauuaaagaucccgaccagaacaccuuugcuggccucgccagaucuuccguccggcaucuggaccuuagccacggcuucguguuuucucugaacagccgcguguucgagacacucaaggaucugaaaguccugaaucuugcuuacaacaagaucaauaagaucgccgacgaagcguuuuacgggcucgauaaccugcagguucugaaucucuccuauaaccugcuuggagagcuguacucuagcaauuucuauggccucccuaaaguggccuacauugaccugcagaagaaccauaucgcuauuauccaagaucagaccuucaaauuucuggagaagcugcagacacucgaccugagagauaaugcccugaccacgauucacuucauccccuccaucccugacauuuuucucagcgggaacaaacuggugacacuucccaagaucaaucugaccgcuaaccucauucaccugucugaaaaucggcuggagaaccuugauauccucuauuuccugcugcgcgucccgcaucuccaaauucugauccuuaaucagaacagauuuuccagcuguucuggagaccagacaccuuccgaaaaccccagccuggagcagcuguuccugggcgaaaauaugcugcaacuugccugggagaccgagcucugcugggauguguuugaagggcugucccaucugcagguucucuaccugaaccacaauuaucuuaacucucugccucccggaguguucagccaccucaccgcccugcggggccugucccuuaauucuaacagacugacaguccucagccauaaugaccugcccgcuaaccucgagauccuggacauuucccgcaaucagcuucuggcgccuaacccggauguguuuguuagccucucugugcuggacaucacgcacaauaaauucauuugugaaugcgagcuguccaccuuuaucaacuggcuuaaucacacaaacgucaccauugccgggcccccugcugauaucuacuguguguaccccgacagcuucucuggcgucucccuguuuagccucucuacagaaggaugcgaugaggaggaagugcuuaagagccucaaguucucccuguucauuguuuguaccgugacgcuuacacuguuucucaugaccauccugaccgucacaaaauuccggggcuuuugcuucaucugcuauaagaccgcccagagacugguguuuaaagaccauccucaagggacagagcccgauauguacaaguaugacgccuaccuuuguuucagcucuaaagauuuuacguggguucagaaugcucugcucaagcaccuggacacccaguauuccgaucagaaccgcuucaaccucugcuuugaggaacgggacuucgugccgggagaaaauagaauugccaacauccaagaugcgauuuggaauagccgcaagaucgucugucuggugucccggcauuuucuuagagacggcuggugccuggaggcuuucucuuacgcccaggggcgcugucugagcgaccucaacuccgcccugauuauggugguugucggcucucuuagccaguaucagcugaugaaacaccaauccauccggggauucgugcagaagcagcaauaccucagauggccugaggaucugcaggacgugggcugguuucuccacaaacugucucagcagauccuuaagaaagaaaaggagaagaaaaaggauaauaacauuccccugcaaacagucgcuaccaucagcuga

SEQ ID NO: 76900 - RNA, 2391 nt, Artificial Sequence
  derived and/or modified sequence opt5 from TLR6__Homo_sapiens__NP_006059
augaccaaggacaaagagcccaucgugaagucuuuccacuuugucugccugaugauuaucauuguuggcacaagaauccaguucuccgaugggaacgaauuugccguggacaaaucuaagcggggacucauucaugugccuaaagaucugccgcuuaagacgaagguccuggacaugagccaaaauuacaucgcugagcuccagguguccgauaugucuuuccugagcgaacuuaccguucugcgccucucccacaacagaauccagcugcuggaccucucuguguuuaaauucaaucaggaucuggaguaucuugaccugagccauaaccaacuccagaagauuuccugucaccccaucgucagcuuucggcaucuggaucuuucuuucaaugacuuuaaagcccugccuauuugcaaggaguucggcaaccucucccagcugaauuuucuggggcucagcgcgaugaaacugcagaagcuggaucugcuccccaucgcucaccuucaccuuucuuacauucugcucgaccugcgcaacuauuacaucaaggagaaugagacagaaucccugcaaauucucaacgccaaaacccugcaucuuguguuccacccuacaagccuguuugccauccagguuaauaucucugugaacacccucggaugucugcagcuuacaaauauuaagcugaacgaugacaauugccaggucuucaucaaauuccucuccgagcugaccagaggcagcacgcugcucaacuuuacccugaaccauauugaaacaaccuggaagugucuugugcggguguuccaauuucuguggcccaaaccugucgaguaucucaauaucuacaaccugacaauuaucgaguccauccgcgaagaggacuucaccuauucuaagacgacacugaaagcucuuaccauugaacacaucacaaaucagguuuuucucuucagccagaccgcccuguacaccguguuuuccgagaugaacauuaugaugcugacaaucagcgauacgccguucauucacaugcucugcccccaugcuccuucuaccuuuaaguuccugaauuuuacacaaaacguguucaccgacuccaucuuugaaaaguguagcacacuugucaaacuggagacccucauccugcagaagaaugggcugaaagaucuuuucaaggugggacucaugacgaaagacaugcccucucuggagauucuggauguuagcuggaacucccucgaaucuggcagacacaaggagaauugcacauggguggaaagcaucgucgugcugaaccuuuccagcaauaugcugaccgacucuguuuuccggugucucccuccccgcauuaaggugcuggaucugcauuccaacaaaaucaagagcgucccgaaacagguggucaaacuugaggcccuccaggaacugaauguggcguuuaacucucugaccgaccucccuggcugcggguccuucagcucccugucuguucuuauuaucgaucacaauagcgugucccaucccucugccgacuuuuuccaaagcugucagaagaugagauccauuaaggcuggagauaacccuuuucagugcacaugcgagcugcgggaguucgucaagaacaucgaccaggugagcucugaaguucucgagggcuggcccgacuccuacaaaugugauuaucccgaaagcuaccgcgggucuccucugaaggacuuucacauguccgagcugagcugcaauaucacccuucucauugugacaaucggagccacgaugcugguccuggcugugaccgugacaucucucuguauuuaucuggaucuuccgugguaccugagaaugguuugccaauggacccagacacggcgcagagcccggaacaucccccucgaagaacugcagagaaaucugcaguuccacgcguuuauuagcuauuccgagcaugacagcgccugggucaaaucugaacuugugccuuaccuggagaaggaagauauccaaaucugucuccacgagcgcaacuucgugcccggcaaauccauugucgagaauaucauuaacugcaucgaaaagagcuauaaguccauuuuugugcugucuccuaauuucguucagagcgaguggugucauuacgaacucuacuuugcucaccacaaccuguuccaugagggguccaauaaccuuauccugauccuccuggaacccauuccgcagaauagcaucccuaacaaauaucacaagcugaaagcccuuaugacccagcggacguaccugcaauggcccaaggagaaaagcaagagaggacucuucugggcuaauauucgcgccgccuuuaacaugaaacugacccucgugacagagaauaacgacgucaaguccuga

SEQ ID NO: 76901 - RNA, 3150 nt, Artificial Sequence
  derived and/or modified sequence opt5 from TLR7__Homo_sapiens__NP_057646
augguguuccccauguggacccugaagagacagauccucauucuguuuaacaucauucuuaucagcaaacugcucggcgcccggugguucccuaagacacugccgugcgacgucacgcuugauguucccaaaaaucacgugauuguggacuguaccgauaagcaucugacagagaucccugggggaauccccaccaacacaaccaaucucacacugaccauuaaccacaucccugacauuucccccgcuucuuuucaucgccuggaucaccucgucgaaaucgacuucagaugcaauugugugccuauuccgcugggcagcaaaaacaauaugugcaucaagcggcuucaaauuaagccccgcuccuuuucugggcugacguaccucaaaagccuguaucuugauggaaaccagcugcucgagaucccucagggccugcccccuucccugcagcuccugucucuugaagccaauaacaucuucagcauuagaaaggagaaucugaccgaacucgcgaacaucgagauucuguaccuugggcaaaauuguuauuaccggaaccccugcuauguuuccuacagcaucgagaaagacgcuuuucugaaucucacaaagcugaaagugcugucucucaaggauaacaacgucaccgccgugccgacaguucugccuuccacccuuacggaacuguaucucuacaauaacaugauugccaagauccaggaggacgauuucaauaaccugaaucagcuucagauccuggaccucagcggaaacuguccccgcugcuacaaugcuccuuuucccugugcccccugcaaaaacaauucuccucugcaaauuccggugaacgcuuucgaugcccugacagaacucaagguccugagacuucauuccaauagccugcagcacgugcccccucggugguuuaaaaacaucaauaagcuccaggagcuggaccugucucagaacuuccuugcgaaagagauuggcgacgccaaguuucuccacuuccugcccucccugauccaacucgaucugagcuucaauuuugaacuucagguguaucgcgcuuccaugaaccugucucaggccuucagcucccucaaaagccugaagauucugagaauccggggcuacgucuuuaaggagcuuaaaucuuucaaccucuccccucugcauaaucugcaaaaccucgaaguucuggaccuugggaccaauuuuaucaagauugcuaaccugagcauguucaaacaguuuaagcgccucaaagugaucgaucugucugugaauaagauuagccccuccggagacucuagcgaggucggcuucuguuccaacgccagaacaagcguggaaucuuaugagccgcagguucuggagcagcuucacuacuuucgguaugauaaguacgcgcgcuccugcagauucaaaaauaaggaagccagcuuuaugucugugaacgaguccugcuauaaauacgggcaaacccucgaccugagcaaaaauuccaucuucuuugucaagucuagcgauuuccagcaucuguccuuccucaagugucugaaccuuucuggaaaucugauuagccagacccucaacggcuccgaauuucagccucuggcugagcugcgguaccuugacuucagcaauaacagacucgaucugcugcacucuacagccuuugaagaacuccacaagcuggaggugcuugacaucuccagcaauucucauuauuuccaauccgaagggauuacgcacaugcugaacuuuaccaaaaaccucaagguucugcagaaacugaugaugaaugauaacgacaucagcucuagcacaucccgcaccauggagagcgaaucucuucggacacuggaguucagaggaaaucaucucgacgugcuguggcgcgaaggcgauaaccgguaccuccagcuguuuaagaaucuucugaaacucgaggagcuggacaucuccaagaacagccuguccuuccuucccucuggcgucuuugaugggaugccucccaaucugaagaaccucagccuggcuaaaaauggacucaaguccuucucuuggaaaaagcugcagugccuuaaaaaccuggaaacccucgaccugagccacaaucaacugacgacagugccugagagacuuuccaacuguucucgcagccugaagaaucucauucugaaaaacaaucagauccggucccucaccaaguauuuucugcaggaugccuuccagcuuagauaccuggaccugagcucuaacaagauucaaaugauccagaaaaccuccuuucccgaaaacguccucaauaaccugaagaugcuucugcuccaucacaaucgcuuccugugcacaugugaugccgugugguucguuuggugggugaaccacaccgaggucacaauuccguaucucgcuacggacgugaccugcguuggcccuggggcgcauaaaggacagagcgugaucucucuggaucuuuacacaugugagcuggaccugaccaaucucauccuguuuucccuuagcauuucugucucccuguuccucauggugaugaugacagccagccaccuguauuuuugggaugugugguacaucuaccauuucugcaaggcuaaaauuaagggcuaucaacggcucaucucccccgacuguugcuacgaugccuuuauuguuuaugacaccaaggaccccgccgucacggaaugggugcuggcugagcuuguggccaaacuggaagauccuagagagaagcacuucaaccugugucucgaggagcgcgacuggcugccggggcagcccguccuugagaaucugagccagucuauccagcucagcaaaaagaccguguuuguuaugacagauaaauacgcgaagaccgaaaacuucaagaucgcuuuuuaucugucccaccaacggcucauggacgagaaaguggaugucauuauccugauuuuccuugaaaagccuuuucagaaaucuaaguuccugcagcugagaaaacggcucugcggaagcuccgugcuggaguggcccacaaauccucaggcccaucccuacuucuggcaaugccuuaagaacgcccuggcuaccgacaaucacguugccuauucucagguguuuaaggaaacggucuga

SEQ ID NO: 76902 - RNA, 3126 nt, Artificial Sequence
  derived and/or modified sequence opt5 from TLR8__Homo_sapiens__NP_619542
auggagaacauguuccugcagagcuccaugcugaccugcaucuuucugcuuauuucuggcagcugugaacugugcgccgaggaaaauuucuccagaucuuaccccugugacgagaagaaacaaaacgauagcgugaucgcugaaugcuccaaucggcgccuccaggaggucccucagacaguugggaaguaugugacggagcuggaccuuucugauaacuuuauuacccacaucacaaaugaauccuuccagggacugcaaaaccucaccaaaauuaaucugaaccauaauccgaacgugcagcaccagaauggcaaccccgggauccaguccaauggacugaacaucacagacggcgccuuucucaaucugaagaaccuuagagagcugcuccuggaagauaaccaacuuccucagauucccagcgggcugccugagucucucaccgagcugucccugauccagaauaacauuuacaauaucacaaaagaaggaauuagccggcucaucaaccugaagaaucuuuaucuggcguggaacuguuacuucaauaaggucugcgagaaaaccaacauugaagacggcguguuugagacgcucaccaaucuggaacuucugucucucuccuucaacagccugucucauguucccccuaagcugccguccagccuccgcaaacuguuucuuuccaauacacagaucaaguauaucucugaggaggauuucaaaggccugauuaaccucacccugcuugaccugagcgggaauugucccagaugcuuuaacgcuccuuuccccugugugccuugcgauggaggcgccuccaucaauauugaccgguuugccuuccaaaaccucacacagcugcgcuaccugaaccucagcucuaccucccugagaaagaucaaugcugccugguucaagaacaugccccaccuuaaaguccuggaucucgaauuuaauuaucuggugggggagauugcuagcggagccuuccugacgaugcuuccgcggcucgaaauccuggaccugucuuuuaacuacaucaagggcagcuacccucagcauauuaauaucucccgcaacuucucuaaacuccugagccuuagagcgcugcaccuccggggguauguuuuucaagagcugcgcgaagaugacuuccagccccugaugcagcuuccuaaucucuccacaauuaaccugggaaucaauuuuauuaagcagaucgacuucaaacuguuucaaaacuucagcaaucucgagaucauuuaccugucugagaacagaaucagcccccuugugaaggauacccggcagagcuaugccaauucuuccagcuuucagcgccacauuagaaaacggagauccacagacuucgaauuugauccccauucuaacuucuaccacuucacccgcccucugaucaagccgcagugugcugccuauggcaaggcucucgaccugagccucaauuccauuuucuucaucggccccaaccaauuugagaaccuuccugauauugccugccucaaucugucugcgaacagcaaugcccagguccuguccgggaccgaauuuagcgcuaucccccaugugaaauaccucgaccugacaaacaaucggcuugauuuugacaacgccucugcucugacggagcucuccgaucuggaagugcuggaccuuagcuauaauucucacuacuucagaaucgccggagucacccaccaucucgaguuuauucagaacuucacaaaucugaagguucugaaccucucccacaauaacaucuacacccugacagauaaauauaaucuugagagcaagucucugguggaacucguguuuagcggcaaccgccuggacauucuguggaaugacgaugacaaccgguacaucuccauuuucaaagggcuuaagaaccugaccagacucgaucugagccucaaucgccugaagcauaucccuaacgaggccuuucuuaaucugcccgcuucucucacggaacugcacaucaacgacaauaugcugaaauucuuuaacuggacacuucugcagcaauucccgcggcucgagcugcucgaucugagaggaaauaaacuucuguuccucaccgacucccugagcgauuuuaccuccucucugcgcacacuucugcucagccauaaccggauuucccaucugccuucuggcuuccucagcgaggucuccucucugaagcaccuugaccugagcuccaaucugcucaagaccaucaacaaaagcgcgcuggaaacaaagacgaccacaaaacuuucuaugcuggagcuccacgggaaucccuuugaaugcaccugugauauuggagacuucagacgcuggauggaugagcaccugaacgugaagaucccucggcucguugacgugauuugcgccucccccggcgaucagagaggcaagagcaucgucucucuggaacuuacaaccuguguguccgacguuacggcugugauccuguuuuucuuuaccuucuuuauuacaaccauggucaugcuggccgcccucgcucaucaccuguucuauugggacgugugguuuaucuacaaugucugccuugccaaagugaagggguaucggagccugucuacaucccagaccuucuacgaugcguauauuagcuacgacacgaaagaugcuuccguuacagacugggugaucaacgagcuccgcuaccaccuggaggaaagcagagauaagaauguccuccugugucuugaggaacgggacugggauccuggacuggccauuaucgacaaccugaugcagucuaucaaucaaagcaagaaaaccguguucguucucacaaagaaauaugccaaguccuggaacuuuaaaaccgcuuucuaccuggcccuucagagacugauggaugagaacauggacgugauuaucuuuauucuccuggaacccguccuccagcauucucaauaucugcgccuucggcagagaaucugcaagagcuccauucugcaguggccggauaauccuaaagcugagggccuguucuggcagacccuccgcaacguggugcugacagagaaugacucuagauacaacaauauguauguugauagcaucaagcaauacuga

SEQ ID NO: 76903 - RNA, 3099 nt, Artificial Sequence
  derived and/or modified sequence opt5 from TLR9__Homo_sapiens__NP_059138
augggcuucugcagaagcgcccugcacccccucucccugcuugugcaggcuaucaugcuggccaugacccucgcgcuggggacacuuccugcuuuucugccgugugagcuccaaccccauggacuggucaacugcaauuggcuguuccucaagucuguuccucacuuuagcauggccgcuccccggggcaacgugacgucccugucucuuagcuccaaucgcauucaucaucugcacgacucugauuucgcucaccucccuagccugagacaccuuaaccugaaauggaauugucccccuguggggcucuccccgaugcauuuucccugccacaugaccaucgaaccuagcacauuccuggccguccccacccuggaggaacucaaccugucuuacaauaacauuaugacagugccugcucugcccaagucccugaucagccucucucugucccauaccaauauucuuaugcuggacagcgccucucucgcgggacugcacgcccugcgguuucucuucauggauggcaacuguuauuacaaaaauccgugccgccaggcucuggagguugccccuggggcccuucugggacucggcaaccugacacaccuuucccugaaguauaauaaccucaccgugguccccagaaaucugccuagcucccuggaauaccuccugcuuucuuauaaccggaucgugaaacuggcccccgaggaccucgcgaaccugacggcccugcgcguucuugaugugggcgggaauuguagacggugcgaccaugcucccaacccuuguauggagugcccgcgccacuuuccccagcuccauccugauaccuucagccaccuguccagacuggaaggacucguccugaaggacagcucucuuuccuggcugaaugccagcugguuucggggccucgggaaccugcgcgugcuggaucuuucugagaauuuccucuacaaguguaucacaaaaaccaaggcuuuucagggacugacacaacugagaaaacucaaccugagcuucaauuaucagaagcggguguccuucgcccaucuuucucuggcccccagcuuuggcucccucgucgcucugaaagaacuggacaugcacgggauuuucuuucgcagccuugaugagaccacgcucagaccucuggcgcggcugcccaugcuccagacacugagacuucagaugaacuucaucaaucaagcccagcugggaauuuuucgcgcuuucccgggccuccgguacguugaccugucugauaacagaaucuccggcgccagcgagcugaccgccacaaugggggaagcugacggaggcgagaagguguggcuucagccuggggaccucgcccccgcgccuguggauacccccucuuccgaagacuuucgcccuaauugcagcacccugaacuucacacuggaucucucccggaauaaccuggucacggugcagcccgagauguuugcucaacuuucucaucugcagugccucagacugagccacaauuguauuucccaggccguuaacggaucucaauuccugccgcuuaccggccuucaggugcucgaccugagccacaacaagcucgaucuguaccaugaacacuccuuuacagagcuuccucgccuggaggcccucgaccugagcuauaauucucagcccuucgggaugcagggagucggccacaacuuuuccuucguggcucaucugcggacccuuagacaccugagccucgcccauaauaacauccacucucaaguuucccagcagcugugcagcacaucucuccgcgcucuggauuucagcggcaaugcccuugggcauaugugggcggaaggagaccuguaccuccacuuuuuccagggccuguccgggcugauuuggcuugaucugagccaaaaccggcuccacacccugcucccccagacgcugagaaaucuuccuaaaucucuccaggugcugcgccugcgggacaacuaucuggccuuuuucaagugguggucccuucauuuucugccgaaacucgagguccuggaucucgcuggaaaucagcugaaggcccuuacaaacggcagccugcccgcugggaccagacugcggcgccucgacguguccuguaauucuaucagcuucgucgccccuggcuuuuucuccaaagcgaaggaacugagagagcuuaaccugucugccaaugcucucaaaaccguggaccacagcugguuuggaccccuggccuccgcucuccaaauccuggauguuucugccaacccucuucauugcgccuguggcgcugcguucauggacuuucugcuggaagugcaggccgcuguccccgggcucccuagccgggugaagugcggaucccccggccagcugcaggggcuuagcauuuucgcccaagaucugagacucugucuggacgaggcccucucuugggauugcuuugcucugucccuucuggccguugcgcugggacucggcgugccgaugcugcaccaucuuugugggugggaccugugguacugcuuccaccucugucuggcuuggcugccuuggcgcggccggcagagcggaagagaugaggacgcccuccccuaugaugccuucgucguguuugacaagacacagucugcuguggccgauuggguuuacaaugaacuucgcggccaacuggaggaaugcagagggcggugggcgcugcgccucugccuggaggaaagagacuggcuuccuggaaaaacccuguucgagaaccucugggcuuccgucuauggcagccggaagacacuguuugugcuggcccacacggaucgcgugucugggcuccuuagagccuccuuccugcuggcucagcagcggcuccuggaggaccgcaaagacgucgugguucuugugauccugagccccgauggaagacggucccgcuacgucagacuccggcagagacugugucgccaaagcgugcugcucuggccgcaucagccuucuggccagcggagcuuuugggcccagcuugggauggcucugaccagagacaaccaccauuucuacaaucgcaacuuuugccaaggccccacagccgaauga

SEQ ID NO: 76904 - RNA, 774 nt, Artificial Sequence
  derived and/or modified sequence opt5 from TLX1__Homo_sapiens__NP_001182446
auggagcaccugggcccccaucaccuccauccugggcacgccgaaccgaucagcuucggaauugaccagauccugaacucccccgaucaaggcgggugcaugggaccugcuucuagacuucaggacggcgaguacgggcugggaugucucgugggcggcgccuauaccuacgggggaggcgggagcgcggcugccacaggagccggcggggcuggagccuauggcacgggcgggcccggaggcccugggggacccgcuggcgggggaggcgccugcuccaugggcccucugaccgggucuuacaaugucaacauggcgcuugccggaggcccggggcccggaggcgggggcggaagcuccggcggggcuggagcccugucugcugccggcguuauucgggugccugcgcaucgcccccucgccggggcuguggcccacccucagccccuggcuacaggacugccgaccgucccuagcgugcccgccaugccuggcguuaauaaccucacagggcugaccuuucccuggauggaauccaauagacgguauacaaaggaucgcuucaccggccaccccuaccagaacagaacgccuccgaaaaagaaaaagccccggaccagcuuuacacgccuucaaaucugugagcuggagaaaagauuccaucggcagaaguaucucgccucugcugaacgcgcggcccuggcuaaggcccuuaaaaugaccgacgcccaggugaagacaugguuucagaauagacggaccaaauggcgcuga

SEQ ID NO: 76905 - RNA, 855 nt, Artificial Sequence
  derived and/or modified sequence opt5 from TLX2__Homo_sapiens__NP_057254
auggagcccggcaugcuggggccucacaaccucccgcaucacgaacccaucagcuucggaauugaccagauccuguccggcccugagacccccgggggaggccuugggcugggaagaggcggccaagggcauggagaaaauggcgccuuuucugggggauaccacggcgcuagcggguauggaccugccggcucccucgcgccccugccuggcucuagcggggugggaccgggcggggucauucggguucccgcucaucgcccucuucccgugccucccccggccggaggcgccccugcugugcccgggccuuccggacugggcggcgccgggggacucgcuggccugacauuccccuggauggauucugggagacgguuugccaaggaccgccugacggcggcccucagccccuucuccggaaccagacggaucggccacccuuaccagaaccgcacaccgcccaaaagaaagaaaccucggaccagcuuuucucgcucccagguccuggagcuugaaagacgguuccugcgccagaaguaucucgcuagcgccgagagagcugcccuggcgaaagcccuucggaugacagaugcucaagugaagaccugguuucagaaucgcagaacaaaguggcggagacagaccgccgaggaacgcgaggcugaacggcacagagccgggcgccugcuccugcaucugcagcaagacgcccucccccggccucugagacccccgcuuccucccgauccucugugccuccacaacucuucccuguucgcgcuucagaaucugcagcccugggcugaggacaacaaaguugccagcgugucuggccucgcuuccgucguguga

SEQ ID NO: 76906 - RNA, 876 nt, Artificial Sequence
  derived and/or modified sequence opt5 from TLX3__Homo_sapiens__NP_066305
auggaggcccccgcuagcgcccagaccccucacccgcaugaacccaucuccuucggcauugaccaaauccugaacucuccugaucaggacagcgcgcccgcuccuagagggcccgauggagccuccuaccucggcgggccuccgggaggccggcccggggccacauauccuucucugcccgcuagcuuugccggacuuggcgcuccuuucgaggacgccggcuccuacucugugaaucugagccucgcgcccgccggggucauucgcguuccggcucacagaccucugcccggagccgugccuccuccccuucccuccgcucugccggccaugcccagcgugccuacggucucuucccucggcgggcugaacuuucccuggauggaaagcucucggcgcuucgugaaggauagauuuaccgcggccgcugcccugacaccuuucaccguuacacggcgcaucggacaucccuaucagaauagaaccccgccuaaacggaagaaaccccgcacauccuuuagcagagugcagauuugcgagcucgaaaagcgguuccaccgccaaaaauaccuggcuucugccgagagagccgcucuugcgaagucccugaagaugaccgacgcccaggucaaaacgugguuucagaaccggcgcaccaaguggagacggcagacagcugaggaaagagaggccgaacgccaacaggccagccggcucaugcugcagcuucagcaugaugcuuuccaaaaaucccugaaugacucuauccagccugauccccucugucugcacaacagcucccuguuugcccuccagaaucugcaaccuugggaggaggacagcucuaaggugcccgcgguuaccucccuuguguga

SEQ ID NO: 76907 - RNA, 609 nt, Artificial Sequence
  derived and/or modified sequence opt5 from TM4SF1__Homo_sapiens__NP_055035
augugcuacggcaagugugccagaugcaucgggcacagccuggugggacucgcucugcuuuguauugccgcgaacauccugcucuauuuccccaauggcgagaccaaauacgcuuccgaaaaccaucugucucgguuugucugguucuuuagcgggauuguuggaggcgggcuucugaugcuccugccugccuucguguuuaucggacuggagcaggacgauugcuguggcugcuguggccacgaaaauugcgggaagcgcugugccaugcucuccucugugcuggcugcccuuauuggaaucgcuggcagcggguauugcgucaucguggccgcgcugggacucgccgagggcccgcugugucuugacucccuggggcaauggaacuacacauucgcuucuacggaaggacaguaucuccuggauaccagcacaugguccgagugcaccgagcccaaacauauuguugaauggaaugugagccuguuuucuauccuccuggcccuuggcggcauugaguucauccugugccucauucaggucaucaacggggugcugggaggcauuuguggguuuugcuguucccaccagcaacaguacgacugcuga

SEQ ID NO: 76908 - RNA, 690 nt, Artificial Sequence
  derived and/or modified sequence opt5 from TM4SF20__Homo_sapiens__NP_079071
augaccugcugugagggcuggacaagcugcaacggguucucccugcucgugcugcuucugcucggagucguucugaaugccaucccccuuauugugucucugguggaagaggaccaguuuagccaaaacccuaucuccuguuucgaauggugguuuccgggcauuaucggggcuggacucauggccauucccgcgacgaccaugucucugacagcuagaaagcgggccugcuguaauaaccgcaccggcauguuccugagcucccucuuuucugucaucacagugaucggggcccuguacugcaugcuuauuagcauccaggcucugcucaaaggaccucugauguguaauucccccagcaacucuaaugccaacugcgaguucucccuuaagaauauuagcgauauccacccugaaucuuuuaaccugcagugguucuuuaaugacuccugugcucccccuaccggcuucaacaaaccgacaagcaaugauaccauggccucuggcuggagagcguccagcuuucauuucgacuccgaggagaacaagcaccggcucauucauuuuucuguuuuccuggggcugcuccuggugggaauccuugaaguccuguucggccucagccagauugugaucggguuucugggaugccuuuguggcguuuccaaacgcagaagccaaaucguguga

SEQ ID NO: 76909 - RNA, 609 nt, Artificial Sequence
  derived and/or modified sequence opt5 from TM4SF4__Homo_sapiens__NP_004608
augugcaccggcgggugugccagaugccugggaggcacacucaucccccuggcuuucuuuggguuccuugccaacauucugcucuuuuucccuggaggcaaggugaucgacgauaaugaccaccugagccaggagauuugguuuuucgggggaauccuuggcuccggcguccugaugauuuuuccggcgcucguuuuccuggggcugaaaaacaaugauuguugcggauguugcggcaacgaaggguguggaaagcgguuugcuauguucacgucuaccaucuuugccguggugggcuuccucggggccggauacagcuuuaucauuuccgcuaucucuauuaauaaaggccccaagugccugauggccaacagcacauggggcuauccuuuccaugacggggauuaccuuaaugacgaggcucuguggaacaaaugucgcgaaccccucaaugucgugccuuggaaccugacccuuuucuccauccugcucguugugggaggcauucaaaugguccugugcgccauccaggugguuaaugggcugcucggaacacuguguggcgauugccagugcugugggugcuguggaggcgacggccccguguga

SEQ ID NO: 76910 - RNA, 594 nt, Artificial Sequence
  derived and/or modified sequence opt5 from TM4SF5__Homo_sapiens__NP_003954
augugcaccggcaagugugccagaugcguggggcugagccucaucacacugugucuugucugcauuguugcuaacgcccugcuccuggugcccaauggagagacguccuggaccaacacaaaucaccuuucucugcagguuuggcucaugggcggguucaucggaggcgggcugaugguccuguguccuggaauugcggcugugcgggccggcggcaaagggugcuguggagccggcugcugugggaaccgcugcagaaugcuccggagcguguuuuccucugcuuucggagugcugggcgccaucuacugucuuagcgucuccggggcuggacugcgcaauggcccgagaugccucaugaacggcgaauggggguaucauuuugaggacaccgccggagcguaccugcuuaaucggacacugugggaucgcugcgaagcucccccuagagugguucccuggaacgugacccucuucucucugcuggucgccgccagcugucucgagauugugcugugcggcauccaacuugugaaugcuacaaucggggucuuuuguggagacugccggaagaaacaggauaccccucacuga

SEQ ID NO: 76911 - RNA, 1134 nt, Artificial Sequence
  derived and/or modified sequence opt5 from TM6SF2__Homo_sapiens__NP_001001524
auggacauucccccucuggccggcaagaucgcugcccucagccuguccgcgcuuccggugucuuacgcucugaaccacgucagcgcccucucccauccccuguggguugcccuuaugucugcucugauccucgggcugcuguucguggccguguauagccucucccacggagaggucucuuacgauccucuguaugcuguguuugccguuuucgcguuuaccagcguggucgaccuuauuaucgcccugcaggaagauuccuacgugguuggcuucauggaguuuuauacaaaagaaggggagcccuaccucagaacggcucauggaguguucauuugcuauugggacggcaccguccacuaccugcuuuaccuggccauggcuggggccaucugucggcgcaagagauaucggaauuuuggacucuacuggcugggcagcuucgcgaugucuauccugguguuucucacaggcaacauucuggggaaauauuccagcgaaauccgcccugccuucuuucuuaccauucccuaccugcucgugccuugcugggcuggaaugaaggucuucucucaaccgagagcccugacacgguguaccgcuaauaugguucaggaggagcagcgcaaaggccuucugcagagacccgccgaucucgcccuggugaucuaucugauucucgcuggguuuuucacacuguuccggggacuugugguccuggacugcccuaccgaugcguguuuuguguacaucuaucaauacgaacccuaccuccgcgacccuguugccuaucccaaggugcagaugcugauguacauguucuauguccuuccguuuugcggccuggcugccuacgcccucacguucccuggguguuccuggcugcccgauugggcucugguguuugccggaggcauuggccaggcgcaguucagccauaugggggcuucuaugcaccucagaaccccuuuuacauaucggguucccgaggacaccuggggaugcuucuuuguguguaaccugcuuuacgcccugggcccccaccuccuggccuaucgcugccugcaauggccugcuuucuuucaucagccgcccccuuccgauccccuugcccuccacaagaaacagcauuga

SEQ ID NO: 76912 - RNA, 1176 nt, Artificial Sequence
  derived and/or modified sequence opt5 from TM7SF2__Homo_sapiens__NP_001264162
auggcccccacccagggcccuagagcuccgcuggaguucgggggaccccucggcgccgcggcucugcuucugcuccugccugccacaauguuucaccuucugcucgccgcucggagcgggcccgcccgccugcugggaccucccgcuucccucccuggccuggaagugcuuuggucuccgagagcccugcuccuguggcuugcguggcuggggcuccaagccgcucuguaccugcuccccgcccggaaggucgcugagggacaggaacugaaagacaagagccgccuuagauauccuaucaacggcuuccaggcccugguucucacggcgcugcuugugggccuggggauguccgccggacucccccugggcgcucugccugagaugcuccugccccuugccuuuguggcuacccugacagccuucaucuuuucucucuuccuguacaugaaagcccaggucgcuccggugagcgcgcuugccccugggggaaauuccggcaaccccauuuaugacuuuuuccuggggcgggaacucaauccucgcauuugcuuuuucgauuuuaaguacuucugugagcugagacccggacugaucggcuggguucucauuaaccuggcucugcugaugaaagaggccgaacuccggggcucucccagccuggccauguggcuggugaauggguuucaacuucucuaugucggagaugcucuguggcaugaggaagccgugcugaccacaauggacaucacccacgauggcuucggguucaugcucgcguuuggagacauggcuuggguuccuuucacauacucccugcaggcccaguuucuucugcaucacccgcagccccucggccugccuauggccagcgugaucugccugauuaacgggcuugagaccaucucuacggcuaccggacgcaagcuccuggucuccggcugguggggcauggugagacaucccaauuaucugggggaucucauuauggcccuggcuuggagccuuccuuguggagugucucaccuucuccccuacuucuaccugcuguauuuuacagcccuucucguccaccgggaggcgcgcgacgaaagacaaugccugcagaaguacggccuggccuggcaggaguauugucggcgcguuccguacagaaucaugccuuauauuuacuga

SEQ ID NO: 76913 - RNA, 1992 nt, Artificial Sequence
  derived and/or modified sequence opt5 from TM9SF2__Homo_sapiens__NP_004791
augagcgccagacugcccgugcucuccccuccgcgguggccccgccugcuucugcucucucugcuucugcucggcgcugucccugggcccagacggagcggagccuucuaccugccuggccuggcgcccguuaacuuuugcgacgaggaaaagaaauccgaugaguguaaggcugaaaucgagcuuuucgugaaucgccuggacucuguggaaagcguccuuccuuaugaguacaccgccuuugauuucugccaggccuccgaggggaaaagaccgucugaaaaccugggacaagugcucuuuggcgagcggauugaacccagcccuuauaaguucacauuuaauaaaaaggagacguguaagcugguuugcaccaaaacauaccacaccgagaaggcugaagacaaacagaagcucgaguuccugaaaaaguccaugcuccugaacuaucagcaucacuggaucguggauaauaugcccgucacaugguguuacgacguggaagaugggcagcgcuuuugcaacccuggauuccccauuggcuguuauaucaccgacaagggccaugccaaagaugcuugcguuauuagcucugacuuucacgagagagauacauucuacaucuuuaaucauguggacaucaagauuuacuaucacgucguggaaaccggguccaugggagcccggcugguggcggccaaacucgagcccaagagcuucaaacacacgcauaucgauaagccugacuguucuggcccgccuauggacauuuccaacaaagcuagcggggagaucaagauugccuacaccuauucugucuccuucgaagaggaugacaagauccgcugggcuagcagaugggauuacauucuggaauccaugccccacacacauauccaaugguuuucuaucaugaauagccuuguuauugugcuguuccucuccggaaugguggccaugaucaugcugcggacccuucacaaagacauugcgcgcuauaaccagauggauagcacagaggacgcccaggaagaguuuggcuggaagcugguccacggggauaucuucagacccccucggaaaggaaugcuccugucuguguuucugggcuccggcacccagauucucaucaugacguucguuacacuguuuuucgcuugccuuggguuucugagcccggccaaucgcggagcucucaugaccugugccgugguccugugggugcuucugggcacacccgccggguacguugcugcgagauucuauaagucuuuuggaggcgagaaauggaagaccaacgugcuccugaccagcuuccugugcccugggaucgucuuugccgacuucuucauuaugaaucucauccuguggggagaaggcuccucugcugccauucccuuuggcacacuuguggccauccuggcucucugguucugcauuagcgucccucugacguuuaucggggccuacuucggauuuaagaaaaacgcgaucgagcaucccgugcggaccaaucaaauuccgagacagaucccugaacaguccuucuacacaaagccccugccuggcauuaucaugggagggauucuucccuuuggcuguaucuucauucagcucuuuuucauccugaacagcaucuggucucaccaaauguauuacauguuuggguuccuguuucucguuuucauuauccuggugauuaccugcuccgaggcuacaauccuucuguguuauuuccaucucugcgccgaagauuaccacuggcaguggcgcagcuuucugaccucuggcuucacggccgucuauuuucugauuuacgcugugcauuauuucuuuuccaaacuucagaucacaggaaccgccagcaccauccucuacuucggcuacacaaugauuaugguucugaucuuuuuccuguuuaccgggacaauuggauucuuugcuuguuucugguucgugacgaagaucuauuccgucgugaaaguggacuga

SEQ ID NO: 76914 - RNA, 1929 nt, Artificial Sequence
  derived and/or modified sequence opt5 from TM9SF4__Homo_sapiens__NP_055557
auggccaccgcuauggacuggcugcccuggagccuccugcuuuucucccugaugugcgagacaucugccuuuuacgugccuggcgucgcgccgaucaacuuccaccagaaugaucccguugaaauuaaggcugugaaacucacgagcuccagaacccaacugccuuaugaguacuauucucuucccuuuugucagccuagcaagaucacauacaaagccgaaaaccugggggaggugcuccggggagaccgcauugucaauacccccuuccaggugcugaugaacuccgaaaagaaaugcgagguucuguguucucagagcaauaagccugugacacucaccgucgagcaauccagacugguggccgaacggaucacagaggauuauuacguucaucuuauugcugacaaccugccgguggccacccgccucgaacuguauagcaauagagauucugacgauaagaaaaaggagaaagacguccaguuugagcacggcuaccggcuuggguucacggaugugaacaagaucuaccugcauaaucaccucuccuuuauccuguauuaccaucgcgaagacauggaggaagaucaggagcacaccuauagagugguccgguucgaaguuauuccccagagcauccgccuggaggaccucaaagcugaugagaagucuuccugcacacugccugaaggaaccaacagcucuccccaagagauugacccuacaaaggaaaaucagcuuuacuuuaccuauuccgugcacugggaggaaagcgacaucaaaugggccuccagaugggauacguaccugacaaugucugacgugcagauucauugguucagcaucauuaacuccgucgugguuguguuuuuccucagcggcauccugucuaugaucauuauccggacccuucgcaaggauauugcgaauuauaacaaagaggacgauaucgaggacacaauggaagaguccggguggaagcugguccacggagauguguuuagacccccgcaguacccuaugauucucagcucucugcugggcagcggcauccaacucuucuguaugauccugauuguuaucuucguggccaugcuugggaugcugucccccucuagccggggagcucucaugaccaccgccugcuuucuguucauguuuaugggcgucuucgggggauuuuccgcuggccgccuuuacagaacacugaaagggcaucgguggaagaaaggagccuucuguacggcgacccucuauccuggcguggucuuuggcauuugcuucgugcugaauuguuuuaucugggggaagcacagcucuggagccguucccuuccccacaaugguggcucugcucugcaugugguuuggcauuucccugccucuugucuaccugggguauuacuucggauuuagaaagcagccguaugacaaccccgugcgcaccaaccagaucccucggcaaauccccgaacagagaugguacaugaaucgcuucguuggcauucucauggccgggauccugccuuucggagcuauguuuauugagcuguucuuuaucuucagcgccauuugggaaaaccaguuuuauuaccuuuucggcuuucucuuccugguguuuaucauucuggucgugucuuguucccagaucagcaucgugaugguuuacuuccaacucugcgccgaggauuaucgguggugguggagaaauuuucuggucuccggcgggucugcuuucuacgugcuuguguaugcgaucuuuuacuucgucaacaaacuggacauuguggaguucauucccagccuccuguauuuuggauacacagcccugaugguucuuuccuucuggcuccugaccggcacgaucggguuuuaugcugccuacauguucgugcgcaagauuuacgccgcugucaaaaucgauuga

SEQ ID NO: 76915 - RNA, 858 nt, Artificial Sequence
  derived and/or modified sequence opt5 from TMBIM4__Homo_sapiens__NP_001269535
auggccgaccccgauccuagauacccgcggagcuccaucgaggacgauuucaacuauggcucuagcguggcuuccgccaccguccacauucgcaugguucugcagagagacugcacauuuucuaagcaauacaugcggauccccagcgcgccuuccgcuacgcucaauauuauccgcuucuuucaucugagacagucugggcggagcggaauggugaacauuuucuauaaaggccccaccuuucuucgcaagguguacuccauccugagccuccagguccugcuuacaaccgugacaucuaccguuuuccuguauuuugaauccgugagaacauucguccacgagagcccugcccucauccugcuguuugcccucgggucucugggacuuauuuucgcucugauccucaaucggcauaaauacccccugaaccuuuaucugcucuuuggcuucacccugcuggaagcccucacgguggcuguuguggucaccuuuuacgauguguacauuauccugcaggccuucauucuuacaaccacaguguucuuugggcugaccgucuauacgcuccaauccaagaaagacuucagcaaguuuggagcgggccuguucgcccuucuguggauccucugucugucuggcuuucugaaguucuuuuucuacuccgagauuauggaacucguucuggcugccgcuggggcccuucuguuuugcggauucaucaucuaugauacacacagccucaugcauaaacuguccccugaggaguacgugcuugcggccauuucucuguaucucgacaucauuaaucuguuucugcaccuccugcgcuuccuugaagcugugaacaagaaauga

SEQ ID NO: 76916 - RNA, 714 nt, Artificial Sequence
  derived and/or modified sequence opt5 from TMBIM6__Homo_sapiens__NP_003208
augaacaucuucgacagaaagauuaauuuugaugcccugcucaaauucagccacaucacccccuccacacagcaacaucugaagaaaguguacgcuucuuuugcccuuugcauguucgucgcggcugccggcgccuauguucacauggugacgcauuuuauucaggcugggcugcucagcgcccugggaucccuuauccugaugauuuggcucauggcuaccccucacucucaugagacagaacagaagcggcugggccugcucgccggguucgcguuucugaccggagugggccuugggccggcccuggaguucuguaucgcugucaaccccagcauccucccuacagccuuuaugggaaccgcuaugauuuucacaugcuuuacccuguccgcccuuuacgcgcgcagacggucuuaucuguuccucggcggcauccugaugagcgcccugucccuccugcuucugagcucucucgggaauguguuuuucggauccauuuggcuguuccaggcuaaccuuuacguuggccugguggucauguguggguuuguucucuucgacacgcaacugaucauugaaaaagccgagcacggagaucaggacuauaucuggcacugcauugaucuguuucucgacuucaucaccguguuucgcaagcugaugaugauccuugcuaugaaugaaaaggauaaaaagaaagagaagaaauga

SEQ ID NO: 76917 - RNA, 2283 nt, Artificial Sequence
  derived and/or modified sequence opt5 from TMC1__Homo_sapiens__NP_619636
augagccccaagaaagugcagaucaaggucgaggaaaaagaggacgaaaccgaggaauccucuagcgaggaggaagaggaaguugaggauaagcugccuagacgggagucccuccgcccgaaaagaaagcggacacgcgacgugauuaacgaagaugaccccgagccugaacccgaggaugaagagacgagaaaggcccgggagaaagaacgcagacggcgccugaagagaggcgcugaggaagaggaaaucgacgaggaggaacuugagcggcugaaagccgaacucgaugagaagcgccaaauuaucgcgaccgugaaaugcaagccuuggaagauggagaaaaagauugagguccugaaagaggcuaagaaauucgugucugaaaaugagggggcccuuggaaagggcaaagggaagagaugguuugccuucaagaugaugauggcuaaaaagugggccaaauuucugcgggacuucgaaaacuuuaaggcugccuguguucccugggagaauaaaaucaaggcgaucgagagccaguucggauccucuguggccagcuacuuucucuuccugcgcuggauguauggcgucaacauggugcuguuuauucucacauucucccugaucaugcuuccugaauaccugugggggcucccguauggaagccugcccagaaagaccguuccucgggcugaggaagccucugcugccaauuuuggcgugcuuuacgauuucaacggccuggcgcaguauuccguccucuuuuacggguauuacgacaauaaaagaacaauuggauggaugaacuuccgccugccccugagcuacuuccucgugggcaucaugugcauuggguauucuuuucuggugguccuuaaggccaugaccaaaaauaucggagaugacggcgggggagaugacaacacauucaauuuuuccuggaagguuuucaccagcugggacuaccugauuggcaacccugagacggcugauaauaaauuuaacucuaucaccaugaauuucaaggaagccaucacagaggagaaggcugcccagguggaagagaacgugcaccucauucgguuucugagauuccuugccaacuuuuucgucuuucugacccucggcggguccggauaucugaucuucugggcugugaaacgcagccaagaauuugcgcagcaggaccccgauacacugggcuggugggagaagaaugaaaugaacaugguuaugucccuccuggggauguucuguccgacccuuuucgaccuguuugccgagcucgaggauuaccauccucugauugcucuuaaauggcugcucggacggaucuucgcccugcugcucggcaaucuguauguguuuauucuugcccugauggacgaaaucaacaauaagaucgaggaagagaaacucgucaaggcuaacauuacgcugugggaagccaauaugaucaaggcguacaacgcuucuuucagcgaaaauuccacagggcccccuuucuuugugcaccccgccgauguucccagaggaccuugcugggagaccauggugggccaggaauuuguccgccugacagugagcgacguccuuaccaccuaugugacaauucucaucggcgauuuccugcgggccuguuuuguuagauucugcaacuacuguuggugcugggaccuggaguacggguauccgucuuacacggaauuugauauuuccggaaaugugcucgcucugaucuucaaccaaggcaugaucuggauggggagcuuuuucgcccccucucuuccuggaauuaauauccugcgccuccauaccagcauguauuuccaguguugggcugucaugugcuguaacgugcccgaggcccggguuuuuaaagcguccagaucuaauaacuucuaccugggcaugcugcuucucauucuguuucugagcacaaugccugugcucuauaugaucgucucccugcccccgagcuucgacugcgggccuuuuucuggcaagaaccgcauguucgaggugauuggagaaacccuugagcacgacuuucccuccuggauggccaaaauccugcggcagcucagcaauccuggccuggugauugcuguuauccuggucauggugcuugccaucuacuaucucaacgcuacagccaaggggcagaaagcggccaaucuggaucugaagaaaaagaugaagaugcaagcucucgaaaacaaaaugagaaauaagaaaauggccgcugcccgggccgcugcggccgcuggacgccaguga

SEQ ID NO: 76918 - RNA, 2721 nt, Artificial Sequence
  derived and/or modified sequence opt5 from TMC2__Homo_sapiens__NP_542789
augagccaccaggugaagggccugaaagaggaagcccgcgggggagucaagggccggguuaaauccgggucuccccauaccggagaccgccucggcagacggagcuccucuaagcgcgcucugaaagccgaggggacaccuggaagacggggcgcgcaacgcagccagaaggaaagagcuggcggguccccgucucccggaagcccucggcgcaagcagacgggcagacggcgccacagagaggaacuuggggagcaggagcggggagaagccgagagaaccugcgaaggcagacggaaaagagaugagcgcgccuccuuccaagagcggacagcugcccccaagagagaaaaagagaucccucgccgggaagaaaagagcaaaagacagaagaagccccggucuuccagccuggcuucuuccgccagcgggggagaaucucucuccgaggaggaacuggcgcagauucuugaacagguggaggagaaaaagaaacugaucgccaccaugcgcagcaagccuuggccgauggcuaaaaagcucacagaacugagagaggcccaagaguuuguggaaaaauacgagggcgcucugggcaaggggaagggaaaacagcucuaugccuacaagaugcugauggcgaaaaagugggucaaauucaagcgcgacuuugauaacuucaagacccaguguauucccugggaaaugaaaaucaaggacauugagucccauuuuggcucuagcguggccuccuauuucaucuuucuucgguggauguacgggguuaaucuggugcuguucggacugaucuuuggccuugucauuaucccugaagugcugauggggaugcccuauggaagcauuccuagaaaaacaguuccccgcgcugaggaggaaaaggccauggauuucucugugcucugggacuuugagggcuacaucaaauauuccgcucuguucuacggcuacuauaacaaucagcggaccauuggguggcugagauaccggcucccgauggccuauuuuauggucggagugagcguguucggcuacucucugaucauugucauccgcagcauggccuccaacacgcaagggucuaccggagaaggcgagagcgauaauuucacauuuuccuucaagauguuuaccagcugggacuaucuuaucgggaacucugagacagcugauaauaaguacgcguccauuaccacgagcuucaaagaaucuaucguugacgagcaggaauccaacaaggaggaaaauauucaccugacaagauuucuccgggugcuggccaacuuccuuaucauuugcugucugugcggcagcggauaucucaucuacuuuguggucaaaagaucccagcaauucucuaagaugcagaaugugagcugguacgagcgcaacgagguugaaaucgugaugucccugcugggcauguuuuguccuccccucuucgagaccauugcugcccuggaaaauuaucauccucggacagggcuuaaauggcagcugggaagaaucuuugcccucuuccugggcaaccuuuacaccuuucugcucgcucugauggaugacguccaccugaagcucgccaaugaggaaaccauuaagaacaucacacacuggacgcuguucaacuauuacaauucuagcggguggaacgaguccgugcccagacccccucuucauccggcggauguuccccgcggaagcugcugggagaccgcugugggcauugaguucaugcggcugacagucucugacaugcucgugaccuauaucacaauccugcugggggacuuucuucgcgccuguuucgucagauuuaugaauuacugcugguguugggaucucgaggccggcuucccuuccuaugcugaauuugacauuagcggaaacgugcugggccugaucuucaaucaggggaugauuuggaugggaucuuuuuacgcccccggccucguugggaucaacgugcugcggcuucugaccuccauguacuuccaaugcugggcugucaugagcucuaaugugccucacgagcgcguuuuuaaagccagcagauccaacaauuucuauaugggacuccugcugcuugugcucuuucugagccugcuccccgucgcguacacgauuaugucucugccgccuuccuucgauuguggccccuuuagcgggaagaaccggauguaugacgugcuucaggaaacaaucgagaaugauuucccuaccuuccugggcaaaauuuuugccuuccucgcuaaccccggacugaucaucccugccauucugcuuauguuucucgcuaucuacuaucucaauuccgugucuaagagccugucccgcgccaacgcgcagcuccgcaaaaagauucagguucugcgggaggucgaaaaaucucauaagagcgugaagggcaaagccaccgcucgcgacuccgaggauacacccaagucuagcuccaaaaaugccacccaacuucagcugacaaaggaagagacgaccccgccuagcgcuucucagucccaggccauggacaaaaaggcccaagggcccggaacaagcaacucugcuuccagaaccacacuccccgcgagcggccaucugccuaucucucggccgcccgggauuggaccugauuccggccacgcccccagccagacccacccuuggagauccgcuagcgggaagucugcccagagacccccucacuga

SEQ ID NO: 76919 - RNA, 3303 nt, Artificial Sequence
  derived and/or modified sequence opt5 from TMC3__Homo_sapiens__NP_001074001
augaagaccagcaaagccucccagagauaccggggcauccgcagaaacgcuucucaaugcuaucuguaccaggagagccuccugcuuuccaaucuggacgauucuuucagcgccgacgaaacaggggauuccaacgaccccgagcagauuuuucagaauauccaauuccagaaggaucucauggcgaacauucggugucgcccuuggacgaugggacagaaacugagagcucugcggcaggccaagaauaucgugcugaaauuugaaggccgccucaccagaacacggggguaucaagccgcuggagccgagcuguggcgcaaguucgcuagacuggccugcaacuuugucguuauuuucaucccgugggaaaugcggaucaagaaaauugagucucacuuuggcagcgggguggcguccuacuucaucuuucuccgcuggcuguucggaauuaauaucgugcuuaccauuaugacaggcgccuuuaucgucauucccgagcugaucgcuggccagccuuucgggagcaccgccagaaagacaauccccaaagaacaggugucuuccgcucaggaccucgauaccguuuggagccugggaggcuaucuucaauacucugugcuguuuuauggguacuacggacgggagcgcaagauuggcagagccggguaucggcucccucuggcguacuuccuggucggaauggccguguucgcuuauuccuuuaucauucuccugaaaaagauggccaagaacagcagaacgucucuugcuuccgccagcaaugaaaacuacaccuucuguuggcgcguguuuugcgccugggacuaucugaucggcaaucccgaggcugcggaguccaaaacagccgcuauuguuaacucuauccgggaagccauccucgaggaacaggagaagaaaaagagcaaaaaucuggccgucaccauuugucuuagaaucauugcuaacauccuggugcuccugucccuggccggcagcauuuaccucaucuauuucguggucgaucgcucucagaagcuggaacaauccaaaaaggagcuuacacugugggagaagaaugaaguuagcgugguggucucucucgugaccaugaucgcgccuagcgcuuuugaccugauugccgcccuugagauguaccauccgcggacgacacugagauuccagcucgcucgcguucuggugcuguaccucgggaaccuguauucccuuaucauugcccugcucgauaaagucaacucuaugagcaucgaagagauggcuaccaagaauaacacaucccacuggauugacagcaccaccuuuuucgccacacggacggcgcccgaagaggagaaauggucuaccuccagaccuggaaugggccugcgccggaauaacacaugggcccuggaagagaccagcaucucugcuuacacaaugccccuuauuaaggccaauaaaaccucccuccauacgcagagcccucaggaucaaugcugggaaacauauguggggcaggagaugcugaagcuguccaucaucgacaugcucuuuaccguugcuucuauucugcuuaucgacuucuuuagaggacuguucgugcgcuaccucagcgauuauugguguugggaccuggaauccaaguuucccgaguacggcgaguucaaaauugccgaaaacguccugcaccuuguguauaaucaggggaugaucuggaugggagcguucuuuucuccgugccucccugccuucaacguccugaagcugauuggccucauguaccugcggagcugggcugugcuuaccuguaauguuccccaucagcaaguguuuagagccucccggagcaacaauuucuaccuggcuaugcuccuguuuaugcuguuccuuugcaugcucccuacaaucuuugccaucguccgcuauaaacccucucugaacuguggccccuucuccgggcaggagaagauuuacgauaucgugagcgaaaccauugagaaagacuuuccuguuugguucggaucuguggucggccacaucuccagcccgguggugauucugcccgccguucuccugcuuuuuaugcugaucuauuaccuccagucuaucgcuagaagccugaagcuguccaaucaccagcuuaagaugcaaauucagaacgcgcggagcgaggauaaaaagaaagucgcccagaugguggaagcuagaauccagacacaagaggaaucuacgaagaaacucccuaaugacuccgaucugaccagccagcuguccucugcccauagcgggacaccccagaacaacggaaauguggcccacuucgacuccggcucuagcaaguccgggcgcauugagaccgucgcucaaucuaugccucagagcccccggccgggcgauagagccccuuccagcccccucccuggagugcccaagucucgccuggaacaugagacaaacagauaucuucacggccugugcgcguccaccagcgaccuccaccggaaucgcucuagaacgccuaugaccuuuacaacccauaucgaggauguucacuccgaaccccuguuccggaaagacuuccagcagauuaacccgccucaucgcgggccccaagcuagcacacugcuugcccagggacccagaccucacgccccgcgguacuaugugaucaaugagugcgacucuuacaagaaaaagcaucugaacgucuggcccgaacgccacuuuaaaaucgaugcuuccggcgacauuguggagcucuacccuagaaauguucggcaguaugccagccgcgugcccagacagccucccuccccucaacugagcgaagaggaggaagagacccccucucgggauuggaucaagagaagccucccgccucgcucccugauugaccuucggagagcgccccacuucuacaucggggaacgcucugagagccagacgcgggauccugaacaucagggaagaguccacuauaaauccuggaacgaggacuuugagggccaucuggaacgccccgcuuacgugccgcggaagccuagaucucgcaauuuccaguauccccaaccuccccucaagccccgggggaaaccuagauuugagccgagccugacagaauccgauucuguuagcgccgccuccagcucugaccagcagaacuccagcgcugaucaauaccuucaggugacccacucucagggccgguucccccgcuccgucggacagccuagcagacggaaggccaaauccggccaagagcuuacaguggaccuggaugaccucauuuguucugauguguga

SEQ ID NO: 76920 - RNA, 3021 nt, Artificial Sequence
  derived and/or modified sequence opt5 from TMC5__Homo_sapiens__NP_001098718
augagcgccuacuauagaaacaauugguccgaggaagaccccgauuacccugacuauucuggcagccagaaccggacccaaggguaccugaagacacagggauauccggaugugcccggcccucucaauaaccccgacuacccugggacgcgcuccaaucccuauucugucgcuagcagaacccggccugauuacccgggaucccuggccgagcccaacuacccucgcucucuuagcaaucccgacuauuccggcacaagaagcaacgcguacucugcugccucccggaccagcccugaucaccccacaucucugccggaaccugacuauuccgaguuccagagccaucccuaccaccgcgccucuuccagacagccugauuaucccgggagccaacggaaucccgacuuugcuggauccucuagcuccggcaacuacgccggcagccgcacccauccugaucacuucgggucucucgaaccggacuaucccggagcucaguccaauagcgaucauccuggccccagagccaaccugaaucacccugggucucggaaaaaccuugagcacaccagcuuucgcaucaaucccuacgcggacucccugggaaagccggacuacccuggcgccgauauucagcccaacucuccucccuucuuuggggagccugacuaucccagcgcugaagauaaccagaaucucccguccacauggagagagccugacuacagcgaugccgaaaacggacaugacuaugggucuuccgagacgcccaaaaugacccggggcguucugagccgcacaucuuccauccaacccagcuucagacaccgguccgaugacccugugggcucucuguggggagagaaugauuacccggaaggcauugagauggcuagcauggaaauggccaacuccuaugggcauucucuccccggagcgccuggcagcggguacgugaaucccgccuaugucggagaguccggcccugugcacgcuuacggcaaucccccucugagcgaaugcgacuggcacaagucuccccaggggcagaaacuuaucgccucccugauuccgaugaccagcagagaucgcaucaaggcuauccggaaccagccuagaacaauggaggagaagcgcaaccuccggaaaauuguugacaaggaaaaaucuaagcaaacccauagaauccugcagcuuaauuguugcauucagugucugaacuccaucagccgcgccuaccggagaucuaaaaauagccucuccgagauucugaacagcaucucucuguggcaaaagacgcucaagauuaucggaggcaaauuugggacauccgugcugagcuauuucaauuuucuucgcuggcugcucaaguucaacaucuuuuccuucauucugaauuuuucuuucaucauuaucccccaguucaccgucgccaaaaagaacacacuucaguuuaccggacuggaguucuuuaccggcgugggguacuuccgggacacaguuauguauuacggcuuuuauacgaacagcaccauucagcacggaaauuccggcgcuucuuacaacaugcaacucgcguauaucuucacaaucggggccugccugaccacauguuucuucagccugcucuuuuccauggcuaaauacuucagaaauaacuuuauuaauccucauaucuacucuggaggcauuaccaagcugaucuucugcugggauuuuacggugacacacgaaaaagccgucaaacuuaagcagaagaaccugagcaccgaaauucgcgagaaucucuccgagcugcggcaggaaaacagcaaacuuaccuucaaucagcugcucacaagauucucugccuauaugguggcuuggguggucuccaccgggguugccaucgcguguugcgcugccguguacuaucuggccgaguacaaccuggaauuucucaagacacauagcaaucccggagcugugcugcuucugccguucgucgugucuuguaucaaccucgccguuccuugcauuuauuccauguuucggcugguggagcgcuacgaaaugcccagacacgaggucuaugugcugcuuauccggaauauuuuccucaagaucagcauuaucggcauucuguguuacuacuggcugaacacgguugcucucucuggggaggaaugcugggagacccugaucggccaagacaucuauagacuucugcucauggauuuuguguucucccuggucaauagcuuucugggagaauuucuucgccggauuaucggcaugcagcucauuacaucccuggggcugcaggaguuugacaucgccagaaacgugcucgagcugauuuacgcgcagacccuugucuggaucggaaucuucuuuugcccucugcuccccuucauucaaaugaucaugcuguuuauuauguucuauagcaaaaacaucucucugaugaugaauuuccagcccccuagcaaggccuggcgcgcuucccagaugaugacauuuuucauuuuucuucucuucuuuccgucuuucaccggcgugcuguguacgcuggccaucaccaucuggagacucaagcccagcgcugauugcgggccuuuucggggacugccccuuuucauucacuccaucuacucuuggauugacacacugagcacccgcccuggcuaucucuggguuguguggaucuacagaaaccugauuggguccguccacuuuuucuuuauccugacacuuaucgugcucauuaucaccuaucuguacuggcagauuacggaaggccggaaaaucaugauucgccugcuccaugagcaaaucauuaaugaaggaaaggauaaaauguuccugaucgagaaacuuaucaagcugcaggacauggaaaagaaggccaaccccucuagccucguucuggagagacgggagguggaacagcaaggcuuccugcaucuuggggagcacgauggaucccuggaccuccgcagcagacggucuguccaggaaggcaauccucgcgcguga

SEQ ID NO: 76921 - RNA, 2418 nt, Artificial Sequence
  derived and/or modified sequence opt5 from TMC6__Homo_sapiens__NP_009198
auggcccagccccuggcuuucauccucgacgugccugagaccccgggcgaucaagggcagggacccagcccuuacgacgaauccgagguccacgauucuuuucagcagcugauucaagaacagagccagugcacagcccaggagggccuugaacugcaacagagagagcgggagguuacgggguccucucagcagacccucuggcgccccgaaggaacacaaagcaccgcgacacugagaauccuugcuuccaugccuucucggaccauuggccgcagcagaggggccaucauuucccaguauuacaaccggacagugcagcugcgcuguagaagcucucggccccuccugggaaauuucgugcgcuccgccuggccuagccugagacucuaugaccuggagcuugauccgaccgcucuggaagaggaggaaaagcaaucucuccuggucaaagagcuucagucccuggccguggcucagcgggaccauaugcuccgcggcaugccccugagccuggccgaaaagagaucucuccgggagaaaucccgcacgccuagaggcaaguggcgggggcagcccggaagcggcgggguuugcuccuguugcggaagacugcgcuacgcgugugugcuugcccugcacucucucggccuggcccuucugagcgcucuccaagcucugaugccuuggcgguaugcccugaaaagaaucgggggacaguuuggcuccagcguccucucuuacuuccuguuucuuaagacccugcucgcguucaacgcccugcuucugcuccugcugguggcuuuuaucaugggcccccagguugccuucccgccugcucuccccgggccugcccccgugugcacaggacuggaacuucugaccggcgccggguguuuuacacauaccgucauguauuacggacacuacuccaaugcuacgcucaaccagcccugcggcagcccucuggaugggucucaauguacaccgcgcgugggaggccugcccuauaauaugccucuugcguaccucagcaccgugggcgucuccuucuuuauuacaugcaucacccugguuuauucuauggcccauagcuucggggaguccuaccgggugggaagcaccucuggcauucacgcuaucacaguguuuuguuccugggacuauaaggucacgcagaaaagagccagccgccugcagcaggauaacauucggaccagacucaaggagcugcuugccgaauggcaacugcgccacucuccccgguccgugugcgggagacuccgccaggcugccguucugggacugguguggcuucucugccugggcacagcgcuggggugugcugucgccgugcauguuuucagcgaguucaugauccaguccccugaagccgcuggccaggaggccgugcuccugguccuuccccugguggucggacuccugaaucugggcgcuccguaccuuugccgggugcucgccgcgcuggaaccucacgacucucccguucuggagguguaugucgccauuuguagaaaccucauccugaaacuugcuauccuggggacccucugcuaccauuggcugggacggcgcgugggcguucugcaagggcaguguugggaggauuuugugggacaggaacuuuacagauuccucgucauggacuuugugcugaugcugcucgauacacuguucggcgagcuuguguggcggauuaucagcgaaaagaaacugaagagacgccggaagccugaguuugacauugccagaaauguucucgaacugaucuaugggcaaacccugacguggcuuggcguccuguucucuccccuccugccugcugugcagauuaucaaacuccugcuuguguuuuacgucaagaaaacaucccugcucgccaacugccaggcgccccgcagaccguggcuggccagccacauguccaccguguuccugacccuucuguguuuuccugcuuuccucggagccgcuguuuuucugugcuaugccguguggcaggucaagcccagcucuacauguggccccuuccggacccucgacacaauguacgaggccgggcgcguguggguuagacaccuggaggcugcgggaccucggguguccuggcuuccguggguccaucgcuaucugauggaaaauacguuuuucguguuccucguuagcgcccugcugcuugcugugaucuaccugaacauucaagucgugagaggccagcggaaagugaucugccuccugaaggagcagauuucuaaugaaggggaggauaaaaucuuucucauuaacaagcugcacuccaucuaugagcgcaaggaaagagaggaacggagccgcgucggaaccacagaggaagccgccgcucccccugcccuucugaccgacgagcaggaugcguga

SEQ ID NO: 76922 - RNA, 2181 nt, Artificial Sequence
  derived and/or modified sequence opt5 from TMC8__Homo_sapiens__NP_689681
augcugcuccccagaagcguguccucugagcgggccccuggcgucccggaacccgaggaacugugggaggcugaaauggagcgccuuagagggagcggaaccccuguucggggccugcccuacgccaugauggacaagcgccucaucuggcagcugagagagccugcgggggugcaaacacuucgguggcagcgcuggcagagacggcgccagacgguggaaagacggcugcgcgaggcugcccaaagacucgcccggggacugggccugugggaaggggcucucuaugagauuggaggccuguucggcaccgggauccgcuccuacuuuacauuccuuagauuucugcuccugcuuaaccugcucucucugcugcucaccgccagcuucguccugcuuccccugguguggcuccggccuccggaucccggaccuacacugaaucuuacccugcagugccccggcuccagacagucuccucccgggguucuccgcuuucacaaccagcuguggcaugugcugacaggacgggcuuucaccaauacguaucucuuuuacggcgccuauagagucgggccggagagcuccagcguguacucuauucgccuggcguaucuucuguccccucucgccugucugcuucugugcuucuguggaacccuccggagaaugguuaaaggccugccccaaaagacacugcucggccagggguaccaggcuccucugagcgccaaaguguuuucuuccugggacuucugcauccgcguccaggaagcugccaccauuaagaaacacgagaucagcaacgaauuuaagguggagcuugaagagggacggagauuccaacugaugcagcagcaaacacgcgcgcagaccgccugucggcuccugucuuaccugagagugaauguccuuaacggccuccugguugugggggcuaucuccgccauuuucugggcuacgaaguauagccaggauaauaaagaggaaucccuguuccuccugcuucaguaccugccucccggagugaucgcccucgucaacuuccugggcccccugcuuuuuacauuccucgugcaacuggagaauuauccgcccaacaccgaaguuaaucugacacucauuuggugcgugguccugaagcucgccucucuggggauguuuagcgugucccucggacagaccauccuguguauuggccgcgacaaaagcucuugcgaguccuacggcuauaacguuugugauuaccagugcugggaaaauagcgugggggaggagcuguauaaacuuucuaucuucaacuuucuccugaccgucgcuuucgcguuucuggugacacucccucggagacugcuugucgaccgguucagcggacgcuuuugggccuggcuggaaagagaggaauuucucgugcccaagaauguucuggauauuguggcuggccagacggucaccuggauggggcuguuuuacuguccucuucucccccugcugaacuccguguuccucuuucugacauucuacaucaagaaguauacccuucugaaaaacucucgggccagcuccagaccguuccgcgccucuagcuccacauuuuucuuucaacucguucugcugcuuggacugcuccuggcugccgugccucucggcuacgucgugagcucuauccauuccagcugggacugcgggcuguucaccaauuauuccgcgcccuggcaagugguuccugagcuugucgcucugggccuucccccuauuggacagcgggcccugcacuaccugggcucucaugccuuuagcuucccccuucugaucaugcucucccuggugcucacggugugcgucucucagacacaggcuaacgccagagcuauucaccgccugagaaagcagcuuguguggcagguucaggaaaaauggcaccugguggaggaucucagccggcugcugccggagccugggcccuccgacagccccggaccuaaguauccggccucucaagcgucccgcccccagagcuuuuguccuggcugccccuguccugggucucccggacaucaggccccuagacccggcccguccgucguggaugcugccgggcuucggagcccuugccccggccaacacggagcuccugccucugcgcgcagauuccgguuucccagcggcgccgaacuguga

SEQ ID NO: 76923 - RNA, 1443 nt, Artificial Sequence
  derived and/or modified sequence opt5 from TMCC1__Homo_sapiens__XP_006713615
auguggugcggcuguaccugccuguucugugagagccacuuuuccgaaacagugaagaucgagagacucgaagucucuagccuggcccagacguccucugcuguugccagcuccaccgacgggucuauucauacagauagcguggacggaacccccgauccucaacggacaaaagcggcuaucgcccaccuucagcagaagauucugaaacucaccgagcagaucaagauugcccaaacagcucgcgacgauaacguggccgaauaccugaaacuugcuaauuccgccgacaagcagcaggcggccagaaucaagcaggucuucgagaaaaagaaccaaaaaucugcucagaccauccugcagcuccagaagaaacuggagcauuaucaccggaagcugcgcgaaguggagcaaaauggcauuccgagacagcccaaggauguuuuucgggacaugcaucaggggcucaaagaugugggagccaaggucacgggcuucucugaaggggugguugacuccgugaaaggaggcuuuagcucuuucucccaagcuacccacagcgccgcgggcgccgucgugucuaagccucgcgagaucgcuucccugauuagaaacaaauuugggagcgccgauaauauccccaaccuuaaggacucccuggaggaaggacagguggaugacgcuggcaaagcccucggggucauuucuaauuuccagagcuccccuaaguacggaagcgaggaagacugcagcuccgccacaagcggcucuguuggggcuaacagcaccacaggaggcaucgcggugggcgccuccucuagcaagaccaauacgcuggauaugcaguccagcggguuugacgcccuucugcacgagauucaagaaauccgggagacacaggcucgccucgaggaaucuuucgagacccugaaagaacauuaucagagagauuacucccugaucaugcagacacuccaagaggaacgguaucgcugugagagacuggaggaacagcuuaacgaccugaccgagcuccaccagaaugaaauucugaaccuuaagcaggagcuggccagcauggaagagaaaaucgcuuaccaaucuuaugagcgggcccgcgauauucaggaagcgcucgaggcuugccagaccagaaucuccaagauggaacugcagcaacagcagcaacaggugguccagcuggagggacucgagaaugccacagcccggaaccugcuuggcaaacugauuaauauccuccuggcugugauggccguucuucugguguuugucagcacgguggcuaacuguguugugccccucaugaagaccagaaaccgcacauucuccacccuguuucuggucguguucaucgccuuccucuggaagcauugggacgcgcuguuuucuuacgucgaacgguucuuuagcuccccuagauga

SEQ ID NO: 76924 - RNA, 1896 nt, Artificial Sequence
  derived and/or modified sequence opt5 from TMCC2__Homo_sapiens__NP_001229854
auguucggccacgggcugaagcaucucuuucacagcagacggcgcuccagagagcgggaacaucagaccucucaagacagccagcagcaccagcaacagcagggaauguccgaucaugacucucccgaugagaaagaacgcagcccugagaugcacagaguguccuacgccaugucucugcacgaccuuccggcucggcccacagccuucaaccgcguccugcagcaaaucagaagccggccuuccauuaagcgcggcgcgagccuccauucuuccagcgggggaggcagcuccgggucuucuuccagacggacgaaaagcuccucucuggaaccccagcgcggaagcccucaccuucugagaaaggcuccccaggauuccagccucgccgccauccugcaucagcaccaaugccggccucgcagcuccagcaccacagacaccgcucugcuccuggccgauggcucuaauguuuaucuucuggcugaggaggccgaaggcauuggggacaaaguggauaagggagaccucguggcgcugagccuuccggccggccacggggauacagacggacccaucucccuggaugucccugacggcgcucccgacccucagagaaccaaggccgcuauugaucaucuccaccagaaaauccugaagaucacagagcaaauuaaaaucgaacaggaggcccgggacgauaacguggcggaguaccugaagcucgccaauaacgcugacaaacagcagguuucuagaauuaagcaaguguuugaaaagaaaaaucagaagucugcccagaccaucgcucagcugcauaaaaagcucgagcacuaucgccggagacugaaagaaauugagcaaaacgggcccucccgccagccgaaggauguccuccgggacaugcagcagggacugaaagaugugggcgccaauguuagagccggcaucagcggguucggaggcgggguggucgaaggagugaagggcucucuuuccgggcugagccaagcuacgcauaccgcgguggucucuaagccucgcgaguuugccucccucauucggaacaaauucggaagcgcugacaauaucgcccaccugaaggauccccuggaggacggcccucccgaagaggccgcuagagcccucuccggcucugcgacacugguuagcucccccaaauacgggucugaugacgaauguagcuccgcuagcgccucuuccgccggagcuggcagcaacucuggggccggaccuggcggggcucuuggcucccccaagagcaaugcccuguauggagcgccgggcaaccucgacgcccugcuugaggaacugcgcgagaucaaagaggggcagucucaccucgaagauagcauggaggaccugaagacccagcugcagcgggauuacacauauaugacccaaugccuccaggaagagagauaccgcuacgaacggcuggaggagcagcuuaaugaccugacggaacuccaucaaaacgagaugacaaaucugaagcaggaacuggcuuccauggaggagaaaguggccuaucagagcuacgaaagagcucgggauauucaggaggccguggaaucuugucuuacccgcgucacaaagcucgagcugcaacagcagcagcaacaggugguucagcuggaaggaguggagaacgcgaacgccagagcucuccugggcaaauuuaucaaugucauucuugcccugauggcugugcuccugguuuucguguccaccaucgccaacuuuauuaccccucugaugaagacacggcuuagaaucacgagcaccacacuccugguccuggugcuuuuccugcuuuggaaacacugggacucccugaccuaucuccuggagcauguccugcuucccucuuga

SEQ ID NO: 76925 - RNA, 1434 nt, Artificial Sequence
  derived and/or modified sequence opt5 from TMCC3__Homo_sapiens__NP_065749
augcccggcagcgacaccgcccugacaguggauagaacguacuccgacccugggcggcaccaucgcugcaagucuagagucgagcggcacgauaugaacacccucagccugccgcuuaauauccgcagaggaggcuccgacacaaaccugaauuucgauguucccgacgggauucucgauuuucauaaagugaagcugaccgcugacucucuuaaacagaagauccugaaagugacagaacaaauuaagaucgagcagaccagccgggauggaaacgucgccgaauaucucaagcuggugaauaacgcggacaaacagcaggcuggccgcauuaagcaaguuuucgagaaaaagaaucagaaauccgcccacucuaucgcccagcugcagaagaagcucgaacaauaccauagaaaacugcgggagaucgagcagaacggggcuagccgcuccagcaaggauauuucuaaagaccaccuuaaggauauccacagaucccugaaagacgcccaugucaagagccggacagcuccucacuguauggaaucuuccaaaagcggaaugcccggcgugucucucaccccucccguguuuguuuucaauaagucccgcgaguuugccaaccugauuagaaauaaguucggcagcgcggacaacaucgcccaucuuaaaaauucccuggaagaguuucggccugaggcuucugcccgcgcuuaugggggaagcgccacgauugugaacaagccgaaauacggcuccgaugacgaaugcagcucugggaccuccggaagcgcggauucuaauggcaaccagagcuucggggccggaggcgcuuccacacucgacucucagggcaagcuggccgucauccuggaggaacucagagagauuaaagauacccaagcucagcuggccgaagacaucgaggcccuuaaggugcaguuuaagcgggaguauggguucaucagccaaacacugcaggaagagagauaccgcuaugaacggcucgaggaucagcugcacgaccuuaccgaucugcaccagcaugaaacggcuaaccucaaacaagagcuggcguccauugaggaaaagguggccuaccaggcuuacgagagaagccgcgacauccaggaagcccuggagucuugucagacacggauuuccaaacucgaacugcaccaacaggagcagcaggcccuucaaaccgauacagucaaugcuaagguucugcucggaagaugcaucaacgugauucuggccuuuaugaccgugauccuugucugugugagcaccaucgcgaaauucguuucucccaugaugaagucccgcugccauauucugggcacauuuuucgcugugacgcuccuggccaucuucuguaagaauugggaccacauucugugcgccaucgagcggaugauuaucccuagauga

SEQ ID NO: 76926 - RNA, 720 nt, Artificial Sequence
  derived and/or modified sequence opt5 from TMCO1__Homo_sapiens__NP_061899
augcccagaaagcggaaaugcgaccugcgcgccgugagagucggccuccugcuugggggaggcgggguuuacggaagccgguuccgcuuuaccuucccuggcuguagagcucuguccccguggcgggugcgcgugcagagacggcgcugcgagaugucuacaauguuugccgauacgcuccugaucgucuucauuagcguguguaccgcgcuucuggcugaagggaucacauggguucucguguauagaaccgacaaguacaaacggcugaaggccgaggucgaaaaacaauccaagaagcuggagaaaaagaaagaaacaauuaccgagucugccggacgccagcagaagaaaaagaucgagagacaggaagagaagcucaaaaacaauaaccgggaucugagcauggugcgcaugaaguccauguuugcuauuggcuucugcuuuacagcccuuaugggcauguucaauucuaucuuugacgggagaguuguggcuaaacugcccuucaccccucucagcuauauccaaggacugucccaccggaaccuucugggcgaugacacgaccgauuguagcuuuauuuuccucuacauccugugcacaaugucuauuagacagaauauccagaagauucuggggcucgcccccucccgcgcggccaccaaacaggcuggaggcuuucuggggccucccccuccgagcggaaaguucucuuga

SEQ ID NO: 76927 - RNA, 1905 nt, Artificial Sequence
  derived and/or modified sequence opt5 from TMCO4__Homo_sapiens__XP_011539488
auggccauguggaacagacccugccagcggcugccucaacagccgcucguggcugagcccaccgccgaaggcgagccucaucugcccacagggcgcgaacuuacggaggcgaauagauucgcuuacgccgcccuguguggaaucagccucucccagcuguuuccugaacccgagcacucuagcuucugcaccgaguuuauggcuggccuuguccaguggcuggaacucuccgaggccguucugccuacaaugaccgcuuucgccucugggcugggaggcgaaggggcggacguguuugugcaaauucuccugaaggauccgauccuuaaagacgaucccacagucauuacccaggaccugcucagcuucucccugaaggauggacacuaugacgcccgggcucgcgugcuuguuugucauaugacaucucugcuccaggugccucuggaggagcuggauguccucgaagagauguuucuggaaagccuuaaagagaucaaggaagaggaguccgaaauggccgaggcuagccggaaaaagaaggaaaacagacgcaaauggaagagauaccugcucauuggccuggccaccgugggcgggggaacgguuaucggcgugaccgggggacuugcggcgccccuggucgcugccggcgcugccacaaucauugggucugccggagcugcggcccucggcuccgcugccggcaucgccauuaugaccagccuguucggggcugccggagcgggccugacaggguauaaaaugaagaaacgggugggagcuaucgaggaauuuaccuuccucccucugacggagggccgccagcuucacauuacaaucgccgugaccggguggcuggccucuggaaaguacagaacauuuuccgcucccugggccgcucucgcccauagccgggagcaauauugccuggcgugggaagccaaguaccuuauggagcugggcaaugcucucgaaaccauucugucuggccuggccaacauggucgcucaggaggcccucaaauauaccguucuguccgggaucguggcggcccuuacauggccggcuagccugcucuccguggccaaugucaucgacaacccuuggggagugugucugcaccgcucugcugaaguuggcaagcaccuggcccauauucuucucagcagacagcaggggcggcgccccgugacgcugaucggauucucccugggcgccagagucauuuacuuuugccuccaagagauggcucaggagaaagauugucaggggaucauugaagacgugauccugcuuggcgcgccuguugagggagaagccaagcacugggagcccuuccggaaaguggucagcggcagaaucauuaauggguacugccgcggagauuggcugcucucuuucguguaucggaccuccagcguccaacugagaguggcuggccugcagcccguucuucuccaggaccgccggguggagaacgucgaucugacaucugugguuagcgggcaucuggacuacgccaagcagauggacgccauccucaaagcugugggaauuagaaccaagccuggcugggaugaaaaggggcugcuucuggccccgggcugucuccccuccgaggaaccucgccaagcggcugccgccgcuucuagcggagagacaccccaccaggucggccagacccaggggccuaucuccggagacacgagcaaacuggccaugucuacagaucccucccaagcccaggugccggugggccuggaccagagcgaaggggcuucucuuccugccgccgcuucccccgagcggccucccauuugcagccacggaauggauccuaauccccucggcuguccggacugcgccugcaagacccaggggccuuccaccggccuggauuga

SEQ ID NO: 76928 - RNA, 867 nt, Artificial Sequence
  derived and/or modified sequence opt5 from TMCO5A__Homo_sapiens__XP_005254225
auggagaucagcagacuggcccaguccaagcggaacauuaucucucucaauauggaccuggaacgcgauacccaaagaauugacgaggcuaaccagaaacuucugcucaagauccaggaacgggaggauaaaauucagcgccuggaaagcgagaucauccaaacaagaggccuuguggaggacgaagagugggaaaaggagaaucggacgaccauggagcgcgaaagagcccugcaggagcucgaagaggaaacagcgcggcuggagcgcaaaaacaagacccugguccacuccauuacagagcuccagcagaagcugaccagaaaaucucaaaagaucacaaauugugaacagagcucccccgauggggcucuugaggaaaccaaaguuaagcugcagcagcucgaggccucuuacgccugucaagaaaaagagcugcuuaaggugaugaaggaguaugcuuucgugacgcagcugugcgaagaccaggcccucuacauuaaaaaguaucaagagacccugaaaaagaucgaagaggaacuggaggcucucuuucuggagcgggaagucagcaaacuuguguccaugaacccuguugagaaggaacauacaagccagaauaacgagggaaccccgacacagaaaaccgcccgccuguucucuaagaagaucuuuuguugccucuucuuuauuacgcuguucuuuauuagacuucuguccuacauguucuuucacgugcgguucaucaaucccgaucuccuggucaacgugcugccuaaaguucucggccgcagcacacuguggaagcugagaugcuuuuucuuucccucucuuacccucgagacagaagacaugcugccucauuga

SEQ ID NO: 76929 - RNA, 660 nt, Artificial Sequence
  derived and/or modified sequence opt5 from TMED10__Homo_sapiens__NP_006818
augagcggccuguccgggcccccugccagacggggaccguucccccucgcucugcuucugcucuuucugcuuggcccucgccuggugcucgccaucucuuuccaucugcccauuaacagcagaaagugccugcgggaggaaauccacaaagaccuccuggucaccggggcguacgagauuuccgaucagucuggaggcgcugggggacuucgcagccaccugaagaucacagacuccgccggccauauucucuauucuaaagaagaugccacgaagggcaaauuugcuuucaccacagaggacuacgauauguuugaaguuuguuucgagagcaaggggaccggaagaaucccugaccaacuggugauccuugauaugaagcacggcguggaggccaaaaauuaugaagagauugcuaaggucgaaaaacugaagccccucgagguggagcugcggcgccuggaagaccucuccgagagcaucguuaacgauuuugccuacaugaaaaagagagaagaggaaaugcgggacacaaaugagucuaccaacacacgcgugcuguauuucuccauuuuuagcauguucugccuuaucgggcuggcgaccuggcaggucuuuuaccucagacgguucuuuaaggccaaaaagcugauugaguga

SEQ ID NO: 76930 - RNA, 684 nt, Artificial Sequence
  derived and/or modified sequence opt5 from TMED1__Homo_sapiens__NP_006849
augauggccgcuggcgccgcgcuggcucucgcccuguggcuucugaugcccccuguggaggucgggggagccggcccgcccccuauccaggacggggaguucaccuuucuccugcccgcuggaagaaagcaaugcuucuaccagagcgccccugcuaacgccucccuugaaacagaauaucagguuauuggcggggcgggacuggauguggacuuuacgcucgagucuccccagggcgugcugcuggucagcgaaucccggaaagccgauggcgugcacaccguugagccuacagaggcuggggacuacaagcucuguuucgauaauucuuuuagcaccaucuccgaaaaacugguguucuuugagcuuauuuucgacucucugcaagaugacgaagaggucgagggaugggccgaagcuguggagccggaagagaugcucgauguuaagauggaagacaucaaagagagcauugagacaaugcgcaccagacuggaacgguccauccagaugcuuacacugcuccgcgccuuugaggcgagagaucggaaccugcaggaaggcaaucuggagcgcgugaacuucuggagcgccgucaauguggcugugcuccugcuugucgccguucuccaggugugcacccugaagagauuuuuccaagacaagcggcccgugccuacguga

SEQ ID NO: 76931 - RNA, 606 nt, Artificial Sequence
  derived and/or modified sequence opt5 from TMED2__Homo_sapiens__NP_006806
auggugacccuggccgagcuccugguccuucuggcugcccuccuggcgacaguuucuggcuacuucguguccaucgacgcucacgccgaagagugcuuuuucgaaagagugacgucugggaccaagaugggacuuauuuuugaggucgccgaaggcggguuccuggauaucgacguggagauuacaggacccgauaacaaaggcaucuauaagggggaccgggagagcuccggaaaauacaccuuugcugcccauauggauggcacauauaaguucuguuuuucuaaucgcaugagcaccaugacaccuaaaauuguuauguucaccaucgacaucggcgaagcuccgaaggggcaggauauggagacggaagcccaccaaaacaagcucgaggagaugauuaaugaacuggcgguggccaugaccgcugucaaacaugagcaggaauacauggaggugagagaacggauccaccgcgccauuaacgacaauacaaacuccagaguugugcuguggagcuuuuucgaggcucucguccugguggccaugacccuuggacagaucuauuaccugaagcgguuuuucgaggugcgcagagucguuuga

SEQ ID NO: 76932 - RNA, 468 nt, Artificial Sequence
  derived and/or modified sequence opt5 from TMED3__Homo_sapiens__NP_001288132
augggcagcaccgugcccagauccgccucuguccugcuccugcuucugcuccugcggcgcgcugagcagccuugcggggccgaacuuaccuucgagcugccggacaacgcgaagcaauguuuucacgaagagguugaacagggagugaaauucagccucgauuaccaggugaucacgggcgggcauuaugacgucgauugcuacguggaggacccccagggaaauaccauuuauagagagacaaagaaacaauacgauuccuuuaccuaucgggcugaaguuaagggcguguaccaguucuguuuuucuaacgaguucagcacauuuucccacaaaaccgucuauuucgacuuucaggugggggaugaaccucccauccugccugacaugggaaaucgcguuacagcccugacccagggccccucugccagcccuacgccgacacccccucucagagugcccgucuga

SEQ ID NO: 76933 - RNA, 684 nt, Artificial Sequence
  derived and/or modified sequence opt5 from TMED4__Homo_sapiens__NP_872353
auggccggcgugggggcuggaccccugagagccaugggccggcaggcgcuccugcuucuggcucucugcgccaccggggcccaaggacuguacuuccacaucggcgagacagaaaagcgcuguuuuauugaggaaaucccugacgagacgauggucauugggaacuauagaacccagaugugggauaaacagaaggaaguuuuccuuccgagcacacccggacugggcaugcauguggaggugaaagacccugauggcaaggucgugcucucccggcaguacgggucugagggacgcuuuaccuucacaagccacacccccggcgaccaucaaaucugccugcacuccaauucuacaagaauggcucuguuugccgggggaaaacuccggguucaucuggauauucaggugggcgaacacgcuaacaauuauccugagaucgccgcgaaggacaaacuuaccgaacugcagcuccgcgccagacagcugcuugaucaagucgagcagauccagaaggagcaggacuaccaacgguaucgcgaagagagauuccggcugacgagcgaauccaccaaccagcgcgugcucugguggucuauugcucagacaguuauccugauucugaccgggaucuggcaaaugagacaccucaagagcuuuuucgaggccaaaaagcugguguga

SEQ ID NO: 76934 - RNA, 675 nt, Artificial Sequence
  derived and/or modified sequence opt5 from TMED7__Homo_sapiens__NP_861974
augcccagaccuggcagcgcccagcggugggcugccguggcggggcgcuggggaugcagacugcucgcucugcuucugcucgucccgggccccgggggagccuccgagaucaccuucgaacugccugacaacgccaagcaauguuuuuacgaggauauugcucagggcacaaaaugcacgcuugaguuccagguuaucaccgggggacacuaugacguggauugucggcuggaagaccccgauggcaaggugcucuacaaagaaaugaagaaacaguaugacucuuuuacauucaccgccagcaagaauggcacauacaaguuuugcuucuccaacgaguuuucuaccuucacacauaaaaccgucuauuuugauuuccaagugggggaggacccuccccuguuuccuagcgaaaaucgcguuuccgcucugacgcagauggagucugccugugugagcauucacgaagcgcucaaguccgucaucgauuaccagacccauuucagacugcgggaggcccagggacgcagcagagcugaggaccuuaacacacggguggccuauuggucuguuggcgaagcucugauucuccugguggucuccaucgggcaaguguuucuucugaaaucuuucuucagcgauaagcgcaccacaaccacgagagugggauccuga

SEQ ID NO: 76935 - RNA, 1215 nt, Artificial Sequence
  derived and/or modified sequence opt5 from TMED7-TICAM2__Homo_sapiens__NP_001157940
augcccagaccuggcagcgcccagcggugggcugccguggcggggcgcuggggaugcagacugcucgcucugcuucugcucgucccgggccccgggggagccuccgagaucaccuucgaacugccugacaacgccaagcaauguuuuuacgaggauauugcucagggcacaaaaugcacgcuugaguuccagguuaucaccgggggacacuaugacguggauugucggcuggaagaccccgauggcaaggugcucuacaaagaaaugaagaaacaguaugacucuuuuacauucaccgccagcaagaauggcacauacaaguuuugcuucuccaacgaguuuucuaccuucacacauaaaaccgucuauuuugauuuccaagugggggaggacccuccccuguuuccuagcgaaaaucgcguuuccgcucugacgcagauggagucugccugugugagcauucacgaagcgcucaaguccgucaucgauuaccagacccauuucagacugcgggaggcccagggacgcagcagagcugaggaccuuaacacacggguggccuauuggcacucuguugauaccuccccgggcuaccaugaaagcgacucuaaaaaguccgaggaucugagccucugcaauguggcugaacacucuaacacaaccgaggggcccacgggaaaacaagaaggcgcccaguccgucgaggagauguuugaagaggaagcggaggaagagguguuccugaaguucgugauucuucacgccgaggacgacacagaugaagcucugcgcguccagaaucuccugcaggacgauuuugggaucaagccuggaaucauuuucgccgagaugcccuguggcagacaacaucugcagaaccucgacgaugcuguuaauggcagcgccuggaccauccugcuucugacagaaaacuuucuccgggacaccuggugcaauuuccaguuuuacaccucccugaugaacucugugaaucgccaacacaaauauaacagcgugauuccuaugagaccccuuaauaacccgcugccucgggagcgcacacccuucgcccuccagacgaucaacgcucuggaagaggaguccagaggguuuccuacccaggucgaacggauuuuccaggagagcguguacaagacacaacagaccaucuggaaagaaacaagaaauaugguucagcgccaguuuauugcguga

SEQ ID NO: 76936 - RNA, 708 nt, Artificial Sequence
  derived and/or modified sequence opt5 from TMED9__Homo_sapiens__NP_059980
auggccguggagcugggcguccuccugguuagaccccggccugggaccggacuuggccgcgugaugagaacacugcuccuggugcuuuggcuggcuacgcgggggagcgcccucuacuuccacaucggagaaaccgagaagaaaugcuuuauugaagagaucccggacgaaacaauggucauuggcaacuaucgcacccagcuguacgauaagcaaagagaggaguaucagcccgcgacaccugggcugggaauguucguggaaguuaaagaccccgaggauaaggugauccucgcucggcaguacggcuccgaaggccgcuuuaccuucacaucucauaccccuggggagcaccagauuugucugcauagcaauuccacgaaauuuucucuuuucgccggaggcaugcugagaguccaccucgacauccaagugggggagcaugccaacgauuaugcugaaaucgccgcuaaggacaagcugagcgagcuucagcugcggguucgccagcucguggaacaggucgagcaaauucagaaagaacagaauuaccagagauggcgggaggagcgcuuuagacaaaccuccgaaucuacaaaccagcgggugcugugguggagcauccugcagacccucauucugguggccaucggagucuggcaaaugcgccaccuuaaguccuucuuugaggcgaaaaagcugguuuga

SEQ ID NO: 76937 - RNA, 1143 nt, Artificial Sequence
  derived and/or modified sequence opt5 from TMEFF1__Homo_sapiens__NP_003683
augggcgccgcugccgcggaggcuccccugagacucccugccgccccgccccuggcuuucugcuguuacaccagcgugcuucugcucuuugccuucucccugccugggucucgggcuagcaaccagcccccuggaggcgggggaggcuccgggggagacugccccggcggcaaggggaaaucuaucaauuguagcgaacuuaacguccgcgaguccgauguuagagugugcgacgaaucuagcuguaaguauggaggcgugugcaaagaggauggggacggacugaagugugccugccaauuucagugucacacaaauuacauuccugucugcggcuccaacggggauacguaucagaaugaauguuuccuccggcgcgcggccugcaaacaucagaaggagaucaccgugauugcuagaggaccgugcuacagcgacaacggcucuggcuccggggagggagaagaggaaggcagcggggccgagguucaccggaagcauucuaaauguggacccugcaaguauaaagcugagugugaugaagacgccgagaaugugggcugcgucuguaacaucgauugcuccggguacagcuuuaauccugugugugcgucugacggauccagcuauaacaaucccugcuucguucgcgaagccuccuguauuaagcaagagcagaucgauaucagacaccugggccauugcacagacaccgaugacacaucucugcucggcaaaaaggacgaugggcugcaguaccggccugacgugaaggaugcuagcgaccagcgcgaagaugucuacauuggaaaccacaugcccuguccggagaaucuuaacggcuauugcauccacgggaaaugcgaguuuauuuacuccacccaaaaggccagcuguagaugcgaaucuggauauacaggccagcauugugagaaaaccgacuucuccauccuguacguggugccuagccggcagaagcucacgcacguccugauugcugccaucauuggggccguucagaucgcuaucauuguggcgaucgugaugugcauuacccgcaaaugucccaagaauaacagaggccggcgccaaaaacagaaccuuggacauuuuacaucugauaccagcuccagaauggucuga

SEQ ID NO: 76938 - RNA, 1125 nt, Artificial Sequence
  derived and/or modified sequence opt5 from TMEFF2__Homo_sapiens__NP_057276
auggugcugugggagagccccagacagugcuccucuuggacccucugugaaggcuucugcuggcugcuucugcucccugucaugcugcuuaucguugcccggccggugaagcuggcugccuuucccacaagccucuccgacugucaaacgccuaccggguggaacugcucuggauacgaugaccgcgagaaugaucuguuccugugugacacaaauaccugcaaauuugauggcgaaugucucagaauuggggacacagugaccugcgucugucaguucaagugcaacaacgauuaugugcccguuuguggaagcaauggcgaguccuaccagaacgaaugcuaucugcggcaggcggcuugcaaacaacagucugagauccuuguggucagcgagggguccugugccacagacgccggaagcggcucuggcgauggggugcacgaaggauccggcgagaccagccagaaggaaacgucuaccugcgacauuugucaguuuggggcugagugcgaugaggacgccgaagauguuuggugugugugcaauaucgacuguucccaaacaaacuucaauccucugugcgcuagcgacggaaaaucuuacgauaacgccugucagauuaaggaggcguccugccagaagcaggagaaaaucgaagucaugagccucggccgcugucaagacaauaccacaaccacgacaaaguccgaagaugggcauuaugccagaaccgacuacgcugagaacgccaauaaacuggaggaaucugcucgggagcaccauauccccugcccugaacacuauaacggauuuugcaugcauggcaagugugagcacagcauuaauaugcaggaaccguccugccgcugugaugccggcuacacagggcagcacugcgagaaaaaggacuacagcgugcuuuaugugguccccggaccuguuagauuccaauacgugcugaucgcggccgugauuggcaccauccagauugcugucaucugugugguugugcucugcauuacccggaaguguccccgcucuaacagaauccaucggcagaaacagaacacagggcacuauuccagcgauaauacgacccgcgccucuacaagacugaucuga

SEQ ID NO: 76939 - RNA, 405 nt, Artificial Sequence
  derived and/or modified sequence opt5 from TMEM100__Homo_sapiens__NP_060756
augaccgaggaacccaucaaggagauucugggcgccccuaaagcucacauggccgcgacaauggaaaagagcccgaaauccgagguggucaucacgaccguuccccucgugucugaaauucagcugauggcugccacagggggaaccgagcuuagcugcuacagauguaucauuccuuucgccguggucguguuuaucgcuggcaucguugugacagccgucgcuuauuccuucaacucucaugggagcauuaucuccauuuuuggacuggugguucucucuagcggccuguuccuucuggccuccagcgcgcucugcuggaaggugcggcaacgcucuaaaaaggccaagagacgggagucccagaccgcucuggucgccaaucagcgcagccuguuugcuuga

SEQ ID NO: 76940 - RNA, 774 nt, Artificial Sequence
  derived and/or modified sequence opt5 from TMEM101__Homo_sapiens__XP_011523653
auggccagcaagaucggcuccagacgguggaugcugcagcucauuaugcaacuggggucugugcuucugacccgcugccccuucuggggauguuuuagccagcucaugcuguacgcugagagagccgaagcgcggcgcaaaccugacaucccgguccccuaucuuuacuucgauaugggcgcugccguucugugcgccuccuuuaugucuuucggggugaagagacggugguuugcucucggagccgcucugcagcuggccauuagcacauaugcggccuacaucggcggguaugugcacuacggagacuggcucaaaguccgcauguauuccagaacgguggcuauuaucggcggcuuccugguucuugccucuggggcuggagagcuguaccggcgcaagccuagaagccggucccuccagagcaccggccaaguguuucuggggaucuaccuuauuugugucgccuauucucugcagcauuccaaagaagaucgccucgcguaccugaaccaucugcccggaggcgagcucaugauccagcuguucuuugugcuuuaugggauucuggcccucgcuuuccugagcggauacuauguuacacuugccgcucagauccuggccgugcuccugccucccgucaugcugcucauugacggcaauguggccuacuggcacaacaccagacggguggaauuuuggaaucaaaugaagcugcuuggcgagucugucgggaucuucggaacagcuguuauucuggcgaccgauggcuga

SEQ ID NO: 76941 - RNA, 390 nt, Artificial Sequence
  derived and/or modified sequence opt5 from TMEM105__Homo_sapiens__NP_848615
augcugcucaaggugagacgggccagccugaaacccccugcuaccccgcaccagggcgccuuccgcgcggggaacgucaucggacaacuuauuuaccugcucacauggucccuguuuacggcuuggcuuagacccccuacccugcuccagggcccccggacaucuccucaggggagcccuccccgcuccccguggggagacugcgccgagcccucuugucugugcgaaaugaagaucagacggcgcagacaugagggcccugccugggggcagagcggauuccuggcuggcggccuccaccugguucccuccucucuuagccuggccgcuugugggguggugcggaugaaaggacucuggggccgcggggccggaauuagaggccgguga

SEQ ID NO: 76942 - RNA, 825 nt, Artificial Sequence
  derived and/or modified sequence opt5 from TMEM106B__Homo_sapiens__XP_005249846
augggcaagagccugucccaccucccccugcauucuagcaaagaggacgccuacgauggggugaccuccgaaaacaugagaaauggacuugucaacucugagguucacaaugaagacggccggaacggggaugugagccaguucccuuauguggaguuuacaggacgcgacuccgucacgugcccgaccugucaaggcacagggagaaucccccggggacaggaaaaucagcugguggcucucauuccuuacucugaucagcgccugagaccccggcgcaccaaacuuuauguuauggccagcguguucgucugccugcuccuguccggccuggcgguguuuuuccucuuuccuagaagcaucgacguuaaguacauuggcgugaagucugcuuaugucuccuacgaugugcaaaaacggacaaucuaucugaacauuaccaauacacuuaacaucaccaauaacaauuacuacagcguggaggucgagaacaucacggcccagguucaguucucuaagaccgugauugggaaggcccgccugaauaacaucacaauuaucggaccccucgacaugaaacagauugauuauaccgugccuacagucaucgcugaagagauguccuacauguaugacuuuuguacccugauuagcaucaaggugcauaauaucguucuuaugaugcaagugacggucacaaccacauacuucggccacucugaacagauuucccaggagagauaucaguacguggauugcgggcggaacaccaccuaucaacugggacagagcgaguaccucaacguucugcagccgcaacaguga

SEQ ID NO: 76943 - RNA, 318 nt, Artificial Sequence
  derived and/or modified sequence opt5 from TMEM108__Homo_sapiens__NP_001269794
augaagagaagccugcaggcccucuacugccaacugcuuaccgugcugcucacagucuguugcaugaaacggaagaaaaagacggcuaaccccgagaauaaccuguccuauuggaauaacaccaucacaauggacuacuucaaucgccacgccguugaacuuccuagagagauucagucucuggaaaccagcgaggaucagcucuccgaaccgcggucucccgcgaacggcgacuaucgcgauacagggauggugcuggugaauccuuuuugucaggagacccuguucgucggaaacgaccaagugagcgagaucuga

SEQ ID NO: 76944 - RNA, 429 nt, Artificial Sequence
  derived and/or modified sequence opt5 from TMEM114__Homo_sapiens__NP_001277026
augaaccccuucagacuggagaaugugaccgucagcgaauccucucggcagcuccugacaaugcacggcacguuuguuauccuucugccucucagccugauucuuaugguguucgggggaaugaccggcuuucuguccuuccuccugcaagccuaccugcuccugcuucugacagggauccucuuucuguucggagcuauggugacccuugccggcauuucugucuauaucgcguacagcgcugccgccuuucgcgaggcucugugccuccuggaagagaaggcccugcucgaccagguggauauuuccuucggguggucucuggcucuuggauggaucagcuuuaucgccgaacugcucacaggcgcggccuuccuggcugccgcuagagagcuuucccugcggcgcagacaggaccaggccauuuga

SEQ ID NO: 76945 - RNA, 1056 nt, Artificial Sequence
  derived and/or modified sequence opt5 from TMEM115__Homo_sapiens__NP_008955
augcagagagcccugcccggcgcucggcaacaccucggggccauccuggcgagcgcuuccguggucguuaaggcccuuugcgccgcugugcuguuccucuaccugcuuucuuuugccguggacaccggaugucuggcugucacaccuggcuaucucuucccgcccaacuuuuggauuuggacgcuggccacccaugggcugauggagcagcacgugugggauguugcgaucagccucacaaccguggucguggccggacgccugcuugaaccucuguggggcgcucucgagcugcuuauuuucuuuuccguugugaaugucucuguggggcugcucggagccuucgcuuaccugcugacauauauggccagcuuuaaccucguguaccuguucaccgucagaauccauggcgcgcuuggcuuucucgggggaguucugguggcccugaaacagacaaugggcgacugcgugguccuucgggugccccagguucgcguguccgucaugccuaugcugcuccuggcucugcuccugcuucugagacucgccacccugcuucaaucucccgcucuggccagcuauggguucggacuccuguccagcuggguguaccugcgguuuuaucagcgccacucuagaggccgcggggauauggccgaccauuucgcuuuugcgacguucuucccugaaauucuccagccgguugugggacugcuugccaaucugguccacucccuccuggugaaggucaaaaucugucagaagaccgugaaacgguacgauguuggcgcucccagcucuaucacaauuucccugccuggcaccgacccccaagaugccgagagacggcgccagcuugcccucaaggcucugaacgaaagacugaagcggguggaggaccagagcaucuggccuucuauggaugacgaugaggaagaguccggggccaaagucgacagcccccucccguccgauaaggcgccuacacccccuggaaaaggcgcugcccccgaaucuagccugauuaccuuugaggccgcucccccuacgcuuuga

SEQ ID NO: 76946 - RNA, 1233 nt, Artificial Sequence
  derived and/or modified sequence opt5 from TMEM117__Homo_sapiens__NP_001273141
auggcuaccugccacagccauagaacaaacuccuggcagaucucugugcccagcgccuucgucugguccguugccccuauuaagaaugugucucggcgcagcuggguggucgacgauaacgugcugcaacacaauucccucucucugcauaucuuuagccacauucagcaugacuccagcaacggcugggagcacgggguuacggauaugaugcuucaggacaaaccguaccccgauuggggaaagucugcgagagcuuucuggaaaaagggcaaugugcggaucacccuguuuuggacaguccucuucacccugacauccgugguugugcuugucauuaccacagacuggaucagcugggauaaacugaaccgcggguuucucccuucugacgaaguguccagagccuuccuggccagcuuuauccugguguucgaucuccugauugucaugcaggacugggaguuuccccacuucaugggagauguugacgugaaucuuccuggccugcauacgccccacaugcaauuuaagaucccuuucuuucagaagauuuucaaagaagaguaucggauccauauuaccgggaagugguucaacuacggaaucauuuuucucgugcugauccuugaucugaauauguggaaaaaccagaucuucuauaagccgcacgaauacggccaguauauuggccccgggcagaaaaucuacaccgucaaggacucugagucccucaaggaccugaaucgcacaaaacugagcugggaguggagauccaaccacaccaauccucggacaaacaagaccuauguggaaggagauauguuucuccauucucgcuucauuggcgcuagccuggacguuaaaugucuugccuuugugcccucccugaucgcuuucgucugguuuggguucuuuauuugguucuuuggaagauuccucaagaaugagccucggauggaaaaccaagauaaaacguacacacgcaugaagagaaaaagccccucugagcacuccaaggacaugggcaucacccgggagaacacacaggccagcguggaagauccgcugaaugacccuucucuuguuugcauccgcagcgauuuuaacgagauuguguacaaguccucucaucugaccagcgaaaaucucuccagccagcugaacgagucuaccuccgcgacagaagccgaccaagaucccacgaccagcaaaucuacaccuaccaauuga

SEQ ID NO: 76947 - RNA, 579 nt, Artificial Sequence
  derived and/or modified sequence opt5 from TMEM11__Homo_sapiens__NP_003867
auggccgcuuggggcagacggcgccuggggcccggaagcuccggcgggucugccagagagcgggugagccucuccgcgaccgacugcuacaucguccacgaaauuuauaacggagagaaugcucaggaucaauucgaauacgagcuggaacaggcccuugaggcccaguauaaguacaucguuauugagccuacacgcaucggcgacgaaacggcuagauggauuaccguggggaacugucugcauaaaacagccgugcucgcuggaaccgccugccuguuuacaccgcuugcgcugccccucgauuauucucacuacaucagccugccugccggcguccugucccucgcuuguugcacccuguauggcaucucuuggcaguucgaccccuguugcaaguaccaaguggaguacgaugccuauaaacuuagccggcugccucuccauacacugaccuccagcacgcccguugugcuuguccgcaaggacgaucugcacagaaaacggcuccauaauaccauugcucuggccgcgcugguguacuguguuaagaagaucuaugaacucuacgccguguga

SEQ ID NO: 76948 - RNA, 378 nt, Artificial Sequence
  derived and/or modified sequence opt5 from TMEM126A__Homo_sapiens__NP_001231664
auggccggcauccccuuccugaccacagaccucacguacagaugcuuugugagcuucccucugaacaccggggaucuugacugugagacaugcaccauuacacgguccggacugaccggccucgucaucgggggacuguauccgguuuuucuugcuauucccgugaauggcgggcuggccgcgcgcuaccagucugcucuccugccucacaagggaaacauccugagcuauuggauuagaacauccaaacccguguuccggaagaugcucuuuccuauccugcuucaaaccauguucucugccuaccugggcagcgaacaguauaaacuccugaucaaggcccuucagcuguccgagcccggcaaagaaauucauuga

SEQ ID NO: 76949 - RNA, 717 nt, Artificial Sequence
  derived and/or modified sequence opt5 from TMEM127__Homo_sapiens__NP_001180233
auguacgcccccggcggggcuggacugccuggcgggagacggcgcagaagcccgggaggcuccgcccuccccaagcagccugagcggucucuggcgagcgcccuucccggggcucuguccaucaccgcccucugcacagcucuggccgaaccugcuuggcuucacauucauggaggcacguguucucgccaagagcugggcgugagcgacguccucggguauguucaccccgaucugcugaaagacuucugcaugaacccucagaccgugcuccugcuuagagugaucgccgcguuuuguuuccugggcauucucugcucccugucugccuuucuucuggaugucuucggaccgaagcaucccgcucucaaaaucacacggcgcuacgccuuugcucacauucugaccgugcugcagugugccacaguuaucggguucagcuauugggcguccgaacucauccuggcccagcaacagcagcauaagaaauaccacggaagccagguguaugucaccuuugcugugucuuucuaccuuguugccggcgcugggggagccuccauucuggccacagcugcgaaucuccugagacacuauccuaccgaggaagaggagcaagcccuugaacugcucagcgagauggaagagaacgagcccuacccugcugaauacgaggugaucaaucaguuucagcccccgccugccuauacgcccuga

SEQ ID NO: 76950 - RNA, 498 nt, Artificial Sequence
  derived and/or modified sequence opt5 from TMEM128__Homo_sapiens__NP_001284480
auggacagcuccagagcccggcagcaacugcgcagacgguuccuccugcuucccgaugcugaggcccagcuggaccgcgaaggcgaugcggggccugagaccucuacagcuguggaaaagaaagagaagccgcuccccagacugaacauccacagcggauuuuggauucuugccuccaucgucguuacguacuauguggacuucuuuaaaacccugaaggaaaauuuccauacaucuagcugguuucucugcggcuccgcccugcugcucgugucucugagcauugcuuucuacuguaucgucuaucuugagugguacugcgggauuggagaguaugaugugaaauacccugcccugauccccaucaccacagcuuccuuuauugccgcgggcaucuguuucaacauugcccucuggcacguuuggagcuuuuucaccccucugcuucuguuuacacaguucauggggguggucauguuuaucacccuccugggauga

SEQ ID NO: 76951 - RNA, 3075 nt, Artificial Sequence
  derived and/or modified sequence opt5 from TMEM132A__Homo_sapiens__NP_060340
augugcgccagaauggcuggccggaccacagccgcgccccgcgggccuuacggaccguggcugugucuccugguggcucuugcccuggacgucguuagaguggauugcggccaggcuccccucgacccuguguaucugcccgcugcccuugagcugcucgaugcuccugaacacuuccggguccaacagguggggcauuacccgccugccaacagcucccugucuagccgcuccgagacguuucugcuccugcagccguggcccagagcgcagccucuucugcgggccucuuaucccccuuucgcuacccaacagguugugcccccgcgcgucacagaaccucaccagagacccgugccuugggacguucgggccgugagcgucgaggcugccgugacccccgcggaacccuacgcccgcgugcucuuucaucugaagggacaggauuggccuccgggcuccgggucucuucccugugcuagacugcacgccacacauccugcuggaaccgcccaccaagccugccgguuccagcccagccucggcgcuugugucguugagcuggagcugccuucccacugguuuagccaggcgucuacaacccgcgccgaacucgcuuauacgcuggagcccgccgccgaaggccccgggggaugcggcuccggggaggagaaugacccuggagaacaggcccuucccgugggcgggguggagcugagaccugccgaucccccucaauaccaggaagucccccucgacgaggcggugacccugcggguuccggauaugccugugcgccccggacagcuuuucagcgcuacacugcuccugagacauaacuuuaccgccucucugcucacacugcggaucaaagucaagaaaggccuucacgugaccgccgcuagacccgcccaaccuacgcuguggacagcuaagcucgaccgcuucaaaggcucccggcaucacaccacacugauuaccugucacagagccgggcuuaccgaaccggauagcucuagcccccuggagcucuccgaguuucuguggguugacuucguggucgaaaauuccacaggaggcgggguggcggucacgcgcccugugaccuggcagcuggaguaucccggacaggccccugaagcugagaaggauaagaugguuugggaaauccucgugucugagcgggacauuagagcccugaucccccuugcuaaagccgaggaacuggucaacacagcgccucucaccggcgugccccagcauguuccggugcgccuggucacaguggacgggggaggcgcccugguggagguuaccgaacacgucggcugcgagagcgcuaauacgcaagugcuucagguguccgaagccugugaugcugucuuuguggccgggaaggagagccggggagccagaggcguucgcguggacuucugguggcggagacuccgcgcuucucugcggcugacagucugggcgccucuccugccccuuagaauugagcugaccgauaccacacucgaacaggugcggggguggcgcguuccuggacccgccgagggcccggcugaaccugccgccgaggcuuccgacgaggccgaaagacgggcgagagggugccaucugcaguaccaacgcgcuggcgugcgguuucuggcccccuucgccgcucacccucuugauggaggcagacgccucacccaucugcuggggcccgacuggcuccuggaugucagccaccuuguggcgccccacgccagaguucuggacucucggguggcuagccucgagggaggccgcgucgugguggggagagaaccuggagucacauccaucgagguucggucuccgcugagcgauuccauccugggcgaacaggcccuugccgugacggacgauaaagugagcguccucgagcugcgcgugcagcccguuauggggauuucucugacccucuccagaggcacagcucauccuggagaggugaccgccacauguugggcucagagcgcccugcccgcgccuaagcaagaagucgcccuuucucuguggcucuccuucagcgaccacaccguggcucccgccgagcuguacgaccggcgcgaucugggccuuuccguuucugcugaagaaccuggggccauccucccggccgaggagcagggagcucagcugggcguggucgugagcggggcgggagccgagggccugccccuccauguugcucugcacccucccgaaccuugcagacgggggcgccacagagugccccuugccuccggcacggccuggcugggacucccgccugcuucuacccccgcccccgcgcugccuagcucccccgcuuggagcccuccggccacagaggccaccaugggcgggaaacggcaggucgcuggaucugugggcgggaacacaggagugagaggcaaguuugaacgcgccgaggaagaggcgcggaaggaggaaaccgaggcuagagaagaggaggaagaggaagaggaagagaugguccccgccccucaacauguuacggagcuggaacuugggauguaugcccugcucggcguguucugcguggcuauuuuuaucuuccuggucaauggagugguuuuugugcuccgcuaccagcggaaagagcccccugacuccgccacagaucccaccagcccgcagccucacaacugggucuggcugggcacagaccaagaggaacuuucuagacagcuggaucgccagucccccgggccucccaagggagaaggcagcuguccuugcgagucugggggaggcggcgaggcucccacccucgccccggggccucccggaggcaccacaagcuccagcucuacgcuggcgcggaaagaagccgggggaagacgcaagcggguggaguucguuaccuuugcucccgccccuccggcucagucccccgaggaaccugugggcgcccccgccguccaaagcauucugguggcuggggaagaggacaucagaugggucugugaggauaugggacuuaaagacccugaggaacugcggaauuauauggaacgcauuagaggcuccucuuga

SEQ ID NO: 76952 - RNA, 3237 nt, Artificial Sequence
  derived and/or modified sequence opt5 from TMEM132B__Homo_sapiens__NP_443139
auguucggcgccgcuagcagaauggacaccacagccgugugcaccgggggagucacggagucccggggcaucguugauucucugcagaaguuuagcucccuccccgcguaccugccuacaaaccuucacauuucuaaugcugaagagagcuucuuucugaaagaagccaaccaagaccucacccgcaauuccucucugcaggccagaguggagccguucuuuaucuaucgggcucgcacacccccuauuaucaacgccagcuacgggcccuucuccguggaaaagauuaucccucaggagcuucugcucaccagcacagcuuuuggaaauauggauaaauuccccuuuaacuggaagcugaaaucucauauccuggacuccagcauuuauucuaauagaccuaagguccagacccucuucuacgugacgggcauggggugggaugacuccgaucugaccgaggaccuuccguguguuaagauguuugccuuccccgaagcgcgggagguggccgcuagcugccgccugcaaggagccccuggccucugugucgcugaacuggagcuucugcccgagugguuuucuuccggccucgaucuggaaccugaggaagagauccccgcccugcucgggggaacaaccauggaacuguucuucacacuuuauccggcggacaaagccggccagugcccucuggaggaggaagggaagugggagaacaauauucacagcggacucgaaucuccccagcaggcuuuuccugccagagagcggaucggcuccgugguuguguaccccacccaagaugaccugaaauggagccuugucucccuggaugaaaacguggugauuagcgucccccucaaucugguucgcgagggggacacggcuacauuccuggugucucucaccuccagcucuguggccgaccaguuuacacugagaaucaaggccgcugcgggagucaaaauuaccgccgugcggguuagcuccgaggaucagugggcugugcaggaagagaucgacaacggcucuacccaaacaagcgccacgcuuaccuguaugggccaucgcccugauacacaguccagagucaaugggagcuucuaugaaauccuucagguggacuuuggaauugauaacucuuccgaccucgccggcgcucaacagaucaccuggcagguugaguacccgauugaagauagcaugucugagcugguggucuccgagaucuucgugagccagacaaccuuugucgggauugugccccuugccauggacacggaaguucugaauacagcgauccucaccggaaagccuguguccguccccgugaagguugugggcguccaagaggaugggucugugguggacguuagcgaauccgucgagugcaaaucugcugaugaggacgugaucaaggugagcaacaacugugacuccauuuucgucaauggaaaagaaaugaaaagcaaaguggauaccaucguuaacuuuacacaccagcauuucaccucucaguuugaggugacagucugggccccucggcugccccugcagauugaaaucuccgacacggagcucagccaaauuaagggcuggcgcaucccgguggccgcuaauagacggccuaccagagaaucugaugacgaggaugacgaggaaaagaagggccgcgggugcucccugcaguaccagcacgccacaguucgggugcuuacccaguucgucgcugagagccccgaucugggacaacucacauauaugcugggcccugacuggcaguuugauaucaccgaccuggugacggaguucaugaagguugaagaacccaaaauugcccagcuucaggaugggagaacccucgcgggacgcgagccuggcaucacaaccgugcaaguccugucuccccugagcgacuccauucucgccgagaagacagugaucgugcuggaugaccgggucaccauugcugaacuugggguucagcugguggccggcaugagccucucucugcagccgcacagagcugacaaacgcgccaucguguccacggcggccgcucuggauguccuucaaagcccucagcaggaggccauuguguccucuuggauccucuucagcgacggauccguuacaccccuggauaucuacgaccccaaggauuauucugugaccgucagcucccuggacgaaauggugguuucugugcaggcuaaccucgagagcaaauggccuauugucguggccgaaggcgaggggcaaggaccgcugaucaagcuggagaugaugauuuccgaacccugucagaagacaaaaagaaagagcguucuggccgugggcaaagggaaugucaaggugaaauuugagccuucuuccgaugaacaucagggaggcagcaacgacaucgaggggauuaaucgggaguacaaggaucaccucucuaacuccaucgaacgcgagggcaaucaggaacgggcugugcaagagugguuccauagaggaacccccgucggccaggaagagagcaccaacaagucuacaacgccucagucccccauggaggggaaaaauaagcugcugaaaagcggaggcccugacgcguuuaccuccuuccccacacagggaaagagcccggauccuaacaaucccucugaccuuaccguuacaagccgcgggcucaccgaucuggaaaucggcauguaugcccugcucugcguguuuugucuggcuauucuuguguuccugaucaacugcgucgccuuugccuggaaauaccggcacaagagauucgcuguguccgagcaagggaauauuccucacucucaugacuggguuuggcucggcaacgaaguggagcugcuggaaaaccccgucgacaucacgcuuccgagcgaggagugcacaaccaugauugaucggggacuccaguuugaggaacgcaauuuccugcugaacggcuccucucagaagaccuuucacagccaacuccugagaccuuccgacuauguguacgaaaaagagaucaagaaugaacccaugaacucuagcgggccuaaacggaagagaguuaaauucacauccuacaccacaauccuucccgaggauggaggccccuauacgaauagcauucuguuugacucugaugacaacaucaagugggugugucaggauauggggcucggagacucccaggauuuccgcgacuacauggagagccugcaggaucaaauguga

SEQ ID NO: 76953 - RNA, 3327 nt, Artificial Sequence
  derived and/or modified sequence opt5 from TMEM132C__Homo_sapiens__NP_001129575
augagaagcgagggcgccgcucccgggccugccgcgccgcugugcggagcucucucccugcuucugggcgcccuccuggggaaggugaucgaaggacacggcgucaccgacaacauucagcgguucucuagccuucccccuuaccugcccguuuccuaucauauccuccgcgccgagacaucuuucuuucugaaagaagcuaaucaagaucugcucagaaacagcucccugcaggcccggguggagagcuuuuucacguacaagacccgccagccucccgugcuuaaugcuucuuaugggccuuuuuccgucgaaaaagugguuccgcuggaccucaugcugacaagcaacuuccuuggacccaccaauaaguuuucuuucgauuggaaacugaaggcccacauucucagagacaagguguaccugucccggccuaaaguccaggugcuguuucauaucaugggccgcgauugggacgaucacggcgcgggggagaagcuccccugucugagaguuuucgccuuucgggagacacgcgaagugagaggaagcugccggcuuaaaggcgaccuggggcucugugucgcugagcuggaacuucugucuuccugguucagcgccccuaccgugggagcuggccgcaagaaaucuauggaucaacccgaggggacaccgguggagcucuauuacaccguccauccuggaaacgaaagaggcgacugcgccggcggggauuuucggaagggaaaugcgauucgccccggcaaggacgggcuggaggaaacgaccucccaucugcagagaaucggaacaguuggccucuaucgggcccaggauagcgcucagcuguccgagcuuagacuggacgggaacguggugaucuggcucccuucucgccccgucaaacaaggagaagugguuaccgccuacgugacaauuagcuccaauagcucugucgaccuguucauccuucgggcuaaggugaaaaagggcguuaacauucuguccgcccagaccagagagccccgccaguggggcgugaaacaggaggucgggagcggaggcaagcacgugacggccacagucgcuugucaacggcucgggccuucuccgagaaaucgcagcuccucucuguucaacgaagugguucagaugaauuuugagaucgcgagcuucuccagccugucuggaacccagcccauuacauggcaaguggaauacccucggaaaggcaccaccgauaucgccgucuccgagauuuuugugagccagaaggaccucguugggaucgugccccuggcuauggauacagaaauccuuaacacggccguccugaccggcaagacaguggccaugccuauuaaagugguuucugucgaggaaaauuccgcugugauggacaucagcgaauccguggagugcaagucuaccgaugaagacgucauuaaagugagcgagagaugugauuauaucuucguuaacggaaaggaaauuaaaggcaagauggacgccguggucaacuuuacauaccaguaucucuccgcgccccugugcgugaccguuugggugccgcgccugccucuucagaucgaggucucugauacggagcucagccaaaucaagggguggcgggugcccauuguuacaaauaaaagaccuacccgcgaauccgaggacgaagaugaggaggaacggagaggacggggcugugcucugcaguaccagcacgccaccgugcgcguccugacacaguucgugagcgagggggccggacccuggggccaaccuaacuaucuccugucucccaauuggcaguuugacaucacccaccuuguggcugacuucaugaagcuggaggagccgcaugucgccacacuccaggauuccagaguucugguggggcgggaagugggcaugacgaccauucagguccugagcccucuuucugacuccauccucgcugagaaaacaauuaccgugcuggaugacaagguuagcgugacagaucuggccauccaacucgucgcgggacugucuguggcccuuuaccccaacgcugagaauagcaaagccguuaccgcuguggucacggccgaagaggugcugagaacccccaagcaggaagcgguguuuuccacauggcuccaguucagcgacggcucugugaccccucuggauaucuaugacacaaaggauuuuucccuggccgcuaccagccaggacgaggccgucguguccgugccgcaaccccgcucuccucgguggcccgucguuguggcugaaggggagggacagggcccucuuauuagaguggauaugacgaucgccgaggccugccagaaaagcaagcgcaaauccauucucgcugucggggugggaaacguuagagugaaguucggccaaaaugacgcggauucuagccccgggggcgacuacgaagaggacgaaaucaaaaaccacgccuccgaucggcgccagaagggacagcaccaugagagaacaggccaggacgggcaccuguacggaucuagcccugucgaacgggaggagggcgcucugcgcagagccaccacaaccgcccggucccuccuggauaauaaggugguuaaaaacagccgcgcugacgggggaagacuugccggcgaagggcaacugcagaauauucccaucgauuuuaccaacuucccggcgcauguggaccucccuaaggcuggcucuggacuggaggaaaaugaucugguccagacaccccggggccuuuccgaccucgagauugggauguaugcccugcugggaguguucugucucgccauccuggucuuucuuaucaacugcgcuacguucgcccugaaauaccgccacaaacaggugccucucgagggccaagcgagcaugacccauucucacgauuggguuuggcuggggaaugaagcugagcugcuugaauccaugggagacgcucccccgccucaggaugagcacacaaccauuaucgacagaggccccggcgccugcgaagagagcaaccaucugcuccugaacgggggaucucacaagcaugugcagucccagauucaccggagcgccgauuccggcgggagacaaggacgcgagcagaagcaggacccucuccacagccccacaucuaaacggaagaaggucaaauuuaccacguucacaaccauucccccugacgauagcuguccgaccguuaauuccaucguuucuagcaacgacgaagauaucaagugggugugccaagacgucgccgugggcgcucccaaagagcugagaaauuaucuugaaaagcugaaagauaaggccuga

SEQ ID NO: 76954 - RNA, 3300 nt, Artificial Sequence
  derived and/or modified sequence opt5 from TMEM132D__Homo_sapiens__NP_597705
augugccccagcgagaugggcacccuguggcaccauugguccccugugcucaucucucuggccgcucuuuucagcaaggucacagaagggagaggcauucuggaguccauccagcgguuuucucuccugccgacguaccuucccguuaccuaucacauuaacaaugccgacgugagcuucuuucugaaagaagcgaaccaagauaucaugcgcaauuccucucuccagagcagaguggaguccuuccugauuuacaagagccggcgccugccuguccucaacgcuucuuauggccccuuuuccaucgaacaggugguuccucaggaccugaugcuucccagcaauccuuucggguuuacaaacaaauucucucugaauuggaagcucaaagcccauauccugagagauaagguguaccuuucccggccgaagguccaagugcuguuucacauuaugggacgcgacugggaugacagaagcgccggcgagaaacuccccugucugcggguuuucgcuuuucgcgagaccagagaagugcgggggucuugccgccugcagggagaucucggccugugugucgccgagcuugaacugcucuccagcugguucuccccucccacagugguggcuggcagacggaagucugucgaccagccugaggggacccccguugagcuguauuacacagugcauccgggaggcgaacgcggggauugcgugagagaggacgcccggagaagcaacggaauccgcaccggccacuccgauauugacgaaagcgggccuccccuucagcggaucggaucuauuuuucuguaucaaacgcacagaaaaccuucccuccgcgagcugcggcuggauaauagcgucgcgauccauuacauucccaagaccgugagaaaaggcgacguucucacauuccccgugucuaucagccgcaacuccaccgaagaccgguucacacugagagccaaggucaagaaaggcgugaauaucauugggguucgcgcuucuagcccuuccaucugggaugugaaggagcggaccgacuacacgggaaaauaugccccggcugucauugugugucagaagaaagccgcgggcagcgagaacucugccgauggggcuuccuacgaagucaugcagaucgacguggagguugaggaacccggagaucuuccugccacacagcuggugaccuggcaagucgaauaucccggcgagauuacaagcgaccucggggugucuaagaucuacguuuccccuaaagaucugaucggaguggucccccuugcuauggaggccgaaauucugaauaccgccauccucaccggcaagacaguggcugugccgguuaaggucgugagcguggaggacgauggcacggucaccgaacugcuggaguccguggaaugcagaucuagcgacgaggauguuauuaaaguguccgaccgcugugacuaugucuuugugaacgggaaggagaugaaaggaaagguuaauguggucgugaacuucacauaccagcaccucucuagcccucuggaaaugaccguuugggugccccggcuuccucugcagaucgaggucuccgauacagaacucaaccaaauuaaaggcuggagagugcccaucgugagcucucggcgcccugcgggggacuccgaggaggaagaggaugacgaaagacggggaagaggcugcacccugcaguaucagcaugccaugguccgcguucugacgcaguuuguggcugaggccgccgggcccggcggacaccuugcucaccuccugggcagcgauuggcaaguggacaucacagaacugauuaaugauuucaugcaggucgaggagccgcggaucgccaagcuccaagggggacagauucugaugggccaagaacuugggaugaccaccauccagauucugucuccucucuccgacacaauccuggcggagaagaccauuacagugcuggaugaaaaaguuacgaucaccgaccuuggagugcagcucgucacaggccugagccugucucuccagcugagccccggguccaacagagcuaucuuugccaccgccguggcucaagagcuucugcagcgccccaagcaggaagccgcuauuagcuguuggguucaguucucugauggcuccgugacaccucucgacaucuacgauggaaaagacuuuagccugauggccaccucccuggacgagaaggucgugucuauucaucaagauccgaaauucaaguggcccaucauugcggccgagacggaaggccaggggacccuuguuaagguggagauggucaucagcgaauccugccagaaaucuaagagaaaaagcgugcucgcugugggaacagccaauaucaaggucaaauuuggccaaaacgacgcuaauccuaacaccuccgauucucggcacacaggggccggaguucauauggagaauaacgugagcgaccgcagacccaagaagccuucccaggaauggggcagccaggaggggcaguacuauggaucuuccagcaugggacugauggagggccgggggaccacgacagaucgcucuauucugcagaaaaagaaaggacaggaaucccuccuggacgauaauagccaccuucagaccauccccucugaccugacauccuucccugcccagguggaucuccccagaagcaacggcgagauggacgggaaugaucugaugcaagcguccaagggacugagcgaccuugaaauuggcauguacgcucuccugggggucuuuugucuggccauccucguguuccugauuaacugcguuaccuuugcucuuaaauaucggcauaaacaggugccguucgaggagcaggaaggcaugucucacagccacgauugggucggacuguccaaucgcaccgagcuccuggaaaaccauaucaauuucgccucuagccaggacgagcaaaucacagccauugacagaggcauggauuuugaagaguccaaguaccugcuuucuacgaacagccagaaguccaucaacgggcagcuguucaagccucucggacccauuaucauugacggcaaagaucaaaagucugagccucccaccagcccgacauccaaacggaagcgcgugaaauuuaccacauucaccgcuguuagcucugacgaugaauauccuacgagaaauuccaucgugaugagcucugaggacgauaucaagugggucugccaggaccuggaucccggggacuguaaggaacuccacaacuacauggagcggcugcaugaaaauguguga

SEQ ID NO: 76955 - RNA, 3225 nt, Artificial Sequence
  derived and/or modified sequence opt5 from TMEM132E__Homo_sapiens__NP_001291367
auggcccccggcaugagcgggagaggaggcgcugcccugcucugccuguccgcgcuucuggcucacgccucugggcggagccauccugccuccccgucucccccuggaccccaggcuagcccugugcuccccgucuccuaccgccugucucacaccagacuugccuucuuucugcgggaggcucgcccuccgagccccgccguugcgaacuccagccuccaaagaucugaaccuuucgugguguuucagacaaaggagcugcccguccugaaugugucccucggcccuuucagcacgucucagguuguggcccgggaacugcuucagcccuccagcacccuggacaucccggagcgccucacagucaacuggaaagugagagcuuuuauuguucggucucaugugccugccucccaacccgucguccaggugcuguucuauguggcugggcgcgauugggacgauuuuggaguuaccgaaagacuuccuugugugcggcugcacgccuuccgcgacgcgagagaggucaagagcuccugccggcucucuggcggccuggccacaugucuggugcgcgcugagcucccccuggccugguuugggcccccugcuccggccgcgcccccuaccgcuagacggaaaagccccgauggacuugaaccugaggcgacaggcgaaucccagcaggccgagcuguacuauacccuccaugcucccgacgccagcgggggaugcggcgggucuagacgcggagccggcccgggcgugggggcucgggccgaguccccuacgcaacacccccugcuuagaaucggaagcauuucucuguuccgcccucccccucggagaacccuccaggaacaccgccuggauagcaaucugaugauccggcuccccgacagaccgcugaagccuggcgagguucuuuccauucugcucuaccuggcgcccaacucuagcucccccagcucuccuuccguggaacauuuuacacuucgcgucaaagcuaagaagggggugacccugcucggaacaaaaagccggucuggccaguggcacguuaccuccgagcugcugacgggggccaagcauagcacagccaccguggaugucgcuugggcccaguccacaccgcugcccccuagagaaggacaaggcccccuggagauccuucagcuggacuucgagauggaaaauuuuaccucucagagcgugaaacgccggaucauguggcacauugauuauagaggccacggggcucucccugaccuggagcgggccgucaccgaacugacagugauccaacgcgauguucaggcgauucuuccccucgccauggacacggagaucauuaacaccgcuauccugacaggaagaaccguggccauuccugucaaggugaucgcuaucgaaguuaauggccuggugcucgacauuuccgcccuggucgagugugagucugauaacgaagacaucauuaaagugagcuccagcugcgauuacguguucguuucugggaaggagucccggggaagcaugaaugcgagagucacauuccgcuaugacgugcuuaacgcuccccuggaaaugaccgugugggucccgaagcucccucugcauaucgagcugucugaugcccggcuuucccaggugaaaggcuggagaguucccauucucccugaccgcagaagcgugcgggaaucugaggaugaggacgaagaggaagaggagcgcagacagagcgccucccggggguguacgcugcaauaccagcacgcuacacugcaggucuuuacccaguuccauaccacaagcucugaaggcaccgaucaagugguuacaaugcucggacccgacuggcugguggaggucacggaucuuguguccgacuuuaugcgcguuggcgacccgagaguggcccacauggucgauagcuccacccuggccgggcucgaaccuggaacaacccccuucaagguggugucuccucugacagaggcuguccugggcgaaacccuucucacgguuaccgaggagaaagugagcaucacacagcugcaggcccagguggucgccucccuggcucucucucugcggcccagccccggguccucucauaccauccuugccacaaccgccgcucaacagacgcugagcuuucucaagcaggaagcccugcugucccuuuggcucagcuacucugacggaacaaccgcgccucugucccuguauagcccgcgcgauuacggccuccuggugucuucccuugacgagcacguugcuacagugacccaggauagagccuucccccuggucguggccgaagcugaggggagcggcgaacuccugcgggccgagcugaccauugcggagucuugccagaaaacaaagcgcaaauccguucuugcuacgaccccugugggacugagaguccacuuuggccgggacgaagaggaucccacauaugacuacccugggcccagccaaccuggaccgggcgggggagaagaugaggccagaggcgccgggcccccuggcuccgcucuccccgccccugaagcucccggaccgggcaccgccagcccugugguuccucccacagaggacuuccugccccuccccaccggguuucuccaggugccucgcggacuuacggaucuggagaucggcauguaugcgcuccugggggucuucugucuggccauucuuguguuucugaucaauugcauuguguucguccuccgguacagacauaagcgcaucccgcccgaaggacaaacaucuauggaccacagccaucacuggguuuuucugggcaacgggcagccucuccgggugcagggcgagcugucucccccugcuggaaauccccuugaaaccgugccggccuucugucacggcgaucaucacuccagcggguccucucagaccagcguccaaucccaggugcauggaagaggcgacgggucuagcggaggcuccgcucgcgaccaggccgaggauccugccagcucucccacauccaagcggaaaagaguuaaguucaccacauuuacgacccugccuagcgaggaacucgcuuaugacucugugcccgcgggcgaggaagaugaggaagaggaggaagaccugggguggggaugcccugaugucgccggccccacacgcccgaccgcuccucccgaccugcacaacuacaugcggagaaucaaagagauugccuga

SEQ ID NO: 76956 - RNA, 543 nt, Artificial Sequence
  derived and/or modified sequence opt5 from TMEM134__Homo_sapiens__NP_001072118
augagcgccgcuagaccccaguucuccaucgacgaugccuuugagcugucucucgaagacggcgggccuggaccggagagcuccggcguggcgcgguucgggccccugcacuuugaacgcagagcucgguucgaggucgccgaugaagacaagcaaucucgccuuagauaccagaaccuggagaaugaugaggacggagcccaggcuagcccugaacccgauggcgggguuggaacccgggacuccucucgcacaagcauuagauccagccaguggucuuuuuccacgaucucuagcuccacccaacggagcuauaacacaugcuguucuuggacccagcauccucucauucagaaaaaucgcagaguggugcuggccuccuuccuucugcuccugcugggccucggcgucagcuccgcuaucuuuuucgugcccggguuucugcuucugguuccuggaguguaccacgucauuuucaucuauugcgccgugaagggccaucggggguuucaguucuuuuaccucccguauuucgagaaauga

SEQ ID NO: 76957 - RNA, 1311 nt, Artificial Sequence
  derived and/or modified sequence opt5 from TMEM135__Homo_sapiens__NP_001162195
auggccgcucugagcaaguccaucccccacaacugcuacgagauuggccauaccuggcacccuucuuguagagugagcuuccuccagaucacagggggagcccuggaagagucccuuaaaauuuaugcgccgcuguaccucaucgcugccauucugcggaagcgcaaacuugacuauuaccugcauaagcuccugcccgaaauccugcaaucugccagcuuucucacggcuaauggcgcccuguauauggcuuucuuuugcauccuuagaaaaauucuggggaaguucuacuccuggaccccuggauuuggcgccgcgcuccccgccucuuaugucgcuauccugauugagagaaagagccgcagagggcuucugacaaucuacauggccaaccucguucugcuguucuguauuaccgcugccauguacauguuuuucuuucggugcaaagauggacucaagggcuucacauuuuccgcgcugcgcuucaucgugggcaaagaagagauuccuacccacagcuuuucucccgaggccgcuuaugccaagguggaacagaaaagagagcagcaugaagagaagccugggcggaugaauaugaucggacuuguccgcaaguucguggacuccaucuguaaacacggcccgagacaccggugcuguaagcauuacgaggauaacugcauuagcuauuguaucaaaggguucauucgcauguuuucuguuggauaccugauccagugcugucuccggauucccuccgcuuuccggcaccuguuuacacaaccuagccgccuucugucucucuucuauaauaaggaaaacuuucagcugggcgccuuccugggguccuuugugagcaucuacaaaggaaccuccugcuuccucagauggauccggaaucuggacgaugagcuucaugccauuaucgcuggcuuucuggcgggcauuucuaugauguucuauaagagcacgaccaucuccauguaccucgccagcaaacuggucgaaacaauguacuuuaaggggauugaggcuggaaaggugcccuauuucccucacgccgacaccaucaucuacucuauuuccacagccaucugcuuucaggcugccguuauggaagugcagacccuuagacccagcuauuggaaauuccugcuccgccugacgaagggcaaauucgcggucaugaaccggaaggugcuggauguguuugggacaggagcuucuaaacacuuccaagacuuuauuccgagacucgauccucgcuacaccacagucacccccgagcugccuaccgaguucagcuga

SEQ ID NO: 76958 - RNA, 489 nt, Artificial Sequence
  derived and/or modified sequence opt5 from TMEM138__Homo_sapiens__NP_057548
augcugcagaccagcaacuacucccucgugcugucucuucaauuccugcuccugagcuaugaccuuuuugucaauuccuucucugagcugcuccagaagacacccguuauccagcuggugcuguuuauuauccaggauauugccgugcuguucaacaucauuaucaucuuucugauguucuuuaauacguucgucuuucaagcuggccuugugaaccuccucuuccacaaauuuaaggggaccauuauccugacagccguuuacuucgcgcuuagcauuucccugcaugugugggucaugaaucucagauggaaaaacucuaauagcuuuaucuggaccgacggacugcagaugcuguucguguuccagcggcucgcugccguucuguauugcuacuuuuauaagcgcacagccgugagacuuggcgauccucacuucuaccaggacucccuguggcuccggaaagaauuuaugcaaguccgcagauga

SEQ ID NO: 76959 - RNA, 702 nt, Artificial Sequence
  derived and/or modified sequence opt5 from TMEM150B__Homo_sapiens__XP_011525158
auguggggcuaccugagccucaugcccguguuccuggccgucugggcuaucuccgggguuuggauuguguuugccaucgcggugaccaacagaacagucgaccuuucuaagggauucccuuauauuagcaucugcggcuccuuuccgccccagucuuguauuuucagccaagugcugaauaugggggcugcccucgccgcuuggaucugcaucguucgguaccaccagcugcgcgauuggggagugagacgguggccuaaccagcuuauucuguggacgggccuccugugugcccuggggaccuccgucgugggaaauuuucaggagaaaaaccaacgccccacacaucucgcuggcgccuuccuggcguuuauccuuggcaauguuuauuucuggcugcagcuccugcuuuggagacugaagcggcucccucagcccggggccgcuuggauuggaccucugcgccugggccucugcucuguguguaccauccugauugucgccaugaucgugcuucacgcuugcagccugagauccgugagcgccgcgugugaaugggucguugccaugcuccuguuugcucuuuucgggcugcucgccguggacuuuucugcucuggaguccugcacacugugugugcagccguggcccagccucucuccucccccugccucccccauuagccugccgguccaacuuuga

SEQ ID NO: 76960 - RNA, 1407 nt, Artificial Sequence
  derived and/or modified sequence opt5 from TMEM151A__Homo_sapiens__NP_694998
augcccgaggacggcgccggggauggaggcgaagugccugcucugaucccggacggggagccccucagagaggaacagcggccucugaagcaaagccuuggauccucucugugccgcgaaagccacuggaaaugucuccugcuuacccugcucauucaugccugcggcgcggucguugcuugguguagacuggccacagugccccggcuggugcucgggccugaggccgcucuggcccgcggagcuggcgggcccccuccgacguaccccgccuccccuugcucugauggcuaucuuuacaucccccuggcguucgucagccuccuguaucuucuguaccucgccgaguguuggcacugccaugugagauccugucaggcuccucggaccgacgcccacacaguucuggcucugauucgcagacuccagcaggcgcccccgugcgugugguggaaggccaccucuuaucauuacguccggcgcacaagacaaaucacccgguaucgcaacggagaugccuacacaaccacccagguguaccacgaaagagcugacagccggacggcccgcggcgaguuugauuauuccgcucacgggguuagagacgugagcaaagaacuggucggacuugccgagcaugccgcuacacggcugagauucaccaaguguuuuucuuucggcuccgcggaggccgaagcuagcuaccucacacagcgcgcccgguuuuucucugccaaugaggggcuggaugacuaucuugaagcuagagagggaaugcaccugaaagauguggacuuucgcgaaucccucaugguguucgccgauccucggagcccucccugguacgcgagagcuugggucuuuuggcugguuucugccgccacccuguccuggccccuccgcgugguggcugccuauggcacggcucauguccacuaccagguggagaagcuguucggcgccagcucucccccuccgggggcgguucccuccggaccuccccuuagccggguggccacagucgacuuuaccgagcuggaauggcacauuugcuccaacagacaacucgugccuagcuauucugaggcuguugugaugggcgccggguccggagcuuaccugcgcggcugucagcggugcagacgcagcgucucuagcaauucccuucccccggcccggccuucugggcccagacugccuuucagccggucccgccucagccugggagcgggcggcagagccacacccgggguguuucggucucuguccggaggcccucucgggagacgcggagaagacaccgagccccuggaaagcccgccuugcuacgaggaugcucuuuauuuccccguccugaucgugcauggcgacucugggugucagggcgauggacagggcgcccucuga

SEQ ID NO: 76961 - RNA, 1701 nt, Artificial Sequence
  derived and/or modified sequence opt5 from TMEM151B__Homo_sapiens__NP_001131032
augagcccucccggcuccgccgcuggggagucugccgcgggaggcgggggaggcgggggaggcccgggcgugagcgaagaacugaccgcugccgccgcugccgcugccgcggacgaagggcccgccagagaggaacagcggccuauccaacccuccuucacaaagucucucugccgcgagagccacuggaaaugucugcuucugucccuccugauguacggaugccuuggcgcugucgccuggugucauguuacgaccgugacaagacugaccuuuucuagcgcuuaucaggggaacucccucauguaccacgauagcccuugcucuaauggauauguguacauuccccuggccuuccugcucaugcuguaugcggucuaccuuguggaguguuggcauugccaggcccggcacgaacugcagcaucgcguugacguguccagcgucagagagcgggugggccgcaugcaacaggcuacaccuuguaucugguggaaggccauuucuuaucacuacguuagacggacccgccaggugacaagauaccggaacggggaugcuuauaccacgacccaggucuaccacgaacgcgugaauacacauguggccgaggccgaguuugacuaugcuagaugcggaguccgggauguuuccaaaacccucgugggccuggaaggcgcgccggccacacgccuuagauucaccaaguguuuuagcuucgcuucuguggaggccgaaaacgccuaccugugccaacgggcuagauuuuucgccgagaaugaagggcucgacgauuauauggaggcgcgcgagggaaugcaccugaaaaacgucgacuuucgggaguucaugguggcuuuucccgauccugccagacccccuugguacgccuguuccagcgcuuucugggccgcugcccugcucacgcuguccuggccccuucgcguucuggcggaguaucggacagccuacgcucauuaccacguggaaaagcucuuuggccuggaggggccgggaucugccagcuccgcuggcgggggacuuagcccuucugacgaacugcugcccccucucacccacagacugccccgcgucaauacaguggauuccaccgagcucgaguggcauauccggagcaaccagcagcugguucccucuuauagcgaagccgugcuuauggaccuggcgggccucggcaccagaugcgggggagccggcgggggauacgcuccuuccugccgcuauggcggggucggcggaccgggcgccgcugggguggcccccuaccggagaucuugugagcacugccagcgcgccgucagcuccagcucuauuuucucccggagcgcucugucuaucugugcguccccuagagccggacccggcccugggggaggcgcugggugcggcggaagccgguucucccuuggccgccuguaugggucuagacggagcugucucuggagaucccgcucuggaagcgugaaugaagccuccugccccacagagcaaacgcggcugagcucucaggccuccaugggcgaugacgaagacgaugacgaggaggaagcugggccgccucccccuuaccaugaugcccuguauuuucccguucucaucgugcacagacaggagggaugucugggccauagccaccgcccucuucacagacaugggucuugcgucgaaaccucccuguga

SEQ ID NO: 76962 - RNA, 552 nt, Artificial Sequence
  derived and/or modified sequence opt5 from TMEM154__Homo_sapiens__NP_689893
augcaggcccccagagcugcccugguguucgcgcucgucaucgcucugguuccugugggccgggggaacuacgaggaacuugagaauagcggagacaccacaguggaauccgagcgcccgaacaaggucacgauucccucuaccuuugccgccgugacaaucaaagaaacccugaaugcuaacauuaauagcacaaacuucgccccugaugagaaucaacucgaguuuauccugaugguucuuauuccccugauccuccuggugcugcuccugcuuuccgucguguuccuggcuaccuauuacaagagaaaacggacaaagcaggaaccuucuagccagggcucccagucugcccuccaaaccuaugagcuggggagcgaaaacguuaaagugcccaucuuugaggaggacacgccuuccgucauggaaauugagauggaggaacuugauaaguggaugaauagcaugaaccgcaaugcggacuucgaaugccugccgacccucaaggaggagaaagaaucuaaccacaaucccuccgauagcgagucuuga

SEQ ID NO: 76963 - RNA, 903 nt, Artificial Sequence
  derived and/or modified sequence opt5 from TMEM158__Homo_sapiens__NP_056259
augcugccccuccuggccgcccuucuggcugcggcuugcccucucccgcccgugagaggcggggccgccgacgcuccuggacugcuuggcguccccagcaacgccuccguuaaugcuucuagcgccgaugagccuaucgcgccccggcugcucgccuccgcugccccugggccgcccgaacgcccuggacccgaggaagcugccgcggccgcugccccuuguaacauuucugugcagagacaaaugcugagcucccugcucgugcgguggggccgccccagaggguuccagugcgaccugcuucuguuuucuaccaaugcucacggacgggccuucuuugccgcugcguuccaucgcgucggcccgccucuccugaucgagcaccuuggccuggccgcugggggagcccagcaggaucucagacugugugugggcugcggguggguucggggacgcagaacaggccggcugcgccccgccgcugccccuagcgcggcugccgccacggcuggggcccccaccgcucuccccgccuacccugcggccgaaccgcccggaccucuguggcuucaaggcgagccccugcauuuuuguugccucgacuucucccuggaggaacuucagggcgagccuggguggagacugaaccggaagcccauugaaagcacacucguggcuuguuuuaugacccuggucaucgugguuuggucuguggccgcucugauuuggccggucccuaucaucgccggauuccuccccaauggcauggagcagcgcagaacaaccgcguccacaaccgccgcuacgccugccgcugugcccgccgggaccacagccgcugcggccgcugccgccgcugccgcggcugccgccgcugugaccagcggagucgccacaaaauga

SEQ ID NO: 76964 - RNA, 567 nt, Artificial Sequence
  derived and/or modified sequence opt5 from TMEM160__Homo_sapiens__NP_060324
augggcgggggaugguggugggccagagcugcccggcuggcgcgccucagauuccggcgcagccugcuucccccucagagaccgcgguccggcggggcucgcggaucuuuugcccccggccacgggccuagagccggagcuucucccccucccguguccgagcuggaccgggccgaugcuuggcuccugcgcaaggcccaugaaaccgcguuccuuagcugguuuagaaacggccugcucgccagcggcaucggggucauuuccuucaugcaaucugacaugggacgggaggcugccuacggcuuuuuccugcucgggggacugugcguuguguggggcagcgcuuccuaugccguggggcuggcggcccuucgcggaccuaugcagcugacacucggcggcgcugccgucggggcuggagccgugcuggccgcuagccuucugugggcgugugccguuggccucuacauggggcagcuggaacuggauguggagcucgucccggaagacgauggaacggcuucugccgagggccccgacgaggccgggagaccucccccugaauga

SEQ ID NO: 76965 - RNA, 1464 nt, Artificial Sequence
  derived and/or modified sequence opt5 from TMEM161B__Homo_sapiens__NP_699185
augggcgugaucgggauucagcuggucguuaccauggugauggccagcgugaugcaaaagaucauuccccacuacucccucgcuagauggcugcuuugcaacggaucucugcggugguaucagcauccuacagaggaggaacuccgcauccuggccggcaaacagcagaaggggaaaacgaagaaagacagaaaguacaauggacacauugaaagcaagccgcuuaccauccccaaagauaucgaccugcaucucgagacaaaguccgucaccgaaguggauacacuggcgcugcacuauuucccugaguaccaauggcucguugacuuuaccguggcugccacagucguguaucugguuaccgagguguacuauaacuucaugaaacccacgcaggaaaugaauauuucucuugucuggugucugcucgugcugagcuuugccaucaaggugcuuuucucccugaccacacauuacuuuaaagucgaggauggcggggaacggucuguuugcgugaccuucggauuuuucuuuuucgugaaggcuauggccguccucauugugacagagaacuaccuggaguuuggccuggaaaccggcuucacgaauuuuagcgacuccgcuaugcaguuccucgagaagcaggggcuggaaagccaaucuccuguuuccaaacuuacauucaaguuuuuccuggccaucuuuuguagcuucauuggagcguuucucaccuuccccggccugcgccuugcccagaugcaccuggaugcucucaaccuggccacagagaaaaucacccagacccugcuccacauuaauuuucuggcuccucuuuucauggugcugcucugggucaagccgaucacaaaagacuauaucaugaaucccccucuggggaaggaaucuauuccccuuaugacggaggccaccuuugauacacugagacucuggcugaucauucugcucugcgcgcugcggcuugccaugaugcgcucccaucugcaggcuuaccucaaccuggcccaaaaauguguggaccagaugaagaaggaggcuggaagaaucagcaccguugaacugcagaaaaugguggcccgggucuucuauuaccuuugcgugauugcccuccaauaugucgcuccucuggugaugcugcuccacacaacccugcuucugaagacgcucggcaaccauucuugggggaucuaccccgaguccaucagcacacugccgguugauaauucccugcuuucuaacagcguguauuccgaacucccuagcgcggagggaaaaaugaaggucaccgugacccagauuacaguugcccugucuucccugaaaaauaucuuuacaccccuccuguuccgcggccuucugagcuuucucaccugguggauugcugccugucuguucucuacgagccuguucggccucuuuuaccaccaguaccuuaccguggccuga

SEQ ID NO: 76966 - RNA, 870 nt, Artificial Sequence
  derived and/or modified sequence opt5 from TMEM163__Homo_sapiens__NP_112185
auggagcccgccgcuggcauccagagacggagcucccaagggccuaccgugccgcccccuccccgcggacacgccccucccgcggcugccccuggcccggcuccccugucuagcccugucagagaacccccucagcucgaggaggaacggcagguucgcauuuccgaaucugggcaguucagcgacggacuggaggauagaggccuucuggaguccucuacacggcucaagccccaugaagcccaaaacuaccgcaaaaaggcccugugggugagcugguuuuccaucauugugacgcuugcucuggccgucgcggccuucaccgugagcguuaugagauauucugcuuccgccuuuggguucgcuuuugacgccauccucgaugugcugagcucugcgauuguccuguggcgguacuccaaugccgcugccgugcacagcgcucaucgcgaguauaucgccugcguuauccucggagugauuuuccugcuuucuuccaucuguauugucgugaaagccauccacgaccugagcacaagacuccugccggaaguggaugacuuucuuuucuccgucucuauucugagcggcauccucugcuccauucuggcuguucugaaguuuaugcucggcaaagugcugaccagccgggcgcuuaucacagauggguucaacucucuggugggaggcgucaugggguuuuccauccuccugagcgccgagguguucaagcaugacucugcuguuugguaccuugauggaagcauuggcgugcugaucgggcucaccauuuuugccuauggagucaagcugcugaucgacauggugccucgcguuagacagacacggcacuacgagauguucgaauga

SEQ ID NO: 76967 - RNA, 975 nt, Artificial Sequence
  derived and/or modified sequence opt5 from TMEM165__Homo_sapiens__NP_060945
auggccgcugccgcgcccggcaacgggagagcuagcgccccucggcugcuccugcuuuuccuggugccgcuccugugggcccccgcugccguccgcgcuggaccugacgaggaucuuucccacagaaauaaggaacccccugcccccgcgcagcaacugcagccucagccgguugccgugcagggccccgagccugcucggguggagaaaaucuuuacccccgccgcuccuguccauacaaacaaggaggaccccgccacgcaaaccaaucucggguucauucacgcguuuguggccgcuaucucuguuauuaucgugagcgaacugggagauaaaacauucuuuauugccgcuaucauggccaugcgcuacaacagacugaccguccucgccggcgcuaugcuggcgcuugggcugaugacaugccucuccgugcuguucggauaugccaccacaguuaucccgcggguguacaccuauuacgucucuacggugcuuuuugcuauuuucggcauccgcaugcugagagagggccucaagaugagcccugacgaggggcaggaagaacuggaagaggugcaggccgagcugaaaaagaaggaugaagaguuucagcggaccaaacuccugaauggacccggcgacgucgaaacagggaccuccauuacaguuccucaaaagaaauggcuucauuucaucucucccauuuuugugcaggcccugacccucacguuccuggcugaguggggagaucgcagccagcuuacaaccaucgugcuggccgcgagagaagaccccuauggcgucgcuguugggggaacagugggccacugucucugcaccggccuggccgugauugggggacggaugaucgcccagaagaucuccguccgcaccgugacaauuaucggcgggauuguuuuucuggcuuucgccuucagcgcucucuuuaucucuccugauuccggauucuga

SEQ ID NO: 76968 - RNA, 894 nt, Artificial Sequence
  derived and/or modified sequence opt5 from TMEM169__Homo_sapiens__NP_001135784
auggaggaacccaccgccguggagggccagguccaacugccuagcccgcaccaggggucccucagaaaggcuguugccgcggcucuggcccuugacggagaaucuacaaugggccaucggaaaaagaaacgcaaggagagcagacccgaauccaucauuaucuaccggucugauaacgagaaaacggacgaggaaccuggggagagcgaaggaggcgaucagcccaaggaggaggaaggggacgauuuccuggacuauccuguggaugacgauauguggaaucucccccuggacucccgcuacgugacccuuacaggaaccauuacaagaggcaagaaaaagggccagauggucgauauccacgugacccugacagagaaagaacuccaagagcugaccaagccuaaagaaucuagccgggagacgaccccggaggggcgcauggccugccagaugggagcugacagaggcccccauguugugcuguggacacucauuugucugccugucguguuuauccuuuccuucguugugagcuuuuauuacgggaccaucacaugguauaacauuuuccuggucuacaaugaggaacggaccuuuuggcacaagaucucuuauugccccugucucgugcuguucuacccugugcuuauuauggccauggcuuccagccugggacucuacgccgcggucguucagcugucuugguccugggaagccugguggcaggcugcccgcgauauggagaagggcuuuugcggguggcuguguagcaaacucggacuggaagacugcucucccuauuccaucguggagcuucuggagagcgacaacauuuccucuacgcucagcaauaaggauccgauccaagaaguggagacauccaccgucuga

SEQ ID NO: 76969 - RNA, 435 nt, Artificial Sequence
  derived and/or modified sequence opt5 from TMEM170A__Homo_sapiens__NP_660297
auggagagagaaggcagcgggggauccggcgggucugccggacugcuccagcaaauccugagccuuaagguggucccccggguuggcaacgggacccugugcccuaauuccacaucucucuguagcuucccggagaugugguacggaguguuucugugggcucuuguguccucucuguucuuucacguccccgccggccuccuggcgcuguucacgcuccgccaucacaaauauggcagauuuaugagcguguccauucugcuuauggggaucguuggaccuauuaccgcuggcauccugacaagcgccgccauugcugggguguaccgggccgcuggaaaggaaaugauccccuucgaggcccucacccugggcacagggcagaccuuuugcguccuugugguuucuuuccugcgcauccucgcgacacuguga

SEQ ID NO: 76970 - RNA, 972 nt, Artificial Sequence
  derived and/or modified sequence opt5 from TMEM171__Homo_sapiens__NP_001154814
augagccccgccgcugccgcggagccugacggcgaucagcaagacagacacguguccaagcugaucuucugcuuuuucgucuuuggggcuguucuccugugugugggagugcuucugucuauuuucggcuuucaggccugccaguacaaaccgcuccccgauuguccuaugguccugaagguggccgggcccgcuugcgccguugugggacuuggcgcugucauccuggcccggagccgcgcgcagcuccaacugagagccgggcugcagcggggacagcagauggacccugaucgcgcuuucauuuguggcgaauccagacaauuugcccagugccucaucuucggcuuucuguuccuuaccucugggaugcugauuagcgugcucggaaucuggguucccggcuguggguccaacugggcucaggagccucugaaugaaacagacacgggagauucugagccgcggaugugcggcuuucuuagccugcagaucauggggccccucauugugcuggucggacuguguuucuuugugguggcccaugucaaaaagcgcaacacccucaaugcgggccaagacgccuccgaaagagaggagggccagauccagauuauggaaccuguucaagugacagugggggauagcgucaucauuuuucccccucccccgccucccuauuucccugagucuuccgcuagcgccguggcugaaucucccggaaccaacucccugcuucccaaugagaacccuccgagcuacuauucuaucuucaauuacggcacacccaccuccgagggggccgccagcgaacgggacugcgaguccauuuauacaaucucuggaaccaacagcuccagcgaagcuagccacacgccucaucugcccuccgagcucccuccccgcuacgaagagaaagagaaugcggccgcuaccuuccugccgcuuagcucugaaccuucucccccuuga

SEQ ID NO: 76971 - RNA, 1140 nt, Artificial Sequence
  derived and/or modified sequence opt5 from TMEM173__Homo_sapiens__NP_938023
augccccacagcucccugcauccuucuaucccgugccccagaggccacggggcccagaaggcugcccucgugcugcuuagcgcgugucuggucacccucuggggacugggcgagccucccgaacauacacuucgguaccugguucuccaccuggcuucccugcaacucgggcugcuucugaacggagugugcucucucgccgaggaacugcgccauauucacagcagauaucggggcuccuacuggcgcacggugagagccugucuugggugcccucugcggcgcggagcucuccugcugcucucuaucuauuucuacuauagccugcccaaugccgucggcccuccguuuaccuggaugcuugcucugcucggccugucccaggcccuuaacauucugcucgggcugaaaggacuggcgcccgccgagaucagcgcugugugugaaaagggcaauuucaacguugcccacgggcucgcuuggucuuacuauauuggauaccugagacuuauccugccugagcuccaggcccggauccgcacauacaaucagcauuauaacaaucugcuuagaggcgcggugucccaacggcuguacauucuccugccccuggacugcggggucccugauaaccucagcauggccgaccccaauauccgcuuucuggauaaacuuccgcagcagaccggagaccacgcuggcauuaaggauagaguguauucuaacuccaucuacgagcugcucgaaaauggccagcgggccgggacauguguucuggaguaugcuaccccucugcaaacacuuuucgccaugagccaguacucucaggccggauuuucccgcgaagacagacucgagcaggcuaaacuguucugccggacccuggaggauauucucgcggacgcccccgaaagccaaaacaauuguagacugaucgcuuaucaggagccugccgaugacuccucuuuuagccuuucccaggaagugcugcgccaucuccggcaagaggaaaaggaggaggucacggugggcagccugaagaccucugccgugcccuccacaagcaccaugucucaggaacccgagcugcuuauuagcgggauggaaaaaccucucccgcugagaacagauuucuccuga

SEQ ID NO: 76972 - RNA, 1269 nt, Artificial Sequence
  derived and/or modified sequence opt5 from TMEM175__Homo_sapiens__NP_001284354
augaccuuccugaucgugacagucgccugggcugcccacacgagacucuuucagguugugggcaagaccgacgauacacuggcgcuucugaaccucgcuugcaugaugaccauuacauuccugcccuacaccuuuagccuuauggugacauucccugacgucccgcuggggaucuuucucuucugugugugcguuauugccaucggagugguccaagcccugauugugggcuaugcuuuucacuucccccaucugcucuccccucagauccagcggucugcccaccgcgcucuguacagacggcacguucuugggaucgugcugcagggacccgcccucuguuuugcggccgcuauuuucagccuguuuuucgucccucuuuccuaucugcucauggugaccgugauccugcugcccuacgucucuaaaguuacgggcuggugccgcgauagacuccuggggcaucgggagccuagcgcccacccgguggaaguguuuuccuucgaccuucacgagccccugucuaaggaacgcgucgaggcuuucagcgauggaguguaugccauuguugcgacccuccugauccuugacauuugugaagauaaugugccugaccccaaagaugucaaggagagauuuuccggcagccugguggccgcucucucugccacaggcccucgguuccuggcuuacuuuggguccuucgccaccguuggacugcucugguuugcccaucacagccuguuccuucaugugcgcaaagcuacaagagcgaugggccugcucaacacccugucucuugccuuugucgggggacugccccucgcuuaucaacagacguccgccuucgcccggcagccgcgcgacgagcuggaaagagugcgggucagcugcacaaucauuuuucuggcuucuaucuuccagcucgccauguggaccacagcgcugcuucaccaagcugagacccugcagccuuccgugugguuuggcgggcgcgaacacguucucauguucgccaagcuggcccuguaccccugugcuagccuucucgccuuugcuucuaccugccugcuguccagauucagcgugggaaucuuccaucucaugcagauugccgucccuugugcguuucugcuucugcggcuccuggugggccuggcccuugcuacacucagaguucugcgcggccuggcccggcccgagcaucccccuccggcucccacggggcaggaugacccucaaucccagcuccugcccgccccuugcuga

SEQ ID NO: 76973 - RNA, 702 nt, Artificial Sequence
  derived and/or modified sequence opt5 from TMEM176B__Homo_sapiens__NP_001094784
augacccagaacacagugaucgucaauggcguugccauggcuagcagacccucccaaccuacgcacgugaacgugcauauucaccaggagucugcccugacccagcuccugaaggcugggggaagccuuaaaaaguuccuguuucauccgggcgacacaguccccuccaccgcgcggaucggguacgaacagcucgcccugggagugauugccgcuggcgccggggcuaucguucacgagaaacauccuggaaaacuugccggcuauauuucuagccugcucacacuggcgggcuucgccaccgcuauggccgcugugguccugugcguuaauuccuuuaucuggcaaacagaacccuuccucuacaucgauaccgugugugaccgcucugauccuguguuucccacgaccggguauagauggaugcggcgcagccaggagaaccaguggcagaaggaagagugcagagccuacaugcaaaugcugcggaaacuuuucacagcgauucgcgcccuguuucucgcugucugugugcugaaggugaucgucucccuuguuagccugggagugggccucagaaaucugugcgggcagucuucccagccucugaacgaggaaggaagcgagaagcggcuccugggcgaaaauucugugccgcccuccccuagccgcgagcagaccucuacagccauuguccuuuga

SEQ ID NO: 76974 - RNA, 894 nt, Artificial Sequence
  derived and/or modified sequence opt5 from TMEM178A__Homo_sapiens__NP_689603
auggagcccagagcccuggugaccgcucucagccugggccuuucccugugcucucucgggcugcuugucacagccaucuucacggaccacugguacgaaaccgauccucggcgccauaaggagagcugugaaagaucccgggcgggagcugacccgcccgaucagaaaaaccgccugaugccucucucucaucugccccugagagacagcccuccccucggccggcgccugcuuccugggggaccgggcagagccgaucccgaguccuggcggucucugcucgggcugggaggccuugacgccgaaugcggccgcccucuguuugcuacauauagcgggcucuggagaaaguguuacuuccugggaauugaucgggacaucgauacccugauucucaaaggcaucgcccaacgcugcacagcuauuaaguaucacuuuucccagcccaucagacugcggaauaucccuuucaaccuuaccaaaacaauucagcaggacgaguggcaccuccuccaucugcgcagaaucaccgccggguuucuuggaauggcgguugccgugcugcucuguggcugcauuguggcuacggucagcuucuuuugggaggaaucucugacccaacacguggccgggcugcuguuccugaugacaggaaucuuuuguaccauuucccuuugcacauacgcugccagcaucucuuaugaucugaaucggcuccccaagcugauuuacucccuuccggcggacguugagcacggcuauagcuggucuaucuucugugccuggugcucccugggcuuuaucguggcugccgggggacucuguauugcuuacccuuucaucagcagaaccaagauugcccagcugaaauccggccgcgauucuacggucuga

SEQ ID NO: 76975 - RNA, 690 nt, Artificial Sequence
  derived and/or modified sequence opt5 from TMEM182__Homo_sapiens__NP_653233
augagacugaacaucgccauuuucuuuggcgcucucuucggggcccugggagugcuucuguuucucgucgcguucggcagcgacuacuggcugcuugcuaccgagguugggcggugcuccggagaaaagaauaucgagaacgugacauuucaccaugaaggcuucuuuuggcgcuguugguucaaugggauuguggaggaaaacgauucuaauaucuggaaauuuugguauacgaaccagcccccuagcaagaauugcacccacgccuaccuguccccguaucccuucaugagaggagagcauaacucuacaagcuacgacuccgccgucauuuaucggggcuuuugggcugugcucaugcugcugggcguuguggccgucgugaucgcuucuuuccucaucauuugugccgcgccuuuugccagccacuuccuguacaaagcugggggaggcuccuauaucgccgcugggauucuuuucagccugguugugaugcucuacgucaucugggugcaagccguggcggauauggagucuuaccgcaauaugaagaugaaagacugccuggauuuuacccccuccguccuuuauggauggagcuucuuucuggccccugcuggcauuuucuuuucucuccuggccgggcuccuguuccugguugugggaagacauauccagauucaccacuga

SEQ ID NO: 76976 - RNA, 1131 nt, Artificial Sequence
  derived and/or modified sequence opt5 from TMEM183A__Homo_sapiens__NP_612400
auggccagaggccccgggccucugggacggccgcgccccgacaccguggcuaugccuaagagaggcaaacggcucaaguuccgcgcccacgaugcgugcagcgggagagucacaguugcugacuacgccaacuccgaucccgccguggugcggucuggacgcgucaaaaaggcuguggccaaugcuguucagcaagaggugaaaagccuguguggccuugaagccucccaggucccugcggaggaagcccugucuggggcuggagagcccugcgacaucauugauagcuccgacgaaauggaugcccaggaggagucuauccaugaaagaacggugagccggaagaagaaauccaagcgccacaaagaggaacucgacggcgcuggcggggaggaguauccuauggauauuuggcugcuucuggccagcuacaucagaccggaagacauuguuaacuuuucucucaucuguaagaaugcguggaccgugacaugcaccgccgcuuucuggacacggcuguaucgcagacauuacacccuggaugccucccucccccugcggcuucgcccugagagcauggaaaaacugagaugucuccgggcuugcgucaucagaucucuguaucacauguacgagcccuuugccgcccgcauuuccaagaacccugcuauccccgaaagcacaccgucuacccuuaaaaauuccaagugucuccuguucuggugccggaagauugugggaaacagacaggagccuaugugggaguuuaauuucaaauuuaagaaacaaagcccccgccugaaguccaaauguacgggcgggcugcagccucccgugcaguaugaagacguccauaccaaccccgaucaggacugcugucuccugcaaguuacaacccuuaauuucaucuuuauuccuaucgugaugggaaugauuuucacacuguuuaccaucaacgugucuacggacaugcggcaccacagaguccgccucguguuccaggauagcccgguucauggcgggcggaagcugagauccgagcagggagugcaggucauccuugaccccgugcacagcguucgccuguuugauugguggcauccucaauaccccuucucucuccgggcguga

SEQ ID NO: 76977 - RNA, 1317 nt, Artificial Sequence
  derived and/or modified sequence opt5 from TMEM184C__Homo_sapiens__NP_060711
augcccugcaccuguacauggagaaacuggcggcaguggauccgcccucugguggccgucauuuaccucguuagcaucgugguggcugucccgcugugcgugugggagcuucaaaagcuggaaguuggcauucacacgaaagccugguucaucgcggggauuuuucuccugcuuaccauccccaucucccugugggugauucuccagcaucugguccacuauacacagccugagcugcagaagcccaucauuagaauccucuggauggugccuauuuacucucuggacagcuggaucgcucuuaaauaucccggaauugccaucuacguugauaccugucgggaaugcuaugaggccuacgugaucuauaauuucaugggcuuucugacaaacuaccucaccaaucgcuacccuaaccugguccuuauucuggaagcuaaggaccaacagaaacauuucccgccccucuguugcuguccucccugggccaugggggaggugcugcuguuuagaugcaagcucggagugcugcaguauacagucguucggccuuucaccacgaucguggcucuuauuugugagcugcucggcaucuacgaugaagggaauuuuuccuucucuaacgccuggaccuaucuggugauuaucaauaacaugagccagcuuuuugcgauguacugccugcuccuguucuauaagguccugaaagaggaacucucccccauccaaccggugggaaaguuucuguguguuaaacuuguggucuucgugucuuuuuggcaggccguugugauugcucugcucgucaaggugggcgucaucagcgagaaacacacaugggaguggcagaccguggaagccguugcuacaggccugcaggacuucauuaucugcauugagauguuccuugccgcgaucgcccaucacuacaccuuuuccuauaagccuuacgugcaagaagcugaggaagggagcugcuucgauucuuuucuggccaugugggacgucuccgauauccgcgacgauauuagcgaacaggugagacacguuggacggacggugcgcggccaucccagaaagaaacucuucccugaggaccaggaucaaaaugaacacacaucucugcuguccucuagcucccaggacgcuaucagcauugccuccucuaugccucccagccccauggggcauuaccagggauuuggccacaccgucacaccgcagaccacccccacaacggccaagaucuccgaugagauucucagcgacaccaucggggagaaaaaggagccuucugacaaauccguggauagcuga

SEQ ID NO: 76978 - RNA, 876 nt, Artificial Sequence
  derived and/or modified sequence opt5 from TMEM185A__Homo_sapiens__NP_001167563
augaaccugagaggccucuuccaggacuuuaauccccgggccgagggggaaaccugcguggaguucaaggcuaugcugaucgccgucggcauucaccuucugcuccugauguuugaaguucuugugugugaucgcaucgagagaggaagccauuucuggcugcucguguuuaugccucuguucuuugucuccccggugucuguugcggcuugcguguggggguuccggcacgaccgcagccuggaacucgagauucuguguuccgucaacauccuucaauuuauuuucaucgcccugagacucgauaagaucauucauuggcccuggcuggugguuugcgugccucuuuggauccugaugucuuuucucugucuggucgugcuguacuauauuguguggagcguccucuuccugcgguccauggacguuaucgccgagcagcgcagaacacacauuacgauggcucuuucuuggaugaccaucguggugccccugcucacauuugaaauucugcuuguccauaagcuggauggacacaaugccuucagcugcaucccuaucuucgugccccucuggcugucccugauuacccucauggcuacaaccuuuggccagaaagggggaaaccacuggugguucggcauccggaaggacuuuugucaguuccugcuugagauuuuuccuuuccugcgcgaauacggcaauaucagcuaugaucuccaucacgaggacaacgaggaaacagaggaaaccccgguucccgagccucccaaaauugccccuauguuuagaaagaaggcgcggguggucaucacgcaaucucccgggaaauacgugcugccgccucccaaacuuaauaucgaaaugccugauuga

SEQ ID NO: 76979 - RNA, 786 nt, Artificial Sequence
  derived and/or modified sequence opt5 from TMEM187__Homo_sapiens__XP_011529501
augaaccccgaguggggccaggccuucgugcacgucgcuguugccgggggacugugcgcgguggcuguguuuaccggcaucuucgacagcgucuccgugcaaguuggguacgaacauuaugccgaggccccuguggcuggacucccggccuuucuggcuaugcccuucaauucucuugucaacauggccuacacacugcucggccugagcuggcuucacagagggggagcgaugggccugggcccucgguaucucaaggauguguuugccgcuauggcccugcuguacgggcccguucaguggcuccgccuguggacgcaguggagacgggcugccgugcuugaccaguggcugacccucccuauuuucgcguggcccgucgccuggugucuguaucuugaucgcggauggagaccuuggcuguuucucucccuggaaugcgugucucuggcuagcuacggccucgcccugcuucauccgcaaggguucgagguggcucugggagcccacgucguugccgcugugggccaggcgcuccggacacaucgccacuauggguccaccacaucugccaccuaccuggcucuuggagugcugagcugucucggcuuugucgugcugaaacugugcgaccaccagcucgccagauggcggcuguuccagugucuuacaggccauuuuugguccaagguuugcgaugugcugcaauuccacuuugccuuccucuuccugacccauuuuaauacgcacccccgcuuccacccuagcgggggaaaaaccagauga

SEQ ID NO: 76980 - RNA, 804 nt, Artificial Sequence
  derived and/or modified sequence opt5 from TMEM189__Homo_sapiens__NP_001155977
auggccggcgcugaggacuggcccgggcagcaacuggaacucgaugaggacgaagccagcugcuguagauggggagcgcagcacgcuggcgcccgggagcuggccgcucuuuacuccccugggaagcgccugcaggaauggugcucugugauccucuguuucagccugauugcccauaaccuuguccaucugcuccugcuggcuagaugggaggauaccccgcucguuauccugggagugguggccggcgcgcuuauugccgacuuucuguccgggcucguccacuggggagcugauacauggggcucuguggagcugcccaucgccuucauucggccuuuucgcgaacaccauaucgaccccacggcuaucaccagacacgauuucauugagacaaauggcgacaacugccuuguuacccugcucccucugcugaauauggccuauaaauuucggacacacagccccgaagcgcucgagcagcuguacccuugggaguguuucguguuuugccuuaucauuuucgggaccuuuacaaaccaaauccauaaguggucccacaccuauuucggacugccgcgcugggucacgcuccugcaggauuggcaugugauucuucccagaaaacaccaccggauccaucacguuucuccucaugaaaccuacuuuuguauuacaaccggcuggcugaauuauccccucgagaagaucggguucuggcgcagacuggaagaccugauccagggacucacaggcgagaaaccucgggccgaugacaugaagugggcucagaagauuaaauga

SEQ ID NO: 76981 - RNA, 1113 nt, Artificial Sequence
  derived and/or modified sequence opt5 from TMEM189-UBE2V1__Homo_sapiens__NP_954673
auggccggcgcugaggacuggcccgggcagcaacuggaacucgaugaggacgaagccagcugcuguagauggggagcgcagcacgcuggcgcccgggagcuggccgcucuuuacuccccugggaagcgccugcaggaauggugcucugugauccucuguuucagccugauugcccauaaccuuguccaccuucuccugcuggcuagaugggaggauaccccgcucguuauccugggagugguggccggcgcgcuuauugccgacuuucuguccgggcucguccauuggggagcugauacauggggcucuguggagcugcccaucguuggcaaagccuucauucggccuuuucgcgaacaccauaucgaccccacggcuaucaccagacacgauuucauugagacaaauggggacaacugccuugugacccugcucccucugcugaauauggccuauaaguuucggacacacagccccgaagcgcucgagcagcuguacccuugggaguguuucgucuuuugccuuaucauuuucggaaccuuuacaaaccaaauccauaaauggucccacaccuauuucggccugccgcgcugggugacgcuccugcaggauuggcauguuauucuucccagaaagcaccaccggauccaucacgugucuccucaugaaaccuacuuuuguauuacaaccggggucaaagugccccgcaauuucagacugcucgaggaacuggaggaaggacagaagggcgugggggacggaacagucagcuggggccuggaggaugacgaggauaugacccucacgcgguggacaggcaugaucaucgggccuccccgcaccauuuaugaaaacagaaucuacucccugaagauugagugcggaccgaaauauccugaagcucccccuuuuguucgguucgugacaaagaucaauaugaacggcgugaauagcucuaacggggucguggacccccgcgccauuuccguucuugccaaauggcagaauagcuacucuaucaaggugguccugcaagagcucagacggcugaugauguccaaagaaaacaugaagcugccccagccuccggagggacaguguuacagcaauuga

SEQ ID NO: 76982 - RNA, 423 nt, Artificial Sequence
  derived and/or modified sequence opt5 from TMEM18__Homo_sapiens__NP_690047
augcccagcgccuucuccgugucuagcuuuccugucuccaucccggcuguucugacccagacagacuggacggagcccuggcucaugggccuggccaccuuccacgcgcuuugcgugcugcucacaugucugucuagcagauccuaccggcuucaaauugggcauuuucugugccucgugauccuggucuauugugcugaauacauuaacgaggccgccgcuaugaauuggcgccuguucucuaaguaucaguacuuugauagcagaggaauguucaucuccauuguguuuagcgccccucuccugguuaacgcuaugaucaucguggucauguggguguggaaaacccuuaauguuaugacagaccugaagaacgcccaggaacggcgcaaagagaagaaaagacggcgcaaggaagauuga

SEQ ID NO: 76983 - RNA, 627 nt, Artificial Sequence
  derived and/or modified sequence opt5 from TMEM199__Homo_sapiens__NP_689677
auggccagcucccugcucgcuggcgagagacuggugcgggcccuugggcccggaggcgaacuggagccugaacgccucccgagaaagcugcgggcggagcuugaagcugcccuggggaaaaagcacaaaggaggcgacucuagcuccgggccccagcgccucgucucuuucagacugauccgggaucugcaucaacaccuccgcgagagagacagcaagcuguaccuucaugagcugcucgaaggauccgagauuuaucugccugaaguugugaaacccccucggaaccccgagcuuguggcccgccuggagaagaucaagauucagcucgcuaaugaagaguacaaaagaaucacccggaacgucacaugccaggauacgcgccacggcggcacccugucugaccuggggaaacaggugagaagccucaaggcccugguuauuacaaucuuuaauuucaucgugaccgucguggcugccuuuguuuguacauaucuuggaucccaauacauuuucaccgaaauggcgagccgggugcuggccgcucucaucgucgccucuguggugggccuggcugagcuuuaugucaugguucgcgccauggaaggggagcugggagagcucuga

SEQ ID NO: 76984 - RNA, 1476 nt, Artificial Sequence
  derived and/or modified sequence opt5 from TMEM200A__Homo_sapiens__NP_001245206
augaucgccaccggcggggugauuacaggacuggcugcccucaagagacaggacagcgcgcggucccaacagcacgucaaccugucucccagcccugcuacgcaggagaaaaagccgauccgcagacggccccgcgccgauguugugguggucagaggcaaaauucggcuuuacuccccuucuggguucuuucugauccucggagugcugauuagcaucaucggcauugccauggcuguucuuggguauuggccccagaaggaacauuucaucgacgccgagaccacacuguccaccaaugaaacacaagugauucgcaacgagggaggcgucgugguuagauuuuucgaacagcaccuccauucugauaaaaugaagaugcugggcccuuuuaccauggggaucggaauuuucaucuuuauuugcgcuaaugccauccugcacgagaaccgggacaaggagacaaaaaucauucauaugcgcgauaucuacagcaccgugauugacauccacacgcucagaauuaaggaacagcggcagaugaauggcauguauaccgggcugaugggagagacagaagucaaacaaaacggcuccagcugugcgucucgccuugccgcuaauaccaucgccuccuucagcggguuuagaucuuccuuccggauggauagcucuguggaggaggacgaacugaugcucaacgagggaaaguccagcggccaccugaugcccccucuucuguccgauucuagcguguccgucuuuggccucuacccgcccccuagcaaaacaaccgacgauaagacgucuggguccaagaaaugcgaaacaaagagcaucguuucuagcuccauuucugcuuucacccugcccgugaucaaacugaauaacugugugauugacgagccuagcaucgauaauauuacagaagacgccgacaaccucaagucccgcagcagaaaucugucuauggauucccuugucgugccccugccgaacaccagcgagucuuuucagccuguuuccaccgugcucccccggaauaacagcaucggagagucccugucuagccaguauaaauccucuauggcgcuuggcccuggggccggacagcugcucagccccggcgcugccagacgccaauucggguccaacacaagccugcaucugcucucuucccacagcaagucucuggaccuugaucggggacccuccacgcugaccguccaggcugaacagagaaaacauccuagcuggccgcgccucgaccggaauaacucuaagggcuacaugaagcuggagaauaaagaagaucccauggacagacuucuggugccucaaguugccaucaagaaagauuucacaaacaaggagaaacuccugaugauuagccgcucccacaauaaccugagcuuugaacacgacgaguuccucucuaauaaccugaagcggggcaccuccgagacaagauuuuga

SEQ ID NO: 76985 - RNA, 570 nt, Artificial Sequence
  derived and/or modified sequence opt5 from TMEM205__Homo_sapiens__NP_001138888
auggaggaaggcgggaaccugggaggccucaucaagauggugcaucugcuuguccugagcggggccuggggaaugcagauguggguuaccuucguguccggcuuucuccuguucagaucucuuccccggcacacauuugggcuggugcaaagcaaacucuucccuuuuuacuuccacauuuccaugggaugcgcuuuuaucaaucuguguauucuggccucucagcaugcgugggcucagcucacguucugggaggccagccagcuguaucuucuguuucucucccugacccuugccacagucaacgcucgcuggcuggaaccgagaaccacagccgcuaugugggcccuccaaaccguggagaaggaacggggccugggcggggagguucccggaucucaccagggcccugaccccuaccgccagcugagagagaaagauccuaaguauagcgcgcuccggcagaauuucuuucgcuaccaugggcuguccagccuuugcaaccugggaugugugcucucuaauggccugugccuugccgggcuggcucucgaaaucagaucccuguga

SEQ ID NO: 76986 - RNA, 441 nt, Artificial Sequence
  derived and/or modified sequence opt5 from TMEM207__Homo_sapiens__NP_997199
augagcagaucccggcuguucucugugaccagcgccaucuccacaauuggcauccucugccugccccuuuuucagcugguccucucugaccugcccugugaggaagaugagaugugcguuaacuacaaugaccaacacccgaacgggugguauauuuggauccuucugcuccuggugcugguggcugcccuccuguguggagcggucgugcuuugccugcaguguuggcuccgcagaccccggauugauagccaucgcagaacgauggcuguuuucgccgugggcgaccuggauuccaucuacgggaccgaagccgcugucucuccuacagugggaauccaccuucagacccagacacccgaccuguauccuguucccgccccuugcuuuggcccgcucgggagcccuccucccuacgaggaaauugugaagaccacauga

SEQ ID NO: 76987 - RNA, 1560 nt, Artificial Sequence
  derived and/or modified sequence opt5 from TMEM209__Homo_sapiens__NP_001288092
augaugcagggcgaggcccaccccagcgcuucccugaucgacagaaccauuaagaugcggaaagaaacagaggcccgcaaggugguccucgcgugggggcugcuuaacguuucuauggcuggaaugaucuacacggaaaugaccggcaaacugauuagcuccuauuacaaugugacauauuggccucucugguacaucgagcuggcccuugccucucuguucagccucaacgcucuguuugauuucuggagauauuuuaaguacaccguggccccgacaucccuggucgugucucccgggcaacagacccuccugggacuuaaaacagcuguugugcagaccacgccuccccaugaccuggccgcgacccagauuccucccgccccuccgagccccuccauccaaggccagagcguccucucuuauuccccuagccggucucccuccacaagcccuaaguucaccacaucuugcaugaccggguacagcccccagcugcagggacuuuccuccggcggcucugggagcuacuccccgggagugacguauagcccuguuucuggcuacaauaagcuggcuuccuuuagccccucuccucccagccccuauccuacaaccguggggccggucgaauccucuggacuccgcagcagauaccgguccagccccacaguguauaacucuccuaccgauaaagaggacuacaugaccgaucugcgcacacuggacacguuccucagauccgaggaagagaagcaacaccgggugaaacugggcagccccgauucuaccuccccuagcuccucucccacauuuuggaauuauagccgcuccaugggggacuacgcccagacccuuaagaaauuccaguaccagcuggcuuguagaucucaagccccgugcgcgaacaaggaugaagccgaccucagcuccaagcaggcugccgaggaggucugggcucggguugccaugaaucgccagcugcuugaucauauggacagcuggacagccaaauuuagaaacuggaucaaugaaaccauucuggugccucucgugcaagagaucgaaucugucuccacgcagaugcggcgcaugggaugucccgagcugcagauuggcgaacugagccagggcgggugcaugucuuccuucagauggaaccggggaggcgauuuuaaggggagaaaaugggacacagaccucccuaccgauagcgcuaucauuaugcacguguucuguaccuaucuggacucucgccuucccccucaucccaaguacccggauggaaaaacauuuaccagccaacacuucguucagacaccuaauaagcccgacgugacgaacgagaaugucuucugcaucuaucaguccgcgauuaaucccccucacuacgagcugaucuaucagcggcauguguacaaccucccgaaaggcagaaacaacauguuucacacccugcuuauguuccuguauaucauuaagacaaaggaaagcgggaugcucggacgcguuaaucugggccugucuggcgugaacauccucuggauuuuuggggaguga

SEQ ID NO: 76988 - RNA, 324 nt, Artificial Sequence
  derived and/or modified sequence opt5 from TMEM213__Homo_sapiens__NP_001078898
augcagagacugcccgccgcuacccgggccacacucauccugagccuugcguucgcuucccugcacucugccugcagcgccgaggcuuccucuagcaacuccucuagccucacggcccaucacccugacccgggcacccuggaacaaugucuuaauguggauuuuugcccccaggcugcccgcuguugcagaacaggggucgacgaguacggauggauugcggccgcuguuggcuggucccugugguuccucacccugauccugcucuguguggauaagcugaugaaacuuacaccugacgaacccaaggaucugcaggccuga

SEQ ID NO: 76989 - RNA, 708 nt, Artificial Sequence
  derived and/or modified sequence opt5 from TMEM215__Homo_sapiens__NP_997723
augagacccgacgauaucaacccucggaccggccugguggucgcccucguuagcguguuccugguguuuggguucauguuuacagucuccggaaugaagggcgagacgcuugggaauauuccgcugcucgcuaucggacccgccauuugccugccuggcaucgcggcuauugcccuugcccgcaaaaccgaaggguguacaaaguggcccgagaacgaacugcucugggugagaaaacugccuugcuuccggaagcccaaagacaaggagguuguggaacugcuccgcaccccuucugaucuggagagcggaaagggcuccucugacgagcuugcuaaaaaggccggccugagagggaaaccgcccccucagagccagggagaagucuccguggcuucuagcaucaauucccccacaccuaccgaggaaggcgagugucagagccucguucagaacgggcaccaggaggaaacaucucgguaccuggauggauauugccccuccggcagcucucuuaccuacuccgcccuggacgugaaguguagcgcgcgcgauagaucugagugcccggaaccugaggacuccaucuuuuucgucccccaagauagcauuaucguguguuccuauaaacaaaauucuccuuacgaccgguauugcuguuacauuaaccagauccaggggcgcugggaucaugaaacgauuguguga

SEQ ID NO: 76990 - RNA, 438 nt, Artificial Sequence
  derived and/or modified sequence opt5 from TMEM216__Homo_sapiens__NP_001167461
augcugcccagaggccucaagauggccccucgggggaaacgccugagcuccaccccgcuugagauccuguucuuucucaacggaugguacaaugcuacauauuuccugcuugaacuguuuauuuuccucuacaagggcgugcugcugcccuauccuacggccaaccucguccuggacguugugaugcuucugcucuaccuggggaucgaggugauuagacuguuuuucggaaccaaaggcaaucuuugccagcggaagaugccccucucuaucagcgucgcgcugacauuuccuuccgcuaugauggccucuuauuaccugcuccugcaaaccuaugugcuucgccuggaagccauuaugaacgggauccuccuguucuuuuguggaagcgagcuucugcucgaaguucugacacuggcugccuucuccagaaucuga

SEQ ID NO: 76991 - RNA, 636 nt, Artificial Sequence
  derived and/or modified sequence opt5 from TMEM217__Homo_sapiens__NP_001273330
augaagcagcaacaguggugcggcaugaccgccaaaauggggacagugcugagcggagucuucacgaucauggcuguugacauguaccucauuuuugagcagaagcaccugggcaacggguccuguaccgaaaucacacccaaauauagaggagccucuaauauuaucaacaauuucauuaucugcuggagcuuuaagaucgugcuuuuccuguccuuuauuaccauccucauuucuuguuuccugcuuuacagcguguaugcgcagaucuuucggggccuggucauuuacaucguguggauuuucuuuuaugagacagcuaacguugugauccaaauccucaccaauaacgauuucgacauuaaagaaguccgcaucaugagaugguuugggcuggugucccggacaguuaugcauugcuucuggauguuuuucgugauuaauuacgcccacaucaccuauaagaaccgcucucagggaaauauuaucagcuacaagagacggaucuccacggccgagauucugcauagccgcaacaaaagacucucuaucuccagcggcuucucuggcucccaccuggaaagccaguacuuugagcggcagcgcagauguucugggaagaccuccauuaaauga

SEQ ID NO: 76992 - RNA, 723 nt, Artificial Sequence
  derived and/or modified sequence opt5 from TMEM219__Homo_sapiens__NP_001077082
augggcaacugccaggccgggcacaaucugcaucucugucuggcucaccaucccccucuugugugcgccacccugauccuccugcuucugggacucagcggccuggggcugggauccuuccuccugacacacagaacgggccuucggucuccggacauuccccaagauugggucagcuuucugcgcuccuucgggcagcucacccuguguccuagaaacggaacaguuaccggcaaguggcggggcucucaugugguggggcuucugacaacccucaauuuuggagacggccccgaucgcaacaaaacaagaaccuuccaggcgacgguccuggggagccagaugggacugaagggcuccucugcugggcaacucgugcugaucaccgcccggguuacaaccgagcgcacagccggaaccugccuuuacuuuagcgcugugccuggcauucugcccuccagccagccuccgaucucuuguuccgaagagggcgccgggaaugcuacgcucagccccagaaugggagaagagugcgucucuguguggucccacgaaggccugguucuuacaaaacugcucaccagcgaggagcuggcccugugugggucucggcuccuggugcuuggauccuuccugcuccuguuuugcggccuucuguguugcgucacagcgauguguuuccacccucgcagagaaagccauuggucccggacccgccucuga

SEQ ID NO: 76993 - RNA, 483 nt, Artificial Sequence
  derived and/or modified sequence opt5 from TMEM220__Homo_sapiens__NP_001004313
auggcccccgcucuguggagagccugcaacggccucauggcggcuuucuuugcccuggccgcucuugugcaggucaaugacccugaugccgagguuugggugguggucuacaccaucccggcugugcugacacuccugguugggcuuaaccccgaagugacgggaaaugucauuuggaaaagcaucuccgccauucacauccuguucuguaccgugugggcgguuggccucgccucuuaucugcugcaucggacacaacagaacauucuccacgaggaagaggggcgcgaacugagcggacuugugaucaucaccgcuuggauuauccugugccauuccucuagcaagaauccugucggcgggcggauucagcucgccaucgcuauugugaucacacuguuucccuucauuuccuggguguacaucuauaucaacaaggagaugagaucuagcuggccuacccacuguaaaacagucauuuga

SEQ ID NO: 76994 - RNA, 1143 nt, Artificial Sequence
  derived and/or modified sequence opt5 from TMEM229A__Homo_sapiens__NP_001129474
auggccggcagcgacguggauuccgaggggcccgcuagacggggaggcgccgcgcgcagaccuggggcuccgggaggccccgggucugaagccgccgcuggaugcccugagccccugagcaccgccgaagcuccugccgaguccgcgacacuccccgccuggaugcggcuguacuucuauggcaugcacggcaucacgcuugacguccugguuucuagcgcucgcagauuugcccgguccccugaucuccgcaugcugggguucucuagcccguacagaugucuucugcauucccucacccacuuugcucuggaaaagguguaucugcagcaacggcgcugccccaacgccuucguguuuaauuuccuccuguacccuagcgcgcaugucggacuucagacacuggccggccaggcucuccugcuuucucucgggggaggcgccgggguggcuguugcccccggagcccuggaccuggcucugcaguaugugcucgcgcuguaccacugucaagucuuucuuaaaagauuccugcggcuccgcuauggcagacagcggcgcagacagcagcaacagcagcagcaacagcagcaacagcagcggagaggcgcccugccugugcccccgggggcucgcguuccuaccgccgccggagcucggagacgccggcccagaggcccucgcggggccggaggcgcgcccucccaggggcuucccgaucugccucgguuucucuucuuuggaaugcauggcuuccuggacgagaucuuuuucacauucuuuuucaacgugcugggccaaggggauggaaccacaagcggccacaccucucucugguccuuuuucauguacgggagcugcucuuuugucguggagaagcuguacuuccaccuucauuauuccagaggauggggcacguggaaacgcgugccgauuuacgucauuuuuaucuauguuugggaacugagcugggggcucggccugcggaccuguggagcuugcuccugggacuacucucacuauccccuuaauuucaugggccugauuacacucauguaccugccuggguggaucuuucugagcguguaucaggaucucaucuccaacgugcuguggagaguccaguacgugcccgccaauuga

SEQ ID NO: 76995 - RNA, 1110 nt, Artificial Sequence
  derived and/or modified sequence opt5 from TMEM231__Homo_sapiens__NP_001070884
auggccaccagacggagccagacauggucccccggcucucgcagcgcuugcgagagauguuccuggcggucuaugagcuccucucugacgcgcagcuccgccgugaccgcgagagggagcgcuccuaagccgcggugcucuuguugcuggccccuccgcuccagaacaagccggcgcuguugguggccuucuggagccaccgucucccugcccagaccucuuugccacgaagcccccagagcucgcagcgccagagcuggccugccuaaccggcucccgacagcccuguucaauucuggguuuuggcuuaaacgcuccagcuacgaggaacaacccaccguuagauuccagcaucaggugcugcucguggcgcugcugggaccugaguccgacggcuuucucgccuggucuacauuccccgcuuuuaaccggcugcagggggauagacuucgcgucccucuggugagcacccgggaagaggacagaaaucaagauggaaagacggacaugcuccacuucaaacuggagcuuccccugcaguccaccgaacauguucucggcgugcagcugauccugacauuuagcuaucgccuccaccggauggccacccuggucaugcagucuauggcuuuccuucaauccagcuuuccggugccuggcucucagcuguacguuaacggggaucucagacugcagcagaagcaaccccuuagcuguggaggccuggacgcccgcuauaauauuuccgugaucaacgggacaucuccuuucgcguacgauuaugaccucacccauauugucgccgcuuaccaggagcggaaugugacgacagugcugaacgaucccaaucccaucuggcuggucggacgggccgcugacgccccuuuuguuauuaacgccaucauccgcuauccgguggaagugauuagcuaccagcccggcuucugggagauggucaaauuugcuugggugcaauacguuuccauccuccugauuuuccuuuggguguucgagcggaucaagauuuuugucuuccagaaucaggugguuaccacaaucccugugaccgucacccccagaggggaucugugcaaggaacaccucagcuga

SEQ ID NO: 76996 - RNA, 330 nt, Artificial Sequence
  derived and/or modified sequence opt5 from TMEM233__Homo_sapiens__NP_001130006
augagccaguacgcccccuccccugacuucaagagagcucuggauucuagcccggaggccaacaccgaagacgauaaaacagaggaagacgugcccaugccuaagaauuaucucuggcugacgaucgucuccugcuuuugucccgcguacccuauuaacaucguugcucuuguguucucuauuaugagccucaauuccuauaacgauggcgacuacgagggggcccggcgccugggaagaaaugccaaauggguggcuaucgccucuauuaucaucggccugcuuauuaucgggauuagcugcgcuguccacuuuacccggaacgccuga

SEQ ID NO: 76997 - RNA, 1227 nt, Artificial Sequence
  derived and/or modified sequence opt5 from TMEM237__Homo_sapiens__NP_001037850
augagaaccgacagcggcgcccggcuggaggaagggcaccucagacccccucgcgcucugccgcccgugccuucccaggaugacaucccccuuucucggccuaagaaaaagaaaccccgcacaaagaacacgccugccagcgcgucccuggagggacucgcucaaaccgccggcagacggccgucugaagggaaugagcccagcacaaaagaacugaaggagcauccugaggcccccguccagcgcagacagaagaaaacccggcuuccucuggaacucgagacauccucuacccagaagaaaagcuccucuagcucccugcugcgcaacgaaaauggaauugaugcugagcccgccgaggaagcuguuauccaaaagccgagacggaaaacaaagaagacccagccugccgagcuccaguacgcgaacgaacugggcguggaggacgaagauauuaucacggacgagcagaccacaguggagcaacagagcgucuucaccgcccccacagggauuucucagccugugggaaaaguuuuuguggaaaagucccgcagauuccaggcugccgaucggagcgagcuuaucaaaaccacggaaaauaucgacgucucuauggaugugaagcccuccuggacaacccgcgacguugcucugacagugcacagagccuuucggaugauuggccucuucagccauggcuuucuggcggggugcgccgucuggaacaucguggugauuuauguccuugcuggagaucaacuguccaaucucucuaaccugcugcagcaguacaaaacccucgccuaucccuuccaaagccugcuuuaccugcuccuggcucuuuccaccaucagcgccuuugacagaauugauuucgccaagaucucuguugcuauucgcaauuuucuggcgcucgacccuacagcccuggcuuccuuccuguauuuuacggcccucauccugagccuuucucagcagaugaccagcgaccggauccaccuguacacaccguccucugugaacggcagccucugggaggccgggauugaggaacagauccugcaacccuggauuguggucaaucuugugguugcucugcucgugggacuguccuggcuguuccucagcuauagaccuggcauggaucugucugaggaacuuauguuuuccagcgaggucgaagaguaccccgacaaagaaaaggagaucaaggccucuuccuga

SEQ ID NO: 76998 - RNA, 891 nt, Artificial Sequence
  derived and/or modified sequence opt5 from TMEM241__Homo_sapiens__NP_116322
augugcgugagacggagccuggucggccucaccuucuguacaugcuaccuggccuccuaucuuacgaacaaguacguucugucugugcucaaauuuaccuaucccacacuguuccagggguggcaaacccuuaucggaggccugcuccugcacgugagcuggaagcuggggugggucgagauuaauuccucuagccgcucccaugugcucguuuggcugccugcuucugugcuuuuugucggaaucauuuacgccggcagcagagcgcugucccggcucgcuaucccgguguuccugacacuucacaacguugccgaagugauuaucuguggguaucagaaaugcuuucagaaggagaaaaccagccccgccaagaucuguucugcucugcuccugcuggccgcugccggaugccucccuuucaaugacucccaguuuaaccccgauggcuacuucugggcgauuauccaucugcuuugugucggcgccuauaagauucugcagaaaagccaaaagccuucugcucucuccgacaucgaucagcaguaccugaauuacauuuuuagcguggugcuucuggccuucgcuucucaccccacaggggaccucuuuuccguccuggauuucccuuuucuguauuucuaccgcuuccauggaagcugcugugccuccggcuuucucggguucuuucugauguucucuaccguuaaacuuaagaaccugcucgcgccgggacaaugcgccgcuuggaucuuuuucgccaaaauuaucacggcuggccugagcauccuucuguuugacgccauucucaccuccgccacaaccgggugucugcugcucggagcucugggcgaagcgcuucugguguucagcgagagaaagucuuccuga

SEQ ID NO: 76999 - RNA, 387 nt, Artificial Sequence
  derived and/or modified sequence opt5 from TMEM244__Homo_sapiens__NP_001010876
auggcccuccaggugagagucgcucccagcaagguugugcugcaaaaauuccugcuuugcgugauccuguuuuacaccgucuauuacgugucccucucuaugggcuguguuauguucgaagugcacgaacugaacguccuugccccuuuugacuucaagacaaauccgagcuggcugaacauuaauuauaaagugcuccugguuuccacggaggugaccuacuuugucugcgggcuguucuuugugcccguggucgaagaguggguuugggauuaugcgaucucugugacaauucuccauguggcuaucaccagcacagucaugcuggaguucccucuuaccucccacuggugggccgcccugggaauuucuaagcuccugguguga

SEQ ID NO: 77000 - RNA, 2640 nt, Artificial Sequence
  derived and/or modified sequence opt5 from TMEM245__Homo_sapiens__NP_114401
auggccgacggcgggggacccaaggaugcuccuagccugagauccucuccgggccccgccccucgggugccccgcgcggucgggccuagcggaggcgggggagagacccccagaacagcugcccucgcccugcgguucgacaaaccuaucaagcaggcuuuuuacaacacgggcgccguucuuuucgugugccuguguugcggcgcugccgugcucgucuauuuuauucuggaagcguuccuucgcccgcugcucugggccgugcugugugggaccuuucugcaccccuucaaauccucucucacaagacugggacggcauuggcuucaacgccugcacagagcucauaccccuaucguucucgccgcucugcuucugccccucugcuuuguggauuacggcgucgaggcccugggggaacaggcgcugcggcgcagacggcuccugcuucugcucggagccggcgggccucugcuuuauggacuguacugucucggcagcuaucugggcgugcagguucugcucgugcacgcugccacacugauuugccgcgggcuugacuacuucuccucucuguggaucuggacccucgucgugggauaugugcugacagucagcuuuaaguggaaugcuuccaccgagagauaccuucgggccguuagcauucccguguggaucauccuccuguuccaucuggccucucuggcuggcuccuggcgcauuccgguguuucucgucaucguguuccugaugagcguugggacgcuuuacgaaaaacagaacggaaaggagucuuccggcgcggagcugccugggcaagugauuagcauggccgcuucuacccucgccaaucuggccaucuccauuacaggauaugaaagcuccucugaggaucagcccagcacccagccugcugaagccgucgacagaggcgaguccgcgcccacacugagcaccucucccuccccuagcucuccgagccccacguccccuucucccacacuuggccggagacgcccugagaucgggaccuuucuccggaagaaaaagacaagcgauauuuacuucgugucccugguuugggcuaucguggucaugcagaucuggcugaaccucuggauugugcaacugcuucccgucccgaucgccguguggauucugaaaaagcucguuauccacuucggaguggucgacuuucuggaaaagagauaucacgugugguggggcauuaucgagagcuuccugaaagaacgccagggggcccuugcuccuuggcccaucguuggacucggcaaguuucugcugaaaguggauucuaagcucuggcauuggcugaauaaaaagaugauuaucuggcuugagaaaaugcuggacaagauuaucuccauuuucaucaucuuucuccuggucauugggacccugcuucucgcccugcugcucaccgcuaaagugcaccaggaaagcgugcauaugaucgagguuacaucuaaccugauuaaugagacgcuugccaaccacccugaaugggcgaauuggcugcccgaggcccaggucgugcaacgggcucucaacuccgccgcuaauaacguguaccaguauggcagagaauggaucacccacaagcugcauaagauucugggagauaaagucaauaacacagccgugaucgagaagcagguucuugaacucugggaccgccuguaccacagcugguucgugaaaaaugucacccauuccggccggcacaaggggcaaaaacugcaugugucuagacagaacagcuggcucggagauauucuggacuggcaggacaucguuuccuuugugcacgagaacaucgagacauuccuuucuauucuggaaagccucuggaucgucaugucccgcaaugugagccugcuguuuaccacgguuacaacccuucugaccauucucuucuauucuggcacagcgcugcucaacuuugugcugucccuuaucauuuuccugaccacacucuuuuaccugcugucuagcuccgaugaguacuauaagccugucaagugggugaucagccuuacgccccugucucagccggggccuagcuccaauaucauuggacaaagcguggaagaggccauccggggcgucuucgacgcuucucucaaaauggccggguucuacggccuguauaccuggcucacacacaccauguuuggaauuaacaucguuuucauucccuccgcucuggccgccauccuuggcgcugugcccuuucuggggacauacugggcggccgugccugcuguccucgaucuguggcugacccagggacuuggcuguaaggccauccugcuccugauuuuccaucuccugccgacguauuuuguggacaccgccaucuacagcgauauuuccgggggaggccaccccuaucuuacagggcuggcuguugccggcggagcguacuaccugggccucgaaggggcuaucauuggaccuauccugcuuugcauccugguggucgccucuaauauuuauagcgccaugcucgugucccccaccaacucuguuccuacacccaaucagaccccuuggcccgcucagccgcaaagaacguuccgcgacaucagcgaggaucugaaauccucugugggcuga

SEQ ID NO: 77001 - RNA, 1863 nt, Artificial Sequence
  derived and/or modified sequence opt5 from TMEM259__Homo_sapiens__NP_001028198
augagcgagcacguggaacccgccgcuccuggcccggggcccaacggaggcgggggaggcccugcccccgcgagagggccucggacccccaaucugaacccuaauccgcucaucaacguccgcgacagacuguuccaugcucuuuucuucaagauggccguuacauacucccggcuguuucccccugccuuccgcagacucuuugaguucuuugugcugcuuaaagcucuguucgugcucuuuguccuggccuauauucacaucguguucucucggagccccauuaauugccuggaacauguucgcgauaaguggccuagagagggaauccuccggguggaaguccgccacaacuccucuagagcucccguguuucugcaguucugugacagcggcggccggggguccuuuccgggacuugccguugagccuggcucuaaucuggauauggaggacgaagaggaagaggagcucacgauggaaauguucgggaacagcuccauuaaauucgagcuggauaucgaacccaagguguuuaaaccucccagcucuaccgaggcgcuuaaugacucccaagaauuucccuuuccugagacaccgaccaaggucuggccccaggaugaguacaucguggaauauagccuggaguacggauuccuccgccugucucaggccacaagacagcggcuguccauuccugugauggucguuacccucgaccccacacgcgaucaaugcuuuggcgacagauucagccggcugcuucuggaugaauuucucggguaugacgauauccugaugucuuccgugaagggacuugcugagaacgaagagaauaaaggcuuccugagaaacguggucagcggcgagcauuaccgcuuuguguccauguggauggcccggaccucuuaucucgcugccuucgcgauuaugguuaucuuuacgcugagcguguccaugcugcucagauacagccaccaccagauuuucgucuuuaucguggaccugcuucagaugcuggaaaugaauauggccauugcuuucccugccgcuccccuccugaccguuauccuugcccugguggggauggaggccaucaugucugaguucuuuaacgacacaaccacagcuuucuacauuauccucauugucuggcuggcggaucaguaugacgccaucuguugccauaccuccacgagcaagcgccacuggcugcgguuuuucuaccucuaucauuuugcuuucuacgccuaucacuacagauuuaauggacaauauucuagccuggcccuugugacauccuggcuguucauucagcacucuaugaucuacuuuuuccaucacuacgaacucccggcuauccugcagcagguccgcauucaagaaaugcugcuucaggccccuccccucggcccugggacccccacagcgcugccugaugacaugaacaacaauagcggagcucccgccaccgccccggauuccgcuggccagccucccgcccuggggcccgugagcccuggagcuucuggcuccccgggccccguugccgcggccccuagcucucucguggcugccgcugccuccgucgcggccgcugccgggggagaccugggcuggauggcugagaccgccgccaucauuacagaugcuagcuuucuuuccgggcugucugcgagccuccuggagcggagacccgccuccccucugggacccgcuggcgggcuuccucaugcuccccaagacucugugccgccuagcgauuccgccgccagcgacacgacaccccucggcgccgcgguuggaggcccuucucccgcuuccauggccccgaccgaagccccuagcgagguggggucuuga

SEQ ID NO: 77002 - RNA, 969 nt, Artificial Sequence
  derived and/or modified sequence opt5 from TMEM25__Homo_sapiens__NP_001137507
auggcccugcccccuggcccggcugcccucagacacacccugcuucugcuccccgcgcugcuuagcuccggguggggagagcuggaaccucagaucgacggccaaacaugggcugagcgggcccuccgcgaaaacgagagacaugccuucacgugccggguggcugggggacccggcaccccucgccuggccugguaccuggaugggcagcuccaggaggcuucuacaagcagacugcuuuccgucggaggcgaagccuuuucuggcgggaccagcacauucaccguuacagcgcaccgggcccagcaugagcugaauuguucccuccaagacccccgcucuggaagaagcgcuaacgccuccgugauucugaaugugcaguuuaagccugaaaucgcucaggucggcgccaaauaucaggaggcgcaagggccgggacuucuggugguucucuucgcccuggugcgggcuaaucccccugccaacgucaccuggauugaucaggacggccccgugacgguuaacaccagcgauuuucuggugcucgacgcucagaauuacccuuggcugacaaaccacaccguccagcuucaacugcgcucucucgcccauaaucuguccgugguggccacaaacgaugucgggguuaccagcgcuucucuucccgcgccgggaccuuccagacaccccagccugaucucuuccgacagcaauaaccucaagcugaauaacgugcggcugccucgcgaaaauaugucccuccccucuaaccugcagcuuaacgaucugacgcccgacagcagagccgugaaaccugcugaucggcagauggcccaaaauaacucccgcccggagcuccuggaccccgagccuggcggccuucugacaagccagggguucauuagacuccccguccugggauauaucuaccgggugucuuccguuagcucugaugaaaucuggcuguga

SEQ ID NO: 77003 - RNA, 339 nt, Artificial Sequence
  derived and/or modified sequence opt5 from TMEM261__Homo_sapiens__NP_219500
augggcagcagacugucccagcccuucgagucuuacaucaccgccccuccggggacagcugccgcgcccgcuaagccugcucccccugccacgcccggagcuccuaccagcccggccgaacaccggcuccugaaaacaugcugguccugucgcgugcuuucuggccuggggcucaugggagcuggcggguaugucuacuggguugccagaaagcccaugaaaaugggauauccucccagcccuuggaccauuacacaaauggugaucggccuguccauugcgaccuggggcaucguggucauggccgaccccaaggggaaagccuaccgggugguuuga

SEQ ID NO: 77004 - RNA, 669 nt, Artificial Sequence
  derived and/or modified sequence opt5 from TMEM27__Homo_sapiens__NP_065716
augcuguggcuccuguucuuucuugugaccgccauccacgcugagcugugccagcccggcgccgaaaacgcguucaaggucagacucagcauucggaccgcucugggggacaaagccuacgccugggauacgaaugaggaauaucuuuuuaaggcuaugguugccuucuccaugcgcaaagugccuaacagagaggcuaccgaaaucucucaugugcugcucuguaaugucacacaacgggugagcuuuugguucguugugaccgacccguccaagaaccacacacugcccgccgucgaggugcagucugcgauucgcaugaauaaaaacagaaucaauaacgccuuuuuccugaaugaucagacccucgaguuucugaagauuccuagcacacuugcucccccuauggaccccuccguuccuaucuggaucauuaucuucggagugaucuuuugcauuauuaucgucgccauugcucugcucauccugucuggcaucuggcagcggcgcagaaagaacaaagaaccgagcgagguggaugacgccgaagauaagugugagaauaugauuaccaucgagaacgggauucccuccgacccucuugauaugaaaggaggccauaucaaugacgcguucaugacggaagaugagcggcugacaccccucuga

SEQ ID NO: 77005 - RNA, 3963 nt, Artificial Sequence
  derived and/or modified sequence opt5 from TMEM2__Homo_sapiens__NP_001129292
auguacgccaccgacagcagaggccacucccccgcuuuccugcagccucaaaacgggaauagccggcauccgagcggauaugugcccggcaaggucguuccucuccggcccccucccccuccgaaaucccaggccucugcgaaguuuacaagcaucagacgggaggaucgcgcuacguucgccuuuucccccgaggaacagcaggcccaaagagaaucucagaaacagaagcggcacaaaaacaccuucauuugcuuugcuaucacaucuuucuccuuuuucauugcccuggcuaucauucuugggaucagcucuaaguacgccccugacgagaauugucccgaucagaacccucgccugagaaauugggaccccggacaagauuccgcgaaacagguggugaucaaggaaggcgacaugcuccggcugaccagcgaugccacaguccauucuauugugauccaggacgggggacuucugguuuuuggcgauaacaaggacggcucccgcaauauuacccucagaacacacuauauccugauucaggaugggggagcucugcauaucggcgccgagaaaugccgguacaagagcaaagcuaccauuacgcucuaugggaagucugacgagggagaauccaugccgaccuucggcaagaaauuuaucgggguggaggccggaggcacacuggaacuucacggcgcgcgcaaggccagcuggacccugcucgcuagaacacugaacuccucugggcuuccuuucggaagcuacaccuuugagaaagauuucucccggggccugaauguccgcgugaucgaccaagacacggccaagauucucgagagcgaaagauucgauacacacgaguaucggaacgaaucuagacgccugcaggaguuucugcgguuccaggaccccgggagaaucguugcuauugccgugggagauuccgccgcuaaaagccuccugcaaggcaccauccagaugauucaggaacgccuugggucugagcugauccagggacucggcuaccggcaagcgugggcccuggucggcgugaucgacgggggaagcacauccuguaaugagucugugagaaacuacgaaaaucauagcuccggcgggaaggcucuugcccagcgcgaguuuuauaccgucgauggacagaaauucagcguuaccgccuacucugaauggauugaggaaacaccucaguuucugcacaugggcgagaucauugacgggguggauaugcgggcugaggugggcauccucacgagaaacauugucauccaaggagaaguggaggacuccugcuaugccgaaaaucagugucaguucuuugauuacgacaccuucggcgggcauaucaugauuaugaagaacuuuacaagcguucaccugucuuauguggagcugaagcacaugggacagcaacagaugggccgcuaccccguccauuuccaccucugcggggauguggacuauaaaggaggcuaccggcaugcgaccuuuguugacgggcuguccauccaccauagcuucuccagauguauuacagugcacggcaccaacggacuucugaucaaggauacgauuggcuuugacacacucgggcacugcuucuuccuggaagauggaaucgagcagcgcaauacccuuuuucauaaccugggccuccugaccaaacccgggacacugcucccuaccgaccggaauaacucuauguguacaacgaugagagauaaggucuucggaaauuacauuccggugcccgcuaccgacugcauggccgucagcacauuuuggaucgcccacccuaacaauaaccugaucaauaacgcugccgcuggcucccaggaugccgggauuugguaucuuuuccauaaagagcccaccggcgaaucuagcggacugcaacuccuggcgaagccugagcugacaccccuuggcaucuuuuacaauaaccgggugcacuccaauuucaaggccgggcucuuuauugacaaaggaguuaagaccacgaacagcucugcugccgauccgcgcgaauaucugugucuggacaauuccgcuagauuccggccucaccaggaugccaaccccgagaaaccuagaguggcggcccucaucgaccgccugauugcuuuuaagaacaaugauaacggcgccuggguccgcgggggagacaucaucgugcagaauagcgcuuucgccgacaacggcauugggcuuaccuuugccucugauggcuccuuccccagcgacgagggaucuagccaagaaguuuccgagagccuguuugugggcgaaucuagaaauuacggguuccagggaggccagaacaaauaugucgggacaggaggcaucgaucagaagccucgcacccuccccagaaaucggacauucccgauucgcggcuuucaaaucuacgacgggccuauucaucugaccagauccacguucaagaaauaugugcccacacccgaucgguacagcuccgcuaucggauuucugaugaagaacucuuggcagaucaccccucgcaauaacauuagccuugugaaauucggcccgcacguuucccucaaugucuuuuucgggaagcccggaccuugguuugaggacugcgaaauggauggcgacaaaaacucuaucuuccaugauauugacgggagcgugacaggauacaaggaugcguaugugggcagaauggacaauuaccugauccggcaccccuccugcgucaacgugucuaaguggaaugccguuauuuguagcggcaccuaugcucagguguacguccagaccugguccacacaaaaccugagcaugacgaucacccgcgaugaguauccuucuaaccccauggugcucagagggaucaaucagaaagccgccuuuccucaguaccagcccguugugaugcuggagaagggauauacaauucauuggaacggcccggcuccucggaccacauuccuuuaccuggucaauuuuaacaaaaaugacuggauccgcguggggcucugcuaccccuccaacaccagcuuccaaguuacguucggauaucugcagagacagaauggcucucuguccaagauugaagaguacgaaccugugcacagccuugaggaacuccaacggaaacagucugagagaaaguuuuauuucgacuccagcacagggcugcuguuucucuaccugaaagccaagucccaccgccauggacacagcuauuguucuagccagggcugcgagcgggucaagauccaggcggcuaccgauuccaaagacauuucuaacuguauggccaaggccuacccccaauauuacagaaaaccgagcguggugaagcgcaugccugcuaugcuuaccggccugugccagggguguggaacacggcaggucguuuucaccuccgauccccauaaaucuuaccucccugugcaguuucaaagccccgacaaggccgaaacacagagaggcgaucccuccgugaucucugucaaugggacggacuucaccuuucgcagcgcgggagugcugcugcuuguuguggauccuugcuccgucccguuccggcucacagagaagaccguguuuccccuggcugacguuagcagaauugaagaguaucugaaaacaggcaucccuccccgcucuaucgugcuccuguccaccagaggggaaauuaagcagcuuaacaucagccaucugcucgucccucugggacuggccaaacccgcccaccuuuacgauaagggcucuacgauuuuccugggcuuuuccgggaauuucaaaccuagcuggaccaagcucuuuacauccccggcuggacagggccugggggugcucgagcaauucaucccccugcagcuugacgaguauggauguccucgggccaccacaguucggcgcagagaucuggaacuccugaagcaggcuucuaaagcccacuga

SEQ ID NO: 77006 - RNA, 978 nt, Artificial Sequence
  derived and/or modified sequence opt5 from TMEM30A__Homo_sapiens__NP_001137430
auggccaugaacuacaaugcuaaggacgagguggauggcgggcccccuugcgccccgggaggcaccgcgaaaacaagacggcccgacaacacggcuuucaagcagcaacgccugccugccuggcagcccauccucaccgccgggacaguccugccuauuuucuucaucauuggacuuaucuuuauucccaucggcaucgggauuuucguuaccagcaauaacaucagagaaauugagggaaauguguuuauguauuacggccuguccaacuucuaucagaaucaccggcgcuacgugaaaucuagagaugacagccagcucaacggcgauuccucugcucugcuuaauccuagcaaggaaugugagccguaucggcgcaacgaagacaaacccaucgccccuugcggggcuauugccaauuccauguuuaacgauacacuggagcucuuucugaucggaaaugacucuuaccccauuccuaucgcgcugaagaagaaaggcaucgccugguggaccgauaagaacgucaaauuuagaaaucccccugggggagacaaccucgaggaacgguucaagggcacaaccaaaccggugaacuggcugaagcccguuuauaugcuugauagcgacccugauaauaacggguuuauuaaugaggacuucaucguguggaugcgcacggcugcccugcccaccuuuagaaagcucuaccggcugauugaacgcaaauccgaccuucaucccacacugccugcuggaagauacagccucaacgucaccuauaauuacccggugcacuauuucgauggccggaagcgcaugauccugucuacaauuuccuggaugggcgggaaaaaccccuuccugggaaucgccuacaucgcgguuggcagcauuucuuuucuccugggggugguccuucuggugaucaaucauaaguauagaaacuccagcaauaccgccgacauuacgaucuga

SEQ ID NO: 77007 - RNA, 1056 nt, Artificial Sequence
  derived and/or modified sequence opt5 from TMEM30B__Homo_sapiens__NP_001017970
augaccuggagcgccacagcuagaggcgcccaccagcccgacaacacggcguucacccaacagcggcugccugcuuggcagccgcuccuguccgccucuaucgcccuuccccuguuuuucugcgcugggcucgccuuuauuggacugggccuugggcuguacuauagcuccaauggaaucaaggagcucgaauacgauuauacaggcgacccugggaccggaaacuguucugugugcgcugccgcgggccagggccgcgcccugcccccucccuguagcugcgcuugguacuucucccugccugagcucuuucaagggccggucuaucuguacuaugaacuuacaaauuucuaccagaacaauagacgguacggaguuucucgcgaugacgcccagcugagcggccuccccuccgcucugagacauccugugaacgagugugcccccuaucagcggagcgcggccgggcuuccuauugcucccugcggagccaucgcuaauucucuguuuaacgauuccuucagccucuggcaccaacgccagccgggcgggccuuacguggaagucccccuggacagaucuggaauugccugguggaccgauuaucaugugaaauuucggaauccuccccugguuaacggcucccucgcccuggcuuuccagggcacagcgcccccuccgaauuggcgcagacccguguacgagcuuagcccugaccccaacaauaccggguuuaucaaccaggauuucgucguguggaugcggacggccgcucugccuaccuuucgcaagcucuaugccagaauccggcaaggaaauuacucugccggccugccccgcggggcuuauagaguuaacauuacauacaacuacccggugcgggccuucggaggccacaaacuucugaucuucuccagcauuuccuggaugggagggaagaauccuuuucucggcaucgcguaucuggucgugggcucucuguguauucucaccggguucgugaugcuggucguuuacaucagauaucaggaccaggaugacgaugacgaggaauga

SEQ ID NO: 77008 - RNA, 573 nt, Artificial Sequence
  derived and/or modified sequence opt5 from TMEM37__Homo_sapiens__NP_899063
augaccgccgugggcguccaggcucaaagaccccuggggcagcggcagccucgccggagcuucuuugaguccuucaucagaacacucauuaucacgugcguugcccuggcgguggugcuuucuagcgucuccauuugugacggacacuggcugcucgcugaagaucgccuguuuggccuuuggcauuucugcaccacaaccaaccagacaaucuguuuuagagaccuggggcaagcccacgugccgggacucgccguuggcauggggcuggugcggucugucggagcucuggccgugguugcugccauuuucggccucgaguuucugauggugagccagcuuugcgaagauaagcauucccaguguaaaugggucaugggcucuauccugcuccuggugagcuucgugcuuuccagcgggggacugcucggcuuugucauccugcugcgcaaucagguuacccucauuggguucacacugauguuuuggugcgaguucaccgcgucuuuucuucuguuccucaacgccaucuccggacugcacauuaauagcaucacgcaucccugggaauga

SEQ ID NO: 77009 - RNA, 900 nt, Artificial Sequence
  derived and/or modified sequence opt5 from TMEM38A__Homo_sapiens__NP_076979
auggagcugcucagcgcccugucccuuggcgaacuggcucucucuuucagcagagugccccuguuuccugucuucgaccuuuccuacuuuaucguuucuauucuguaucucaaguacgagccgggggccguggaacugagccggcgccaccccaucgcguccuggcugugcgcuaugcuccauuguuucggaucuuauauucuggccgaucuucugcucggcgagccucugaucgacuacuuuagcaacaauuccagcauucuucuggccucugcugugugguaucucaucuucuuuugcccccuggaucuguucuacaaaugugucugcuuucucccugugaagcugaucuucguugccaugaaagaaguggucagagugcggaagauugcuguugggauccaccaugcccaccaucacuaucaccauggaugguuugugaugauugcgaccggcugggucaaaggguccggaguggcccuuaugagcaacuucgagcagcugcuccgcggcguguggaagcccgagacaaaugaaauccugcacaugucuuuuccuacgaaggcuucccuuuacggcgccauucuguucacccuccaacagacaagauggcugccggucagcaaggcuucucugaucuucauuuuuacccucuucaugguuuccuguaaaguguuucugacagccacccauagccacuccucucccuucgacgcgcuugagggguacaucugcccugugcuguuuggaagcgccuguggcggggaucaccaucacgacaaccauggaggcucccacagcgggggaggccccggcgcucagcauucugccaugccugcuaaauccaaggaggaacucagcgaggggucucggaaaaagaaggccaaaaaggccgauuga

SEQ ID NO: 77010 - RNA, 876 nt, Artificial Sequence
  derived and/or modified sequence opt5 from TMEM38B__Homo_sapiens__NP_060582
auggacagccccugggaugagcuggcccucgcuuucuccagaaccucuauguuuccuuucuuugacaucgcccacuaccuggugagcgucauggcgguuaagcggcagccgggcgcugccgcccuugcuuggaaaaaccccauuuccucuugguucacagccaugcugcauugcuuugggggaggcauccucagcugucugcuucuggcugaaccuccccucaaguuccuggccaaucacacgaacauucugcucgcguccucuaucugguauauuaccuuuuucugcccucaugaucuggugagccaaggguacuccuaucuucccgugcagcugcucgccagcggaaugaaagaggucacacgcaccuggaagaucgugggcgggguuacacacgcuaauucuuacuauaaaaacggauggaucgugaugauugccaucggcugggcuagaggcgccgggggaaccauuaucacaaauuuugaacggcuggucaagggcgacuggaagccugagggggaugaauggcuuaaaauguccuacccggcgaaggugacccugcucggaagcguuauuuucacguuucagcauacccagcaccuggccaucucuaaacacaaccugauguuccucuauacaauuuuuaucguggcuaccaagaucacaaugaugaccacgcaaacauccaccaugacauucgcccccuucgaggacacccugagcuggaugcuuuuuggcuggcagcagccuuucucuuccugugagaaaaagagcgaagcuaagucccccucuaauggggucggaagccuggccuccaaaccuguggauguggccagcgacaacgucaagaaaaagcauaccaaaaagaaugaguga

SEQ ID NO: 77011 - RNA, 1467 nt, Artificial Sequence
  derived and/or modified sequence opt5 from TMEM39A__Homo_sapiens__NP_060736
augcccggcgggagacggggaccuagccgccagcaacuguccagaucugcccucccgagccugcagacccuugugggcgggggaugcggcaacgggacaggacugcggaaucgcaacggcuccgcuaucggccuccccgucccucccauuacggcccugaucaccccugggcccguuagacacugucagauuccugaccuuccgguggauggaucucugcuguucgaguuucuguucuuuaucuaccugcucguggcgcuguucauucaguauaucaauaucuacaagacagucuggugguaucccuacaaccauccugcuagcugcaccucccuuaauuuucaccugauugacuaucaucucgccgccuucaucacagugaugcuggcucggcgccuuguuugggcccugauuucugaagcuaccaaagccggcgcggccagcaugauccacuacauggugcucauuuccgcuagacugguccugcucacacugugugggugggugcuuugcuggacccugguuaaccucuuucggagccauucugugcugaaucuucuguuccucggauaucccuuuggcgucuacgugccucuguguugcuuccaccaagauucccgcgcccaccuccuccugacggacuacaacuaugugguccagcaugaggcuguugaagagagcgccucuaccgugggagggcuugcgaaguccaaagauuuucugagccuccugcuugaaucucugaaggagcaguucaauaacgccacacccaucccgacccacuccuguccucucagccccgaccugauuagaaaugagguggaaugccugaaagcugauuuuaaccaucggaucaaggagguccucuucaauucccuguucucugccuacuauguggcuuuucuuccucuguguuucguuaagagcacacaguacuaugacaugcgcugguccugcgaacaccucaucaugguguggauuaacgccuuugucaugcugaccacgcaacugcuucccagcaaauacugugaucuccugcacaagucugccgcucaucugggcaaauggcagaagcucgagcacggcuccuauagcaaugcgccccagcauaucuggucugagaacacaauuuggccucagggggugcugguuagacacagccggugccuuuaccgcgccaugggaccguacaacguggcuguccccuccgacgugucucaugccagauucuauuuucuguuccaccggccucucagacugcugaaucuucucauccugauugaaggcagcgucguguuuuaccaacuguauucccuccugcgcagcgagaaauggaaccacacccuuucuauggcccugauccucuucugcaauuacuauguucuguuuaagcugcuucgggauagaaucgugcucgggcgcgcuuacuccuauccccugaacagcuacgaacugaaggccaauuga

SEQ ID NO: 77012 - RNA, 750 nt, Artificial Sequence
  derived and/or modified sequence opt5 from TMEM40__Homo_sapiens__NP_001271335
auggccgaggcuggcgccgggagccugucccuccccggaggcaaggcgauggaaaccucugcuagcuccucucagccucaagacaacagccaggugcacagagagacagaagaugucgacuacggggagacggauuuccauaaacaggacggaaaggccggccuguuuucccaggaacaauaugagcggaauaaaucuagcuccagcagcuccagcagcuccucuucuuccagcuccucuagcuccucuucuuccagcgagucuaacgaugaagaccagcagccgcgcgccaccgggaagcacagacggagccuuggagcuggcuacccccauggcaauggguccccuggacccggccacggggagccugauguucugaaagacgaacuccagcuguauggagaugcccccggcgagguggugccuucuggggagagcggacuucgcagacggggcuccgacccggcuagcggcgaagucgaggccucucaacugcgcagacucaacaucaagaaggaugacgaguucuuucauuucgugcugcugugcuuugcgauuggggcccuccugguuuguuaccacuauuacgcugauugguucaugucccuuggagugggccugcucacauuugccagccuggaaaccgucgggaucuauuucggacuuguguaccggauucacucuguucugcagggcuuuaucccccucuuccagaaauuucgccugacaggguucagaaagaccgacuga

SEQ ID NO: 77013 - RNA, 1203 nt, Artificial Sequence
  derived and/or modified sequence opt5 from TMEM43__Homo_sapiens__NP_077310
auggccgcuaacuacagcuccaccucuacaagacgggagcacgugaaggucaaaacgagcucccagcccggcuuccuggaacgccucucugagaccagcgggggaauguuuguuggccugauggccuuccuucuguccuuuuaucucaucuucacaaaugaagggagagcgcugaagaccgcuacaucucuugccgagggacugagccucgugguguccccugacagcauucauucugucgccccggaaaacgagggccggcuggugcacaucauuggggcucugcgcaccuccaaacuccugagcgaucccaauuacggaguucaucuuccugccgugaagcugagacggcacgucgagauguaucaauggguggaaacagaggaaucucgcgaguacaccgaggacggccagguuaaaaaggaaacgagauauuccuacaacaccgaguggcggagcgaaaucauuaauucuaagaacuuugaucgcgagaucggccauaaaaaucccuccgcuauggccguggagagcuucauggcgacagccccuuuuguccagaucgggagauucuuucucuccucuggacugauugacaagguggauaacuucaaaagccuuucccugagcaagcucgaagacccccacguggauaucauucggcgcggcgacuuuuucuaucacucugagaauccuaaauacccggaagucggggaucugagaguuuccuuuagcuacgcuggacugucuggcgacgaucccgaccucgggccugcccauguggugaccgucaucgcucggcagcgcggagaucaacuggugcccuucagcacaaaguccggcgacacccuucugcuccugcaccauggcgacuucucugccgaggaaguuuuucacagagagcuucggagcaacuccaugaagacgugggggcugagagcggccggauggauggcuauguucaugggccucaaucugaugacacgcauucuguauacccucguggauugguuuccugucuuccgggaccuggugaacaucgggcuuaaagccuuugcuuucugcguugccacaagccugacccuccugaccguggccgcuggauggcuguuuuacagaccccuuugggcgcuccugauugccggccuggcucucgucccgauccugguggcccgcacacgggucccugccaagaaacuugaauga

SEQ ID NO: 77014 - RNA, 828 nt, Artificial Sequence
  derived and/or modified sequence opt5 from TMEM45A__Homo_sapiens__NP_060474
augggcaacuucagagggcacgcccugcccggaaccuuuuucuuuaucauuggccucugguggugcacaaagagcauccugaaauacauuuguaagaaacagaagcggacgugcuaucuuggguccaaaacccuguucuaccgccucgagauccuggaaggaauuacaaucgugggcauggcucuuaccgggauggccggagagcaauuuaucccuggcggcccgcaucugaugcucuaugacuacaagcaggggcacuggaaucagcugcugggauggcaucacuucacaauguauuucuucuuuggccuccugggggucgcggauauucuuuguuucaccaucucuagccugcccguuucccucacaaagcugaugcuuucuaacgcucuguuuguggaagccuucaucuuuuacaaucauacccacggaagagagaugcucgacauuuucgugcaccagcugcugguccucgugguuuuccugacgggccuuguggccuuucuggaauuucucguccggaacaaugugcugcuugagcugcuccgcagcucccugauucugcuccaagggucuugguuuuuccagaucggauuuguucuguauccucccagcggcggcccugcuugggaucuuauggaccaugagaacauucuguuccucaccaucugcuuuuguuggcacuacgccgugacaaucgucauuguggggaugaauuacgcuuucaucaccuggcuggugaaauccagacuuaagcggcugugcagcucugaagucggacuccugaaaaacgccgagcgcgaacaggaguccgaggaagagauguga

SEQ ID NO: 77015 - RNA, 546 nt, Artificial Sequence
  derived and/or modified sequence opt5 from TMEM47__Homo_sapiens__NP_113630
auggccagcgcuggcuccgggauggaggaagugagagucucuguucugacaccccucaagcuggugggacuugugugcaucuuccuggcccucugucuggaccuuggcgcgguccugagcccugcuugggugaccgccgaucaccaguacuaucucucccugugggagucuugccggaaaccggccagccuggacauuuggcauugugaauccacgcucucuagcgauuggcaaaucgcuacccuggcccuucugcucgggggagcugccauuauccugauugcguuucuuguuggccugaucuccaucugcguggggagccgcagacgguucuaccgccccgucgccgugaugcucuuugcugccguugugcugcaggucuguucucuggugcucuauccuauuaaguucaucgagacagugucccugaaaauuuaccacgaauuuaacuggggauauggccuugcuuggggcgccaccaucuucagcuuugggggagcgauucuguacugccucaaucccaagaacuaugaggacuacuacuga

SEQ ID NO: 77016 - RNA, 477 nt, Artificial Sequence
  derived and/or modified sequence opt5 from TMEM50B__Homo_sapiens__NP_006125
auggccggcuuccuggacaacuuuagauggcccgagugcgaauguaucgauuggagcgagcggcgcaaugcuguggccuccgucguugcggggauucucuucuuuaccggaugguggaucaugauugacgcugccgugguguacccuaagccggaacagcugaaccacgccuuccauacaugcggcgucuuuucuacgcuugcuuucuuuaugaucaaugccgugagcaacgcucaaguuagaggggauuccuaugagucuggaugucugggccggaccggggcccgcguguggcuguucauuggauuuaugcucauguucggcagccuuaucgcguccauguggauccuguuuggcgccuacgucacacagaauaccgacguguaucccgggcucgcuguuuucuuucagaacgcccugauuuucuucucuacacugaucuacaaauuuggaagaaccgaggaacucuggacauga

SEQ ID NO: 77017 - RNA, 774 nt, Artificial Sequence
  derived and/or modified sequence opt5 from TMEM55A__Homo_sapiens__NP_061180
auggccgcugacggcguggaugagagaagcccccugcucuccgccucucacagcgggaacgucaccccuacagcgccgcccuaccugcaggaauccucuccucgggcugagcuucccccucccuauacggccaucgccagcccugacgcuuccggcauuccgguuaucaauugccgcgugugucaaucucugauuaaccucgauggaaagcugcaucagcacguggucaaaugcaccguguguaaugaagccacacccaucaagaacccucccaccgggaaaaaguacguuagaugcccuuguaauugccuucugauuuguaaagacacaagccggcgcaucggaugccccagaccgaacugucggcgcaucauuaaucucggcccugugaugcugaucuccgaggaacagcccgcucagccugcccugcccauucaacccgaggggaccagagucgugugcggacauuguggcaacacauuccucuggauggagcugcgguuuaauacccuugcgaagugcccucacugcaagaaaaucagcucuguuggcuccgcccugccgcgcagacgguguugcgcuuauauuacgaucgggaugauuuguaucuucaucggagugggccucaccgucgggacacccgauuuugcccgcagauuccgggcuaccuacgugagcugggccauugcguaucugcuuggacugaucugccucauucgcgccuguuacuggggcgcuaucagagugucuuauccugaacauuccuuugccuga

SEQ ID NO: 77018 - RNA, 1464 nt, Artificial Sequence
  derived and/or modified sequence opt5 from TMEM57__Homo_sapiens__XP_011540006
augagacugcggaagcagaaagaggugcaaaaggaaaacgaguucuacaugcagcuccugcagcaggcccuucccccugaacaacagaugcugcagaaacaggagaaggaagcugaggaggccgcgaaaggccucccggacauggauagcuccauccugauucaccauaaugggggaauccccgcuaacaagaaacuuucuaccacacugccugaaauugaguaucgcgaaaagggcaaggagaaagacaaggaugccaaaaagcacaaucucgggaucaacaauaacaauauucugcaacccgucgacagcaagauccaggagaucgaauacauggagaaccauauuaauuccaaaagacugaacaaugaucucguuggaucuacggaaaaccugcuuaaggaggacagcugcaccgccuccucuaaaaauuauaagaacgcuagcggcguggucaauuccagcccucggucucacuccgccacaaacgggagcauccccucuuccagcucuaaaaacgaaaagaaacagaaguguaccuccaagagcccuuccacacauaaagaucugauggagaauugcauuccgaacaaucagcucucuaagcccgacgcucuggugcgccuugagcaagauaucaaaaagcugaaagccgaccuccaggcgagcagacagguggaacaagagcugcggucccagauuagcucucuguccagcaccgaacgcggaaucagaucugagaugggccagcuccggcaggaaaacgagcugcuucaaaauaagcugcacaacgccguucagaugaagcagaaagauaagcagaauauuagccaacucgagaaaaagcugaaagcugaacaggaggcccgcuccuuuguggaaaagcagcuuauggaggaaaagaaaagaaagaaacuggaggaggcuacagccgcgcgggccgucgcuuucgccgcugccucucgcggcgaauguaccgagacgcucagaaaccggauccgcgaacuggaggccgaggggaagaaacugaccauggacaugaaggugaaggaagaucagaucagagagcucgaacugaaaguucaagagcuucggaaguacaaagaaaaugagaaggacacagaggugcugaugagcgcucucuccgcgaugcaggacaaaacccagcaccuggaaaacagccuuucugccgagacaagaauuaagcuggaucucuuuuccgcucugggagacgccaaacgccagcuggaaaucgcccaaggccagauucuccagaaggaucaagagaucaaggaccugaaacagaagauugcugaagucauggccgugaugccuagcaucaccuauucugcggcuacgagcccccuuuccccugugucuccccauuacuccagcaaauucgucgagacauccccgucugggcuggauccuaaugccagcguuuaucagccccucaagaaauga

SEQ ID NO: 77019 - RNA, 1332 nt, Artificial Sequence
  derived and/or modified sequence opt5 from TMEM5__Homo_sapiens__NP_055069
augagacugacccggaagcgccucugcagcuuccugaucgcccuuuacugucuguuuucccucuaugcugccuaccacguguucuuuggcagacggcgccaggcgcccgcugggucuccuagaggacugcggaaaggcgccgccccggcucgcgagagacgggggcgcgaacaaagcacacuugaguccgaagaguggaaccccugggaaggagacgagaagaaugagcagcagcauagauucaaaacgucucugcagauucucgauaagagcaccaaaggcaagacagaccuguccguccaaaucugggggaaggccgcuauuggacuguaucucugggaacacaucuuugagggccugcuugauccuucugacguuaccgcccaguggcgggaaggcaaaagcauuguggggcgcacacaguacuccuucaucaccggacccgcggugaucccuggcuauuuuagcgucgaugugaacaauguugugcugauucucaacgggagagagaaggccaaaaucuucuacgcuacacaguggcugcuuuaugcccaaaaucugguccagauucagaagcuccagcaucuggcugugguucugcucggaaacgagcacugcgacaaugaauggaucaaccccuuucugaaacggaauggcggguucguggagcuucuguuuauuaucuacgauucuccuuggauuaacgacgucgauguguuccaauggccgcucggaguggccaccuaccgcaauuuucccgucguugaagcguccuggagcaugcugcaugacgagagaccuuaucuuuguaacuuccugggcacgaucuacgaaaauucuucccggcaggcccucaugaacauccugaagaaggauggcaaugacaaacugugcugggugagcgcuagagagcacuggcagccccaagagaccaacgaaucucucaagaacuaucaggaugcccugcuucaguccgaccugacacucuguccugugggggucaauaccgagugcuaccgcauuuaugaggcuuguagcuacggauccauccccgugguugaagacgugaugacagccggcaacugcgggaauaccucuguccaccauggagccccgcugcagcuucugaaaagcaugggcgcuccuuucauuuuuaucaagaacuggaaagaacuccccgcggugcuggagaaggagaaaacgauuauccugcaagaaaagaucgagcggagaaagaugcuccugcagugguaucagcacuucaaaacagaacuuaagaugaaauuuaccaauauucuggaguccagcuuccucaugaacaauaagucuuga

SEQ ID NO: 77020 - RNA, 402 nt, Artificial Sequence
  derived and/or modified sequence opt5 from TMEM60__Homo_sapiens__NP_116325
augagaaugagccuggcccagcgggugcuccugaccuggcuuuucacacugcucuuucugaucaugcuuguccugaagcucgacgagaaagcucccuggaacugguuccugauuuuuaucccuguuuggauuuucgauacgauccugcucgugcugcuuauugugaagauggccggccgcugcaaauccggguuugacccgagacacggaucucauaauaucaagaaaaaggcgugguaccugaucgcuaugcuccugaaacuugccuucugucuggcccucugcgcuaagcuggaacaauuuaccacaaugaaccugagcuaugucuucauuccccucugggcccugcuugcuggcgcccugaccgagcucggguacaauguguuuuucguucgggauuga

SEQ ID NO: 77021 - RNA, 1932 nt, Artificial Sequence
  derived and/or modified sequence opt5 from TMEM62__Homo_sapiens__NP_079232
auggccgcugugcuggcccucagagucguugcgggccuggcugccgccgcucuuguggccaugcugcucgagcacuacgggcuggcuggacagcccagcccucuuccgcggcccgccccuccccgcagaccucaucccgcgccuggcccgggggacuccaacaucuucuggggacugcaaauuucugauauccaccucagccgguuucgcgaccccggcagagccguggaucuggaaaaguucugcuccgagaccauugacaucauucagccugcucugguccucgccacaggggaucugacggacgcuaaaaccaaggaacagcuuggaucucggcagcaugagguggaauggcaaacauaucagggcauccugaaaaagacccgcguuauggagaaaacaaaguggcucgauaucaagggcaaucacgacgccuuuaacauucccagccuggauuccaucaaaaauuacuauagaaaguacucugcggugcggcgcgacgggagcuuccauuauguccacuccaccccuuuuggaaacuacagcuucauuuguguggaugccacaguuaaucccggcccgaaaagaccuuauaacuuuuucgggauccuugacaagaaaaagauggaggaacugcuccugcuggcuaaggagucuucccggagcaaucacaccauuugguuuggacauuucacgaccucuacaauccucucccccagcccuggcauucgcucuaucauguccagcgccaucgcuuaccugugcgggcaccuucauacccugggaggccucaugcccgugcugcacacaagacacuuucagggcacccuugaacuggaggucggggauuggaaagacaaccggcgcuacagaauuuucgccuuugaccaugaucucuucuccuucgccgaccugaucuuuggaaaguggcccguggugcugauuacgaauccuaaaucucuccuguauagcuguggcgagcacgaaccgcuugagcggcugcuccauuccacacacaucagaguccuggcuuucagccuuucuuccauuaccagcguuacagugaagaucgauggggugcaucugggacaggcgguccacgugucuggccccaucuuuguucucaaauggaacccucgcaauuacagcuccgggacccacaacauugaagugaucguccaagacucugccggacggagcaaguccgugcaucacauuuucagcguucaggagaauaaccaucugucuuuugauccccuggcuuccuucauccucagaaccgaccacuauauuauggcccgcgugcuguuuguccuuaucgugcugagccagcucacaauccugauuaucuuccgguacagaggcuauccugaacugaaagagcccucuggcuuuauuaaucuuacguccuucagccuccacguccuguccaagaucaacaucuuuuacuauucugugcugcuccugacccuuuacacaguucuggggccgugguucuuuggagagauuauugauggcaaguucgggugcuguuucagcuuuggaaucuucgugaacggccauuuucuccagggguccaucaccuucauuaucggcauucugcaacuggccuuuuucaauaucccucuuauggcuuacaugugcuggucucuccugcagcgcuguuuuggacacaacuuccggagccaucugcaccagagaaaauaucucaagauuaugcccguccaucugcuuaugcugcuccuguacaucuggcaaguguauuccugcuacuuucuguaugccacauacggcacccuugcguuccucuuuagcccucugcgcacguggcugacacuccugacccccguucuuauccgguauguguggacccucaauucuacaaaauucgggauuuuuaugguccagcugaagucccaccugagcucuuga

SEQ ID NO: 77022 - RNA, 2424 nt, Artificial Sequence
  derived and/or modified sequence opt5 from TMEM63A__Homo_sapiens__NP_055513
augauggacagccccuuccuggagcucuggcaguccaaggccgugucuaucagagaacaacugggccuuggggaucggccuaacgacagcuacugcuauaauuccgcuaaaaacucuaccguccugcagggaguuacauuuggcgggauuccgacggugcuccugaucgaugugagcuguuuccuuuuucugauucucgucuucuccaucauucgcagacgguuuugggacuacggacgcaucgcccuggugucugaggcggauagcgaauccagauuccagcggcugagcucuaccuccagcucuggccagcaagacuuugagaaugaacucgggugcugucccuggcugacagcuaucuuccgccuucacgaugaccagauucuggaguggugcggagaggaugccauccauuaucucuccuuucagagacacauuaucuuccugcuuguuguggucagcuuucugucucucugugugauucugccuguuaaccuguccggcgaccuccuggauaaggaccccuacagcuucggccggaccacaaucgccaaucuucagaccgauaacgaccugcucuggcugcauacaauuuuugcugugaucuaucuuuuccugaccgucggguucaugcgccaccauacgcaauccaucaaauacaaggaagagaaucucgugagacggacccuguuuauuacaggacugccucgcgacgccagaaaagaaaccguggagucucacuuccgggaugcuuaucccacaugcgaggucguugacgugcagcucuguuacaacguggccaagcugaucuaccuuugcaaggagaaaaagaaaaccgaaaagagccugacguauuacacaaaucuccaggucaaaaccggccagcgcacacugauuaacccuaagccgugugggcaauuuugcuguugcgaagugcuuggaugcgagugggaagaugcgaucuccuauuacaccagaaugaaggaccggcugcucgagagaauuaccgaggaagaacgccacguucaggaucagccccugggcauggccuucgugacauuucaagagaaaagcauggcuacguauauccugaaggacuucaaugccuguaaaugccagucucuccaguguaagggggagccucagcccuccagccauucucgggaacuguacaccagcaaauggacagucaccuuugcugccgauccugaggacaucugcuggaagaaccuuuccauucaaggacugagaugguggcuccaguggcugggcaucaauuucacacuguuucuuggccucuucuuucugaccacgcccucuauuauccugagcacaauggauaaauucaacgugaccaagccgauucacgcgcucaauaacccuaucaucucccaguuuuuccccacccugcuucuguggagcuucucugcccuccugccuuccauuguuuauuacagcacacugcuugagucucauuggaccaaguccggggaaaaccagaucaugaugacaaaaguguacauuuuucucaucuucaugguccugauucugcccagccucggacugacgucccuugacuuuuucuuucgcuggcuguucgauaagaccucuagcgaggcuuccauccggcucgaauguguguuucugcccgaccaaggcgccuucuuugucaauuaugugauugcuucugccuucaucgggaacggaauggagcugcuuagacucccuggccugauccuguacacauuucgcaugauuauggccaaaaccgcugcggaccggagaaauguuaagcagaaccaggccuuccaguaugaauuuggggcuauguacgccuggaugcucugcguguucacagucaucguggccuauagcauuaccuguccgaucauugcucccuucggacugaucuacauccuucugaaacacaugguugaucgccacaaucucuauuuuguguaccugccugccaagcuggagaagggcauucauuucgcggcugucaaccaagcccuugccgcucccauccucugccuguuuuggcuguacuucuuuuccuuccuccggcugggcaugaaagccccugcuacgcuuuuuaccuuccuggugcuccugcugacaauucuugugugucuggcccauaccugcuuuggguguuucaagcaccucagcccccugaauuauaaaacagaggaaccggcgucugacaagggauccgaggccgaagcucacaugccucccccuuuuacccccuacguuccuagaauccucaacggccuggccagcgagcgcacggcucuuucuccccagcagcagcaacagcagacauauggggccauucauaauaucuccggaaccaucccgggccaaugccuggcgcagagcgccacagggucugucgcugccgcuccucaggaggccuga

SEQ ID NO: 77023 - RNA, 2745 nt, Artificial Sequence
  derived and/or modified sequence opt5 from TMEM67__Homo_sapiens__NP_001135773
augagccugucccacuggcccuacuucagacucgugcugaacuuucggccucaggucaucugccuuccgcaacccccuaagguucugggcuaucgccucgagcccccucaucugacccuugccuguacacuggaagggauguacaauauuaucgaggaaauucucgagagagacaucaacggaacgcugcugucucaggcuaccugcgaacucugugauggcaaugagaacagcuucaugguggugaaugcccugggggaccggugcguccgcugugagcccacauuugugaacaccuccagaucuugcgcguguagcgaaccuaauauucuuacaggaggccugugcuucuccucuaccgggaacuuuccgcuccggcgcaucagcgcugccagauauggagagguuggcaugucccugacaagcgaaugguucgccaaauaccuucagucuuccgcugccgcuuguuggguguaugccaaucugaccagcugccaggcgcucggcaacaugugugucaugaauaugaacucuuacgauuuugccacguucgacgcuugcgggcuguuucaauucaucuuugagaauaccgccggacuguccacagugcacagcauuucuuucuggcggcagaaccuccccuggcuguuuuauggcgaucagcuugggcuggcuccucagguucucuccagcaccucccugcccacaaauuucucuuucaagggagagaaccaaaacaccaaacuuaaguuuguggccgcgagcuacgacauccgcggcaauuuccugaaauggcagacgcucgaagggggaguccugcagcugugcccugauacagagaccagacucaacgccgcuuacuccuuuggcacaaccuaucagcaaaauugugaaauucccaucagcaagauucugaucgacuucccgaccccuaucuuuuacgauguguaucuugaguacacagacgaaaaccagcaucaguauauucuggccgugcccguccucaaucugaaccuucaacacaauaagaucuucguuaaccaggauucuaauuccggcaaauggcugcucacgcggcgcauuuuucugguggacgcugugagcgggagagagaacgaucugggaacccagccucgggucauccgcguggccacacagauuucucucagcguucaucuggugcccaauaccaucaacggcaauauuuaucccccucuuaucacaaucgccuacuccgacauugacaucaaggaugcuaacucucaaagcgucaaaguguccuucagcguuaccuacgagauggaccacggggaagcgcacgugcagacggauauugcccugggaguccucggcgggcuggcugugcuggccucucuucucaagacagccggauggaaaagacggaucggcuccccgaugauugaccugcagaccgucgugaaguuucugguuuacuaugcuggcgaucucgccaauguguucuuuaucaucaccgucgggacaggacuguacuggcuuauuuucuuuaaggcgcagaaaagcgugucuguucugcuccccaugccuauccaagaggaaagauucgugaccuaugucggcugcgcuuucgcccugaaggcccugcaguuucuucauaaacucauuucccagaucacaauugacguguucuuuaucgauugggagcgccccaaggggaaagugcugaaggcuguugaaggagagggcgggguccggagcgccacggugccuguguccauuuggagaaccuacuucgucgcuaacgaguggaacgaaauccagacagugcgcaaaaucaauucucuguuucaaguucucaccgugcuguucuuucuugaggucgugggcuucaagaaccuggcccucauggacagcuccucuagccugucccggaaucccccgagcuauauugcgccuuacucuuguauccugagauaugccguuuccgcugcccuuuggcucgcuauuggaaucauucagguggucuuuuucgccguguuuuacgaacgcuucaucgaggauaagauccggcaguuuguugaccugugcagcaugucuaacauuuccguguuccugcucagccacaaauguuucggcuacuauauccaugggagaucuguccacggacacgcggauacaaauauggaagagaugaacaugaaucugaagcgcgaggccgaaaaccuuugcagccagcggggccuggugcccaauaccgacgggcaaacguuugagauugcuaucuccaaccagaugagacagcauuacgaccgcauucacgaaacccucauccggaaaaauggaccugccagacugcugucuagcuccgcuagcacauucgagcaauccaucaaggccuaucauaugaugaacaaauuucuuggcucuuucauugaucacgugcauaaggagauggacuacuuuaucaaggauaaacuccugcuggaacggauucucgggauggaguucauggaacccauggagaaaagcaucuuuuauaaugacgaaggcuacuccuucucuagcguccuguauuacggaaacgaggccacccuucugauuuuugaucuccuguucuuuuguguuguggaccuggcuugccagaauuucauccuugcguccuuccugacauaccuccagcaggagaucuuucgcuauauuagaaacaccgugggccaaaagaaccuggccucuaagacgcucgucgaucagcgguuccugaucuga

SEQ ID NO: 77024 - RNA, 324 nt, Artificial Sequence
  derived and/or modified sequence opt5 from TMEM70__Homo_sapiens__NP_001035703
augcuguuccucgcccugggcagccccugggcuguggagcuuccucugugcgggagacggaccgcccucugugcggcugccgcccugcgcggaccgagagcuuccgucucucgggccagcuccucuagcggccccuccgggccuguugcuggauggucuacaggccccagcggggccgcgcgccuucugagacggccuggacgcgcccagauccccguguacugggaaggcuaugugagauuucucaacacgccuuccgacaagagcgaggauggccggcugauuuacaccgggaauauggcucgcgccgucuucggaaaauga

SEQ ID NO: 77025 - RNA, 771 nt, Artificial Sequence
  derived and/or modified sequence opt5 from TMEM74B__Homo_sapiens__NP_001291677
augcccccugcccagggcuacgaguucgcugccgcgaaggggccgagagacgaacugggacccagcuuuccuauggcuucucccccuggccucgagcugaaaacccuuuccaacgggccccaagccccucggcgcagcgccccgcugggacccguggcuccuacaagagaaggcguggagaaugccugcuucuccucugaggaacacgagacgcauuuucagaaccccgggaauacccggcucggaagcuccccuucucccccgggcggcguuagcucccugccucgcagccagagagaugaccuuucucugcacuccgaagaggggcccgcucucgaaccugugagccggcccguggauuauggauucgucucugcccugguguuucugguuuccggcauccuccugguggucacagcguacgccauuccccgcgaggcuagagugaacccugacaccguuacagcccgggagauggaacgccuugagauguauuacgcuagacuggggagccaucucgaucgguguaucauugccggacugggccuucugaccgucgggggaaugcuccugucugugcugcucauggugucccugugcaagggcgaacuuuaucgcagacggacauucgugccgggcaaagggagccgcaagaccuacggauccaucaaucugagaaugcggcagcucaacggcgacgggggacaagcgcuggucgagaaugaaguuguccaggugucugagacgagccacacccuucagagauccuga

SEQ ID NO: 77026 - RNA, 1185 nt, Artificial Sequence
  derived and/or modified sequence opt5 from TMEM79__Homo_sapiens__NP_115699
augaccgagcaggaaacacuggcccuccuggaggugaagagaagcgacucccccgaaaaaucuagcccucaagcucuugucccgaacggccggcagcccgagggggaaggaggcgccgaguccccuggggcggagucucugcgcguuggaagcuccgcuggcucucccacggccaucgaaggggccgaggauggacucgacagcaccguguccgaagcugccacacugccuuggggcaccggcccccagccuagcgcuccguuccccgauccucccggguggagagacauugagccugagcccccggaaucugagccucuuacaaagcuggaggaacuccccgaagaugacgccaaucugcugccugagaaagcggcccgggcuuuugugcccaucgaucuccagugcauugagcgccaaccccaggaagaccugaucgucagaugugaggccggagaaggcgagugccggaccuucaugccuccgcgcgugacacaccccgauccuaccgaaagaaagugggcugaggccguugugcggcccccuggguguuccugcggaggcugugggagcugcggagaccgcgaguggcuuagagcggucgccucugugggcgcugcccugauucucuuucccugucugcuuuacggcgcuuaugccuuccugccguuugauguuccucggcuccccacgauguccagccgccugaucuacacccugagaugcgggguguucgccacauuuccuaucguccucggcauucugguguauggacuuucucugcucuguuucuccgcucugcggcccuuuggggaaccucgcagagagguggaaauccaucggagauacgucgcgcagagcguucagcuuuucauucuguacuuuuucaaccucgccgugcuguccaccuaucugccccaagacacacucaaacugcuuccgcugcucaccggacuguuugcugugucucgccuuaucuauuggcugacguucgccgucggccggagcuucagaggguuuggauacggccucacauuccugccucugcucuccaugcugauguggaaucuuuacuauauguuugugguugagcccgaacgcaugcugaccgccacagagagccggcucgauuaccccgaccacgcuagaucugccuccgacuaucgcccucggccguggggcuga

SEQ ID NO: 77027 - RNA, 546 nt, Artificial Sequence
  derived and/or modified sequence opt5 from TMEM87A__Homo_sapiens__NP_001103973
auggccgcugccgcguggcuccaggugcugcccgucauccugcuucugcucggcgcucacccuagcccgcuguccuucuuuucugccgggcccgccaccguugcugccgcugacagaagcaaguggcauauuccuauccccuccggaaagaacuacuucucuuuuggcaagauucuuuuccggaauacaacgaucuuucugaaauucgauggggagccuugcgaccucagccugaacauuaccugguaucugaaguccgccgauuguuacaaugaaaucuauaacuuuaaagcggaggaaguggagcucuaccuggaaaaacuuaaggagaaacgcggacugucuggcaaguaucaaacaagcuccaaacucuuccagaauugcagcgagcuguuuaagacccagacauucucuggggacuuuaugcacagacuuccccugcucggagaaaaacaggaggccaaggaaaacggcaccaaucugacauucaucggcgauaagaccauucaaaugccuuuucugaaaaagcauuuccucgacuguuga

SEQ ID NO: 77028 - RNA, 480 nt, Artificial Sequence
  derived and/or modified sequence opt5 from TMEM88__Homo_sapiens__NP_981956
auggccgacgugcccggcgcucagagagccgucccuggggauggaccggagccccgggacccucuggauugcugggcgugugcuguucucgugaccgcccaaaaccugcuuguggccgcuuucaaucugcuccugcuuguccuggugcucggcacaauccugcugcccgccguuacgaugcucggguuuggauuccugugccacagccaguuucuucgcucccaggcuccucccuguaccgcccaucugagagacccuggcuucacagcgcuccuggugaccggguuucuucugcucgucccgcugcuggugcucgcccuggcuucuuaccggcgccuuugccugagacuccggcuggccgauugucuuguucccuauagccgcgcucuguacagacggcgcagagccccucagccccggcaaauucgcgcguccccuggaucucaggccgugcccacaagcggcaaggucuggguguga

SEQ ID NO: 77029 - RNA, 480 nt, Artificial Sequence
  derived and/or modified sequence opt5 from TMEM89__Homo_sapiens__NP_001008270
augcugcacgugcucgccagccugccccuucugcuccugcuugucaccuccgcuucuacacacgccuggagcagaccucugugguaccagguuggccucgaccugcaaccgugggggugccagcccaaguccguggagggaugucggggcgggcugucuugcccuggauauuggcucggccccggggcgagccgcaucuacccuguggcugccgucaugauuacgaccacaaugcugaugaucuguagaaaaauucuucagggacggcgcagaucccaggccaccaagggcgaacacccccaagugacaaccgagccuugcggcccguggaaacggcgcgcucccaucucugaucauacacugcucagagggguucugcacaugcuugacgcccugcucgugcauauugaaggacaucugcggcaccuggcuacccagcgccagauccagaucaagggcacgagcacccaauccggguga

SEQ ID NO: 77030 - RNA, 1419 nt, Artificial Sequence
  derived and/or modified sequence opt5 from TMEM8B__Homo_sapiens__NP_001036055
augaacaugccccagagccugggcaaucaaccucucccgcccgagccucccucccuggggaccccugccgaaggacccggcacaacgucuccuccggagcacugcuggcccgugagaccuacccuucggaacgaacuggacacauucagcguccauuuuuacaucuucuuugggcccuccguugcucucccucccgagcgcccggccguguucgcgaugagacugcuuccugugcuggauucuggaggcguccucagccuggaacugcagcucaaugcuuccucugugcggcaggagaacguuaccguguuugggugucugacacacgaggucccccuuagccugggagacgccgccgugaccugcuccaaggaaagccucgcuggcuuccugcuuucuguuuccgccacaacccgcguggcuagacugcggauuccuuuuccccagacgggcaccugguuccucgcccugcgcagccuguguggggucggacccagauuugugcggugccgcaaugcgacagccgaggugagaaugcggaccuuccucucuccuugugucgaugacugcggcccguaugggcaauguaaacugcuucgcacacauaacuaccuguaugcugccugcgaauguaaggcuggauggagaggcugggggugcaccgauuccgccgacgcgcucacguacggauuucagcugcuuagcacacugcuccugugucugucuaaucucauguuccugcccccuguugugcuugccauccggucccgcuaugugcuggaggcugccgucuacaccuuuacaauguucuucagcaccuuuuaucacgcuugcgaucagcccggcauugugguuuucugcaucauggacuacgaugugcuccaguuuugugacuuccugggcucccuuaugucugucugggugaccguuauugccauggccagacugcaaccuguggucaaacaggugcucuaccugcugggggcuaugcuccugagcauggcgcuucagcuggaucggcauggacucuggaaccugcugggccccucccuuuuugcccucgggauccuggcuacagccuggacggucagaagcgugcgccggagacacugcuauccgccuaccuggcgccgguggcuguucuaccucugucccggaucucugaucgccggcuccgcuguucuucuguaugccuuuguggagacaagagacaauuacuucuauauucacagcaucuggcauaugcucauugcggggucugucggauuucugcugccuccccgcgcuaagaccgaucacggcgugccuagcggcgcccgggccagagggugcggauaccagcuuuguaucaacgaacaagaggaacucggccugguugggcccggaggcgcuacaguguccucuauuugcgccagcuga

SEQ ID NO: 77031 - RNA, 531 nt, Artificial Sequence
  derived and/or modified sequence opt5 from TMEM95__Homo_sapiens__NP_001307365
auguggagacuggcccucggcgggguguuccuggcugccgcgcaggcuugcgucuuuugucggcuucccgcccacgaccugagcggacgccucgccagacugugcucccaaauggaggcucggcagaaggaauguggcgccucuccugauuucagcgcuuuugcccuugacgagguuuccaugaacaaagugaccgaaaagacacaucgcgugcugagagucauggagaucaaagaagcggugucuagccucccguccuacuggucuuggcugcggaagacgaaacugcccgaguauacccgcgaggcccucugcccucccgcuuguagagggagcacaacccuguacaauugcuccacauguaagggaaccgaaguuagcugcuggccucggaagcgcuguuuccccggcucucaggaucuuugggaggccaaaauucugcuccuguccaucuuuggggcuuuccuucugcucggagugcugagccugcucgucgaaucucaccaucugcaggccaaguccggccuuuga

SEQ ID NO: 77032 - RNA, 531 nt, Artificial Sequence
  derived and/or modified sequence opt5 from TMEM97__Homo_sapiens__NP_055388
augggcgcccccgcuaccagacggugcguggaguggcugcucgggcuguacuuccuuagccacaucccuauuacacuguuuauggaccuccaggccguccugccgcgcgaacuuuaucccguugaguucagaaaccugcucaagugguacgcgaaagaauuuaaggauccucugcugcaagagcccccugcuugguucaaauccuuucucuucugugaacugguguuucagcuucccuucuuuccuaucgccacguaugccuuccugaagggaucuugcaaauggauucggaccccggcuaucauuuacagcgugcauacaaugaccacacucauccccauccuguccaccuuucuuuucgaggacuuuucuaaggccagcggcuucaaggggcagcgcccugagacacugcacgaaagacucacccuggucuccguguaugcucccuaccugcucauuccuuucauccugcuuauuuuuaugcugcggucucccuauuacaaauacgaggaaaagcgcaaaaagaaauga

SEQ ID NO: 77033 - RNA, 681 nt, Artificial Sequence
  derived and/or modified sequence opt5 from TMEM98__Homo_sapiens__NP_001288675
auggagaccguggucaucguugccauuggcgugcuggcuacaaucuuccucgccagcuuugcggcucuggugcuugucugcagacagcgguacugucgccccagagaccugcuccaacgguacgauuccaagccuauuguggaccugaucggggccauggaaacgcagucugagccgagcgaacuugagcuggaugacguugugauuaccaacccccacaucgaagccauccucgagaaugaggauuggauugaagacgcuuccggacugaugucucauugcaucgccauucugaaaaucugucacacacucaccgagaagcuggucgcuaugacaaugggcagcggggccaaaaugaagaccuccgcgucugugagcgauauuaucguuguggccaaacgcauuuccccuagagucgacgauguggucaagagcauguaucccccucuugaccccaagcugcucgaugcucggacaaccgcccugcuucugucugugucccaucucguucuggugacgcgcaacgcuugccaccugaccggaggccucgacuggaucgaucagagccugucugccgcggaggaacaucuugaggugcugagagaagccgcucucgccuccgagccugacaaagggcugccgggacccgaaggcuuccuucaggagcaaagcgcuaucuga

SEQ ID NO: 77034 - RNA, 3282 nt, Artificial Sequence
  derived and/or modified sequence opt5 from TMF1__Homo_sapiens__NP_009045
augagcugguucaacgccucccagcugucuagcuuugcuaagcaagcccucucccaggcgcagaaaucuaucgacagagugcuggauauucaggaggaagaacccagcaucugggcugaaaccauuccuuacggcgagccggggaucuccucucccgucagcggaggcugggacacauccacgugggggcuuaagagcaauaccgaaccucaaucucccccuauugccucccccaaagccaucacaaagccuguucggcgcaccgugguggaugagagcgagaacuucuuuucugcuuuccuguccccgacagacguccagaccauccagaaaagccccgugguuucuaagccucccgccaagucccagagaccugaagaggaagugaaaagcucccuccacgagucucugcauauuggacaaagccggacacccgagaccacggaaucccaggucaaggauagcucucuuugcguguccggcgagacccuggcugccgggacaagcucuccgaaaaccgaaggaaagcacgaggaaacaguuaauaaagagagcgacaugaaggugccuaccgucucccucaaggugucugagagcgugaucgaugucaaaacgacaauggaauccauuagcaacaccucuacacagucccugaccgcggagaccaaggacaucgcccuggaacccaaagagcagaagcaugaagaucgccaaagcaauacaccuucuccucccguuuccacguuuagcuccggcaccucuacaaccagcgacauugaggugcucgaucacgaguccgugaucucugaaagcuccgcuagcucuagacaggagacaaccgacuccaaaagcucucugcaucuuaugcagacguccuuccaacugcucagcgccucugcuugucccgaauauaaccggcuggaugacuuucagaaacuuacagagagcugcuguuccagcgacgccuucgaacgcauugauucuuuuuccguccagagccuggacuccagaucugugagcgagaucaauuccgaugacgagcucucuggcaaaggguacgcgcugguuccgaucauugugaacagcuccacccccaagucuaagaccgucgaaagcgccgagggaaaauccgaagaggugaaugagacacugguuaucccuaccgaagaggcugaaauggaggaaagcggccggucugccacacccgugaacugcgagcagccugauauucucgucuccagcacgcccaucaaugaggggcaaaccgugcuggacaaggucgcugaacagugugagccggccgaaucucagccugaggcccuuuccgaaaaagaggaugugugcaagacaguugaguuccugaacgaaaaacucgagaagcgcgaagcucagcugcuuagccugucuaaggagaaagcgcuccuggaagaggccuuugacaaucugaaggaugagauguucagagugaaagaagaguccagcuccauuagcucucucaaggacgaauuuacccaacggaucgcugaggccgagaaaaagguccagcuggccuguaaggaacgcgaugcugccaaaaaggagaucaaaaacauuaaggaagaacuugcgacaagacugaauagcuccgaaaccgcugaccuccugaaagagaaggacgagcagauccggggacuuauggaagagggcgaaaagcugucuaaacagcaacuccacaacagcaacauuaucaagaaacugcgcgccaaggauaaagagaaugaaaacaugguggccaagcugaauaaaaagguuaaggagcucgaggaggagcugcagcaccuuaaacaggugcuggacgggaaggaagaggucgaaaaacagcauagagagaacauuaagaaacucaauuccaugguggagcggcaagaaaaggaucugggaagacuucagguggacauggaugagcuggaagagaagaaccgcucuauccaggcugcccucgacagcgcuuauaaagagcugacggaucugcacaaggccaaugcggccaaagacuccgaagcucaagaggccgcucucucucgggaaaugaaggccaaagaggaacugagcgcggcccuugagaaggcucaggaggaagccagacagcagcaagagacccuggcuauccagguuggcgaucuccgccuggcccugcagcggacagaacaggccgcugcgagaaaggaggacuaccuucgccaugaaauuggcgagcuccaacagcggcugcaggaggccgaaaacagaaaucaggagcugucccaaagcgucucuuccaccacacgcccccuccugcggcagaucgaaaaccuucaggcuacccuggggagccaaacgucuuccugggagaaacucgaaaagaaucugagcgauagacugggagagucccagacacuucucgccgccgcuguggagcgcgaacgggccgcgaccgaggaacugcuggcuaacaaaauucagaugucuagcauggagucccagaauagccuccugagacaagagaacucucgguuccaggcccagcuugaauccgagaagaaucgccugugcaaacucgaagacgagaacaacagauaucagguggaacuggagaaucugaaggaugaguacguccggacacuugaagagaccagaaaggaaaagacccuccugaacagccaacuggagauggaacgcaugaagguggagcaggagcggaaaaaggccaucuucacacaggaaacgauuaaagagaaggaaagaaaaccuuuuucuguuagcuccacccccacaaugucucgcagcuccucuaucagcggcguggacauggcugggcuccagaccuccuuccugagccaagacgagucucacgaucacuccuuuggaccuaugcccauuagcgccaauggcuccaaccuuuaugacgcggucagaaugggggcuggaucuagcaucaucgaaaaucugcagucccagcucaagcugcgggagggcgagauuacacaucugcagcuugaaaucggcaaccuggagaagacccgcucuauuauggccgaggagcucgugaaacugacgaaucaaaacgaugagcucgaagagaagguuaaagaaaucccgaagcugagaacacagcuucgggaccuggaucagcgcuacaauaccauucuccaaauguacggggagaaagccgaagaggcugaggaacugagacuggaccuugaggaugugaagaacauguauaagacccagaucgacgaacugcuccggcagagccuguccuga

SEQ ID NO: 77035 - RNA, 471 nt, Artificial Sequence
  derived and/or modified sequence opt5 from TMIE__Homo_sapiens__NP_671729
auggccggcuggcccggggcuggaccucugugcgugcucggcggggccgcgcugggagucugucuugcuggcguugccgggcagcugguggagccgagcaccgcucccccuaagcccaaaccucccccucucacaaaggaaacgguggucuucugggacaugagacuguggcacgugguuggaaucuuuucccuuuucgugcugucuauuaucauuacccucugcugugucuuuaacugccgggugccgcgcacaagaaaagagaucgaagcccgguaccugcaacgcaaggccgcuaaaauguauaccgauaagcuggagacaguucccccucucaaugaacugaccgaggugcccggcgaggacaagaaaaagaaaaagaaaaagaagaaagauagcgucgacacaguggccauuaagguggaagaggaugagaaaaacgaagcgaagaaaaagaaaggcgagaaguga

SEQ ID NO: 77036 - RNA, 849 nt, Artificial Sequence
  derived and/or modified sequence opt5 from TMIGD2__Homo_sapiens__NP_653216
augggcagccccgggauggugcugggacuccugguccagaucugggcccuucaagaggcuuccucucugagcguucagcagggcccuaaccuccuucaggugagacaagggucccaggccacccuggugugccaggucgaccaggcgacagcuugggaacggcugcgcgugaaguggacgaaagauggagccauucucugucaaccguacaucaccaauggcucucugagccuggggguuugcggaccccagggcagacucuccuggcaggccccuucucaccugacacuucagcuggaccccgugagccucaaccauuccggcgcuuaugucuguugggccgcuguggagauuccugaacuggaggaagccgaggggaauaucacccggcuuuucguugaucccgacgauccuacacaaaaccgcaauagaauugcgagcuuuccgggauuccuguuugugcuccugggcgucgggucuaugggaguggccgcuaucguguggggcgccugguucugggggcggcgcuccugccagcagagagacagcggaaacucucccggcaaugcuuuuuacuccaacguccuguaucggccucgcggcgcccccaagaaaagcgaggauuguucuggggaaggaaaggaccaaagaggccaguccaucuacagcaccuccuucccucagcccgcgccgcggcagccucaccucgccucucgccccugcccuagccccagacccuguccuuccccgcggcccgggcauccuguuagcauggugcgcgugucucccagaccuucccccacacaacagccgcggccuaaaggauuucccaaggucggcgaggaauga

SEQ ID NO: 77037 - RNA, 537 nt, Artificial Sequence
  derived and/or modified sequence opt5 from TMIGD3__Homo_sapiens__NP_001289609
auggagggcagccccgccgggccuaucgaacagaaggaggcuagaugggaauccucuugggaggaacaaccggacuggacccugggaugccucagccccgagucccacacaaaccauguggcccugcgggauacgggcaaucagcuuauugucaccaugucuugucugacaaaagaggacaccgggugguacuggugcggaauccagcgcgauuucgcgagagacgauauggacuuuacagaacucauuguuaccgaugacaagggcacacuggcuaacgauuucuggagcgggaaagaccuuuccggaaauaagacccggucuuguaaagccccuaagguggugcgcaaggccgauagaagccggacguccauccugauuaucugcauccucauuaccggccugggcaucauuagcgucaucucucaccugacaaaacgcagacggucccagcgcaacagacggguggggaauacccucaagcccuuuagccgcguucugacaccuaaagagauggcucccaccgaacaaauguga

SEQ ID NO: 77038 - RNA, 1131 nt, Artificial Sequence
  derived and/or modified sequence opt5 from TMLHE__Homo_sapiens__NP_001171726
augugguaccacagacugagccaucuccacucccggcugcaggaccuucugaagggcggggugaucuaucccgcccucccucaaccgaacuucaaaucucugcuuccccuggcuguccauuggcaccauaccgccagcaagucccucacaugcgcguggcagcagcacgaggaucacuuugaacugaaauacgcuaauacgguuaugcgcuucgacuauguguggcugagagaucauugucggucugccagcugcuacaacuccaagacccaccagcgcucucucgacacagccagcguggaucuguguauuaaaccuaagaccaucagacuugacgagacaacccuguuuuucacauggcccgauggacaugucaccaaguaugaccucaauuggcuggugaaaaacuccuacgaaggccaaaagcagaaaguuauucagccucggauccuuuggaaugcugagauuuaucagcaagcccaggugcccagcgucgauugccagucuuuucuggaaacgaacgaggggcucaagaaauuccugcagaauuuucugcucuacggaaucgcuuucguggagaacguuccuccgacccaagaacacacagagaagcuggccgaacgcaucucccuuauuagagagaccaucuacggccggaugugguauuuuacaagcgacuucucucgcggggauaccgcguacacgaagcuggcccucgacagacacacagauaccacauauuuucaggagcccuguggcauucagguguuccauugccugaaacacgaaggaaccggcgggcggacccuucuggucgacggauuuuacgcugccgagcaagugcuccagaaggcuccugaagaguucgaacugcuguccaaagugccccucaagcaugaguauaucgaggacgucggcgaaugucacaaucauaugauugggaucggaccuguucugaacauuuaccccuggaauaaagagcuuuaucugauccgccucuucaaggaaaaacagaacacagugaauagacaguggaacagcucucugcaaugcgauaucccggagcggauucuuacguaccgccacuuuguguccggcaccagcaucgaacacagagggucccugauuuga

SEQ ID NO: 77039 - RNA, 1080 nt, Artificial Sequence
  derived and/or modified sequence opt5 from TMOD1__Homo_sapiens__NP_001159588
augagcuacagacgggagcuggaaaaguaucgcgaccucgaugaggacgaaauccugggcgcccuuaccgaggaagaacugagaacacucgagaacgaacuggaugagcuugaccccgauaaugcucugcucccugccgggcugcggcagaaagaccaaacgaccaaggcgccgacaggacccuucaaacgcgaggagcugcucgaucaccuggagaagcaggcuaaagaauuuaaggacagagaggaucuugugccuuacaccggcgaaaagcgggggaaagucuggguucccaagcagaaaccucuggaccccgugcucgaguccgugacacuggaaccugagcuugaggaagcccuggccaacgcuucugaugccgagcucugcgacauugcugccauccugggaaugcauacccugaugagcaaucagcaauauuaccaggcgcucuccucuagcuccauuaugaacaaggaaggccuuaauucugucaucaaaccgacacaguauaagcccgugccugaugaggaacccaacagcaccgacguugaggagacgcuugaacgcauuaagaauaacgacccuaaacuggaggaagugaaucucaacaauaucagaaacauccccauuccgacccugaaggccuacgcugaggcccuuaaagaaaauuccuaugucaagaaauucagcaucguggggacacggucuaacgauccuguugcuuacgcccuggcggagaugcucaaggagaauaaagugcugaagacccugaacgucgaauccaacuuuauuagcggagccggcauccuccgccugguggaggcucugcccuacaauacaucucugguggaaaugaagauugacaaccagucccaaccucucggcaauaaagucgagauggagaucguuagcaugcuggaaaagaacgccacccuucugaaauucggguaucacuuuacgcagcagggacccagacuccgggcuucuaaugccaugaugaacaauaacgaucuggugcgcaagagacggcuggccgaccucacaggccccauuaucccuaaaugucgcuccgggguguga

SEQ ID NO: 77040 - RNA, 948 nt, Artificial Sequence
  derived and/or modified sequence opt5 from TMOD2__Homo_sapiens__NP_001136357
auggcccugcccuuccagaaggagcucgaaaaauacaagaacaucgacgaggaugaacugcuuggcaaacugagcgaggaggaacucaagcaacuggagaaugugcuugacgaucuggacccugaauccgcuaugcucccggccggguuuagacagaaagaucagacccagaaggcggcuacaggacccuucgaccgggagcaucugcugauguaucucgaaaaggaggcccuggagcaaaaagaucgcgaagacuuugucccuuucacgggcgagaagaaagggagaguuuuuauucccaaggaaaaaccuaucgagacccggaaggaagagaaggugacacuugaucccgagcuggaagaggcccucgcuucugccagcgacaccgaacuguacgaucuugcugccgugcugggaguccacaaccuccugaauaacccuaaauucgacgaggaaacagcgaauaacaagggcgggaaaggaccggugcgcaauguugugaagggcgagaaagucaagcccguguuugaggaaccucccaacccuaccaauguugagauuucccugcagcagaugaaagccaacgaucccucucuccaggaagugaaucugaacaauaucaaggcuuucgccgacaugcuuaaggucaacaaaacacugaccagccucaauauugaguccaacuuuaucacgggcaccgggauccuggcucuuguggaagcccugaaggagaacgacacacucaccgagauuaaaaucgauaaucaaagacagcagcugggaacagcgguggaaauggagauugcccagaugcuggaagagaacucucggauccucaaguucggcuaucaauuuaccaaacaggggccgcgcacgagagucgcugccgcuauuacaaagaauaacgaccugguucggaagaaacgcguggaggccgauagacgguga

SEQ ID NO: 77041 - RNA, 1059 nt, Artificial Sequence
  derived and/or modified sequence opt5 from TMOD3__Homo_sapiens__NP_055362
auggcccugcccuucagaaaggaccucgagaaauacaaggaucuggacgaagaugagcuucugggcaaccucagcgaaaccgagcugaaacagcuugaaacagugcuggacgaucucgacccugagaaugcucugcugccggccggguuucggcaaaagaaccagacguccaaaucuaccacaggacccuucgaucgcgagcaccuccugagcuaucuugaaaaggaggcgcuggaacauaaggacagagaggauuacgucccuuauaccggcgagaaaaaggggaaaaucuuuauucccaagcagaaaccuguucagacauucaccgaagagaaggugucccucgaccccgaacuggaggaagcucuuacaucugccagcgauaccgagcugugcgaccucgccgcuauccugggaaugcacaaucugauuacgaacaccaaguuuuguaauaucaugggcuccucuaacgggguggaucaagagcauuucagcaaugucgugaaaggagaaaagauucucccuguuuuugacgagccgcccaacccuacaaauguggaagagucccugaaacggaccaaggaaaacgacgcccaccuugucgaggugaaucugaacaauaucaaaaacauccccauuccuacacucaaggauuucgcuaaagcccuggagaccaauacgcauguuaagugcuuuagccuugcggccacacgcucuaacgaccccguggcuaccgccuucgcugaaaugcugaaggucaacaaaacacucaagucccugaauguggagagcaacuuuaucaccggcgugggcauucuggcccucaucgaugcgcugagagacaaugaaacccuugccgagcugaaaauugauaaccagcggcagcagcucgggacagcugucgaacuggagauggccaagaugcuugaggaaaauacgaacauccugaaauucggauaccaauuuacccagcagggcccgcgcacaagagcugccaaugccauuaccaagaacaaugaccucguucggaagcgcagaguggagggggaucaccaguga

SEQ ID NO: 77042 - RNA, 1038 nt, Artificial Sequence
  derived and/or modified sequence opt5 from TMOD4__Homo_sapiens__NP_037485
augagcuccuaccagaaggagcuggaaaaauauagagacaucgaugaggacgaaauucuccggacccugucucccgaggaacuugagcaacuggauugcgagcuccaggaaauggacccugagaacaugcugcuuccggccggccugcgccagagagaucagacaaagaaaagccccacggggccucucgaccgggaagcucugcugcaauaccucgagcagcaggcccuggaggugaaggaacgcgaugaccuuguccccuucaccggagagaaaaagggcaagccuuauauccagcccaaaagagaaauuccugcggaggaacaaaucacacuggagccggagcucgaagaggcucuggcccacgccaccgaugcugaaaugugugacauugccgcuauccuugauauguacacacugauguccaauaagcaguauuacgacgcccucugcucuggggagaucuguaacaccgaaggaauuagcuccguugugcagcccgauaaauauaagccugugcccgacgagccucccaauccgacaaacaucgaggaaauucugaaacggguccgcucuaaugacaaggagcuggaagaggugaaccucaauaacauccaggauauuccuauccccaugcugagcgaacuuugcgaggcgaugaaggccaauaccuacguuagauccuuuagccugguggcuacgcggucuggcgacccuauugccaacgcugucgccgauaugcuccgcgagaauagaucccugcaaagccuuaacaucgaaucuaauuucaucuccagcaccgggcugauggcggugcucaaagccguucgggagaacgcuacacugaccgaacugcgcguggacaaucagagacaguggcccggagaugccgucgagauggagauggcuacagugcucgaacaaugucccucuauugugcgguuuggcuaccauuucacccagcagggcccucgcgccagagccgcucaggcgaugacgcggaacaacgagcugagacgccaacagaagaaacgguga

SEQ ID NO: 77043 - RNA, 1365 nt, Artificial Sequence
  derived and/or modified sequence opt5 from TMPO__Homo_sapiens__NP_001027454
augcccgaguuccuggaagacccuagcgugcucaccaaggauaaacugaaguccgagcuugucgccaacaauguuacacugccggcuggcgaacagagaaaagacguguacgugcaacucuaucugcagcaccuuacggcccggaacagacccccucugcccgcggggaccaauucuaagggaccucccgauuuuagcuccgacgaggaacgcgagccuacaccgguccucggcucuggggcugccgccgcuggacggagccgcgccgcugugggcagaaaagccaccaagaagacagauaaaccccggcaggaggacaaggaugaccuggauguuaccgaacugacaaacgaggaccuccuggaucagcuugugaaauacggggucaauccuggacccaucgugggcaccacgcgcaagcuguaugagaaaaagcuccugaagcugagagagcaaggcaccgagucccggucuagcacaccucugcccaccauuuccagcucugcggaaaacacacgccagaauggguccaacgacagcgauagauacucugacaaugaggaagacuccaaaaucgagcucaagcuggaaaaacgggagccgcugaagggacgcgccaaaaccccuguuacgcucaagcagagacggguggagcauaaccagagcuauucucaagcuggcauuacagaaaccgaguggacauccgggagcuccaaaggaggcccccugcaggcccuuacccgcgaaucuaccagagggagccggagaacaccucgcaagcgggucgagacguccgaacacuucagaaucgauggacccgugauuagcgagucuacccccaucgcugagacaaucauggccuccagcaaugaaucucugguggucaaccgcguuaccggcaauuuuaagcaugcgagcccuauucucccgaucacagaguucuccgacauuccccggagagccccuaaaaagccccugacccgcgcugaagugggcgagaaaacggaagaacggagaguggagcgcgauauccuuaaggaaauguuuccuuacgaggccucuacacccaccgggauuagcgcuuccugccggagaccgaucaaaggagccgccggccgcccucuggaacucagcgacuuccggauggaggagucuuuuuccagcaaguauguccccaaguacgugccucuggcugauguuaaaucugaaaagaccaaaaaggggagauccauucccguguggaucaaaauccuucucuucgucgugguugcgguguuucuguuccuugucuaccaggccauggagacaaaccaggugaauccuuuuagcaacuuccugcacgucgacccccggaaguccaacuga

SEQ ID NO: 77044 - RNA, 1257 nt, Artificial Sequence
  derived and/or modified sequence opt5 from TMPRSS11A__Homo_sapiens__NP_001107859
augauguacagaaccgugggcuucgggacacggagccgcaaccugaagcccuggaugaucgccguccucauuguucugucccuuacggugguggcugucaccaucggacugcucgugcacuuucugguuuucgaccagaaaaaggaguauuaccauggcucuuuuaaaauucuugauccucaaaucaauaacaauuucgggcagagcaacacauaucagcugaaggaccucagagaaaccacagagaaucugguggaugaaauuuuuaucgacuccgccuggaaaaagaacuacaucaagaaucaggucgugcggcugaccccggaggaagauggaguuaaaguggacgucauuaugguguuccaauuucccucuacagagcagcgcgcggugagagagaagaaaauccagagcauucucaaccagaagauccggaaucugcgcgcccuuccuauuaacgcuuccucuguccaaguuaaugccaugagcuccagcaccggcgaacugacggugcaggcuucuugcgggaaaagaguggucccccucaacgugaaucggaucgccuccggaguuauugcuccuaaggccgcguggcccuggcaggccagccugcaguaugauaacauccaccaauguggcgcuacccuuaucucuaauacauggcuggugaccgccgcucauugcuuccagaaguacaaaaacccucaccaguggacagucuccuuuggcaccaagauuaacccgccccucaugaaacgcaaugugagacgguucaucauucaugagaaguaucgcagcgccgcgagagaauacgacaucgccguugugcaagucucuucccgggugacguuuagcgaugacauucgccagaucugucugccugaggcuuccgccucuuuccagcccaaccugacaguccacaucaccggguuuggagcucucuacuauggcggggagagccagaaugaucugagagaagcccgggugaaaauuaucuccgacgauguuugcaagcaaccucagguguacggaaacgacauuaaacccggcauguucugugccggguauauggagggaaucuacgacgcuugcagaggcgauagcggcgggccgcuugucacacgcgaccugaaggauaccugguaucucauuggaaucgugucuuggggcgacaauugugggcagaaggauaaaccuggaguuuacacccaggugacauauuaccggaacuggaucgcguccaagacgggcauuuga

SEQ ID NO: 77045 - RNA, 1251 nt, Artificial Sequence
  derived and/or modified sequence opt5 from TMPRSS11B__Homo_sapiens__NP_872308
auguacagacacggcaucagcucccagcggucuuggccccuguggaccacaauuuucaucuuucucgggguggccgcuauucugggagucacgaucggccuucugguucauuuccucgccguggagaagaccuauuacuaucaaggggacuuucacauuagcggagugacauacaacgauaauugcgaaaacgcggcuucccaggccucuaccaaucugagcaaagacaucgagacaaagaugcuuaacgccuuccaaaauuccucuaucuauaaagaauacgucaagagcgaggugauuaaacugcucccuaacgcuaauggcuccaacguucagcugcagcugaaguuuaaguucccgcccgccgaaggggugagcaugcgcaccaaaaucaaggcuaaacuccaucagaugcugaagaauaacauggccucuuggaaugcggucccugccuccauuaaacuuauggagaucagcaaggcugccucugagaugcugacaaacaauuguugcggaagacagguggcuaacuccauuaucaccggcaauaagauuguuaacggcaaaagcucucucgaaggggccuggcccuggcaggcguccaugcaauggaagggacggcacuauuguggcgccagccugaucuccucucgcuggcuucugagcgcugcccauugcuuugcuaaaaagaacaauuccaaagauuggacggugaacuucgggaucgucgugaauaagccuuacaugaccagaaaagugcagaacauuaucuuucacgagaauuacagcucucccggacuccacgacgauauugcccugguccagcuggccgaagagguuuccuucacagaguauauccggaagauuugucucccugaagcuaagaugaaacugagcgagaacgacaaugugguggucaccggcugggggacacuuuacaugaacggaucuuuuccggugauccugcaggaagauuuccucaagaucauugacaauaaaaucugcaacgcgagcuaugccuacuccggcuuuguuaccgauacgaugcugugugcuggcuucaugucuggggaggccgacgccugccaaaaugauagcggaggcccccuugcuuauccugacucccgcaacauuuggcaucugguggggaucgucagcuggggagauggcugugggaagaaaaauaagcccggaguguacacaagaguuaccucuuaucggaacuggauuacauccaagaccggccucuga

SEQ ID NO: 77046 - RNA, 1257 nt, Artificial Sequence
  derived and/or modified sequence opt5 from TMPRSS11D__Homo_sapiens__NP_004253
auguacagacccgcccgggugaccagcacaucccgcuuccugaacccuuaugucguuugcuuuaucgugguggcuggcgucgugauucucgccguuacgaucgcgcugcuuguguacuuccuggcuuuugaccagaagucuuauuucuacagaagcuccuuucaacuccugaaugucgaguauaacucucagcuuaauagcccggccacccaggaauaccggacacuguccgggcgcauugagucucucaucaccaaaacauucaaggaaagcaaccugagaaaucaguuuauucgggcccacguggcuaaacugcgccaagauggauccggcguuagagccgacguggucaugaaguuccaguuuacccggaacaauaacggggcuagcaugaaaucucgcaucgaguccgugcucagacagaugcugaauaacagcggaaaucuugaaaucaaccccucuacagagauuaccucccugacggaucaggccgcggccaauuggcucaucaacgaguguggcgcugggccugaccugauuacccuuagcgaacaacggauccugggaggcacagaggccgaagagggcucuuggcccuggcaagugucccuccgccugaauaacgcucaucacugcgggggaagccugauuaacaauauguggauccucaccgccgcgcauuguuucagauccaacucuaauccucgggauuggauugccacaagcggcaucuccaccacguuucccaagcugcgcaugagaguccggaacauccuuauucacaauaacuauaagagcgcuacacaugagaaugacaucgcccugguuagacucgaaaacucugugaccuucacaaaagauauucacuccgugugccugccugcugccacccagaauaucccgcccgggagcaccgccuacgucacaggauggggcgcucaggaguacgcggggcacacggugccugaacuucgccagggacagguucggauuaucucuaacgacguguguaaugcuccccauagcuauaacggcgccauccuguccggcaugcucugcgccggggucccucagggaggcguggaugccugucaaggggacucuggaggcccccugguucaggaggauagcagacgccugugguuuauuguggggaucgucuccuggggagaccagugcggccucccggauaagccuggcguguacacccgggucacagcuuaucuggacuggauuagacagcaaaccgggaucuga

SEQ ID NO: 77047 - RNA, 1272 nt, Artificial Sequence
  derived and/or modified sequence opt5 from TMPRSS11E__Homo_sapiens__NP_054777
augauguacagacccgacgugguccgggcccgcaagagaguuugcugggagccuugggugaucggccuggugauuuucaucagccucauuguccuggcuguguguaucgggcuuaccguucacuaugugcgguacaaccagaaaaagacauauaauuacuauuccacgcugucuuuuaccacagauaaacucuacgccgaguucggacgcgaagcgagcaacaauuuuaccgaaaugucccaaagacuggagucuauggucaagaacgcuuucuauaaaagcccgcuucgggaagaguuugugaagucccagguuauuaaguucucucagcagaaacauggcgugcuggcccacaugcuccugaucugccgcuuucauagcacagaggaccccgaaaccgucgauaagaucgugcaacuggugcuccacgagaaacugcaggacgccgucgggccucccaagguugauccucauuccgugaaaauuaagaagaucaauaaaacagaaaccgacagcuaccuuaaccacuguugcggaacgagacggucuaagacccugggccagucccuccgcauugucgggggaacagagguggaggaaggcgaguggcccuggcaggcuagccugcaaugggauggcucucacagauguggggccacccuuaucaaugcuacauggcugguguccgccgcgcauugcuucaccacguacaaaaacccugcccgguggacagcuagcuuuggaguuaccauuaagccgucuaaaaugaagcgcggccucagacggaucauugugcacgaaaaauauaagcaucccucccacgacuacgauaucagccuggccgagcuguccucuccuguccccuauacaaaugcugugcaccgcguuugucucccugacgccagcuacgaguuccagcccggggaugugauguuugucaccggauucggcgcgcugaagaacgacggguauucccagaaucaucuuagacaggcccaagugacccugaucgaugcuacaacgugcaacgaaccgcaggccuacaaugacgcuauuaccccucggaugcucugugccggaagccuggagggcaaaacagacgccugccagggcgauucugggggaccccuugucuccagcgacgcuagagauaucugguaucuggcgggcauugugucuuggggagacgaaugugccaagccuaacaaacccgggguuuacacccgcgugacagcucuccgggauuggaucaccagcaagacgggcauuuga

SEQ ID NO: 77048 - RNA, 1704 nt, Artificial Sequence
  derived and/or modified sequence opt5 from TMPRSS13__Homo_sapiens__NP_001070731
auggagagagacagccacggcaacgccucccccgcucggaccccuucugccggggcgagcccggcucaggccucccccgccggaacaccucccggccgcgcuucuccugcccaagcuagccccgcccaggcguccccugccgggacgccgcccggacgcgcuucuccugcccaggcuagccccgccggcaccccucccgggcgggcguccccgggacgcgccagcccugcucaggccucucccgcucaagccuccccugccagagcuagccccgcgcuggccucucucucccggucuagcuccggccgcagcuccucugcuagaagcgccuccgugacaaccagccccacacgggucuaccugguucgcgccaccccugugggcgcugugccgaucagaucuucccccgcccggagcgcgccugcuacacgcgccaccagagaaucucccgggacgagccuuccuaaguucaccuggcgggagggacagaaacagcugccccucauuggcugcguccugcuucugaucgcccucgugguuucccugauuauccuguuucaguucuggcaagggcauacaggaauuagauauaaggaacagagagagucuuguccgaaacacgcugugcggugcgauggcgucguggacuguaagcucaaaagcgaugaacuggggugcguuagauuugacugggauaagucccuucugaagaucuacagcggaucuucccaucaguggcucccuaucuguagcucuaauuggaacgacuccuauagcgagaaaaccugccagcaacugggcuucgaguccgcccaccgcacaaccgaaguggcucaucgggauuuugccaauucuuucagcauucuuagauacaacuccacgauccaggagucucugcaccgcagcgaaugucccucccagcgguauauuagccuccaaugcucucacuguggccugagagcgaugacagggcgcaucgucggaggcgcccuggcuuccgacagcaaguggccuuggcaagugucucuccauuuugggaccacacacauuugcggaggcacccugaucgaugcccagugggugcuuaccgcugcccauuguuucuuugucacacgggagaaaguucuggagggguggaagguguacgcgggaacguccaaucuccaccagcugcccgaagccgcuagcauugccgagaucaucauuaacucuaauuauaccgacgaagaggaugacuacgauaucgcucuuaugagacugagcaaaccucucacacuguccgcccacauucaucccgccugccugccgaugcacggccagaccuucagccucaacgaaacaugcuggaucaccggcuuugggaagacgcgcgagacagacgacaagaccucuccuuuccugcgggaggugcaggucaaucuuauugauuuuaaaaaguguaacgacuaccugguguaugauuccuaccucacccccagaaugaugugcgcuggagaccugcgcggcgggcgggauagcugucagggagacuccggcgggccccuuguuugcgaacagaauaacagaugguaucuggcgggcgugacaucuuggggaaccggcugugggcaacggaauaaaccuggagucuacacaaaggugacggagguucucccguggaucuauagcaaaauggaauccgaggugcgcuucagaaagucuuga

SEQ ID NO: 77049 - RNA, 3060 nt, Artificial Sequence
  derived and/or modified sequence opt5 from TMPRSS15__Homo_sapiens__NP_002763
augggcagcaagagagggaucuccucucggcaccauagccuguccucuuacgagauuauguucgccgcucucuuugccauccuggugguccuuugcgcgggacugauugcuguuagcugucucaccaucaaagaaucccagcgcggcgccgcccuggggcaaucucacgaggcuagagccacauucaagauuacgagcggagugaccuauaaccccaaucuucaggacaaacuguccguggauuuuaagguccucgcuuucgaccugcagcagaugaucgaugaaaucuuucugagcucuaaccucaaaaaugaguacaagaacucccgggugcugcaauucgaaaauggcagcauuaucguuguguuugaccuuuucuuugcccagugggucucugaugagaacgugaaggaggaacugauucaggggcucgaggcgaauaaauccagccagcugguuacauuccauaucgaccuuaacucuguggauauucuggacaagcucaccacaaccucccaccuggccacaccuggaaaugucagcaucgaaugccugccgggcuccucucccuguaccgaugcucucacgugcauuaaagccgaccuguuuugugauggcgaggugaacugcccugacgggagcgaugaggacaauaagaugugugcuaccgugugcgacggacgcuuccuucugacaggcuccagcgggucuuuucaagccacccauuaucccaaaccuuccgaaacaagcgucguuugucaguggaucaucagagugaaccagggacucucuauuaagcugagcuucgaugacuucaauaccuacuauacggauauccuugacauuuacgagggcgugggguccucuaagauccugcgggcgagcauuugggaaacaaaccccggaaccauccgcaucuuuuccaaucaggucacagccaccuuccucauugagagcgaugaaucugacuaugugggcuuuaacgcuaccuacacagccuucaacuccagcgagcugaauaacuacgagaaaaucaauugcaacuuugaagauggcuucuguuuuuggguucaagaccugaaugaugacaacgagugggaacggauucaggggucuacguucuccccuuuuaccggaccgaauuucgaucacacauuuggcaacgcuagcggguucuauaucuccacccccacaggaccuggcgggagacaggagcgcgugggacuccugucucuuccccuggacccuacccucgaacccgccugccugagcuuuugguaccacauguauggcgagaauguccauaaacuuuccauuaacaucucuaaugaccaaaacauggagaagacgguguuccagaaggaaggcaauuacggggauaacuggaauuauggacagguuacacugaacgagaccgugaaauucaaggucgccuuuaacgcuuucaaaaauaagauccucagcgacauugcgcuggaugacaucucccugaccuacggcauuugcaacgggagccucuauccggaaccuacacuggugcccaccccuccucccgagcuucccacagauuguggaggcccguuugaacugugggagcccaauacgaccuucucuuccacaaacuuuccuaauagcuaccccaaccucgccuucugcgucuggauccugaaugcucagaaggggaaaaacauucaacugcacuuucaggaguucgaccuugaaaauaucaacgaugugguugagauuagagacggcgaagaggccgauucucuccugcuggccguguacaccggaccuggccccgucaaggacguguuuuccacaaccaaucggaugacgguucuccugaucaccaacgaugugcuugcucgcgggggauucaaagccaauuuuacaaccggcuaucaucuggggaucccggagccuuguaaggcggaccacuuccagugcaaaaacggagaaugugucccccucgugaaucugugcgauggccaucugcacugugaggacgggagcgacgaagcugauugcgugagauuuuucaacggcacaaccaacaauaacggacuuguucgguuccgcauucagucuaucuggcacacggccugugccgagaauuggacaacccaaauuagcaacgacgucugccagcuccugggccugggguccggaaauagcucuaagccuaucuuuuccacagauggcgggcccuucgugaagcucaacaccgcuccugacggacaucugauucuuacccccagccagcagugucugcaagauucccucaucagacugcagugcaaucacaaaucuugcggcaagaaacuggccgcucaggacaucacaccgaagauugucgggggcagcaacgccaaagaaggagcguggccuuggguggugggccuuuacuaugggggacggcuccuguguggcgccucccugguuucuagcgauuggcucguguccgcugcccauugcgucuacgggagaaaucuggagcccucuaaguggacggcuauccuuggacugcacaugaaguccaaccucaccagcccccagacagugccucgccugauugacgagaucguuauuaauccgcacuauaaccggagacgcaaagauaaugacaucgccaugaugcaucuggaauuuaaggugaacuacaccgauuauauccaacccauuugucuuccugaggaaaaucaggucuuucccccuggccggaacugcagcaucgcgggguggggcacagugguuuaccagggaaccacggccaacauucuccaagaggcugacgugccccugcugucuaaugaaagaugucagcagcagaugccugaguacaacaucacagagaauaugauuugcgccggcuaugaagaagggggaaucgauuccugucaaggcgacagcgggggaccccucaugugccaggagaacaaucgcugguuccuggcuggcgucaccucuuucggcuacaaaugugcccuuccgaaccggccugggguguaugccagagugucccgcuuuaccgaguggauccagagcuuccugcacuga

SEQ ID NO: 77050 - RNA, 1590 nt, Artificial Sequence
  derived and/or modified sequence opt5 from TMPRSS2__Homo_sapiens__NP_001128571
augcccccugccccgcccggcggggagagcggaugcgaagagagaggcgcugccgggcacaucgaacauucccgguaccugucucuccuggacgcgguggauaacagcaagauggcucuuaauuccggaucuccucccgccauuggcccuuauuacgagaaccacggguaucagcccgaaaauccuuacccggcccaacccaccgucguuccuacaguguaugaggugcaucccgcucaguacuauccuagccccgucccgcaguacgccccucgcgugcugacgcaggcuuccaaccccguuguguguacccaaccuaaaucucccagcggaacagucugcaccuccaagacaaagaaggcccucuguaucacccugacacuuggcaccuuccuggugggcgcggcccucgcugccgggcugcuguggaaauuuaugggaagcaagugcucuaauuccggcauugagugugacagcucugggacgugcaucaaccccuccaauuggugugauggaguuagccacugcccuggcggggaagacgagaacagaugugugcggcucuacggaccgaauuucauucugcaggucuauucuucccagcgcaagagcuggcaucccgugugccaggaugacuggaacgaaaauuacggcagagcugccugucgggauaugggcuauaaaaacaauuuuuacuccucucaagggaucguggacgauagcggauccaccagcuucaugaaacuuaacacaucugcgggcaaugucgacaucuauaaaaagcuguaccacuccgaugccugcagcucuaaagcuguugugagccuccgcugcauugccuguggggugaaccugaacuccucuagacagagccggaucgucggaggcgaguccgcccuuccuggggcuuggcccuggcaagugagccugcacguucagaaugugcaugucugcggaggcucuauuaucaccccugaguggauugugacagccgcucacuguguugaaaagccccucaacaauccguggcauuggaccgcguuugccggcauccugcgccaguccuucauguuuuauggggcuggauaccagguggagaaggucauuagccacccuaacuacgacucuaaaacgaagaauaacgauaucgcccugaugaaacuccagaagccccugacauucaaugaccuugugaaaccugucugccugcccaacccuggcaugaugcuccaacccgaacagcuguguuggaucuccggguggggagccaccgaggaaaagggcaaaacaagcgaggugcuuaaugcugccaagguucugcucauugagacccagagaugcaacucccgguauguguacgacaaucugaucaccccggcgaugauuugugcuggguuucugcagggcaacgucgauucuugccaaggagacagcggcgggccucucgugacauccaagaauaacaucugguggcugauuggagauacgucuuggggcagcgggugugccaaagccuaucgccccggaguuuacggcaaugugauggucuucaccgacuggaucuauagacagaugcgggcugauggguga

SEQ ID NO: 77051 - RNA, 1362 nt, Artificial Sequence
  derived and/or modified sequence opt5 from TMPRSS3__Homo_sapiens__NP_001243246
augggcgagaacgaucccccugccguggaagcuccguucagcuuuagaucccuguucgggcucgacgaccugaagaucucucccgucgccccugaugcggacgcuguugccgcccagauucuuagccugcucccccugaaauuuuucccuaucauugugaucggaauuaucgcucuuauccuggcccucgcuauuggccuggggauccacuuugauugcuccggaaaguaccggugucgcucuagcuucaaaugcauugagcugaucgccagaugugacggcguguccgauugcaaggacggggaagaugaguaucgguguguccgcgugggaggccaaaaugcgguucuccagguguuuaccgccgcuucuuggaaaacaaugugcagcgacgauuggaagggccauuacgccaacgucgcuugugcccagcugggguuccccuccuaugugagcucugacaaucuuagaguuuccagccuggaaggacaguuucgggaggaguucgugucuauugaucaccuccugccugacgacaaggucacggcgcuucaucacuccguguacgugcgcgaaggcugcgccagcgggcaugucguuacccugcaauguacagcuugcggacacagacggggcuauucuucccgcaucgucgggggaaacaugagccuccugucccaguggccguggcaggccucucugcaguuucaaggcuaccaccucuguggcgggagcgugauuacaccccuguggaucaucaccgcugcccauugcguguaugaucuuuaccugccuaaauccuggaccauucaggugggacucguuagccugcuugacaaucccgccccuucucaccugguggagaagaucgucuaccauuccaaauauaagcccaaaagacucggcaacgauauugcucugaugaagcuggcggggccgcucacauucaaugaaaugauccagccugugugccugcccaacagcgaggagaauuuuccugacggaaagguuuguuggaccucuggcuggggagccacggaagaugggggcgacgcuagccccgugcuuaaccacgccgccgucccccugauuuccaauaaaaucugcaaccaccgggauguguacggcgggaucauuucuccuagcaugcucugugcuggauaucugaccggcggggucgacuccugccagggagauagcggcgggccgcuugugugucaagagcgcagacuguggaagcucguuggcgccacaucuuucggaaucggcugcgcggaagugaauaaacccggggucuacacccgggugacauccuuccuggacuggauucaugagcagauggaacgcgaucugaagaccuga

SEQ ID NO: 77052 - RNA, 1299 nt, Artificial Sequence
  derived and/or modified sequence opt5 from TMPRSS4__Homo_sapiens__NP_001077416
augcugcaggaccccgauagcgaccaaccucucaacucccuggaugugaagccgcuuagaaaaccccggaucccuauggagaccuuccgcaaggucggcauucccaucauuaucgcccugcucucucuggcuagcauuaucaucguuguggugcuuauuaaagucauccuggacaaguacuauuuucucugcgggcagccucugcacuucauucccagaaaacagcugugugauggagaacucgacugcccucugggcgaggaugaggagcauugugugaaguccuuuccggaagggcccgccguugcggugcggcuuucuaaggaccgcagcacacugcagguccucgauuccgcuacgggaaauugguucucugccugcuuugacaacuucaccgaggcccuggcugagacagccuguagacaaaugggcuacagccgggcuguggaaaucgggccugaucaggaccuugauguuguggagauuaccgaaaauucccaggagcugcgcaugagaaacagcucuggacccugccucuccggcagccuggucucucugcacugucucgccugcggcaaaucccugaagacaccucggguggucgggggagaggaagcgagcguggacucuuggcccuggcagguuuccauccaauaugacaaacagcauguguguggcgggagcauucuugauccgcacugggugcugaccgccgcucauugcuuucgcaagcacacagacgucuucaauuggaaagugagagccggauccgauaagcucggcucuuuuccuagccuggcuguugccaagaucaucauuaucgaguucaaccccauguacccuaaagacaaugauauugcgcuuaugaagcugcaguuuccccucaccuucuccgggacggugcggcccaucugucugccguuuuucgacgaggaacugaccccugccacaccccucuggauuaucggauggggcuucaccaaacagaacggcgggaagaugagcgauauccugcuucaggcuucuguccaagugauugacuccacacgcugcaaugccgaugacgcuuaucagggagaaguuaccgagaaaaugaugugcgccggcaucccugaagggggaguggauacgugucaaggcgacagcgggggaccccugauguaccagucugaccaguggcacgucgugggcauugucagcuggggcuaugggugcggaggcccuuccacacccgggguguacaccaagguuucugccuaccucaacuggaucuauaauguguggaaagcugaacuguga

SEQ ID NO: 77053 - RNA, 2436 nt, Artificial Sequence
  derived and/or modified sequence opt5 from TMPRSS6__Homo_sapiens__NP_705837
augcugcuccuguuccacagcaagagaaugcccguggccgaggcuccucaggucgccggcgggcaaggagacggcggggauggagaagaggcggaaccggagggcauguuuaaggcuugcgaagacuccaaacggaaagcccgcggguaccuuagacugguuccccucuucgugcugcuugcccugcucgugcuggcuucugccggaguccugcucugguauuuucugggcuacaaggcugaggugaugguuagccagguguauuccggcucucuucggguccugaaccgccauuucagccaggaucucaccagacgggaguccucugccuuucgcagcgaaacagcgaaagcccagaagaugcugaaggagcuuaucacguccaccagacuggggacauacuauaauucuagcuccguguacagcuucggagaaggcccucucaccuguuucuuuugguuuauucugcaaauccccgagcaccggcgccugaugcucucuccugagguugugcaggcucugcuugucgaggaacugcucuccacagugaacagcucugccgcugugcccuauagagccgaauacgaggucgacccugaagggcugguuauucuugaggcguccgugaaagauaucgccgcucugaauagcacccucggaugcuaccgguauuccuacgugggccaggggcagguccugcgccugaagggaccggaccaucucgccucuagcugucuguggcaccuucaaggccccaaagaucugaugcucaagcugagacuugaguggacacuggcugaaugccgggaccgccucgccauguaugauguggccggcccucuggagaaaagacugauuaccuccguuuacggguguagccggcaggaacccguggucgaggugcucgcuucuggagcgaucauggccguuguguggaagaagggccugcauuccuauuacgacccuuucguccuuagcgugcagcccgucguguuucaggcuugcgaaguuaaccugacgcucgauaauagacuggacucucaaggggugcugagcaccccguauuucccuuccuacuacucuccccagacacacuguagcuggcaccuuaccgucccuucccucgauuauggacuggcccugugguuugacgccuacgcucuccgccggcagaaauaugaccugcccugcacacaaggccaguggaccauccagaacagacgccuuugugggcugcggauucuccagcccuacgccgagagaaucccugugguugcgacggcuggaauuacaaucaauuucaccagccaaauuucucugacaggcccgggcgugcgcguccauuaugggcuguacaaccaguccgaucccugcccuggagaguuccuuuguagcgugaauggccucugcgugcccgccugcgacgggguuaaggauuguccuaacggacuggacgaacggaauugcgucuguagagccaccuuucagugcaaagaggauucuaccuguaucucccugcccaaggugugcgacggccagccggauugucucaacgggagcgacgaggaacaaugccaggaaggcgugccuuguggaacauucacguuucagugcgaggaucgcuccugugucaaaaagcccaauccucagugcgacggccggcccgauugcagagacgggucugacgaggaacacugugauugcggacugcaaggcccuagcucccgcauuguugggggagcugugucuagcgagggcgaauggcccuggcaggccucccuucaggugcgggggagacauaucuguggcggagcucugaucgccgaccggugggucauuaccgcggcccacugcuuccaggaggauagcauggcuucuacagugcucuggaccguuuuucugggcaaaguguggcaaaacucccgcuggccgggggaggucagcuucaaggugucuagacugcuucuccacccuuaucaugaagaggacucccacgauuacgacguugcccugcugcagcucgaucaucccgugguccggagcgcugccgugagacccgugugucugccugcgcgcucucacuuuuucgaaccgggacuucauugcuggaucacaggcuggggagcccugcgggaagggggccccauuagcaaugcucuccagaaggucgacguucaacugaucccucaggaucuguguuccgagguguacagauaucaggugacgccccgcaugcuuugcgccggguacagaaaaggcaagaaagacgcuugucagggagauagcggcgggccucucgucugcaaggcccugucuggacggugguuucuggccggccucguguccugggggcugggauguggccgccccaacuauuucgggguuuacaccagaauuacaggcgugaucagcuggauccaacaggucgugaccuga

SEQ ID NO: 77054 - RNA, 2154 nt, Artificial Sequence
  derived and/or modified sequence opt5 from TMPRSS7__Homo_sapiens__NP_001036040
auguucagaaucaccaacauugaguuucugcccgaauaccggcagaaggagagccgcgaguuccucuccgugucuagaacaguccaacagguuaucaaucugguguauacgaccagcgccuuuuccaaauucuacgagcagucuguggucgcugacgugagcaacaauaagggcgggcuucugguucacuuuuggauuguguucgucaugccucgggccaaaggacauaucuuuugcgaagauuguguggcggcuauucucaaggacuccauccagacaucuaucauuaaccgcaccagcguuggcucccugcaagggcuugccguggauauggacagcgucgugcugaaugauaaaggaugcucucaguauuucuacgccgagcaccucucccugcauuauccgcuggagaucagcgcugccucuggcagacucaugugucacuuuaagcugguggcuauugucggguaccuuauccggcuguccauuaagagcauccagauugaagccgacaacugcguuacagauucucucaccaucuaugacucccugcuucccauccgcagcuccauucuguacagaaucugugagccuacacggacccucaugucuuucgugagcacgaauaaccugaugcuggugaccuuuaaaagcccccauauucgcagacucuccggaauccgggcguacuucgaagucauuccugagcagaagugcgagaauacagugcugguuaaagauaucaccggcuuugaaggcaagaucucuucccccuauuacccuagcuauuacccgcccaaauguaagugcacauggaaguuccaaaccucucuuagcacgcuggggauugcccucaaauucuauaacuacuccaucacaaagaaaucuaugaagggaugugagcacggcuggugggaaauuaaugagcacauguauugcgggagcuacauggaccaucagaccaucuuucgcgugccuagcccccugguccacauucagcuucaguguuccucuagacuguccgauaaaccucuccuggcugaauacggaagcuauaacaucucucaacccugcccggugggcuccuuccggugcagcuccgggcuguguguuccucaggcccagcgcugcgacggagugaaugauuguuuugacgagucugacgaacucuucugcgucagcccccaaccugcuuguaacacauccucuuuuagacagcauggcccccugaucugcgauggcuuccgggacugugaaaaugggagagaugagcagaacugcacccagagcauucccuguaacaaucgcaccuuuaagugcggaaacgacaucuguuuccggaaacaaaaugccaagugcgauggcacaguggacugcccugauggguccgacgaagagggauguacgugcagcagaucuuccagcgcgcuucaccgcauuaucggcgggaccgauacacuggaaggaggcuggccguggcaggucucucuccacuuugugggcuccgccuacuguggggcuagcguuauuucucgggaguggcugcuuagcgccgcucauugcuuccacggaaacagacuguccgaccccaccccuuggacagcccaucucggcauguaugugcaggggaaugccaaguuugucagccccgugcgccggaucguugugcacgaguacuauaacucucagaccuucgauuacgacauugcucugcugcaacucuccaucgcguggccugaaacgcugaaacagcuuauccagcccauuuguaucccgccuacaggacagagaguccgcagcggcgagaagugcugggugaccggguggggccggagacaugaagccgacaauaaaggaucccuggugcuccaacaggcugagguugaacugauugaucagacccugugugucucuacauauggcaucauuaccagccgcaugcuuugcgccgggaucauguccggaaagcgggacgccuguaaaggcgauucugggggaccccucagcugcagacggaaguccgacggcaaguggauccugacagggauugugucuuggggccacggaagcggccgcccuaacuuucccgggguguacacgagagucuccaauuucgugccuuggauccacaaauacguucccagccugcucuga

SEQ ID NO: 77055 - RNA, 3180 nt, Artificial Sequence
  derived and/or modified sequence opt5 from TMPRSS9__Homo_sapiens__NP_892018
auggagcccaccguggccgacguccaccugguuccuagaacaacgaaggaagugccggcucucgaugccgcgugcugucgggcugccagcaucggcguggucgccaccucccuggugguucuuacacugggggugcuccuggcuuuccuuucuacccagggauuucaugucgaccacacagccgagcugcgcggcauuagauggaccagcucccuccggcgcgaaacaucugauuaccauagaacccugacgcccacccuggaggcucuccugcacuuccuucugcggccucuccagacacugagccuugggcuggaagaggagcuccugcagcgcggaaucagagcccggcugcgcgaacauggcauuucccucgcggccuaugggaccaucgugucugcugagcugacaggaagacacaaaggcccccuugccgaacgggacuuuaagagcggccgcugcccugggaacuccuucagcuguggaaauucucagugcguuaccaaagugaaccccgagugugaugaccaggaggauugcuccgacggcagcgaugaagcucacugugagugcgggcugcaaccugccuggagaauggcgggacggauugucggcgggauggaagccucuccgggagaguuucccuggcaggcuucccuccgcgaaaauaaggagcauuucuguggcgccgcuaucaucaacgccagauggcuggugagcgccgcucacugcuuuaaugaguuccaggacccuacgaaauggguggcguacgucggcgccacauaucuuucuggguccgaagcuagcaccguucgggcccagguggugcaaauugucaagcauccccuguacaacgccgauacagcugacuuugauguggccguucucgagcugaccuccccucugcccuucggaagacacauccagccggugugucucccugcggcuacccacauuuuucccccuucuaagaaaugccugaucagcggcuggggguaucuuaaggaagacuuccuggucaaacccgaggugcuccagaaggccacaguugaacugcuugaccaggcccugugcgcuucccucuacggacauagccugacggaucgcauggugugugccggcuaucuggacgggaaagucgauucuugccaaggagacuccggcggcccccucgugugugaggagccuagcgggcgguuuuuccuggcuggaauugucucuuggggcaucgggugcgccgaagcgagacgcccgggaguguacgcccggguuaccagacuucgcgauuggauucuggaggcuacaaccaaggccagcaugccccucgcuccuacaauggcccccgcgccugccgcucccuccaccgccuggccgacgucuccugaaagccccguggucuccacaccuaccaagagcaugcaggcucugucuaccgugccccuggacuggguuacagugccuaaacuucaggaguguggcgcccggcccgccauggaaaagccgaccagagucguugggggcuucggagcugcguccggcgaggugccuuggcaagugagccucaaagaggggucucgccacuuuugcggagccacagucgugggcgaucgguggcugcuguccgcugcccauuguuucaaucacacgaagguggaacaggucagagcccaucucgggaccgcuagccugcuuggacugggcgggucccccgugaaaaucggccuccgccggguugugcugcacccccuguacaacccuggaauccuugacuuugaucucgccguccuggagcuggcgucuccgcucgcuuucaauaaguauauucagcccgugugccugccucuugccauccagaaauuucccguuggcagaaaguguaugauuagcggguggggaaacacacaagaaggcaaugccaccaagccugagcugcuccagaaggcuuccguggggaucauugaccagaaaacaugcucuguccuguacaacuucagccugaccgaucggaugaucugugccggauuucuugagggcaaaguggacuccugccagggggacagcggcggaccccucgcgugcgaagaggcuccuggcguuuucuaucuggccgggaucgugucuuggggaauuggcugugcccaagucaagaaacccgggguguacacgcgcaucaccagacugaagggauggauucucgaaaucauguccagccagccgcugccuaugucucccccuuccacaacccggaugcuugcuacaaccagccccagaacgacagccggccugaccgugccgggggcuacaccuucucgccccaccccuggcgccgcgagccgggucaccggacagcccgccaauuccacacucagcgcuguuucuacgaccgccagaggccagacacccuuuccugaugcuccggaggccaccacacacacccaacugcccgacugcgggcuggccccugcugcgcuuacgcgcauugugggaggcuccgccgcugggagaggagaauggcccuggcaagugagccucuggcugcggcgcagagagcaucgguguggcgccguccugguggccgagcgcuggcuccuguccgcugcccacugcuucgauguuuauggcgacccuaagcagugggcggcuuuucuugggacacccuuccugucuggagccgaaggccagcucgagagaguggcccggaucuacaaacauccuuuuuauaaccuguacacccuggauuacgacgucgcccuucuggaacucgcugggccggugcgcagaagccggcugguucgccccaucugucucccugagcccgcgccuagacccccggauggaacccggugcgugauuacaggcuggggguccgucagagaaggaggcucuauggcucgccagcugcagaaggccgccgugcggcuucugagcgagcagaccuguagacgcuucuauccuguucaaaucuccucucggaugcucugcgcuggcuucccccaagggggaguggacagcuguuccggcgaugccgggggaccccuggcuugcagagagccuagcggccgcuggguccugacaggggugacgucuuggggauacggcuguggccggccccacuuuccugggguguauaccagagucgccgcgguucgcggauggauuggccagcacauccaggaauga

SEQ ID NO: 77056 - RNA, 135 nt, Artificial Sequence
  derived and/or modified sequence opt5 from TMSB10__Homo_sapiens__NP_066926
auggccgacaagcccgauaugggcgagaucgcuagcuucgacaaagccaagcugaaaaagaccgaaacacaggagaaaaacacgcucccuaccaaggaaacaauugagcaagaaaagagauccgagaucucuuga

SEQ ID NO: 77057 - RNA, 138 nt, Artificial Sequence
  derived and/or modified sequence opt5 from TMSB15B__Homo_sapiens__NP_919305
augagcgacaagcccgaucuguccgagguggaaaaauucgacagaucuaagcucaaaaagaccaacacagaggagaaaaauacgcugccuagcaaggaaaccauccagcaagaaaaggagugcguccagacauccuga

SEQ ID NO: 77058 - RNA, 135 nt, Artificial Sequence
  derived and/or modified sequence opt5 from TMSB4X__Homo_sapiens__NP_066932
augagcgacaagcccgauauggccgagaucgaaaaauucgacaaguccaaacugaagaaaaccgagacacaggaaaagaacccucucccgucuaaggagacgauugaacaagagaaacaggcuggcgagagcuga

SEQ ID NO: 77059 - RNA, 2649 nt, Artificial Sequence
  derived and/or modified sequence opt5 from TMTC1__Homo_sapiens__NP_001180380
augguggucaccacaagcgccagaggcgggggaggcgaccggacgcccucccgcagacgggggugcggacuggcuccugccggcgcggcugcccuccuggccggggcuucuugucuuugcuacggacgcagccugcagggcgaguucguucacgaugacgugugggccaucgugaacaauccggaugucagacccggcgcuccucuccggugggggauuuuuaccaacgacuucuggggaaagggcauggccgaaaauacaucccauaaaucuuaucgcccccugugugugcuuaccuuuaagcugaacaucuuccucacagggaugaauccuuuuuacuuccacgcgguuaacauuauccugcauugccuggugacccucguccugauguauacaugugauaaaaccguguuuaagaauagaggacuugccuucguuacggcucugcucuuugccgugcaccccauucauaccgaggcugucgccggcaucguggggcgggcggacgugcuggccugccuucuguuccuccuggcuuuucugagcuacaaccgcucccucgaucaaggaugugucggcggcucuuucccuagcacaguuuccccguuuuuccugcuucugagccucuuccuggggaccugcgccaugcuugugaaagaaacaggaaucaccguguuuggcgucugucugguguaugaccucuucucucuguccaauaagcaggauaagagcucuaacggggcucugugccccagauccccucagcagcccggaagcccucaacccucuucccucccgggccacccucaccgggagaaugggaaacagcagcgcuuuccccauaagggagccuggggcggcugucacagcccucugccucccgaacccaaauccucuggguucccgguuagccccagagccgugugguccaugaugcgguuucuuacguacagcuaucugcucgcuuucaacgucuggcugcuucuggcgccugugacacucugcuacgacuggcagguuggaucuauuccccugguggagaccaucugggauaugcgcaaucuggccacaauuuuucucgcugucgugauggcccugcuuucccugcauugccucgccgcuuucaagagacuggagcacaaagaaguccuggugggccuucucuuucugguuuucccuuuuauccccgccagcaaccuguucuuucgggugggguucgucguggcggagagaguucucuacaugccgucuaugggauauuguauucuguucgugcacggccuuagcaagcugugcaccuggcucaaucgcuguggggcuaccacacugaucgucuccacggugcugcuucuccugcuguuuucuuggaagaccgugaaacaaaacgaaauuuggcucagccgggagucccuguucagaagcggcguucagacacuuccucauaacgccaagguccacuacaauuaugccaacuuucugaaagaccagggacgcaauaaggaggcuaucuaccauuaucggaccgcccucaaacuguaccccagacacgcuucugcccugaacaaucuuggcacacucacccgcgauacggcggaagccaagauguauuaccagcgggcucugcaacugcauccucagcacaacagagcccucuucaaucuggggaaccuucugaaaucccaggagaagaaggaagaggcuaucacacuccugaaagacagcauuaaguacggacccgaauuugccgacgcguauucuucccuggccagccuucucgcugagcaagagcgcuucaaagaagccgaggaaaucuaccagaccggcauuaagaauugcccugauuccucugaccugcacaacaauuaugggguguuucugguggauaccggacuccccgagaaagcugucgcccauuaccagcaggccaucaagcugagcccgucccaccauguggcuaugguuaaccuuggccggcuguauagaucucucggggaaaauagcauggcggaggagugguacaagcgcgcccugcaaguggcucacaaagccgaaauucuguccccucuuggcgcccuguauuacaacacaggacgguacgaggaagcucuccagaucuaucaggaggccgcggcucugcagcccagccaaagagaacuccggcuggcccuugcccagguccuggcugugaugggccagaccaaggaggccgagaaaaugacaaaucacaucguuucugaagagacggggugucucgaaugcuaccgccugcuguccgcgauuuauagcaagcaggagaaccaugacaaagcucuugaugccaucgacaaggcccugcaacucaagcccaaagauccuaaggugauuucugagcuguucuuuaccaaaggaaaccagcucagagaacagaaucugcuugacaaggcuuucgaguccuaccgggucgccgugcagcugaacccggaucaagcucaggccuggaugaauaugggcgggauccagcacauuaaaggaaaguauguuagcgcgagagccuacuaugaacgcgcucuccaacuggugcccgacucuaagcugcuuaaagagaaccuggccaagcucgaucggcuggagaaaagacuccaggaaguccgcgagaaggaccagacauga

SEQ ID NO: 77060 - RNA, 2511 nt, Artificial Sequence
  derived and/or modified sequence opt5 from TMTC2__Homo_sapiens__NP_689801
augaucgccgagcuggugagcuccgcucucggccuggcccuuuaccugaacacccucucugcggacuucugcuaugaugacagcagagcuauuaagacaaaucaggaucugcuucccgaaacgccuuggacccacaucuuuuacaacgacuucugggggacacugcucacccauuccggaucucacaaaagcuaucggccgcuguguacacuguccuuucgccucaaucaugccauuggcgggcugaaccccuggucuuaccaccuugucaauguucugcuccaugccgcugugaccggacuguucaccagcuuuuccaagauccuucugggcgauggguauuggacauucauggccggacucauguuugcuagccacccuauucacacggaggccguggcgggcaucgucggcagagccgacgugggggcuucucuguucuuucugcucucccugcuuugcuacaucaaacauuguagcacccggggauauucugcccgcacauggggcugguuccugggguccggacucugcgcuggcuguagcaugcuguggaaggaacaagggguuaccgugcuugccgucucugcgguguacgauguuuuuguguuccacagacugaaaauuaagcagauccuccccacaauuuacaagcggaaaaaccugucccuguuucucagcaucucccugcuuauuuucuggggaucuagccugcucggcgcccgccuguauuggaugggcaauaagccucccuccuucagcaacucugacaauccugcugccgauuccgacagccuucugaccagaacgcucacauuuuucuaccugccgaccaaaaaccuguggcuccugcuuugccccgauacacugucuuuugacuggagcauggaugcugucccucuccugaagaccgugugugacuggcggaaucugcauaccguggccuucuauacagggcuucuccugcuggccuacuauggacucaaaucccccucugucgaccgcgagugcaacggcaagacgguuaccaaugggaagcagaacgcuaauggacacagcugucuguccgauguggaauaccagaacagcgagacaaaaucuuccuuugcgagcaagguggagaacggcaucaaaaaugacgucucucaaagaacccagcuuccuuccacagaaaacauugugguucugagccucucccugcugaucauccccuucgugccggccaccaaucuuuucuucuaugucggguuugugauugcugagcggguucucuacaucccuucuaugggauucugccugcugauuacggugggcgcccgcgcccucuacgucaaggugcagaaaagauuucucaagagccuuaucuucuaugcuacagccacccugauugucuuuuacggccucaaaaccgcgauccggaacggggauuggcagaaugaagagaugcuguaucgcuccggaaucaaggugaaccccgcuaaggccuggggcaaucuggggaacguucuuaaaucucaaagcaagauuuccgaggccgaaagcgcuuacagaaaugcccucuauuaccggucuaacauggcugacaugcuguauaaucugggacuccugcuucaggagaacuccagauucgccgaagcgcugcacuacuacaaacucgccaucggcagccgcccuacacuggcuucugccuaucugaauaccgggauuauccuuaugaaccagggccggacagaggaagcuagacgcacguuccucaaguguuccgagauucccgaugagaaucugaaagacccccaugcccacaagagcucugugaccagcugccuguacaaccucggaaagcuguaucaugaacagggccacuacgaggaagcgcuuuccgucuauaaagaggccauccaaaagaugccucggcaguuugcuccgcagagccuguacaacaugaugggggaagccuauaugagacucucuaaacugcccgaggcugagcauugguacauggaaucccugcgcagcaagacagaucacaucccugcccaccuuaccuacggaaaacugcucgcccugacaggccggaaguccgaggcugaaaagcuguuccugaaagcgauugagcuugaccccaccaaggggaauugcuauaugcauuacggacaauuucugcucgaagaggccagacugaucgaggcugccgaaauggccaaaaaggcugccgagcuggauucuacggaauuugacgugguuuuuaacgcggcucacaugcuucgccaggccagccugaaugaggccgcugagaaauauuacgaucucgccgcgcggcugagaccuaacuaucccgcugcccucaugaaucugggcgccauucuucaucugaacgggcgccuccagaaggcugaagccaauuaccugcgggcucugcagcuuaagccggacgacgugaucacccaauccaaccugagaaaacucuggaauauuauggagaagcagggccugaaaacaucuaagaccuga

SEQ ID NO: 77061 - RNA, 2745 nt, Artificial Sequence
  derived and/or modified sequence opt5 from TMTC3__Homo_sapiens__NP_861448
auggccaacaucaaucugaaggagauuacccucaucgugggcgucguuacagcuugcuacuggaacagccuguucuguggguuuguguucgacgauguguccgccauucuugacaauaaagaucugcaccccucuacgccucucaagacccuguuucagaacgacuucuggggaacaccgaugagcgaagagagaucccauaaaucuuaucggccccuuaccguccugacauuucgccucaauuaccugcugagcgaacucaagccuauguccuaucaucugcuuaacaugaucuuccacgcggugguuucugugauuuuucugaaagucugcaaacucuuccuggauaauaagagcuccgugaucgcuagccuucuguuugccguucaccccauccauaccgaggccgugacaggcgucguggggagagcugaacuccugucuuccauuuucuuucuggccgcuuuccucagcuacacccggucuaaaggaccugacaacuccaucauuuggacgcccaucgcccugaccguguuucuugucgcgguugccacacuguguaaggagcaaggcauuaccgugguggggaucugcugugucuaugagguguucauugcucagggauacacacucccucugcuuugcaccacggccggccaguuccugcgcggcaaagggagcaucccguuuucuaugcuccagacacugguuaagcugaucgugcucauguucuccacccugcuucuggucgugauuagaguucaagugauccagagccagcuccccgucuuuacacgguucgauaauccugcugccgugucccccaccccuacccgccagcugacauuuaacuaucuucugcccgucaaugcguggcuccugcugaacccgucugaacucuguugcgacuggacgaugggaaccauuccucugaucgagagccuucuggauauuagaaaucucgccacauucaccuuuuucuguuuucugggcaugcuggggguguucuccauccgguacagcggagacucuuccaaaacaguucuuauggcucucugccugauggcccugcccuuuaucccugcuagcaaccucuucuuucccgugggcuucgucguggccgaacgcguucuguacgugcccucuaugggguucuguauucuugucgcccacggauggcaaaagaucagcaccaaguccguguuuaaaaagcugucuuggauuugccucagcauggugauccugacgcacucccugaaaacauuccauagaaauugggauugggagagcgaguauacccuuuuuaugucugcucucaagguuaacaaaaacaaugcgaagcuguggaacaaugucggccacgcccuggaaaacgagaaaaauuucgaacgggcucucaaguacuuucugcaggccacccaugugcagccugacgauauuggcgcccacaugaacguggggcgcacauauaagaaucuuaacagaaccaaagaggcugaagaguccuacaugauggccaagagccugaugccgcagaucauccccggaaagaaguaugcggcucggauugccccuaaucaccucaacgucuacaucaaucuggccaaccugauucgcgcuaaugagucuagacuugaagaggccgaccaacucuaucggcaggcuaucuccaugagacccgacuucaaacaggccuacauuagccgcggcgaacugcugcucaagaugaacaagccucugaaagcgaaggaggccuaccuuaaagcucuggaacucgaucggaauaacgccgaccugugguauaaccuggcuaucgugcauauugagcuuaaggagcccaaugaagcccucaaaaacuuuaauagagcgcuggagcugaacccgaagcacaagcucgcccuguucaauuccgcuaucguuaugcaagaaucuggggaggugaaacuucgcccugaagcccggaagagacugcucagcuacaucaacgaggagccccuggaugcuaauggauauuuuaaccugggcaugcuugccauggacgauaaaaaggacaaugaagccgagauuuggaugaaaaaggcuaucaagcugcaggcggauuuccgcuccgcccucuuuaaccuggcucuccuguacucucagacagccaaagaacuuaaggcccugccuauucucgaggagcugcugcgguauuaccccgaccauaucaaagggcuuauucugaagggagauauccucaugaaucagaaaaaggacauccugggcgcuaaaaagugcuucgaacgcauucucgagauggauccuagcaacguccaaggcaagcacaaucugugugugguuuauuuugaagagaaagaccuucugaaggccgaaagaugccuccuggagacgcuggcgcuugcuccccaugaggaauacauccagcggcaccugaacauugugagagacaaaaucuccucuagcuccuucauugagccgaucuucccuaccagcaagaucucuuccgucgaagggaaaaagauucccacagagagcgugaaggaaauccgcggagagucucggcagacccagauuguuaaaacaagcgauaauaagucccaaagcaaaucuaacaagcagcucggcaaaaacggggacgaggaaacgccccacaagaccaccaaggauaucaaagagauugaaaagaaaagaguggccgcccugaagcggcucgaggaaaucgagcgcauccugaauggagaguga

SEQ ID NO: 77062 - RNA, 843 nt, Artificial Sequence
  derived and/or modified sequence opt5 from TMX1__Homo_sapiens__NP_110382
auggcccccagcggcucccuggcugugccucucgccguccugguucuucugcucuggggagcgccguggacccacgggagacggucuaacgugcgcgugaucacagacgagaauuggagagaacugcuugagggcgauuggaugauugaguucuacgcucccuggugcccugccugucagaaccugcaacccgaaugggagagcuuugccgaauggggagaggaccucgaagucaauaucgcuaagguggauguuacggagcagccugggcuguccggccgguucauuaucaccgcccugcccacaauuuaucauugcaaagacggggaauuucgcagauaccagggaccucggaccaagaaagauuucaucaacuuuaucucugacaaggaguggaaaagcauugagccgguguccucuugguucggccccggcagcguccucauguccagcaugucugcucuguuucagcuuuccauguggauccgcacaugucacaauuauuucauugaagaucuggggcucccuguguggggaagcuacaccguuuuugcccuggcgacacuuuucucuggccugcuccuggggcugugcaugaucuuuguggccgacugucucugccccuccaagagacggcgcccucaacccuauccguacccuagcaagaaacugcuuucugaguccgcucagccccugaagaaagucgaagaggaacaggaggccgaugaggaagacgugagcgaggaagaggcugaauccaaggagggaaccaacaaagauuucccucagaaugccauuagacaacggucucucggccccagccuggcgacggacaaguccuga

SEQ ID NO: 77063 - RNA, 777 nt, Artificial Sequence
  derived and/or modified sequence opt5 from TMX2__Homo_sapiens__NP_001137484
auggccgugcuggcuccccucaucgcccuggucuacagcguuccuagacuuucccgguggcuggcgcagccguauuaccuccugucugcccuucugagcgcugccuuccuccuggugcgcaagcugcccccucucugccacggccugcccacccaaagagaggacgggaacccuugugauuuugacuggcgggaaguggagauucuuauguuccuguccgcuaucgucaugaugaaaaaucgcagaucuauguuucucaugacaugcaagcccccucuguauaugggaccggaauacauuaaauauuucaacgauaagacgaucgacgaggaacuugagcgggauaaacgcgugaccuggauuguugaguuuuucgccaauuggagcaacgacugucaguccuuugcucccaucuacgccgaucugucucucaaguauaauugcacaggccugaacuucgggaagguggacgucggaagauacaccgaugugagcacacgguacaaaguuuccaccagcccucugacaaagcagcuccccacccugauccuuuuucagggcgggaaagaagcgaugcgcagaccucaaauugacaagaaaggacgggccgugucuuggacguucuccgaggaaaaugucauccgcgaguuuaaccugaaugagcucuaucagagagcuaagaagcugagcaaagccggcgauaacauucccgaggaacagccgguggcuucuaccccuacaaccguguccgacggcgaaaauaagaaagauaaguga

SEQ ID NO: 77064 - RNA, 1365 nt, Artificial Sequence
  derived and/or modified sequence opt5 from TMX3__Homo_sapiens__NP_061895
auggccgcuuggaaguccuggaccgcccugagacucugcgcgacaguggucguucuggacauggugguguguaaaggcuucgucgaggaucuugacgaauccuuuaaggagaaccggaaugaugacaucuggcugguggauuucuacgcucccuggugcgggcacuguaaaaagcucgaaccuauuuggaacgagguuggacuggaaaugaaaucuaucggcagcccggugaaggucgggaagauggacgccacguccuauucuagcauugccuccgaguuuggagugcgcggcuaccccaccaucaaacuucugaagggggaucucgcuuauaauuacagaggaccucggacaaaagacgauauuaucgaguucgcccaucgcguuucuggcgcucugaucagaccccugccuagccagcaaauguuugaacacaugcagaagcggcaucgcguguucuuugucuaugugggcggggagagcccccucaaagaaaaguacauugacgccgcgagcgagcugaucguguauaccuacuucuuuucugccuccgaggaagucguuccugaguacgugacacuuaaggaaaugccggcugugcuggucuucaaagaugagaccuauuuuguguacgacgaauaugaggauggagaccucagcucuuggauuaacagagagcgguuccagaauuaccuggccauggacggcuuucuucuguaugaacucggggauacaggaaagcugguugcucuggccgugaucgacgagaaaaacaccuccgucgaacacacgcgccucaagagcauuauccaggagguggcgagagauuaccgggaccuguuccaucgcgauuuccaauuuggccacauggacgggaaugauuauauuaacacccuucugauggacgaacucacaguucccaccguggucgugcugaauacaucuaaccagcaguacuuccuucuggauagacagaucaaaaaugucgaggacauggugcaauuuaucaacaauauucucgauggaaccguugaggcccagggcggcgacuccauccugcagcggcugaagcgcauuguguucgacgcuaaaagcacgaucgucuccauuuuuaagucuagcccucucauggggugcuuccuguuuggacuuccccugggcgugaucuccaucauguguuacgggauuuauacagccgauaccgacggaggcuacaucgaagagagauaugaaguuagcaagucugagaacgaaaaucaggagcaaauugaggaauccaaagagcagcaggaaccuagcucugggggaagcgugguccccacagugcaagagccgaaggaugugcucgagaaaaagaaagacuga

SEQ ID NO: 77065 - RNA, 6606 nt, Artificial Sequence
  derived and/or modified sequence opt5 from TNC__Homo_sapiens__NP_002151
augggcgccaugacccagcugcucgcugggguguuccuggccuuucuugcccuggcuacagagggaggcguccucaagaaaguuaucagacacaagcggcaaagcggggugaacgccacgcugcccgaagagaaucagccuguggucuucaaccauguguacaauauuaaacuuccgguuggaucccagugcucuguggaccuggaaagcgccuccggcgagaaggaucucgcucccccuucugaacccagcgaguccuuucaggagcacaccgucgacggggaaaaccaaaucguguucacacauagaauuaauaucccuagacgggccuguggaugcgcugccgcgcccgauguuaaagagcugcugucucgccucgaggaacuggagaaccuugugagcucccugagagaacaguguaccgccggcgcuggcugcugucuccagccugccacagggcggcuggacacccgcccguuuugcagcggaagaggcaauuucucuacagagggguguggaugcgucugugaacccggcuggaaggggccuaacugcuccgagcccgaauguccuggaaauugccaccuucggggccgcugcauugauggccaguguaucugcgacgauggguuuaccggagaggacuguagccaacuggcuugccccucugauuguaacgaccagggcaagugcgugaaugggguguguaucugcuucgagggauaugccggcgcggauuguuccagagaaauuugcccggucccuuguagcgaggaacaugggacgugcguugacggacucugcgugugucacgauggcuuugccggcgacgacugcaacaaaccccugugucugaauaacugcuacaaucgggggcgcuguguggagaacgaaugcgucugugaugagggauucaccggcgaggacugcucugaacucaucuguccuaacgauugcuuugacagagggcgguguauuaauggaacaugcuauugcgaggaaggcuucaccggggaggauuguggcaagcccacaugcccccacgcuugucauacccagggacgcugcgaagagggccagugugugugcgacgagggguuugccggaguugauuguuccgagaaaagaugcccugcugacugucacaaccggggcagaugcguggaugggcgcugugaaugcgacgauggauucacgggcgccgacugcggggaacugaaguguccgaauggcugcagcggacauggccggugugucaacgggcaaugcgugugugacgagggauacacaggcgaggauugcucccagcuuagaugucccaaugacugccacucucgcgggcgguguguugaaggaaaaugcgugugugagcagggcuucaagggguaugauugcagcgacauguccugcccuaacgauugucaccaacauggcagaugcgucaauggaaugugugugugcgacgauggcuacaccggggaagacugucgcgaucggcagugccccagagacuguagcaaccgcggacugugcgucgauggccagugugugugcgaggacggguuuacaggaccugauugugccgaacucucuugccccaaugacugccacggccaggggcgguguguuaacggccaaugcgugugucaugagggauucaugggcaaggacugcaaagagcagagauguccguccgauugccacgggcagggacgcugugucgacggccagugcaucugucaugaaggguuuaccggacuggauugcggccaacacagcuguccuucugacugcaauaaccuuggccagugugugagcgggcggugcauuugcaaugagggauauuccggcgaagauuguucugagguuuccccucccaaggaccugguggucaccgaagugacagaggagacggugaaccucgcuugggauaaugaaaugagaguuaccgaguaccuggucguguacacacccacccacgaagggggacuggagaugcaguuccgggugccuggcgaccagacauccaccaucauucaagaacucgagcccggggucgaguauuuuauccgcguguucgcgauccuggaaaacaaaaagagcauuccgguuucugccagaguggcuacguaccuuccugcccccgagggacugaaauuuaaguccaucaaagaaacaagcgucgagguggagugggauccccucgacauugccuucgaaaccugggagaucauuuuucggaacaugaauaaggaagaugagggcgaaaucaccaagucucugagacgcccugagacauccuaucggcagaccggccuugcuccggggcaggaguacgaaaucagccugcauauuguuaaaaacaauacaagaggacccggccucaagcgcgugacgaccacaagacuggacgccccuucccagaucgaggucaaagaugugaccgacacaaccgcgcugauuacgugguucaagccccucgcugaaaucgacgggauugagcugaccuauggaaucaaagauguuccuggcgaccggacaaccaucgaucuuacagaagacgagaaccaauacucuauugggaaucugaagcccgauaccgaguaugaagugagccucaucucccgcagaggagacaugucuagcaacccugccaaggagacguuuacaaccggccuggaugcgccccggaaucugcgcagagucucccagacagacaacagcauuacccuugaauggcggaauggcaaagcugccaucgauucuuaccgcauuaaguacgcuccgaucuccgggggagaccacgccgagguggaugugccuaaaagccagcaagcgaccacaaagacgacccucacaggccugagacccgggaccgaauauggaauuggcgucucugccguuaaagaggacaaggaguccaacccugcuacaaucaaugccgcuaccgaacuggacacgcccaaggaucuccaggugagcgagacagccgaaaccucucugacccuucuguggaaaacaccgcucgcgaaguucgaccgguaccgccugaacuauagccugccuaccgggcagugggugggaguccagcuucccagaaauacaacguccuacgugcuccggggccuggagccuggccaagaguauaacguucugcucaccgccgaaaaagggagacauaagagcaaacccgcucgcgugaaggccucuacagagcaggcucccgaacuggagaaucuuaccgucacagaagugggaugggauggccugcggcucaacuggaccgccgccgaccaggcuuacgagcacuuuaucauucagguucaagaggcgaacaagguggaagccgcuagaaaucugacggucccugggucccugcgcgccguggauaucccgggacuuaaagccgcuacccccuauacaguuagcauuuacggcgugauccagggguaccggaccccuguccucuccgccgaggcgucuacaggagaaacccccaaccugggcgaggugguggucgcugaaguuggcugggacgcccugaagcucaauuggacagccccugagggggcuuaugaguacuucuucauucaggugcaggaagccgauaccguggaggcggcucaaaaccugacgguccccggaggccuuagaagcacagaccugccugggcucaaagccgccacccacuauaccaucacaauccgcggagugacccaggauuuuuccacgacaccgcugucuguugaagugcugaccgaggaaguccccgacaugggcaaucuuacagugaccgagguuagcugggaugcucuccggcugaacuggacaaccccugacgggacguacgaucaguucaccauucaagugcaggaggccgaccaggucgaagaggcucauaaucugacagugcccggaucccucagaucuauggaaaucccuggccugcgcgccggcacccccuauacagucacccuucacggggaggugcggggacauagcacgagaccgcuggcgguugagguggucacagaagaccucccucagcugggcgaucuggccguguccgagguugggugggacggacuucggcugaacuggaccgcugccgauaaugcuuacgaacacuuugugauucaaguccaggaggugaacaagguggaagccgcccagaaucucacacugcccggcagccuccgcgcuguugacauccccgggcuggaggcggccaccccuuauagagucucuauuuacggagugauccggggcuaccgcacccccgugcuuuccgcugaggccagcacagccaaagaaccugagaucggcaaccugaaugucucugauauuacgccggaauccuucaaccucagcuggauggcuaccgacgggaucuuugagacauucaccauugaaaucauugauucuaauagacugcuggagacaguggaguauaacaucuccggagccgaacggaccgcgcauaucagcggccuucccccuuccacggacuuuauuguuuaccugagcgggcucgcucccucuaucagaacaaagaccauuagcgccaccgccacaaccgaggcucugccucuccuggaaaaccuuacaaucuccgauauuaaucccuauggauucacggugucuuggauggccagcgagaacgcguuugacuccuuccuggucaccgugguugauucuggcaaacuccuggacccgcaggaauuuacacugagcgggacccaacgcaaacuugagcugcggggccucaucacaggaauuggcuacgaggugauggucuccggguucacccagggacaccagacgaagccucugagagcugaaaucgugaccgaggccgaacccgagguugauaaucuccuggugucugacgccacaccugacggcuuucgccuuagcuggaccgcugaugagggggucuucgacaacuucgugcugaaaauccgggauacaaagaaacaguccgaaccccuggagauuacccuccuggccccugaaagaacacgcgacaucacgggacuucgggaggcuaccgaauaugagauugagcuguacggcaucagcaaggggagacgcucucaaacaguguccgccauugcgaccaccgccaugggcagccccaaagaagucaucuuuucugauaucacagagaauagcgcuacgguuagcuggagagccccgaccgcucagguggaauccuuccggauuacauaugugccuaucaccggaggcacacccucuauggucaccguggacgggacgaagacacagacccgccucguuaagcugauucccggaguggaguaccucgucagcaucauugccaugaaaggcuuugaagaguccgagccugugagcgggucuuucaccacagcccuggauggaccguccggccuuguuaccgcuaacaucacagacagcgaagcgcuggccagauggcagcccgcuaucgccaccguggauucuuacgucauuagcuauacgggggagaaggugccugaaaucacacggaccgucuccggcaauacaguggaguacgcccugaccgaccucgaacccgcuacggaguauacccugcgcauuuuugccgagaaaggaccucaaaagucuagcacaaucaccgcgaaauucacaaccgaucuugacucccccagagaccugacagcuaccgaaguucagucugagacggcccuccugacauggcggccuccgagagccagcgugaccggcuaccuccugguguaugaauccgucgaugggaccguuaaggaggugauugugggacccgacacaaccagcuacucucuugcugaucuguccccuagcacacacuauacggccaagauccaggcgcugaacggcccccuccgcuccaauaugauucaaaccaucuuuacaaccaucgggcugcuuuacccuuuccccaaagacugcucucaggccaugcugaacggagauacaaccagcggccucuacacgauuuaucugaauggcgacaaggcugaggcccucgaagucuuuugugauaugaccuccgacgggggaggcuggaucguguuccugcggcgcaagaacgggcgcgagaauuuuuaccagaacuggaaggcuuaugccgcuggauucggcgaucggagagaagaguucuggcuugggcuggacaaucugaacaaaauuacagcccagggacaauacgaacuccggguugaucugcgcgaccauggcgagaccgcguuugccguguaugauaaguucucugucggcgacgcuaagacaagauacaaacuuaagguggagggguauagcggaaccgccggcgacuccauggcuuaccacaaugggcggagcuuuucuacguucgauaaagacacagauuccgccaucaccaacugcgcccugagcuacaagggagcuuuuugguaucgcaacugucauagagucaaucucaugggccgguacggggacaacaaucacucucagggagugaacugguuccauuggaaaggccacgaacacuccauucaguuugcggagaugaagcugcgcccgagcaauuucagaaaccuggaaggccggcgcaaaagagccuga

SEQ ID NO: 77066 - RNA, 951 nt, Artificial Sequence
  derived and/or modified sequence opt5 from TNFAIP1__Homo_sapiens__NP_066960
augagcggcgauaccugccugugucccgccuccggggcuaagccuaaacucucuggauucaagggcgggggacugggcaacaaauacgugcagcuuaaugucgggggaagccuguauuacacaacgguuagagcccucacccggcacgacacaaugcugaaggcgauguuuuccggccgcauggaggugcuuaccgacaaagaaggcuggauccugauugauagaugcgggaagcauuucggaacaauccucaacuaucugcgggacgauaccauuacacugccgcaaaaucgccaggagaucaaggaacucauggcugaggccaaauacuaucugauucagggccuugugaacaugugucagucugcccugcaagacaagaaagauagcuaccagcccgucugcaauaucccuaucauuaccucccucaaggaagaggagagacugaucgaaucuagcacgaaacccgugguuaaacuucuguauaaccgguccaauaacaaguacagcuacaccucuaauuccgacgaucaccuccugaagaacauugagcuguuugacaagcucagccugcgcuucaaugggagagugcuuuuuaucaaagaugucauuggagacgaaaucuguugcuggucuuucuauggccaggggcggaagcuggcugagguguguugcacauccauuguuuacgccaccgagaaaaagcagacaaaaguggaauuuccugaggcucgcaucuaugaagagacccucaacguccugcuuuacgaaacgcccagagugccugauaauagccugcucgaggccacaucucggucccgcagccaagcguccccgucugaggacgaagagaccuucgaacugagagaccgggugcgcagaauccaugucaagcgguauagcacauacgaugacagacagcugggacaccaguccacccaucgcgauuga

SEQ ID NO: 77067 - RNA, 1965 nt, Artificial Sequence
  derived and/or modified sequence opt5 from TNFAIP2__Homo_sapiens__NP_006282
augagcgaggccuccucugaagaccuggugcccccucucgaggcuggcgccgcgccguacagagaagaggaagaggcugccaagaaaaagaaagagaagaaaaagaaaagcaaggggcuggccaacgucuucugcguuuuuaccaagggcaaaaagaaaaagggccagcccuccucugcugaaccugaggaugccgcugggagccggcaaggacuugacggacccccucccacaguggaggaacugaaggccgcgcucgagcgcgggcagcuggaagccgcuagaccucuucuggcccucgagcgggaacuggcugccgcggccgcugccggaggcguguccgaggaggaacugguccgcagacagucuaaaguggaggcucucuaugaacugcuucgggaucagguucugggcgugcuccgcagaccgcuggaggcucccccugaacggcuucgccaagcccuggcugucguggcggagcaggaaagagaggaccggcaggccgcugccgccgggcccggaacgagcggccucgcugccacccgcccuagacgguggcugcagcuguggcgcagagggguugcggaggcugccgaggaacggaugggacaaagacccgccgcuggcgccgaagugccggaguccgucuuccuccaccuggggcgcacaaugaaggaagaucuugaggcugugguggagcggcugaaaccucucuuucccgccgaguucggagucguugcggccuacgcugaaagcuaucaucagcacuuugccgcucaucuggccgcgguggcccaguucgaacuuugugagagagacaccuacaugcugcuccugugggugcagaaucuguauccuaacgauaucauuaauucucccaagcucgucggcgagcugcaaggcauggggcuuggaucccugcugcccccucgccagauccggcuccuugaagcuacauuucugagcucugaggccgcuaacgugagagaacucauggaccgcgcccuggagcuggaagcccggagaugggcugaggauguuccgccccagcgccucgacggccacugccauuccgagcuggcgauugauaucauucaaaucaccagccaggcccaggcuaaagccgaaucuaucacacuugaccuggggucccagauuaagcgggugcuccuggucgagcugccugccuuccuuagaagcuaccaacgcgcuuuuaaugaguuccucgaacggggaaaacagcugaccaacuauagagccaaugugaucgcgaacauuaauaacugucuguccuuucggaugucuauggaacagaauuggcagguuccccaagauacgcucagccugcuucugggcccucucggggagcugaagucccacggauucgacacccugcuucagaaccuccacgaggaccugaagccccuguuuaaacgcuucacacauaccagaugggcugccccgguggaaacacucgagaauaucauugccaccgucgauacgcggcugccugaguucagcgaacuucagggcugcuuuagagaggaacugauggaggcucuccaucugcaccuggugaaggaauacaucauucagcuuucuaaaggccgccucguccugaagacagccgagcaacagcagcagcuggcgggguacauccucgcuaacgccgacaccauccaacacuucuguacacagcacggaucccccgccaccuggcugcagccugcccuucccacccuggccgaaauuauccggcuccaagauccuagcgcuauuaaaaucgagguggccacauaugcgacgugcuaccccgacuuuucuaagggccaucugagcgccauucuggcuaucaaggggaaucuuuccaacucugagguuaaaagaauccgcagcauucucgauguguccaugggagcccaggaaccgagcagaccucuguucucucugaucaaggucggcuga

SEQ ID NO: 77068 - RNA, 2373 nt, Artificial Sequence
  derived and/or modified sequence opt5 from TNFAIP3__Homo_sapiens__NP_006281
auggccgaacaggugcugccccaagcucucuaccugagcaacaugagaaaggccgucaaaauccgggagcgcaccccugaggacauuuucaagccgacaaauggcaucauucaccauuuuaaaacgaugcacagauauacccuugaaauguuccggacaugccaguuuuguccccaguuccgcgagaucauucauaaggcgcugaucgauagaaacauccaggcuacccucgaaucccaaaagaagcugaauuggugccgggagguucgcaaacuuguggcccugaaaacaaacggggacggaaauugucucaugcacgccaccucucaguacauguggggcgugcaggauacagaccugguccugagaaaggcucucuuuagcacccugaaagagacggauacccggaacuucaaguuucgcuggcagcuugaaucccugaaaucucaagaguucguggaaacagggcucugcuaugacaccagaaauuggaacgaugagugggacaaucugauuaagauggccagcacagauaccccuauggcucgguccggacuucaguacaacucucuggaggaaauccauauuuuuguucucuguaauauccugcgcagacccauuaucgugauuagcgacaagaugcugcggucccucgagagcggcucuaacuucgccccucugaaagucgggggaaucuaucuuccccugcacuggccugcgcaggaaugcuaccgcuauccgaucgugcucggcuacgauucccaccauuuuguuccccuggugacgcuuaaggacagcggcccugagauuagagccgucccccuggugaaucgggauagagggcgcuucgaagaccucaaagugcacuuucugacagacccugagaacgagaugaaggaaaaacugcucaaggaguaccugauggucaucgaaauucccguucagggaugggaucauggcaccacacaccuuaucaaugcugccaaacuggacgaggcuaaccucccgaaggaaauuaaccugguggaugacuauuucgagcuugugcaacacgaguacaagaaauggcaggaaaauucugagcaggggcggagagaaggacaugcccaaaacccuauggagcccuccgucccucagcugagccucauggaugugaagugugaaacccccaauugccccuucuuuaugucuguuaacacccagccucugugucacgagugcuccgagcgccggcagaaaaaucaaaacaagcugccgaaacucaauagcaagcccggcccugaagggcugcccggaauggcgcuuggcgccuccagaggcgaggcuuaugaaccucuggccuggaaccccgaggagucuacagggggaccgcauagcgcuccucccacggccccuucccccuuccucuuuagcgaaaccacagccaugaagugucgcucuccuggcugccccuucacccugaaugugcagcacaacggguuuugcgagcggugucauaaugcuagacagcugcacgcgucccacgccccggaccauacacgccaccuugauccuggaaaaugccaggcuugucuccaagacgucacccggacguucaacggcaucugcagcacauguuuuaagagaaccaccgccgaagccucuagcucccugucuacaagccugccucccuccugccaucagcgcagcaaaucugaucccucccggcucgugagaagcccgucuccccacuccugucaccgggcugggaaugacgccccugcgggaugccugagccaggcugcccgcacccccggcgauagaacaggcacguccaagugucggaaagccgggugcguuuacuucggaaccccugagaacaagggcuuuuguacacuuugcuucaucgaauauagagagaauaagcauuuugcugccgcuucugggaaagugagccccaccgccucccgcuuccagaacacaauuccuugccugggacgggaguguggcacccucgggucuacgauguuugaaggcuacugccaaaaguguuucaucgaggcgcagaaccagagauuccacgaagccaaacgcaccgaggaacagcugagaagcucccaacggcgcgacguccccagaacaacccagagcacaucucggccgaagugcgcucgcgccuccuguaaaaauauucuggcuugcagaagcgaggagcuuuguauggaaugccagcauccuaaccaacggaugggacccggcgcccaccgcggggagccugcgcccgaagacccgccuaagcagagaugucgggcccccgcuugcgaucauuuuggaaaugccaaguguaacggcuauugcaaugagugcuuccaguuuaaacagauguacggguga

SEQ ID NO: 77069 - RNA, 834 nt, Artificial Sequence
  derived and/or modified sequence opt5 from TNFAIP6__Homo_sapiens__NP_009046
augaucauucugaucuaccucuuccugcuucugugggaggacacccagggcuggggguuuaaggauggaauuuuccacaacagcaucuggcucgaaagagccgcuggcguguaucaucgggaggcccgcuccgggaaauacaagcugacauaugcggaagcuaaagccgucugcgaguuugaaggaggccaccuugccacguacaagcaacuggaggcugccagaaaaauuggguuccauguuugugcugccggauggauggcgaagggccgggugggcuaucccaucgugaagccugggccgaauugcggauuuggcaaaaccgggaucauugacuacggaauccgccucaacagaucugagcggugggaugccuauuguuacaauccccacgcuaaggaaugcggcggggucuucacagacccuaaacagauuuuuaagagccccggauucccuaacgaguacgaagauaaucagaucuguuauuggcauauucgccugaaauacggccagagaauccaccuguccuuucucgacuucgaucuggaggacgaucccggcugccuugccgacuauguggagauuuacgauucuuaugacgauguucacggguuugugggacgguacuguggcgacgaacugccugacgauaucaucagcaccgggaacgucaugacacucaaguuccuguccgacgcuucugugaccgccggaggcuuucaaauuaaguauguugcgauggauccggugagcaaauccagccaggggaagaauacaucuaccacguccaccggaaacaaaaauuuccuugccggccgcuucagccaucuguga

SEQ ID NO: 77070 - RNA, 567 nt, Artificial Sequence
  derived and/or modified sequence opt5 from TNFAIP8__Homo_sapiens__NP_001071122
auggccaccgacguguucaacagcaagaaucuggcuguccaggcccagaaaaagauccucggcaaaaugguuuccaagucuauugcgacaacgcugaucgaugacaccagcuccgaggugcuugaugaacuguacagagugacacgggaguauacccaaaacaaaaaggaagcugagaagauuaucaaaaaucucauuaagacagucaucaaacuggccauccuuuaccgcaacaaucaguuuaaccaggacgaacuggcccucauggagaaguucaaaaagaaggugcaccaacuggcuaugaccguugugucuuuucaucaggucgauuauacauucgacagaaaugugcugagccggcuccugaacgagugccgcgaaaugcuucaccagauuauccagagacaucugaccgccaaaucccacgggcggguuaauaacguguuugaucauuucucugacugugaguuucucgcugcccuguacaaucccuucggaaacuuuaagccucaccuucaaaaacugugcgauggcauuaauaagaugcucgacgaagagaacaucuga

SEQ ID NO: 77071 - RNA, 555 nt, Artificial Sequence
  derived and/or modified sequence opt5 from TNFAIP8L2__Homo_sapiens__NP_078851
auggagagcuucuccucuaagagccuggcccuccaggcugaaaagaagcugcuuuccaaaauggccggcagaucuguggcgcaccuguuuaucgacgagaccagcuccgaaguccucgaugagcuguaccggguuucuaaggaauauacacauagccgcccccaagcucagagagugauuaaagaccuuaucaagguggccauuaaggucgccgugcugcaccggaacggguccuucggaccuagcgagcucgcucuggccacgcgcuuuagacagaaacugcggcagggcgcuaugaccgcccucucuuucggggagguugauuuuacauucgaagcggccgugcuggcuggacuucugaccgagugccgcgacguccuccuggaacuuguggagcaucaccugacaccgaagucccauggcagaauccggcacguuuuugaucacuucagcgaccccgggcuccugaccgcccuguacggaccugauuuuacacaacaucucggcaaaauuugugacggccugcgcaaacuucuggaugaggggaaacucuga

SEQ ID NO: 77072 - RNA, 879 nt, Artificial Sequence
  derived and/or modified sequence opt5 from TNFAIP8L3__Homo_sapiens__NP_997264
augggcaagcccagacagaacccuagcacccugguguccacacucugcgaggccgaaccgaaagggaagcugugggucaauggauacgcuggcacgcaagggacccgggacgccacacuucagacccgccugaucccccucucuuuccaucugcagagaggaaaaggccuugcggcuccucugagcgcccucuccgcuccccggcugccugagcgccccgccgaugggagaguugccguggacgcucagccugccgcgcggucuauggauagcgacuccggagaacaaucugagggcgaaccggugacagccgcuggccccgaugucuuuagcuccaagagccuggcccuccaggcucagaaaaagauucugucuaagaucgccuccaaaaccguggcgaacaugcuuauugacgauacaagcucugagaucuucgacgagcuguauaagguuaccaaagaacacacgcacaauaagaaagaggcccauaagauuaugaaggaucucaucaaaguggcuaucaagauugggauccuguaccgcaacaaucaguuuucccaagaggaacuugucauuguggagaaauucagaaagaaacugaaccagaccgccaugacaaucguuagcuuuuaugaaguggaguacaccuucgaccggaauguccucucuaaccugcugcacgaauguaaggaucucgugcaugagcuggugcagcgccaccuuacaccuagaacccacggacggauuaaucaugucuuuaaccacuucgcugacguugaauuucuguccacgcucuauagccuggauggcgacugccgccccaaucuuaaaagaaucugugaggggauuaacaagcugcucgacgagaaggugcuguga

SEQ ID NO: 77073 - RNA, 702 nt, Artificial Sequence
  derived and/or modified sequence opt5 from TNF__Homo_sapiens__NP_000585
augagcaccgaguccaugaucagagacguggaacuggccgaggaagcucuccccaagaaaacaggcgggccucagggaucucggcgcugccuguuccuuagccuguuuuccuuccucauugucgccggcgcgacgacccuguuuugucuucugcacuucgggguuaucggaccgcaaagagaggaauuuccccgggaucucucucugauuagcccucuggcucaggccgugcgcuccucuagcagaacacccuccgacaagccuguggcccaugucguggcuaacccccaggccgagggccagcuccaauggcugaaucggcgcgcuaacgcccuucuggcgaaugggguugagcucagagauaaccagcugguggucccuagcgaaggacuuuaccugaucuauucucagguucucuucaaaggccagggcugcccguccacccacgugcugcugacacauaccauuagccggaucgccgugucuuaccaaacaaaggucaaucuccuguccgcuaucaaaagccccugucagcgcgagaccccugaaggggccgaggcuaagcccugguaugagccuauuuaccuuggaggcguguuucagcuggaaaagggggacagacucucugccgagaucaaccggcccgauuaucuggacuucgcggaauccggacagguguacuuuggcauuaucgcccuuuga

SEQ ID NO: 77074 - RNA, 1407 nt, Artificial Sequence
  derived and/or modified sequence opt5 from TNFRSF10A__Homo_sapiens__NP_003835
auggcucccccuccggccagagugcaccugggcgccuuccucgcggucacccccaacccugggagcgcugccuccggaacagaggccgcugccgcuacgcccucuaagguuuggggcagcuccgccgggcggaucgaaccucgcggaggcgggagaggagcgcugcccaccucuaugggccagcauggcccuagcgcccgggcucgcgccgggagagcuccgggaccccggccugcccgcgaggcgucccccagacuucgggugcacaaaacauuuaaguucguggucgugggcguucugcuccaaguggucccuucuagcgccgcuaccauuaaacugcaugaccaguccaucgggacacagcagugggaacacagcccccuuggagagcugugcccgccuggcucucaucgcuccgaacaccccggggccuguaauagaugcaccgagggagugggcuacacaaacgcuagcaauaaccucuuugccugucugccuugcaccgccuguaagucugaugaggaggaacggucccccugcacgaccacacgcaauaccgcuugucaaugcaaacccggcacauucagaaacgacaauagcgcggaaaugugucggaagugcucucgcggguguccuagaggaaugguuaaggugaaagauugcaccccgugguccgacauugagugcguccacaaggagagcggcaacgggcauaauaucugggugauucugguggucacgcucguugugccccugcuucugguggccguccucaucguguguugcuguaucggauccggcugcgggggagauccuaaauguauggaccggguuugcuuuuggagacugggccuucugcgcggccccggggcugaagauaacgcccacaaugagauucucucuaacgccgacagccuguccacauucgugagcgaacagcagauggagucucaggaaccugcugaucugaccggagucacagugcaaucccccggcgaggcccagugucuccuggggccggcggaggcugaaggaagccagcggagacgccuucugguuccugccaauggcgccgaccccaccgagacccucaugcuguuuuucgauaaguuugcuaacaucgugccuuucgacucuugggaucagcuuaugcggcaacuggaccucacgaaaaaugaaauugacgucgugagagccgggacagcuggccccggagaugcccuguaugcgaugcugaugaagugggucaacaagaccggccgcaacgccagcauccauacacuccuggacgcucuugagcggauggaagagagacacgcccgcgagaaaauucaggaucugcucguggacuccgggaaguuuaucuaccuggaagauggaaccggcucugcuguuagccuugaguga

SEQ ID NO: 77075 - RNA, 1323 nt, Artificial Sequence
  derived and/or modified sequence opt5 from TNFRSF10B__Homo_sapiens__NP_003833
auggagcagagaggccaaaacgcccccgcugccagcggggcgcggaagcgccacggaccuggcccgagagaagcucgcggggcccggcccggaccuagagugcccaaaacccugguccucguuguggccgcugugcugcuucuggucuccgccgagucugcucucaucacacagcaggaccuggccccucagcaacgggcggcuccccagcagaagcgcagcuccccuucugaaggccuuugcccgcccgggcaccacauuagcgaggauggaagagacuguaucuccugcaaauacggccaggauuauucuacgcauuggaaugaccugcuguucugucugcggugcacccgcugugauagcggcgaaguggagcuguccccuugcacaaccacaagaaacaccguuugucaaugcgaggaagggacauuucgggaggaagacagccccgagaugugucgcaagugcagaaccggauguccucggggcauggugaaagucggggauugcacgcccuggucugacauugagugcgugcacaaggaauccggaaccaagcauagcggcgagguuccggccguggaagagacagucaccucuuccccugggacacccgccagcccuuguucucucuccggaaucauuaucggcgugaccguggcugccgucguucugaucguggcgguguucgucugcaaaagccuucuguggaagaaagugcuccccuaccugaagggcauuuguuccgggggaggcggggaucccgaacgcguugacagaucuagccagcggccuggagccgaggauaaugugcuuaacgagaucgucuccauucugcagccgacacaggugcccgaacaagagauggaaguucaggagccugcugaacccacgggcgugaauaugcucagcccuggggagucugagcaccuccuggaacccgccgaggcugaaagaucccagcgccggagacuccuggucccggccaacgagggagacccuaccgaaacacuucgccaaugcuuugaugacuucgccgaccuggugcccuuugauagcugggagccucucaugcggaaacugggccuuauggacaaugagaucaaggucgcuaaggcggaagccgcuggccacagagauacccuguauaccaugcucauuaaaugggugaacaagacagggcgcgacgccucuguucauacgcugcuggaugcccucgagacccugggagaacggcuugcuaaacagaagaucgaggaccaucugcucagcuccggcaaauucauguaccuggaggggaaugccgauucugcgaugagcuga

SEQ ID NO: 77076 - RNA, 780 nt, Artificial Sequence
  derived and/or modified sequence opt5 from TNFRSF10C__Homo_sapiens__NP_003832
auggccagaauccccaagacccugaaauucguggucguuauuguggcugugcuccugccuguccuugccuacagcgcgacaacggcucggcaggaggaagugccgcaacagaccguugcuccccagcagcaacgccacuccuuuaagggcgaggaaugcccugccgggucucauagaagcgagcacacaggagccuguaaccccugcaccgaaggcguggacuauacaaaugccuccaacaaugagccuucuuguuuccccugcaccgucuguaaaagcgaucagaagcauaaauccucuugcacaaugacccgggacacggugugucagugcaaggaggggaccuuucgcaacgaaaauagcccugagauguguagaaagugcucccgguguccgagcggagaaguucaggugucuaacugcacauccugggaugacauccaaugcgucgaggaguucggcgcuaaugccaccguggaaacacccgcggccgaggaaaccaugaacacgagcccugggacacccgcuccugccgcugaggaaaccaugaauacaucucccggaaccccggccccugcggccgaggagaccaugacaacgucccccggcaccccugcucccgccgcugaagagacaaugaccacaagccccggcaccccugccccggccgcugaagagacgaugacaaccucucccgggaccccugcguccagccacuaccuguccuguacaauugugggaaucauuguccucaucguucugcuuaucguguuuguguga

SEQ ID NO: 77077 - RNA, 1161 nt, Artificial Sequence
  derived and/or modified sequence opt5 from TNFRSF10D__Homo_sapiens__NP_003831
augggccugugggggcagagcgugcccaccgccuccucugcuagagccggacgguacccuggcgcgcgcacagcuagcgggacgagaccguggcuccuggaccccaagauccuuaaauucgucguuuuuauuguggccgugcugcucccuguccggguggauuccgccaccaucccccgccaagacgagguuccucagcagacaguggcuccccagcaacagagacggucucugaaggaagaggaaugcccugccggaagccaccgcuccgaguauaccggcgcuuguaacccgugcacagaaggggucgauuacaccauugccucuaauaaccuucccagcugucugcucugcacaguguguaaauccggacagaccaauaagagcucuugcacgaccacaagagacaccguuugucagugcgagaaaggcuccuuccaagauaagaacagcccugagaugugucggacaugccgcaccggcugucccagagggauggugaaggucucuaauugcacgccucgguccgacaucaaaugcaagaacgaaagcgcggccucuuccacaggaaaaacccccgcugccgaggaaacagugaccaccauucugggcaugcuggcuagcccguaucauuaccucaucaucauugugguccugguuaucauucuugccgugguggucgugggguuuuccugucgcaagaaauucaucucuuaucugaagggaauuugcagcggcgggggaggcggcccugagagaguucaccgggugcucuuucgcagacgguccugucccagcagagucccuggggcggaggauaaugcccgcaacgaaacacugucuaaucgguaccuucagcccacccagguguccgagcaggaaauccaaggacaggagcuggcugaacucacgggcguuacaguggagcugcccgaggaaccucagagacugcucgagcaagccgaagcugaggggugccagcgccggagacugcuugucccggugaacgacgccgauagcgccgacauuucuacccugcucgaugcuagcgcgacacuggaagagggacaugccaaggagaccauccaggaccagcuugucggcuccgaaaaacuguucuaugaggaagaugaggcugggucugccacgagcugucucuga

SEQ ID NO: 77078 - RNA, 900 nt, Artificial Sequence
  derived and/or modified sequence opt5 from TNFRSF11A__Homo_sapiens__NP_001257880
auggcccccagagcucggcgcagacggccucuguucgcccuccugcuucugugcgcgcuccuggcucgccuucagguggcccugcaaaucgccccgcccuguaccagcgagaagcacuacgaacaucucggcagaugcuguaacaaaugcgagccugggaaguauauguccucuaaauguacaacgaccagcgacuccgucugccugcccuguggaccugaugaauaccuggacucuuggaaugaggaagauaagugccuccugcacaaaguuugugacacaggcaaggcucuuguggccguggucgcugggaacagcaccacaccccggcgcugcgccuguaccgcgggauaucauuggucccaggauugcgagugcuguagacggaauacagagugcgccccuggccugggggcucagcacccgcuccagcugaacaaggacaccguguguaaacccugccuugccggauacuuuucugaugcuuucagcuccacggacaagugucgcccuuggaccaauugcacauuucugggcaaaagaguugaacaucacggcaccgagaaaagcgaugccguguguucuuccagccuccccgcgcggaaaccucccaacgggaaugucacaggaaacucuaauuccaccuucauuagcucuggccaagugaugaacuuuaagggggacaucauuguuguguaugucucccagacgagccaggaaggagccgcugccgcugccgagccgaugggccgcccugugcaggaggaaacacuggccagacgggauuccuucgcugggaauggaccccgcuuuccugaccccugcggcggccccgaggggcugagagaaccugagaaggcgucucggccggugcaagaacagggaggcgccaaggcuuga

SEQ ID NO: 77079 - RNA, 1206 nt, Artificial Sequence
  derived and/or modified sequence opt5 from TNFRSF11B__Homo_sapiens__NP_002537
augaacaaucugcucugcugugcccugguguuccuugacaucagcauuaaguggaccacacaggagacguuucccccuaaauaccugcacuaugaugaagagaccucccaucaacuccugugcgacaaguguccgcccggcacauaccuuaaacagcacugcaccgcuaaguggaaaacagucugugccccuugccccgaucauuauuacaccgacucuuggcacacaagcgaugaaugucuguauugcuccccuguuuguaaggagcuccaguacgugaagcaggaaugcaacagaacccauaaucgggugugugagugcaaagaggggcgcuaucuggaaaucgaguucugccugaagcacagaucuugucccccuggauuuggcgucgugcaagcggggacgccggaacggaacaccguuugcaaacgcugucccgacggauucuuuagcaaugagacauccucuaaggcuccuugcagaaaacacaccaacuguagcguguucggccuccugcuuacacagaaggggaaugccacccaugauaacauuugcuccggaaauagcgagucuacgcagaaguguggcaucgacgucacacugugcgaagaggccuuuuuccgguuugcugugcccaccaaauucacaccuaacuggcucuccguucugguggauaaucuucccggcaccaaggucaacgccgaaagcguggagcgcauuaaaagacagcacucuucccaagaacagaccuuucagcugcucaagcuguggaaacaucagaauaaggaccaagauaucgugaaaaagaucauucaggacaucgaucugugugagaacagcguccagcggcacauugggcacgcuaaucucacauucgagcaacugcgcucucuuauggaaucccugccgggaaagaaaguuggcgccgaggacaucgaaaagacgauuaaagcgugcaagccuagcgaccagauccucaaacugcuuucccuguggagaauuaagaacggggaucaggacacccucaagggacugaugcaugcccugaaacacucuaagacauaccauuuucccaaaaccgugacacagagccucaagaaaaccauccgguuccugcacuccuucacgauguacaaacuuuaucaaaagcuguuucucgagaugaucggcaaccaggugcagagcgucaagauuucuugucuguga

SEQ ID NO: 77080 - RNA, 390 nt, Artificial Sequence
  derived and/or modified sequence opt5 from TNFRSF12A__Homo_sapiens__NP_057723
auggccagaggcagccugcggcgccuccugagacuucuggugcucgggcuguggcuugcucugcuccgguccgucgccggagagcaggcgcccggcaccgcuccuugcucucgcgggagcuccuggucugccgaccuggauaaguguauggacugcgccagcuguagagcucggccgcacuccgauuucugccugggaugugccgcugcgcccccugcccccuuucgccuccuguggccuauccuuggcggggcccugucucucacauucguucugggacuucugagcggcuuucucguguggagacggugccgcagacgggaaaaauucacgacccccauugaggaaacaggcggggagggauguccugcuguggcccugauccaauga

SEQ ID NO: 77081 - RNA, 882 nt, Artificial Sequence
  derived and/or modified sequence opt5 from TNFRSF13B__Homo_sapiens__NP_036584
augagcggccuggggagaucccggcgcggaggcagaucucggguggaccaggaggaacgcuucccccaagggcucuggaccggagucgccaugagaagcugcccugaggaacaguacugggauccgcugcuuggcacauguauguccugcaagacgaucuguaaccaccagucucagcggaccugcgcugccuuuugucgcagccuguccugcagaaaagagcaagggaaguucuaugaccaucuccugcgggauuguauuucuugcgcgagcaucuguggacagcaccccaaacagugcgcuuacuuuugugaaaauaaacuucgcuccccuguuaaccugcccccugagcucagacggcagcgcagcggcgagguggaaaauaacucugacaauuccggcagauaucaagggcuggagcaucggggaagcgaagccucucccgcccugccuggccucaagcuguccgcugaucagguggcccuugucuacagcacacuggggcucugccugugcgcugugcuuuguugcuuccugguugccguggcguguuuucucaagaagcgcggagacccgugcucuugucagcccagaucccggccuagacagagccccgccaaauccucucaagaucacgcuauggaggccggcagcccugucuccaccagccccgagccgguggaaacaugcucuuucuguuuuccugagugccgcgcucccacccaggaauccgccguuacaccugggacccccgaccccacgugugcgggacgguggggcugccauaccagaacaaccgugcugcagccuuguccgcacauucccgauagcggccuggggaucgucugcgugccugcccaagagggaggccccggggcuuga

SEQ ID NO: 77082 - RNA, 555 nt, Artificial Sequence
  derived and/or modified sequence opt5 from TNFRSF13C__Homo_sapiens__NP_443177
augagacggggcccccgcagccugagagggcgggacgccccugcuccgacccccugcgugccugccgaguguuucgaucuccugguccgccacugcguugcguguggacuucugagaacaccccggccuaagcccgcuggcgccuccucuccugccccgcgcacggcucuccagccccaagaaagcgugggggccggagcuggcgaggccgcgcugccucuucccgggcugcucuuuggagccccugcucugcugggccucgcccuggugcuugcucugguccucgugggccugguuuccuggagacggcgccagagacggcuucgcggggccucuagcgcggaagcccccgacggagauaaagacgcuccggagccucuggauaaggugaucauucucucccccggcaucucugacgccaccgcuccugccuggcccccucccggggaagauccgggaacaacacccccuggccauagcguccccgugccugccaccgagcugggguccaccgagcugguuacaaccaaaacggcuggacccgaacagcaguga

SEQ ID NO: 77083 - RNA, 555 nt, Artificial Sequence
  derived and/or modified sequence opt5 from TNFRSF14__Homo_sapiens__NP_001284534
auggagcccccuggcgacugggggccgcccccuuggagaagcacccccaagacagaugugcugcggcucguccuguaccuuacguuccugggagccccuugcuaugcucccgcccucccuuccuguaaagaagacgaguacccgguuggcucugaaugcugucccaagugcagcccuggguaucgcgugaaagaggcguguggagaacugaccggcacagugugcgagcccuguccucccgggaccuacaucgcucaccuuaacggacuguccaagugccuccagugucaaaugugcgauccggccaugggccugagagccucucggaauuguagccgcacagagaacgcugucugcggcugcuccccugggcauuuuuguauugugcaggacggagaucacugcgccgcuuguagagccuaugcgaccucuagccccggccagcggguucagaaagggggaacagaaucccaagacacccugugccagaauuguccucccggcacguucagccccaacgggacccucgaggaaugccagcaucagacaaaguga

SEQ ID NO: 77084 - RNA, 858 nt, Artificial Sequence
  derived and/or modified sequence opt5 from TNFRSF19__Homo_sapiens__NP_001191388
auggagugcgugcccuguggcgacccuccgcccccuuacgaaccccacugcgccagcaaggucaaccugguuaaaaucgcuuccaccgccucuagcccuagagauacagcgcucgcugccgugauuuguuccgcccuggcuacggugcuucuggcccuccugauccuuugcgucauuuauuguaagcggcaguucauggagaaaaagcccucuuggagccugcgcucccaagacauccaguacaaugggucugaacucagcugcuuugauagaccucagcugcaugaguaugcucaccgggccuguugccagugucgcagagacuccgugcaaaccugcggaccgguucggcugcuccccagcauguguugcgaagaggcgugcucuccuaaccccgccacacugggcuguggggugcauuccgcugccagccuucaggcucgcaaugccggaccugcgggcgagaugguccccaccuucuuugggucucugacacaguccauuugcggagaguucagcgaugccuggccgcucaugcagaacccuaugggcggcgacaauaucucuuuuugugauuccuaccccgaacugaccggggaagacauccacagccuuaacccugagcuggaguccucuacaagccucgauuccaauagcucucaagaccuggugggaggcgcuguucccgugcagucccauagcgaaaacuucaccgccgcuacggaucugucuagauauaauaacacccucgucgagagcgccuccacacaggacgcccugaccaugcggucucagcuugaucaagaaagcggggcugugauucaccccgcgacacagaccucccugcaggaggccuga

SEQ ID NO: 77085 - RNA, 1368 nt, Artificial Sequence
  derived and/or modified sequence opt5 from TNFRSF1A__Homo_sapiens__NP_001056
augggccugagcaccgugcccgaccuccugcuuccucugguccuccuggagcuucugguugggaucuacccguccggagugauuggccucgugccccaccugggggauagagaaaagcgggacucugucugcccucagggaaaauauauccauccccaaaacaauagcauuuguugcacaaagugucacaaaggcacguaccuguauaacgauugcccugggcccggacaggacaccgauugucgcgagugcgaauccggcucuuucacagccagcgagaaucaucucagacacugucuguccugcucuaagugucggaaagaaaugggccagguggagaucagcuccugcaccguugaccgcgauacagugugugggugcagaaagaaccaguaccggcauuauuggagcgagaaucuuuuucaaugcuucaacuguucucugugccucaauggaaccguccaccuguccugucaggaaaagcagaacacagugugcaccugucacgcuggcuuuuuccuucgcgagaaugaaugcguuagcuguucuaacugcaaaaagucccuggaguguacgaaacucugccugccucagauugagaaugugaaggggaccgaagacagcggaacaaccguccugcucccgcuggugaucuuuuucggccuuugucugcucucucugcuuuuuaucgggcugauguacagauaucaacgguggaaauccaagcucuacagcauugugugcggaaaguccacacccgagaaagaaggcgagcuggaaggcaccacgacaaagccucuggcccccaacccuucuuucagccccaccccgggguuuacaccuacccucggauucucccccgucccuagcucuaccuuuacauccagcucuacguacacccccggcgauugccccaauuucgcggcuccucgcagagagguugccccgcccuaucagggggccgacccuauccuggcuacagcccuugcuagcgaucccauuccuaacccccugcagaaaugggaggacuccgcccauaagccgcagucucucgauaccgacgacccugcgacacuguacgccgugguggaaaaugugcccccucuucgguggaaagaguuuguccgcagacugggacucagcgaucacgaaaucgaccggcuggagcugcaaaacggccgcugucucagagaagcucaguauuccaugcuggccaccuggcggagacgcacgccccggagagaggcuacacuugagcugcucgggcgcguucugcgggauauggaccugcuuggaugccucgaagauauugaggaagcccuguguggcccugcggcccugcccccggcuccuagccuccugagauga

SEQ ID NO: 77086 - RNA, 1389 nt, Artificial Sequence
  derived and/or modified sequence opt5 from TNFRSF1B__Homo_sapiens__XP_011540365
auggcccccguggcugucugggccgcgcuggcuguuggccucgagcugugggccgccgcucacgcccuuccugcucagguggccuucaccccguacgcgcccgaaccugggagcacaugcagacugcgggaguauuacgaccaaacggcccagauguguugcuccaaguguucucccggacagcaugcuaaaguguuuugcaccaagacaagcgauaccgucugugacuccugcgaagauucuacauauacccagcucuggaacugggugccugagugucugagcugcggcucccgcuguucuagcgaccaaguugaaacacaggccugcaccagagagcagaaucggaucuguacgugccgccccgggugguacugcgcucuuuccaaacaggagggauguagacugugcgccccucuccggaagugucgcccgggcuucgggguggcgagacccggaaccgaaacaagcgaugucgugugcaaaccuugugcccccggcaccuuuucuaacacaaccuccagcacggacauuugccggccucaccaaaucuguaauguuguggcuauucccggcaacgccucuauggaugcugucugcacauccaccagcccgacacgcucuauggccccuggggccgugcaucugccccagccuguguccaccagaagccagcacacccagcccacacccgagccuuccacggcuccgucuaccagcuuccugcuccccaugggaccuuccccucccgcggaaggcagcacaggggacuuugcccugcccgucggacuuaucguuggcgugaccgcucuggggcuccugauuaucggaguggucaauugugugaucaugacacaaguuaagaagaaaccgcuuugccugcagcgggaggccaaggugccucaucuccccgccgauaaagcucgcggcacccagggcccugagcaacagcaucugcugauuacggcccccucuuccagcucuagcucccucgaaucuagcgcguccgcucuggacagacgggccccuacacgcaaccagccccaggccccgggggucgaggcuagcggagccggcgaagcuagagccucuaccggguccagcgcggauucuuccccuggaggccacgggacccaagugaauguuacauguaucgugaacgucugcagcuccucugaccacagcucccagugcucuagccaggccuccagcaccaugggagauacagacucuucccccagcgagucucccaaggacgaacaggugccuuucuccaaagaggagugugcuuuucggagccaacuugaaacgccggagacccugcucggcucuacagaagagaagccccugccucuuggcguccccgaugccgggaugaagccuagcuga

SEQ ID NO: 77087 - RNA, 1968 nt, Artificial Sequence
  derived and/or modified sequence opt5 from TNFRSF21__Homo_sapiens__NP_055267
augggcaccagccccuccucuagcacagcccuggcuuccugcucuagaaucgcccggcgcgcgacggcuaccaugauugccgggagccuccugcuucugggauuccucuccacaaccacagcccagccugagcaaaaggcuucuaaccugaucggcaccuacagacacguggaccgggccacagggcagguccuuaccugugauaaaugcccggcuggaacguauguuagcgaacauuguaccaauacaucccugcgcgugugcagcucuugucccgugggcaccuuuacaagacacgagaacgggauugaaaagugccaugacuguucccagccuugccccuggccuaugaucgagaaacuccccugugccgcgcugaccgaucgggaaugcacguguccuccgggaauguuccagagcaaugccacaugcgcuccccacaccgucugcccugugggcuggggcguucgcaagaaagggacagagaccgaggacgugagauguaagcaaugcgcccggggaaccuuuucugauguccccuccagcgugaugaaguguaaggcuuacacagacugccugucucagaaccucguugugauuaaaccuggcacgaaagaaaccgauaaugucugugggacacugcccuccuucagcuccucuaccagcccguccccuggaacagccaucuuuccccgcccugagcauauggaaacccacgaggugcccagcucuacguaugugcccaagggcaugaacuccacagagagcaauucuagcgcguccgucagaccuaaaguucuuucuagcauccaggaagggaccgugccggacaacaccuccagcgcccggggaaaggaggaugugaauaagacacugcccaaccuccaggucgugaaucaccaacagggcccucaucaccgccauauucugaaacuucugcccucuauggaagcuaccggcggggagaaguccagcacaccuaucaaaggacccaagagaggccacccgcggcagaaccuccacaaacauuucgacauuaaugaacaucugccuuggaugaucguucuguuucuccugcuugugcuggucgugauuguugugugcucuauccgcaaguccagcagaacgcucaaaaaggggccccggcaggauccuuccgccauugucgagaaggcuggacugaaaaagucuaugacccccacacaaaacagagagaaauggaucuacuauuguaauggccacgggaucgacauucuuaagcugguggccgcccaggucggaagccaguggaaagauaucuaccaauuccucugcaacgcuuccgaacgcgagguggcggccuuuucuaacggcuauaccgcugaccacgaacgggccuacgccgcucugcagcauuggacaauuagaggcccugaggccagccuggcgcagcucaucuccgcucugcgccagcaccggagaaaugacguuguggaaaagauucgcgggcuuauggaggauaccacgcaacuggagaccgacaagcucgcccugcccaugagcccgucuccucuuucccccagccccaucccuucuccgaacgccaaacuggaaaauuccgcucuccugacagucgagcccagcccucaggauaagaacaaaggauucuuuguggacgaaucugagccccugcuccggugugauagcaccuccagcgggucuuccgcccugagcagaaauggcuccuucaucacaaaggaaaagaaagacaccguucuucgccaggugcggcuggauccuugcgaccuccagcccauuuuugaugacaugcugcacuuccugaacccugaggagcuuagagucaucgaagagauuccccaagcugaagauaagcucgaccgccuguucgagaucauuggagugaaaucucaggaggccagccagacgcugcucgacuccguguacucucaucugccggaucuucuguga

SEQ ID NO: 77088 - RNA, 903 nt, Artificial Sequence
  derived and/or modified sequence opt5 from TNFRSF6B__Homo_sapiens__NP_003814
augagagcccuggagggccccgggcucagccugcuuugccuggugcucgcucugccugcccuucugccgguccccgcgguucggggaguggcugaaaccccuacauaccccuggcgcgacgccgagacgggcgaaagacucgugugugcccagugcccucccgggaccuucguccaacggccuugucgcagagauuccccgacaaccugcggacccuguccuccccggcacuauacacaguuuuggaacuaccuggagcgcugcagauauuguaaugugcugugcggcgaacgggaggaggaagcucgcgccugucaugcuacccacaacagagccugccggugucgcacaggguucuuugcgcaugccggauucugccucgagcacgcuucuugcccucccggcgccggcguuaucgcuccggggaccccuagccagaauacgcagugucaacccugcccucccggaaccuuuuccgccucuagcuccucuagcgaacagugucagccccauagaaacugcacagcgcugggccuugcccugaaugugccuggguccagcucucacgacacccucuguacauccugcaccggauucccgcugagcacgcggguccccggcgcugaggagugugaacgcgccgugauugauuuuguugcuuuccaggacaucucuauuaagagacuucaacggcugcuccaggcccuggaggccccugaaggguggggacccacaccuagagcuggccgcgcggcccugcagcucaaacugcggagacgccuuaccgagcugcucggcgcucaggauggggcccugcuugugcggcugcuccaagcccugagagucgcucgcaugcccggacuggaacgguccgugagagagcgcuuucucccggugcacuga

SEQ ID NO: 77089 - RNA, 1785 nt, Artificial Sequence
  derived and/or modified sequence opt5 from TNFRSF8__Homo_sapiens__XP_011540743
augagagugcugcucgccgcucugggccuucuguuccucggggcccugcgggcguuuccccaggaccgcccuuucgaggauaccugccacggaaacccgagccauuacuaugacaaggcugucagacgguguugcuaccgcugucccaugggccuuuuuccuacacaacagugcccccagagaccuacggauugucggaaacagugcgaacccgacuauuaccuggaugaggccgaccgcuguaccgccugcguuacauguuccagagaugaccucguggaaaagaccccuugcgcuuggaacucuagccgggugugugagugccgcccggggauguucugcuccacaucugccgucaauagcugugcuagaugcuuuuuccacuccgugugucccgccggaaugaucguuaaauuuccuggcaccgcgcaaaagaauacagugugcgaacccgccucuccuggggucagccccgcuugugccuccccggagaacugcaaagagccuagcucuggaaccauuccccaggcuaagccuacgcccgugucccccgccaccagcucugcguccacaaugccuguucggggcggcacccgccuggcccaggaagcugccagcaagcugacaagagcuccggauucucccuccagcguggggcggccuuccucugaccccggacucagcccuacccagcccuguccggagggcuccggggauugccgcaaacaaugugaaccugacuauuaccuggaugaggccggaagaugcacggccugugucagcugcucucgggacgaccuuguggagaagacacccugcgcuuggaacuccagcagaaccugugaaugccgcccuggcaugaucugugcgacaucugccaccaauagcugcgcucggugugugcccuauccuauuugcgccgccgagaccgucacaaaaccccaggauauggcugaaaaggacacgaccuucgaggccccgccucuggggacacagcccgauuguaaucccaccccugaaaacggagaggcgccggcuuccacaucucccacccagagccuccugguugacucccaagccagcaaaacgcuuccuauccccacaucugccccuguggcucuguccagcaccggcaagcccgugcucgaugccggcccuguccuguuuugggugauucugguucucguggucgugguugggucuuccgcuuuccugcuuugccauagacgcgccugucggaagagaauccgccagaaacugcaccucugcuaccccgugcagaccagccaaccgaagcuggagcuugucgacucccggccuagacgcucuagcacacugcgguccggagcgucugugaccgaacccgucgccgaggaaagaggccucaugagccagccucugauggagacaugucauuccgugggggcugccuaccuggaaagccucccccugcaggaugcuucuccggccggaggcccuuccagcccccgcgaccuuccugagccccggguuucuacggagcacaccaauaacaaaaucgaaaagauuuauaucaugaaagcggauacagugauugucgggaccgugaaggccgagcugcccgaaggaagaggccucgcuggcccugccgagccggaacuggaggaggaacuugaggcugaccacacaccccauuacccugaacaggagaccgagcccccucugggguccugcagcgauguuaugcucucuguggaagaggaaggaaaagaggacccccugccuacggccgccagcggcaaguga

SEQ ID NO: 77090 - RNA, 306 nt, Artificial Sequence
  derived and/or modified sequence opt5 from TNFSF10__Homo_sapiens__NP_001177871
auggccaugauggaggugcagggcgggcccagccugggacaaaccugcguccucaucguuauuuucacagugcugcuucagucccuguguguggcugucacguacguguauuuuaccaacgaacucaagcagaugcaggacaaauacucuaagagcggcaucgccugcuuccugaaagaggaugacuccuauugggauccuaaugacgaagagucuaugaacagcccguguuggcaaguuaaguggcagcuuagacagcuggugcggaaaacaccccgcaugaagagacucugggcggcuaaguga

SEQ ID NO: 77091 - RNA, 954 nt, Artificial Sequence
  derived and/or modified sequence opt5 from TNFSF11__Homo_sapiens__NP_003692
augagacgggccagccgcgacuacaccaaguaucugagaggcuccgaggaaaugggagggggccccggggcuccucacgagggaccgcuccaugcgcccccucccccugcuccccaccagccuccggccgccucucggagcauguucguggcccugcuuggccuggggcucggacaagucguuugcuccguggcucuguuuuucuacuuucgcgcccagauggaucccaacagaaucucugaagacggcacacauuguauuuaucggauccuucgccugcacgagaaugcugauuuccaggacacgacccucgaaagccaggauacaaaacugauuccugacuccugcagacggaucaagcaagccuuucagggcgcggugcagaaagagcugcagcauauugucgggucucaacacauccgcgccgagaaggcuaugguggauggaagcuggcucgaccuggccaaaagauccaaacuugaagcucagcccuucgcccaccugaccaucaacgcgacagauauuccuagcggcucucauaagguuucccucagcucuugguaccacgaccgggggugggccaagaucuccaauaugaccuuuagcaacggaaagcugauugugaaucaggauggcuucuauuaccuuuaugcuaacaucuguuuucgccaucacgagacaucuggggaccuggccaccgaauaccuccagcugauggucuacgugacgaaaaccuccauuaagauccccagcucccacacacugaugaaaggaggcucuaccaaguauuggagcggcaauuccgaguuccauuuuuacagcauuaacguugggggauucuuuaagcucagaucuggcgaggaaaucuccaucgaggugagcaauccgucucugcuugauccugaccaagacgcuacauauuucggggccuucaaaguccgggauauugacuga

SEQ ID NO: 77092 - RNA, 750 nt, Artificial Sequence
  derived and/or modified sequence opt5 from TNFSF12__Homo_sapiens__NP_003800
auggccgcuagacggagccagcgcagacggggccgcagaggggagcccggaaccgcccugcucgugccucuggcgcuuggccuggggcucgcucuggccugccuuggacugcuccuggccgucguuucccugggcucucgggcuagccucuccgcccaagaaccggcucaggaggaacugguggccgaggaagaccaggaucccucugagcuuaacccucagacagaggaaagccaagaccccgcgccuuuccugaaucgccucgugagaccccggcgcuccgccccuaaggggagaaaaacgcgggcucgcagagccaucgcugcccacuacgagguccauccgcggcccggacaggauggcgcgcaggccggcguggacgggaccguuucuggaugggaagaggcucgcauuaacagcuccagcccucugagauauaaucggcagaucggcgaguuuauugugacaagagccgggcuuuacuaucuguacugucaaguccacuucgaugaaggaaaggcuguguaucucaaacuggaccugcucguugauggcgugcuggcccuucgcugccuggaggaauuuucugccaccgcugcguccagccucgggccccagcugcggcuuugucaggucucuggacugcucgcccugagaccuggcuccagccugcgcauccggacacuccccugggcucaucugaaggccgccccguuccuuaccuacuuuggccuguuccaggugcacuga

SEQ ID NO: 77093 - RNA, 993 nt, Artificial Sequence
  derived and/or modified sequence opt5 from TNFSF12-TNFSF13__Homo_sapiens__NP_742086
auggccgcuagacggagccagcgcagacggggccgcagaggggagcccggaaccgcccugcucgugccucuggcgcuuggccuggggcucgcucuggccugccuuggacugcuccuggccgucguuucccugggcucucgggcuagccucuccgcccaagaaccggcucaggaggaacugguggccgaggaagaccaggaucccucugagcuuaacccucagacagaggaaagccaagaccccgcgccuuuccugaaucgccucgugagaccccggcgcuccgccccuaaggggagaaaaacgcgggcucgcagagccaucgcugcccacuacgagguccauccgcggcccggacaggauggcgcgcaggccggcguggacgggaccguuucuggaugggaagaggcucgcauuaacagcuccagcccucugagauauaaucggcagaucggcgaguuuauugugacaagagccgggcuuuacuaucuguacugucaaucuuccgaugcucucgaagccugggagaacggagaacgcagccggaagagacgcgccguccugacccagaaacagaagaaacagcacucugugcugcaucucguucccaucaaugcuacauccaaggacgauagcgacgugaccgaggucauguggcaaccugcgcugcggagaggccgcgggcuucaggcccagggauauggcgugcggauucaagaugcuggcguguaccugcucuauucucagguccuguuccaggacguuacauuuaccaugggacaggugguguccagagaagggcaaggccgccaggagacgcuuuuccggugcaucagaagcaugcccucccacccggaucgcgccuacaacucuuguuacagcgccggggucuuucaucugcaccagggagacauccucuccgugauuaucccucgggcuagagccaagcugaaucugagcccccacggcaccuuccucggguuuguuaaacuguga

SEQ ID NO: 77094 - RNA, 801 nt, Artificial Sequence
  derived and/or modified sequence opt5 from TNFSF13B__Homo_sapiens__NP_001139117
auggacgauagcaccgagagagaacagucccggcugacaucuugccucaagaaacgcgaggaaaugaagcugaaagagugugugagcauccuucccagaaaggaauccccuucuguccggagcuccaaagacggcaagcugcucgccgcuacgcugcuucuggcccuccugucuugcugucugaccguugugagcuucuaccaaguggcggcucuccagggggaucuggccucccuucgcgccgagcugcagggacaccaugcugagaagcucccggccggcgcuggggcccccaaagcgggacuggaagaggccccugcugucacagccggccuuaagauuuuugaacccccugcucccggggagggaaacagcucucaaaauuccagaaacaaacgggccgugcagggcccugaggaaaccggcagcuauacauucguuccguggcugcucucuuuuaagcgcggguccgcgcuggaggaaaaagagaauaagauccuggugaaggaaaccggauacuucuuuauuuauggccagguccucuacacagacaaaaccuaugccauggggcaccugauccagagaaagaaagugcauguuuucggagaugagcuuagccuggugacgcucuuucggugcauucagaacaugcccgagacccugccuaauaacucuuguuacuccgcuggcaucgccaaacuugaagagggggacgaacugcaacucgcuaucccccgcgagaaugcccagauuagccuggauggagacgucacauucuuuggcgcccugaagcuccuguga

SEQ ID NO: 77095 - RNA, 669 nt, Artificial Sequence
  derived and/or modified sequence opt5 from TNFSF13__Homo_sapiens__NP_001185552
augcccgccagcuccccuuuccugcucgcuccgaaggggcccccugggaacaugggaggccccgugagagagccugcccugucugucgcgcuuuggcugagcuggggcgcugcccucggagccguugcuugcgccauggcucugcuuacccagcaaacagaacugcagucccuccggcgcgaggugucuagacugcagggcaccgggggacccagccagaauggcgaaggcuacccuuggcaaucccugccggagcagcacucugugcuccaucugguccccaucaacgccacgagcaaagacgauuccgacgugacagaaguuauguggcagccugcgcuucggcgcgggagaggacugcaggcccaaggcuauggggugcggauucaggaugcuggagucuaccuccuguauagccaggugcuuuuucaggacguuaccuucacaaugggccaaguggucucucgcgaggggcagggaagacaggagacccuguuucgguguauccgcuccaugcccagccacccugauagagccuacaauucuugcuauuccgcuggcguguuccaucuccaccaaggcgacauucugagcgugaucauuccccgggcccgcgcgaagcugaaccucucuccgcaugggacauuucugggauucgucaaacuuuga

SEQ ID NO: 77096 - RNA, 723 nt, Artificial Sequence
  derived and/or modified sequence opt5 from TNFSF14__Homo_sapiens__NP_003798
auggaggaaagcguggucagacccuccguuuucgugguggacggccagaccgauaucccuuuuacacggcuggggcgcucucacagacggcaaagcugcuccgucgcccgcgugggacucggccugcuucugcuccugaugggggcuggacuugccguucagggcugguuccugcuccagcugcauuggagacugggggagauggugacgcggcucccggacggacccgcgggcucuugggaacagcugauucaagagcgcagaagccacgaagucaacccugcugcccaucuuaccggcgccaauuccucucugacagggagcggaggcccccuccugugggagacccagcuugggcuggcuuuucuccggggacuguccuaccacgauggcgcccuggugguuacaaaggcuggguauuacuauaucuacagcaaagugcagcucggaggcgucggcuguccucuggggcuugccucuaccauuacacauggacuguauaagcgcacccccagauacccugaggaacucgagcugcuugugucccagcaaagcccgugcggccgggcgacgucuuccagccgcguguggugggacucuuccuuccucgggggagucguucaccuggaagccggcgagaaagugguggucagagugcuggaugagcggcugguucgccucagagacgggacccggagcuauuuuggagcuuucaugguguga

SEQ ID NO: 77097 - RNA, 579 nt, Artificial Sequence
  derived and/or modified sequence opt5 from TNFSF15__Homo_sapiens__NP_001191273
augcagcugaccaagggcagacuccacuucagccauccccugucccacacaaaacauaucucuccuuuugugacggacgccccgcuucgggcugauggggacaagccccgcgcccaccugaccgucguuagacaaacaccuacccagcauuucaaaaaccaguuucccgcgcuccacugggagcacgaacugggacuugcuuucacaaagaaucggaugaacuacaccaauaaauuucugcucauuccugagagcggcgauuauuucaucuacucccaggugacauuucgcgggaugaccucugaaugcagcgagauuagacaagccggacggcccaacaagccugacuccaucacgguggucauuaccaaggugacagauucuuauccggaacccacccagcugcugaugggcacaaaaagcguuugugaggugggguccaauugguuccagccuaucuaccucggagccauguuuagccugcaggagggcgacaaacuuauggucaacgugucugauaucucccugguugacuauaccaaggaagauaagacguucuuuggcgcuuuccuccuguga

SEQ ID NO: 77098 - RNA, 600 nt, Artificial Sequence
  derived and/or modified sequence opt5 from TNFSF18__Homo_sapiens__NP_005083
augacccugcaccccagcccuaucacaugcgaguuccucuuuuccacggcccugauuucuccgaagaugugucuuagccaucuggaaaacaugccccucucccacucuagaacccagggcgcucaacggagcuccuggaaacuguggcuuuucugcucuaucgugaugcugcucuuucuguguagcuucuccuggcugauuuuuaucuuccuccagcuggagacagccaaggaaccuugcauggcgaaauuugggccccuuccuagcaaguggcagauggcuucuuccgagcccccuugugucaauaaaguuagcgacuggaagcuggaaauucuccagaacggacuguaccuuaucuauggccaaguggccccgaaugccaacuacaaugauguggcucccuucgagguccgccuguauaagaacaaagacaugauccagacccucacaaauaagucuaaaauucagaacguugggggaaccuacgagcugcaugugggcgauacaaucgaccugauuuuuaauuccgaacaccaggugcucaagaacaauaccuauugggggaucauucugcuugccaacccucaauucaucagcuga

SEQ ID NO: 77099 - RNA, 402 nt, Artificial Sequence
  derived and/or modified sequence opt5 from TNFSF4__Homo_sapiens__NP_001284491
auggugagccacagauacccccggauccaguccauuaagguccaauucaccgaguauaaaaaggaaaaaggcuuuauccugacaucucagaaggaggacgaaauuaugaaaguucagaacaauagcgugaucauuaacugcgauggguucuaccucaucucccugaagggauauuuuucucaggaggugaauaucagccuucauuaccaaaaggacgaagaaccucuguuccagcucaaaaagguccgcuccgugaacucucugaugguugccagccuuacguauaaagauaagguguaccugaaugucaccacagacaacaccucccucgaugacuuucacgugaauggcggggagcugauucugauccaucagaacccgggagaguucuguguucucuga

SEQ ID NO: 77100 - RNA, 705 nt, Artificial Sequence
  derived and/or modified sequence opt5 from TNFSF8__Homo_sapiens__NP_001235
auggaccccggccugcagcaagcccucaacgggauggcuccuccgggagauaccgccaugcacgugcccgcgggcagcgucgcuucccaucuggggacaacgucuagaagcuacuucuaucuuaccacagccacccuggcccucugccugguuuuuacaguggcuaccaucauggugcuugucgugcagcggacagacuccauuccuaauucucccgauaacguuccucugaagggaggcaauuguagcgaggaccuccugugcauccugaaacgcgcccccuucaagaaauccugggcuuaccuccagguggccaagcaccugaacaaaaccaaacuuucuuggaauaaggaugggauucugcauggagucagauaucaggacggcaaccucgugauccaauuuccuggccuguacuucauuaucugucagcuucaguuucugguucagugcccgaauaacagcguggaucucaagcuggaacugcucaucaauaagcacauuaaaaagcaagcgcuggucacggugugugaguccgggaugcagaccaaacauguguaucagaaccuuagccaguuccugcucgacuaccugcaagucaauacaaccaucucuguuaacguggauacauuucaguauauugacaccuccacguucccccuugaaaaugugcugagcaucuuucucuacucuaacuccgauuga

SEQ ID NO: 77101 - RNA, 765 nt, Artificial Sequence
  derived and/or modified sequence opt5 from TNFSF9__Homo_sapiens__NP_003802
auggaguacgccagcgacgcuucccuggaucccgaagccccuuggccgcccgcgccuagagcucgggccugccgcgugcuccccugggcccuggucgcuggccuucugcuccugcuucugcucgccgcugccugugcgguuuuccuggccugcccuugggcugugucuggggccagagcuagccccggauccgccgcgucuccucggcugcgcgagggcccggaacucagccccgacgauccugccgggcugcuugaccugagacagggaauguuugcucaacucguggcccagaacguccugcuuaucgauggcccccuguccugguauucugacccugggcucgcuggagugagccugaccggcggccuguccuacaaggaggauacaaaagaacucguuguggccaaggccggggucuauuacguguucuuucagcuggagcuucggcgcguuguggcuggagagggcagcgggucugucucccuggcgcuccaucugcagccccuuagaagcgccgcuggagccgccgcucuggcccucacgguggaccugccgccugcgucuuccgaagcucggaauagcgccuucggcuuucaagggcgccugcuccaccugucugccggacagagacuuggcgugcaucugcacaccgaggcucgggcccgccacgcuuggcagcucacacagggcgccaccguccuggggcuuuucagaguuacacccgaaauuccugcgggacugcccagcccccgguccgaguga

SEQ ID NO: 77102 - RNA, 4059 nt, Artificial Sequence
  derived and/or modified sequence opt5 from TNIK__Homo_sapiens__NP_001155032
auggccagcgacucccccgcuagaucucuggaugagaucgaccucagcgcccugcgggauccugcgggcauuuucgaacuuguggagcuggucgggaacggaaccuacggccagguuuauaaggggcgccacgugaaaacaggacaacucgcugccaucaaggugauggacgucacgggcgaugaagaggaagagauuaaacaggagaucaauaugcugaagaaauacucccaucacagaaacauugccaccuauuacggggcuuuuaucaagaagaauccgcccggaauggacgaucagcuuuggcuggugauggaguucugcggcgccggcucuguuacagaccucaucaaaaacaccaaggggaauacacugaaagaagaauggauugcuuauaucugucgggagauucugcgcggacucagccaucugcaccagcauaaggugauccacagagauauuaaaggccaaaacguccuucugaccgagaaugccgaagugaagcucguugacuuugggguguccgcgcagcuggaucggacagucggacgcagaaacaccuucaucggcacgccuuacuggauggcccccgaggugauugcuugcgacgaaaauccugaugccaccuaugacuuuaagucugaccuuuggagccuggggaucacagcuaucgagauggccgaaggagcgcccccucucugugauaugcacccgaugcgggcccuguuccugauuccccgcaacccugcucccagacucaaauccaagaaauggagcaagaaauuucagucuuucaucgaguccugccuggugaagaaucauagccagcggccugccaccgagcaacuuaugaaacaccccuuuauucgcgaccagccgaacgaaagacagguccggauccagcugaaggaucauauugaccgcacaaagaaaaagagaggcgagaaagaugaaaccgaguacgaauacucuggcuccgaggaggaagaggaagagaaugacagcggggaaccuucuuccauccucaaccugcccggagagagcacgcuucggagagauuuccugcgccuccaacuggcuaauaaggagcgguccgaagcccugagacgccagcagcucgagcaacagcagcgggaaaacgaggagcacaaaagacagcugcuugccgaacgccaaaagcggaucgaggaacagaaggagcagagacgccggcuggaggaacagcaaagacgcgagaaagaacuccggaagcagcaggagagagaacagcggcgccacuaugaggaacaaaugagacgggaggaggaaagacgccgggcugagcaugaacaggaguacauuagacgccagcuggaagaggagcagagacaacuugaaauccugcagcagcaacuccugcacgagcaggcgcugcuccuggaauauaaacggaagcagcuugaggagcagcgccaagccgaaagacugcagcggcagcucaaacaggagcgcgacuaccugguuucucugcaacaucagagacaggaacagcggccuguggagaagaagccccuuuaucacuacaaagaaggcaugagccccuccgagaagccugcuugggccaaagagguggaggaacgcagcagacucaaccggcaaucuuccccggccaugccccauaaggucgcuaaucgcauuagcgauccuaaccugcccccuagaucugaaucuuuuuccaucucuggggugcagcccgcccggacaccgccuaugcugagacccguugacccucagauuccccaccucguggcggucaaaagccaaggaccugcucugaccgccucccagagcgugcacgagcagcccacaaagggccuuucuggguuccaggaagcccugaauguuaccucccaucgcguggagaugccgcggcaaaacagcgauccuaccucugagaauccuccccuccccacaagaaucgaaaaguuugaccgcuccagcuggcugcggcaggaggaagacaucccgcccaaagucccucagagaacgaccuccauuucucccgcucuggcccgcaagaacagcccuggaaauggcuccgcucuuggcccccggcucgggucucagccuaucagagccagcaaccccgaucugcgccggacagagccgauucuggaauccccucuccaaagaaccagcucuggauccagcagcuccagcucuacacccagcucccagccuagcucucagggcgggucccagcccggaagccaagcgggcuccucugagcggacccgcgugagagccaauagcaaauccgaggggucuccgguccugccucacgaacccgcuaaggugaaaccugaggaaagccgggacaucacgcgccccuccagacccgccgaucuuacagcucuggccaaggagcuccgggagcugagaauugaagagaccaaccgcccuaugaaaaagguuaccgacuauucuagcuccagcgaagagucugaauccagcgaggaggaagaggaagauggcgagucugaaacacaugacggaaccguggcggucuccgauaucccgcggcugauucccacaggcgccccugggagcaaugagcaguacaacgugggaaugguuggcacgcacgggcuugagaccucucacgcugacuccuucagcggauccaucagcagagaaggcacacucaugauccgcgagaccucuggggaaaagaaacggagcggccauuccgauucuaauggauucgccggccacauuaaccugcccgaccuggugcagcagagccauuccccugcugggacacccaccgagggacucggcagagucucuacgcacagccaagaaauggauuccgggaccgaguacggaaugggcucuagcacaaaggccuccuuuaccccuuucguggacccgcgcguguaucagacaagccccaccgaugaggacgaagaggacgaagagucuuccgccgcugcgcuguuuacgagcgagcuucugcggcaggaacaagccaaacucaaugaggcuagaaagaucucuguugucaacgugaacccuacaaauauucgcccccauuccgauaccccugaaaucagaaaauacaagaagcgguucaacagcgagauucugugugccgcccuguggggcgugaaucuucucgucgggacagaaaacggacugaugcugcucgaccgcuccggccaggggaaaguguauaaucugaucaacagacggcgcuuucagcagauggauguucuugagggacugaaugugcucgucaccaucucuggcaagaaaaacaagcugagaguguacuaucugagcuggcuucggaaucgcauucugcacaacgaccccgagguugagaaaaagcaaggguggaucaccgugggagaucucgaaggcugcauucacuacaaggucgugaaauaugaaagaaucaaguuccugguuauugcucucaaaaaugccguggagaucuacgcgugggcuccgaagccuuaccauaaauuuauggccuucaaguccuuugccgaccugcagcacaagccccuucuggucgaucucacaguggaagaggggcagcggcugaaagugaucuucggcagccauacgggauuucacgucauugacguugauucuggcaacuccuaugacaucuacauucccagccauauccaggggaauauuaccccucacgcuaucgugauccugcccaagacagauggaauggagaugcuuguguguuaugaagacgagggcgucuacgugaacaccuaugggagaauuacaaaagauguugugcugcaauggggagaaaugccuaccucugucgccuacauccacagcaaucagauuaugggcuggggcgagaaggcgaucgaaauucgcuccguggagacggggcaucucgacggaguuuucaugcacaaacgggcucagagacugaaguuucucugcgagcggaacgacaaaguguucuucgccucuguccgcagcggcggguccucucagguguuuuucaugacacugaacagaaauagcaugaugaacugguga

SEQ ID NO: 77103 - RNA, 1752 nt, Artificial Sequence
  derived and/or modified sequence opt5 from TNIP1__Homo_sapiens__NP_001239315
auggaggccaccagacugcggcagaaggcugaggaacuggugaaagacaacgaacugcuucccccuccgagccccucccugggcucuuucgauccucucgccgagcugacagggaaggacagcaaugucacggcgucccccaccgcuccugccugccccucugauaaaccugccccgguucaaaagcccccuagcuccggaacaucuagcgaauuugagguggugacccccgaggaacagaacuccccugaguccucuucccacgcuaaugccauggcucuuggcccccugccgcgcgaagacgggaaccucaugcugcaucugcagagacucgagacaacccugagcgucugugccgaggaaccugaucacggacagcuuuucacacaucugggccggauggcgcucgaguuuaaucgccuggccucuaaagugcacaagaacgaacaaagaaccuccauccuucagacgcugugcgagcagcuccggaaggaaaaugaggcucugaaagccaagcuggacaaagggcucgagcagcgcgaucaagcugccgaaagacugcgggaggaaaaccuugagcugaagaaacuccugaugagcaauggaaacaaggaaggcgcgucuggccgccccggguccccuaagauggagggaaccggcaaaaaggccguugcugggcagcagcaggccagcgugacagcuggaaaaguccccgaggugguugcccuuggcgccgcugaaaagaaagugaagaugcuggagcaacagagauccgaacuccuggaggucaauaaacagugggaccaacauuuccggucuaugaagcagcaguacgaacagaagauuaccgagcugcgccaaaaacucgcggaucugcagaaacaggugacagaccuugaggccgaaagagagcagaagcaacgggauuuugaccgcaagcugcuccuggcuaaaagcaagaucgaaauggaggagaccgauaaggaacagcuuacggccgaggccaaagaacugagacagaaggugaaauaucuccaggaccaacugagcccccugacacggcagagagaguaccaggaaaaggagauucagcgccucaacaaagcucuggaggaagcccuuagcauccaaaccccuccgucuuccccucccacagcguucgggagccccgagggagcuggcgcccugcuccggaagcaggaacuggucacccagaaugagcugcuuaagcaacagguuaaaauuuuugaagaggacuuccagagagagcgcucugaucgggaaagaaugaacgaggaaaaggaggaacucaaaaagcaaguggagaaacugcaggcccaggugacccugagcaaugcucagcucaaggccuuuaaggacgaggaaaaagcucgcgaggcccugcggcagcaaaagagaaaagcgaaggccuccggcgaacgcuaucacgucgagccucaccccgagcaucuuuguggggcuuacccguaugccuacccucccaugccugcuauggugccccaccauggauucgaagauuggucucagauccgguauccucccccgccuauggccauggagcacccuccgccccugcccaacagcagacucuuucaccuccccgaauacacauggcgccugccuugcggcgggguucggaaccccaaucaguccagccaggugauggacccucccacggcgagaccuaccgagcccgaaucuccgaaaaacgaucgggagggaccucaauga

SEQ ID NO: 77104 - RNA, 969 nt, Artificial Sequence
  derived and/or modified sequence opt5 from TNIP2__Homo_sapiens__NP_001154999
augcagcaacugcucagccagccccagcacgagagagaaaaggaggugguccugcuucggcgcuccauggccgaaggcgagagagcucgggccgcgucugacguucugugccgcagccucgcuaacgaaacccaucagcugagacggacacuuacggccaccgcccacaugugucaacaucuggcuaaaugccucgaugagcgccagcacgcccagagaaaugugggggagcgguccccugaccagucugaacauacagauggacacaccagcgugcaauccgucaucgagaagcugcaggaagagaaccgccugcucaaacagaaggugacacacguugaggaccugaaugcuaaauggcagagauacaacgccucucgggaugaauaugugcgcggccuucaugcgcaacugagagggcuccagauuccgcacgagcccgaacugaugcggaaggagaucagccgccuuaauagacagcuggaagagaagauuaacgacugugccgaggucaaacaagaacucgcugccucccggaccgcuagagaugccgcgcuggagcgcgugcagaugcuggaacagcagauccucgccuacaaggacgauuucaugagcgagcgggcugacagagaacgcgcccaaucucggauucaggagcuggaggaaaaaguugcuucccuucugcaucaggugagcuggagacaggauucucgcgagccugacgccggacggauccacgccggcuccaagacagcuaaauaucucgcggccgaugcucuggaacuuaugguccccgggggauggagaccuggcaccggcagccaacagcccgagccuccggccgaagggggacaccccggcgccgcucagcgcgggcagggagaccugcaaugcccucauugucuccagugcuuuucugacgagcagggcgaggaacugcugcggcacguggccgaguguugccaguga

SEQ ID NO: 77105 - RNA, 1110 nt, Artificial Sequence
  derived and/or modified sequence opt5 from TNIP3__Homo_sapiens__NP_001122315
augaacaagaaugagaaacacgacgauaagcuggugauguucaccaaccagagcgaagacuccgagagaugcgaaucuauggagcucgauaaaaagauccaagaccugauugaacggaaugccagcccccauccuaaacgcuuuacaccggaggcuaugcccacgcacagaaaccuuuguucccugaagaccccuggcaagacagccucuauggcgcauuucguccaggggaccagccggaugaucgcugccgaguccucuacagaacacaaagagugcgccgaacccagcacccgcaagaaucucaugaacucccuggagcagaaaauuagaugucuugagaagcagcggaaagaacugcucgagguuaaucaacagugggaucagcaguuucgcagcaugaaggaacuguacgagagaaagguggcugaacugaaaacaaagcucgacgccgcugagcgguuccugucuacccgcgagaaagauccucaucaaagacagcggaaggacgaucgccagagagaagacgaucggcagcgcgaccuuacgagagaucggcugcaaagagaggaaaaagagaaggaacgccucaacgaggagcugcacgaacuuaaagaggaaaauaagcugcucaagggcaaaaacacccuggccaauaaggagaaagaacacuaugagugcgagaucaagcggcugaacaaagcgcuccaggacgcccugaauauuaaguguuccuuuagcgaagacugccuuagaaagucucgcguggaguucugucaugaagagaugcggacagagauggaaguccugaaacagcaagugcagaucuacgaggaagauuuuaagaaagagagauccgaccgcgaacggcucaaccaggagaaggaggaacugcagcaaaucaaugagaccagccagucucagcuuaacagacugaacucccagauuaaggcuugccaaauggaaaaagagaagcucgaaaaacagcugaagcagauguauugucccccuugcaauuguggacugguuuuccaccuccaggauccgugggugcccacagggccuggagccguccaaaaacagcgcgagcaucccguguacccucaguga

SEQ ID NO: 77106 - RNA, 1986 nt, Artificial Sequence
  derived and/or modified sequence opt5 from TNK1__Homo_sapiens__XP_011522347
augcugcccgaggccggcagccucuggcugcuuaagcugcucagagacauccagcuggcucaauucuacuggccuauucuugaggagcugaacgugacccggccggaacacuuugauuucgucaaacccgaggaccucgaugggaucggaaugggccgcccugcccagagacggcuguccgaagcgcugaagcgccucagaucugggcccaaaagcaagaauuggguuuauaaaauucugggaggcuuugcuccugagcauaaggagcccacacuuccuuccgacucuccgcggcaucugcccgaaccugaagggggacucaagugccugauccccgaaggcgccgugugucgcggcgagcuucuggggagcggaugcuucggcgugguccacagagggcucuggacgcugccuuccggaaaaucugugcccguugccgugaagucucugcgggucggcccggaggggccuaugggaaccgaacucggcgauuuucugcgcgagguguccguuaugaugaaccuugaacacccccaugugcugagacuccacggccugguccuugggcagccucugcagauggugauggagcucgcuccccugggaagccugcacgcccggcucacagcucccgccccuaccccgccccugcuuguggcgcugcucugucuguuccuucgccaacuggccggcgcuauggccuaccucggggcuagaggacugguccaucgggaccuggccacacgcaaucuccugcuugcgucuccuagaaccauuaaaguugccgauuuuggccuggugcggccccucgggggagcuagaggccgcuaugugaugggcgggccucggcccaucccguacgccuggugcgcuccugaaucccugagacacggagccuucagcucugccuccgacgucuggauguuuggcgugacacugugggagauguucagcgggggagaggaacccugggcuggcguuccucccuaucuuauccuccagcgccuggaggaucgggcgagacugccucggcccccgcucuguucucgcgcccuguacucccuugcucugagaugcugggccccucaucccgccgaccgccccagcuuuucccaccucgaagggcugcugcaggaggcuggcccuucugaagccuguugcgugcgggaugucaccgagccgggagcgcuuagaauggagacgggcgaccccauuaccgugaucgaagggagcccugauuccacaauuuggaagggacagaacggccgcaccuucaaaguugggagcuuucccgcuucugccgugacacucgccgacgcuggaggccugccugccacccggcccguccacagagggacgccugcucggggcgaccaacaucccggauccaucgauggcgaccgcaagaaggccaaucugugggaugcgccgccugccagagggcagcggagaaacaugccccucgagcgcaugaaaggaauuagccggucucuggaaagcgugcuuucccugggcccuagacccacagggggaggcucuagcccgccugagauccgccaggcuagagccgucccccaggggccucccggccugcccccucggccgccccucuccagcagcuccccucaacccagccagccuucucgcgaaagacugcccuggccuaagcggaaaccgccccacaaucauccuaugggaaugcccggcgcucgcaaggccgcggcccuuuccgggggacuccugagcgacccugagcugcagagaaaaauuauggagguggaacucuccguucacggcgugacccaucaagagugucagacagcucugggggccaccggaggcgaugucgugucugcuauccggaaccuuaagguugaccagcuguuccaccucagcucccgcucuagagccgauugcuggcggauccuggaacacuaucagugggaccugagcgccgcuucccgcuacgugcuugcgagacccuga

SEQ ID NO: 77107 - RNA, 3261 nt, Artificial Sequence
  derived and/or modified sequence opt5 from TNK2__Homo_sapiens__NP_001010938
augcuggaggccagacccccucggacccagggcagcgacgcugccggggcggcugccggacgcggccucagagcccugcuucugucccucacagcugccgcugggaucuggggaucuaugggcgaacggagcgccuaccaacgccuggcugggggagaggaaggcccgcagagacuuggcgggggacggaugcagcccgaggaaggcacgggguggcugcucgagcugcuguccgaggugcagcuccaacaguauuuccugcgccuuagagaugaccugaacgucacccggcucucucacuuugaauacguuaagaaugaggaucuggagaaaauuggaaugggccgcccugggcagagacggcuuugggaggccgugaagcgcagaaaagcucugugcaagcggaaaagcuggauguccaagguguucucuggaaagcgccucgaggccgaauuucccccucaucacagccaguccacauucagaaaaaccagccccgcuccuggcggcccggccggggagggaccccugcaaucucugacaugucucaucggcgaaaaggaccugcggcuucuggagaaacucggggauggauccuuuggcgucgugagacgcggggaaugggacgcgccuagcggaaagaccguuucuguggccgucaaaugccugaagcccgaugugcuuucccagccugaggcuauggacgauuucauucgggagguuaacgccaugcauagccuggaccacagaaaucucauccgccuguauggcgugguccugacacccccgaugaagauggugaccgaacucgcuccucugggcucucuucuggaucggcucagaaaacaucaggggcacuuucugcuuggaacgcugucccgcuacgccgugcaggucgccgagggcaugggguaucucgaaagcaagcgguucauucacagagaccuggcugcgcgcaaccugcuccuggccacccgggaucuuguuaaaaucggagacuuuggccugaugagagcucucccccaaaaugacgaucauuacgugaugcaggagcaccgcaaggugccuuucgccuggugugcccccgaaucccugaaaacacggaccuuuucucaugcuagcgacacauggauguucggggucacccugugggagauguuuacguauggccaggagcccuggaucggacuuaacggcucccaaauucuccacaagaucgauaaagaaggggagagacugccucggccggaagacugcccccaggauauuuacaaugugaugguucaguguugggcccacaagccugaggaccgccccacauucguggcgcugagagauuuccuccuggaagcucagccuaccgacaugcgggcccuucaagauuuugaggagcccgacaagcugcauauccagaugaacgaugucauuacagugaucgaaggcagagccgagaauuacugguggcgcggacagaacacccggacccucugcguugggccguucccuagaaauguggucacaagcguggcuggacugucugcccaggacauuucccaaccccugcagaacagcuuuauccacacgggccauggggacucugauccucgccacuguuggggcuuccccgacagaaucgaugaacuuuaucucggaaauccuauggaucccccggaccugcugagcgucgagcucuccaccucucggccuccccagcaucugggcggggugaaacgcgagcccccuccgagacccccucagcccgcguuuuucacacaaaagccuaccuacgaccccguuagcgaagaucaggacccucuuuccagcgauuuuaaacggcugggacuccgcaagcccggccugccgagagggcuguggcuugccaaaccuucugcgcgggugcccggaacaaaggccucccgcggcagcggggcugaggucacccucauugacuucggcgaagaaccugugguucccgcccugagaccgugcgcuccuucucuggcccagcucgcgauggaugccuguucccugcuugacgaaacgcccccucagagccccacacgggcucugccccgcccucuccacccgacccccguggucgauugggacgccagaccucugcccccucccccugcuuaugacgauguggcccaagacgaggaugacuuugagaucugcuccauuaacucuacccuggugggagccggcguuccggcugggcccagccagggacagacaaauuacgcguucgucccugaacaagcccggcccccucccccgcuugaggauaaccucuuucugccuccccagggcgggggaaagcccccuuccucugcucagaccgccgaaaucuuccaggcccugcaacaggaguguaugagacagcuccaggcucccgccggcagcccugcgccgucccccagcccugggggcgacgauaaaccccaagugccuccccgcgugccgauuccuccccggccuacaagaccccacguccagcugucuccugcucccccgggagaagaggagacgucccaguggccuggccccgccucucccccucgcgugccgccccgggaaccucuuagcccccagggguccagaaccccuagcccccugguuccuccgggaucuagcccccucccuccccgccuguccagcucuccuggcaagacaaugcccaccacacaauccuuugccagcgacccgaaauaugcuaccccucaggugauccaggcccccgggccccgggcgggaccuugcauccugcccauugucagagauggcaagaaaguguccucuacgcauuacuaucuucugccugagcgcccgagcuaccucgaacgguaccaaagauuccugcgggaggcucagucccccgaggaaccuacaccccucccuguuccccugcuucugccgccucccucuaccccugcccccgccgcuccuaccgccacagugcgccccaugccgcaggcugcccucgacccuaaggcgaacuucagcaccaauaacuccaaucccggcgccagacccccuccgccccgggcuacggcccgccugccucagagagggugccccggagauggcccugaggcugggcggcccgccgacaagauccaaauggucgaacagcuguuuggacuuggccugagaccucgcggggagugucacaaagugcucgaaauguucgauuggaaccuggagcaggccggaugccaucuccugggcucuuggggccccgcucaccacaagcgguga

SEQ ID NO: 77108 - RNA, 3501 nt, Artificial Sequence
  derived and/or modified sequence opt5 from TNKS2__Homo_sapiens__NP_079511
augagcggcagacggugcgccgggggaggcgcugccugugcguccgcugccgccgaggcuguggaacccgccgcucgcgagcuguucgaagccugcagaaacggggacgucgagcggguuaagcgccucgugaccccugaaaaagugaauagcagagauacagcgggacgcaagagcacgccgcugcacuuugccgcuggcuucgggcggaaagacgucguggaguaccuucugcagaacggagccaauguucaagcuagagaugacggcggccucaucccccugcauaacgccuguuccuuugggcacgcggagguggucaaucuucugcuccggcauggagccgauccuaacgcucgcgacaauuggaacuauacaccccugcacgaagccgcuauuaagggcaaaaucgaugugugcauuguucugcuccagcauggggccgagccuaccaucagaaauaccgacggacggacagcccuggaucuugcugaccccucugcgaaggccgugcugaccggcgaauacaagaaagaugagcuccuggagagcgcucgcuccgggaacgaagagaagaugauggcccuucugacaccucucaaugucaacugucacgccucugacggaagaaaaagcaccccgcugcaccuggcugccggcuauaaucgggugaagauugugcagcuccugcuucagcauggcgcggauguccacgcuaaagacaagggggaccugguuccccuccauaacgccugcuccuacggacacuaugaagugacggagcugcuugugaagcacggcgccugugucaaugcuauggaucuguggcaauucaccccucuccaugaagccgcuagcaaaaaccgcguggagguuugcucucugcugcucuccuacggggccgaccccacacugcuuaacugucacaauaagagcgcgaucgaucuggccccuacaccccagcucaaagagagacuggcuuaugaauuuaagggacauucucuucugcaggccgcucgggaggccgacgugaccagaaucaaaaagcaccucucccuggaaauggucaacuucaaacauccgcagacccacgagacggcgcugcacugcgccgcugccagcccuuaccccaagcgcaagcaaauuugugaacuccugcuucggaaaggcgcuaauaucaacgagaagacaaaagaguuucugaccccucuccauguggccucugaaaaggcccacaaugauguuguggaggucguggucaaacaugaagcuaaggugaacgcgcuggacaaucuggggcagacaucccuucacagagccgcuuacugcggacaccuccagaccugccgccugcugcucagcuauggcugugaucccaacauuaucucccugcagggcuucaccgcccuucaaauggggaaugagaacguucagcagcugcuccaagaaggaauuucucugggcaauagcgaggccgaccggcagcugcuugaggcugccaaggcgggggauguggaaacagucaaaaagcucugcacggugcaguccguuaacuguagagacaucgagggacgccagagcacaccccugcauuuugcugccggcuacaaucgggugucugucguggaauaucugcuccaacacggggccgaugugcaugcuaaagacaagggcggacugguuccucuucacaacgccugcuccuacggccauuaugaggucgcggagcugcucgugaaacacggggcuguggucaauguggccgaccuguggaaguucaccccgcugcacgaagccgcugccaagggaaaauacgagauuuguaaacuucuccugcagcauggcgcugaucccaccaagaagaacagagacgggaacacaccucuggaucucguuaaagacggagauaccgacauccaggaucugcuucgcggcgacgccgcgcugcucgaugccgcuaagaaggggugccuggcccgggugaaaaagcugagcucucccgacaaugucaacuguagagauacgcagggccgccacagcacaccucuucaucucgcugccggauauaauaaccuggaaguggccgaguaccugcuccaacacggcgcugacguuaaugcgcaggauaaagggggacugaucccccuucauaacgccgcuuccuacggccacguggacgucgccgcccugcucauuaaguauaaugcuugcgugaacgccaccgacaaaugggcguuuaccccgcugcacgaagcugcccagaaggggcggacacagcugugugcccuucugcucgcucauggagccgauccuacccugaaaaaucaagagggccagacaccccucgaccugguuucugcggaugacgugagcgcccuucugacggcugccaugccucccuccgcucucccuagcugcuacaagccccagguccugaacggggugagaucuccgggcgccaccgcugaugcccuguccagcggaccuucuucccccagcucccuuucugcggccagcucccuggacaaucucucuggcagcuucuccgagcugagcucuguggucuccagcucugggacagaaggagcuuccagccucgagaagaaagaaguucccggcguggauuuuucuaucacccaguucgugcggaaccuggggcuugagcaccugauggacauuuucgaacgcgagcaaaucacacucgauguccugguggagaugggacauaaggaacugaaagagauuggcaucaaugccuaugggcacagacacaaacuuaucaagggcguugaacggcugauuagcggacagcagggccucaacccuuaccugacccucaauacguccgggagcggaaccauccugauugaccuuucuccggaugacaaggaguuucaauccguggaagaggagaugcagagcacagucagagaacaucgcgauggcgggcacgcuggaggcaucuucaaccgguauaacauucugaagauccagaaaguguguaauaagaaacugugggagagauacacccaucgcagaaaggaaguuuccgaggagaaccacaaucaugccaacgaacggaugcucuuucacggcucucccuucgugaaugccaucauucacaaaggguuugacgagcgccaugcuuauaucggaggcauguucggggcgggaauuuacuuugccgaaaacagcuccaagucuaaucaguacgucuauggcaucgggggaggcacaggcugcccugugcacaaggacagaagcugcuacauuugucaucggcaacugcuuuucugccgcguuacccuggggaaauccuuucuccaguucucugcuaugaagauggcccacucucccccuggacaccauuccgugacgggcagacccagcgucaacgggcuggcccucgcugaguaugugaucuaccggggagaacaggccuauccugaguaccugauuacauaucagaucaugcgccccgagggcaugguggauggguga

SEQ ID NO: 77109 - RNA, 3984 nt, Artificial Sequence
  derived and/or modified sequence opt5 from TNKS__Homo_sapiens__NP_003738
auggccgcuagcagacggucccagcaccaucaccaucaccaucaacagcagcugcagcccgccccuggcgcgucugcuccgcccccucccccucccccuccgcucagccccgggcuggccccuggaaccacacccgccuccccuacggcuucuggccuugcccccuucgcuagcccgcgccacgggcuggcccucccugagggagacggcuccagagaucccccugaccggccccgcucucccgauccuguggacgggaccagcugcuguuccacaaccagcacaaucugcaccgucgcggccgcuccgguugugcccgccgugucuacauccagcgcugccggagucgcgccuaaccccgccggcucuggcuccaauaacagcccuucuuccagcuccucucccaccagcuccucuagcuccagcccgucuagcccuggguccucucuggcugaaagccccgaggccgcuggaguguccagcacggccccucuuggccccggggccgcuggaccuggcaccgggguucccgcggugucuggagcccugagagaacuccuggaggcuugucggaauggcgaugucucccgcgugaagagacugguugacgccgccaacgugaaugcuaaagauauggccggcagaaagagcucuccgcuccacuuugcggcuggguucggacgcaaagacgucguggaacaucugcuucaaaugggcgccaacgugcacgccagagaugacgggggacugauuccucuccauaaugcuugcuccuuuggccacgccgaggucguuagccugcuucugugucagggggcugaucccaacgcccgggacaauuggaacuacacaccccuccacgaggcggccaucaagggaaaaauugaugugugcaucgugcugcugcagcauggcgcugacccuaauauucgcaacaccgacggcaaguccgcccucgaucuggcugacccgucugccaaggcgguccuuacaggggaauauaaaaaggaugagcugcucgaagccgcuagaagcggaaaugaggagaaacugauggcccuucugacgccccucaacgugaauugucacgcuuccgacggccggaagucuaccccucugcaucuggccgccggguacaaccgcguuagaaucgugcagcuccugcuucaacacggagcugauguccaugcgaaagacaagggcgggcuggugccccuccacaacgccugcagcuauggccacuacgaaguuacagagcugcuucugaagcauggagcuugugugaaugccauggaucucuggcaguucaccccucugcacgaagccgcuuccaaaaaccgggucgaggugugcagccugcuccugucucauggcgccgaccccacacuugucaauugucacgggaaguccgcgguggauauggcuccuacccccgaacugagagagcgccucaccuaugaguuuaaaggacacagccugcugcaggccgcccgggaagcugaccuugccaagguuaaaaagacacucgcgcuggagaucauuaacuucaaacagccgcaaucucaugaaacggcucugcacugcgccguggccucccuccauccuaagagaaagcaggucaccgagcugcuucugcgcaaaggcgcuaaugugaacgaaaagaauaaagauuuuaugacaccccuccacguugccgcugagcgggcccauaacgacgugauggagguccugcacaagcacggggcgaaaaugaaugcccuggacacccuuggacagacagcucuccauagagccgcucuggccggccaucugcaaaccugccgccuccugcuuagcuacgggucugauccuagcaucauuucccugcagggcuucacggccgcucagaugggaaacgaagcggugcagcaaauccucagcgagucuacacccauucggaccuccgacguggauuauagacugcuggaagccagcaaggcuggcgaccuugagaccguuaagcagcucuguuccucucagaaugucaacugccgcgaucuggaagggcggcacagcacaccgcugcacuuugccgccggauacaauagaguguccguggucgaguaccuccugcaucacggcgcugacgugcacgccaaagauaaagggggacuuguuccucugcauaacgcguguucuuauggccacuacgagguggcugaacuccugguccgccauggggccagcgugaauguugccgaccuguggaaauucacaccccuucacgaggcugccgcgaagggcaaauaugaaaucugcaagcuccugcugaagcacggagcugauccuaccaagaagaaccgggacggcaacacgccccucgaucuggugaaagagggggacaccgauauucaggaccuucugagaggagacgccgcccuccuggaugcugccaagaaaggcugucuggcucggguccaaaaacuuugcacacccgagaauaucaacugucgcgacacccaggggagaaauuccacaccucugcaucucgccgcgggauacaacaaucuggaaguggccgaguaucuccuggaacacggcgcugauguuaacgcccaggacaaagggggccuuaucccgcugcauaaugcugccucuuacggacacguggauauugccgcucuccugaucaaguauaauaccugcgucaacgcgacggacaagugggccuuuacaccccugcaugaggcugcccagaagggccggacccaacuuugugcccugcuccuggcucacggggccgauccuaccaugaagaaccaggaaggacagacaccccucgaccuggcgaccgcugaugacauuagagcccuucugaucgaugccaugccucccgaggcucucccuacgugcuucaaaccgcaggccacaguggugagcgcgucccugauuagccccgccucuaccccuuccugucugagcgcugccucuuccaucgacaaucuuacaggcccccuggcugagcucgccgucgggggagcuagcaacgccggcgauggcgcggccgggaccgaacgcaaggagggagaaguugcuggccuggacaugaauaucucucaauuucucaaaucccuggggcuugagcaucugcgggacauuuucgaaaccgagcagaucacacuggaugugcucgccgacaugggacacgaggaacugaaggagauuggcaucaacgcuuacgggcacagacauaaacuuauuaagggaguggaacgccugcucggcggccagcaagggacgaauccuuaccugaccuuccacugcgucaaccagggaacaauccuccuggaucuugcccccgaggacaaggaauaucagagcguggaggaggaaaugcaguccaccaucagagagcaccgggauggcgggaacgccggaggcauuuuuaaucgcuacaacguuauccggauucaaaaaguggucaauaagaaacugcgggaacgcuucugccauagacagaaggaggugagcgaggaaaaccacaaucaucacaacgagcggaugcuguuucaugggucuccguucaucaaugcuauuauccacaagggauuugacgaacgccacgcguauauuggcggcauguucggggccggaaucuacuuugcugagaacagcuccaaaucuaaucaguauguuuacggcaucgggggaggcacaggguguccuacccauaaggauagaagcugcuauauuugucaccggcagaugcuguucugccgcgugacgcucggaaaauccuuucuucaauucucuacaaugaagauggcccaugccccucccggccaccacagcgucaucggcagacccuccgugaacgggcuggcuuacgccgaauacguuauuuaucggggagagcaggcguaccccgaguaucucaucaccuaccagauuaugaaaccugaagccccgucucagaccgcuacagccgcugagcaaaagaccuga

SEQ ID NO: 77110 - RNA, 954 nt, Artificial Sequence
  derived and/or modified sequence opt5 from TNMD__Homo_sapiens__NP_071427
auggccaagaaucccccugagaacugcgaagacugucacauccugaacgcugaggccuucaaaagcaagaaaauuugcaagucccucaaaaucuguggccugguguuugggauucuugcgcugacccucaucguccuguucuggggaucuaagcauuuuuggccggaaguucccaagaaggcuuacgauauggagcacacauucuauagcaauggcgaaaagaaaaagauuuacauggagaucgacccugugacgagaaccgagaucuuucgguccgggaacggaacagaugaaacccuugaggugcaugacuucaaaaauggcuauacagggauuuacuuugucggacugcagaagugcuucaucaagacccaaauuaaagugauccccgaauuuucugagccugaggaagagauugaugaaaacgaggaaaucacaaccacguucuuugagcagagcguuauuugggugcccgccgagaagccuaucgaaaaucgcgacuuccucaaaaacuccaagauccuggagauuugugauaaugucaccauguauuggaucaacccgacacugauuucugugagcgaacuccaggacuuugaggaagagggcgaggaucugcacuuccccgccaaugaaaagaaaggcaucgagcagaacgaacaauggguugugccucaggucaaaguggagaaaaccagacaugcucggcaggccuccgaagaggagcuucccauuaaugacuacacagaaaacgggaucgaguucgauccuaugcuggacgaacgcggauauugcuguaucuacugcagacggggcaaucgcuacuguagacgggugugcgagccccuccugggguauuacccguauccuuacuguuaucagggaggccgcgucauuugcagaguuaucaugcccugcaacugguggguggcucggaugcuugggcgcguguga

SEQ ID NO: 77111 - RNA, 486 nt, Artificial Sequence
  derived and/or modified sequence opt5 from TNNC1__Homo_sapiens__NP_003271
auggacgauaucuacaaggccgcuguggagcagcugaccgaagaacagaaaaacgaguucaaggccgcguuugacauuuucguccucggcgcugaggaugggugcaucagcacaaaagaacugggaaagguuaugagaaugcuuggccaaaaucccacgccugaggagcugcaggaaaugauugacgagguggaugaagacggguccggaaccguggauuuugacgaguuccucgucaugauggugcgguguaugaaagaugacucuaagggcaagagcgaggaggaacuguccgaucuuuuucgcauguucgacaaaaacgccgauggguauaucgaccuggacgaacucaagauuaugcugcaggccacaggagagaccaucacagaagaugacaucgaggagcugaugaaagauggcgacaagaauaacgauggcagaauugacuacgaugaauuucucgaguucaugaaagggguugaauga

SEQ ID NO: 77112 - RNA, 3900 nt, Artificial Sequence
  derived and/or modified sequence opt5 from TNN__Homo_sapiens__NP_071376
augagccugcaggagauguucagauuucccaugggccuccugcuuggguccgugcugcucgucgccucugcuccugccacccuggaaccgcccggaugcagcaacaaggagcaacagguuacagugucccacacguacaaaaucgacgugccuaagucugcgcuuguccagguggaugcugacccccagccucugagcgaugacggcgccucccuccuggcccugggggaagcucgggaggaacaaaauauuaucuuccgccauaacauuagacuccagacaccccagaaagauugugagcuggccggaucuguucaggaccuucuggcucgggugaagaaacucgaggaagagauggucgaaaugaaggagcaaugcagcgcccagcgcuguugccagggcgugaccgaucuguccagacacuguagcgggcauggaaccuuuucucuugagacaugcuccugucacugcgaagagggccgggaaggcccugcgugugagcgccuggccugcccgggggcuuguagcggacauggcagaugcguugacgggcggugccucugucacgaacccuaugugggagccgauugcggcuacccugcuugucccgagaauugcucugggcacggagaguguguccgcggcgugugccagugucaugaagacuucauguccgaggauugcagcgaaaagagauguccuggcgacugcucugggcacggauuuugugauaccggcgagugcuauugcgaagagggguucacaggacuggacugugcccaaguggucacgccccagggccugcagcuccugaaaaacaccgaggacucccuucugguuagcugggaaccguccucucaaguggaucauuaccuccugagcuauuacccucuugggaaggagcuguccggaaaacagauccaggugcccaaggaacagcacagcuaugagauucucggccugcugccuggcaccaaauacaucgucacacuccggaaugugaagaacgaaguuucuuccagcccccaacaucugcuugcgaccacagaccuggccgugcucgggaccgcuugggucacggaugagacagaaaauucucuggacguggaaugggagaaccccagcaccgaaguugauuacuauaaacuucgcuacggaccuaugacaggccaggagguggccgaggucaccgugccgaaguccucugaccccaagagcagauaugauaucaccgggcugcacccuggaacagaauacaaaauuacggucgugcccaugcggggcgagcucgaagggaagccuauccugcugaauggccgcaccgagauugacucccccacaaacguugugaccgauagagucacagaagacaccgcuacggugagcugggauccgguucaggccgugaucgacaaauaugucgugcgguacacaucugccgacggagauaccaaggagauggcugugcacaaagacgaguccagcaccguucucacaggccugaagccuggggaagcguauaaggucuacgugugggccgagagaggaaaucagggcucuaaaaaggcugauaccaacgcccuuacagaaauugacucccccgccaaucuggugacggaucgcgucaccgagaacacagcuaccaucagcugggacccugugcaagccacaauugauaaauacguugugcgguauaccuccgcggacgaucaggaaacgagagagguccucguggggaaggagcagucuagcaccguucugacaggacugcgccccggcguggaauacaccguccaugugugggcucagaaaggggaccgggaguccaagaaggccgauacaaaugccccuaccgacaucgauucucccaaaaaccuuguuacggacagagugacagaaaacauggcuaccgucagcugggacccggugcaagccgcuaucgauaaguaugugguccgcuacacauccgccggcggagagacccgggaaguuccugugggcaaagagcagagcucuaccgugcucacagggcugagacccggaauggaguauaugguccacgugugggcgcagaagggcgaccaggaauccaaaaaggccgauacgaaggcucaaaccgacauugauagcccccagaaucugguuacagaccgcgugaccgagaacauggccacagucucuugggauccugugcgggcuaccaucgacagauacguugugcgcuauacguccgccaaagauggggaaacacgggaggucccggugggaaaggagcagagcucuaccguucucaccggccugagacccgggguggaauacacaguccaugugugggcgcaaaaaggcgcccaggagagcaagaaagcugacaccaaggcccagacagauauugacuccccucagaaucuugugacggauugggucaccgaaaacacagcuaccguuagcugggaccccgugcaagccacaaucgaccgguacgugguccacuauaccucugccaauggagagacgcgcgaagugccuguuggcaaggagcaguccagcaccgugcugacagggcucagacccggaauggaguacaccguccacgugugggcucagaaaggcaaccaggaauccaagaaagcggauacaaaggcccaaaccgagauugacgggccuaaaaaucugguuacagauugggugaccgaaaacauggcuacggucucuugggaccccgugcaggccacaaucgauaaguauaugguccgguacaccagcgccgacggagagaccagagaagugccgguuggcaaagagcauuccucuacagugcugaccgggcuucgcccuggcauggaguauaugguccacgugugggcucagaagggagcccaggaaagcaagaaagcggauacgaaggcucaaacagagcucgaucccccucggaaucugagacccuccgccguuacccagucuggcgggauccugacauggaccccgccuagcgcccagauucauggauacauccucacauaucaauuucccgacggcaccgugaaagaaaugcagcuggggcgcgaggaccagagauucgcccuucagggacuggaacaaggcgcuacguacccugucucccucguggcguuuaagggcgggcggcgcagcagaaacgugucuaccacacuguccaccguuggagcucgguucccccaccccagcgauugcucucagguccagcaaaauuccaacgccgccagcggccuguacacaauuuaucuucacggggacgcuucucgcccucuccagguguacugugacauggagaccgauggaggcggguggaucguguuucagagacggaauacgggacagcuggacuucuuuaaacgcuggagauccuaugucgagggcuucggcgauccgaugaaggaguucuggcuggggcucgacaagcugcauaaccuuacaaccggaacacccgcccgguacgaggugcgcguugaucugcagaccgcuaaugaaagcgccuaugcgauuuacgacuuuuuccaaguggccuccagcaaagagagauauaagcucaccgucggcaaauaccgggggacagcuggagaugcccugacguaccacaacggcuggaaguuuaccacauucgacagagauaacgacaucgcucugucuaauugcgcccuuacccaucacgggggauggugguauaaaaacugucaucucgccaauccuaacggccgcuacggcgagacaaagcacagcgaaggggugaauugggagcccuggaagggacacgaauuuuccaucccuuauguugagcugaaaauucggccccauggcuacucuagagaaccugugcuggggcgcaagaaacggacccucagaggacgccugcggacguucuga

SEQ ID NO: 77113 - RNA, 564 nt, Artificial Sequence
  derived and/or modified sequence opt5 from TNNI1__Homo_sapiens__NP_003272
augcccgagguggaaagaaagccuaaaaucaccgccagccggaagcugcuccugaaaucccuuaugcuggcuaaggccaaagagugcugggaacaggagcacgaagagagagaggcggaaaaggucagauaccucgcugagcggauuccgacacugcaaacgcgcggccuuucucugagcgcccuccaggaccuguguagagaacugcaugccaagguugaggugguggaugaggaacgguaugacaucgaggcuaaaugccuccacaacacccgcgaaauuaaggaucugaaacuuaaggucauggaccugagagggaaauucaagcggcccccucuccgcagagugcggguuuccgccgaugcuaugcugcgcgcccuucugggaucuaagcauaaagugagcauggaccucagagcgaaucugaaguccgucaaaaaggaggauacagaaaaagagcggcccguggagguuggcgacuggcgcaagaacguggaagccaugucugggauggagggacgcaaaaagauguuugaugcugccaagagcccuaccucccaguga

SEQ ID NO: 77114 - RNA, 549 nt, Artificial Sequence
  derived and/or modified sequence opt5 from TNNI2__Homo_sapiens__NP_001139313
augagccagugcaagaaaagaaaccgggccaucaccgcucgcagacaacaccugaaguccgugaugcuccagauugccgcgacagagcuggaaaaagaggaaucucggcgcgaggcugaaaagcagaauuaccuugccgagcauugucccccucugcacaucccgggcagcauguccgagguccaggaacucugcaaacaacugcaugccaagauugacgcugccgaggaagagaaguaugauauggagguuagagugcagaaaacgucuaaggaacuugaggacaugaaccagaaacuguucgaucuccgggggaaguuuaaaagacccccucugcgccgggugcgcaugagcgcugacgccaugcugaaggcgcuccugggauccaagcacaaagucuguauggaucuuagagccaaucugaaacaggugaagaaggaagacaccgagaaagaacgggaucuccgcgacguuggcgauuggagaaagaacaucgaggagaaaucugggauggaaggacggaagaagauguucgagagcgaauccuga

SEQ ID NO: 77115 - RNA, 633 nt, Artificial Sequence
  derived and/or modified sequence opt5 from TNNI3__Homo_sapiens__NP_000354
auggccgacggcagcuccgaugcugccagagagccccggccugcgccggcucccauccgcagacggucuagcaacuaccgcgccuaugccaccgaaccucacgcuaagaaaaaguccaaaauuucugccagcagaaagcugcagcucaaaacacugcuucugcaaaucgcuaagcaggagcucgaacgggaggccgaagaacgcagaggggagaagggacgggcgcuguccacgcgcugccagccccuugaacuggccggccucggguucgcugagcugcaggaccuguguagacaacuccaugcccggguggauaaagucgacgaggagcgcuacgauauugaggcuaagguuaccaaaaauaucacagaaauugccgaccugacccagaagaucuuugaucuuagaggaaaauucaagcggccuacacugcgcagagugcggaucucugcggacgccaugaugcaggcucuccugggcgccagagcuaaggagagccuugaucugcgcgcccaccucaaacaggugaagaaagaagacaccgagaaggaaaaccgggaggucggggauuggcgcaaaaauauugacgcccuguccggaauggagggcagaaagaaaaaguuugaaagcuga

SEQ ID NO: 77116 - RNA, 756 nt, Artificial Sequence
  derived and/or modified sequence opt5 from TNNT1__Homo_sapiens__NP_001278703
augagcgacaccgaggaacaggaguacgaagaggaacaacccgaggaggaagccgcugaggaagaggaggaagaggaagagagaccuaagccgucccggcccguggucccuccccugaucccucccaaaauuccugaaggcgagcgcguugauuucgacgauauccacagaaagcggauggagaaagaccuccuggaacuucagacacugauugaugugcauuuugagcagcgcaagaaagaagaggaagaacucguggcccugaaggagagaaucgaacggcgcagaucugagcgggcggaacagcaacgcuucagaacggagaaggaacgggagcgccaggcuaaacuugccgaggaaaagaugagaaaagaggaagaggaggccaagaaacgggcugaagacgaugccaagaagaaaaagguccugagcaacaugggggcucacuuuggaggcuaucucgugaaagccgagcagaagcgcgggaaaagacagaccggacgggaaaugaagguuagaauccuguccgagcgcaaaaagccgcuggacauugauuacaugggcgaggagcaacuccgggagaaggcgcaggaacugucugacuggauccaucagcuugagagcgaaaaauucgaucugauggccaagcucaaacagcaaaaguaugagauuaaugugcuguacaacagaaucucccacgcucagaaauuucgcaagggggccggaaagggccgggucggcgggagauggaaauga

SEQ ID NO: 77117 - RNA, 867 nt, Artificial Sequence
  derived and/or modified sequence opt5 from TNNT2__Homo_sapiens__NP_001001430
augagcgacaucgaggaaguggucgaggaauacgaggaagaggagcaggaagaggccgcuguugaagaacaagaggaagccgcggaggaagaugcugaggccgaagccgagaccgaggaaacaagagcugaggaagacgaggaagaggaggaagccaaggaggcugaagauggccccauggaggaauccaaaccuaagccgcggucuuucaugcccaaccuggugccucccaaaauuccugacggggagcgcguggauuuugacgauauccacagaaagcggauggagaaagaccucaaugaacugcaggcccuuauugaggcgcauuucgaaaaccgcaagaaggaggaggaggagcuggucagccucaaagauagaaucgaacggcgcagagccgagcgggcugaacagcagcgcauuagaaaugagcgggagaaggaacgccaaaacagacuggccgaggaacgggcucgcagagaggaagaggagaaucggagaaaagccgaagacgaggcgcgcaagaaaaaggcccuuuccaacaugaugcacuuuggaggcuauauccagaagcaggcucagacggaacggaaaucugggaagagacaaaccgagcgcgagaaaaagaaaaagauccuggccgaacggagaaaagugcucgcuauugaucaucugaaugaggaccagcugcgcgaaaaggccaaggagcucuggcagagcaucuacaaccuggaagccgagaaauucgaucuucaggagaaguuuaaacaacagaaguaugaaauuaauguucugcggaacagaaucaaugacaaccagaaaguguccaagacacgcggaaaggcuaaagucaccggccgguggaaguga

SEQ ID NO: 77118 - RNA, 753 nt, Artificial Sequence
  derived and/or modified sequence opt5 from TNNT3__Homo_sapiens__NP_001036245
augagcgacgaggaaguggagcaggucgaggaacaauacgaagaggaggaagaggcccaggaagaggaggaaguucaggaggaagagaagcccagaccuaaacugaccgcuccgaagauccccgaaggcgagaaaguggauuucgacgauauucagaagaaacggcaaaacaaggaccucauggagcugcaggcccuuaucgauucccacuuugaagcgcgcaagaaagaggaagaggaacugguggcucucaaggagagaauugagaaacggcgcgccgaaagagccgagcagcagcggauccgcgcugaaaaggagagagaacggcaaaaucgccuggccgaggagaaagcuagacgggaagaggaagacgccaagcgcagagcggaggaugaccuuaagaaaaagaaagcccugucuagcaugggggcuaacuauuccucuuaccucgccaaggcugaucagaaacggggaaagaaacagacagcccgcgagaugaagaagaaaauucuggcggaaagacggaagccucugaauaucgaccaucucggcgaggauaaacugagagacaaggccaaagaacuuugggagacgcugcaccagcucgaaaucgauaaguucgaguuuggggagaagcugaaacgccaaaaguaugacauuaugaacguccgggcuagagugcagaugcuugccaaauucagcaagaaagcuggaacccccgccaagggcaagguugggggacgcuggaaauga

SEQ ID NO: 77119 - RNA, 168 nt, Artificial Sequence
  derived and/or modified sequence opt5 from TNP1__Homo_sapiens__NP_003275
augagcaccuccagaaagcugaaaucucacggcaugcggcgcagcaaguccagaucuccccauaaaggggugaagcggggaggcagcaaacgcaaguacagaaaggggaaccucaaaucccggaagcgcggagacgaugccaauagaaacuaucggucucaccuguga

SEQ ID NO: 77120 - RNA, 417 nt, Artificial Sequence
  derived and/or modified sequence opt5 from TNP2__Homo_sapiens__NP_005416
auggacacccagacacacagccugcccaucacgcauacccagcuccacuccaacucucagccucagagcagaacaugcacccggcauugucagacauucucccaaucuugccgccagagccacagaggcucccggucucagagcuccagccagucuccggccucccaucgcaaucccaccggggcucacagcuccuccggacaccaaagccagucuccuaacacaucucccccucccaagagacauaaaaagaccaugaauagccaccauuccccuaugcggccgacgauucugcacugucgcugccccaaaaacagaaagaaucuugagggcaaacugaagaagaaaaagauggccaaacggauccaacagguguacaagaccaaaacacgcucuagcggguggaaguccaacuga

SEQ ID NO: 77121 - RNA, 2697 nt, Artificial Sequence
  derived and/or modified sequence opt5 from TNPO1__Homo_sapiens__NP_002261
auggugugggacagacagaccaagauggaguacgaauggaaacccgaugagcaaggccugcagcagauccuccagcugcuuaaggaaagccaauccccugacacaacgauucagcggaccguccagcagaaacuggagcaacucaaccaguauccggauuucaauaacuaccugaucuuuguucuuacaaagcugaaaucugaagacgagcccacccgcagccucuccgggcugauucugaagaauaacgugaaggcccacuuccagaauuuuccuaacggagugacagauuucaucaaaucugagugccucaauaacauuggcgacagcucuccccugaucagagcuaccgucgggauccuuauuacaaccaucgccuccaagggagaacugcagaauuggccugaucuccugcccaaacuuuguagccugcucgacuccgaggauuauaacacgugcgaaggcgcguuuggggcucugcaaaagauuugugaggacagcgccgagauccuggauucugacgugcucgaucggccucugaauauuaugaucccgaaauuccuucaguuuuucaagcauuccagccccaagauucgcucucacgccguugcuugcgugaaccaguuuaucaucuccagaacccaagcccugaugcuccauauugacagcuucaucgaaaaucuguuugcucuugccggagacgaggaaccugagguccggaaaaacgugugucgcgcgcugguuaugcuccuggaagugagaauggaucggcugcucccccacaugcauaauauugucgaguacaugcugcagcgcacacaggaccaggaugagaacguggcccuugaagccugcgaguucuggcugacccucgcugaacaaccuaucuguaaggacgugcuggucagacaccuucccaaacugauuccgguucucgugaacggcaugaaguauucugauaucgacaucauucugcugaaaggcgauguggaggaagacgagacaaucccugauuccgagcaggacauucggccccgcuuucacagaagccggaccgucgcucagcagcaugaugaagacgggaucgaggaagaggacgaugacgaugacgaaauugaugacgaugacacgaucuccgauuggaaucuccgcaagugcucugccgcggcccuggacgugcuugcuaacguuuacagagaugagcugcucccucacauccugccccugcuuaaagagcuccuguuccaucacgaauggguggucaaggagagcgggauucuggugcucggcgccaucgcugaaggguguaugcaaggaaugauucccuaucugccugagcuuaucccgcaccugauucagugccucuccgacaagaaagcccugguucggagcaucacauguuggacccugucuagauacgcccauuggguggucucccagcccccugauacauaccuuaagccccucaugaccgagcugcugaaacgcauucucgacagcaauaagcgggugcaggaagcugcgugcucugccuucgcuacccuggaggaagaggccugcacagaacuugucccuuaucuggccuacauccucgacacgcugguguuugcuuucagcaaauaucaacacaagaaccugcuuauccucuacgaugccauuggcacccuggcggacuccguugggcaucaccugaauaagcccgaguauauccagaugcucaugccgccucugauucagaaauggaacaugcuuaaggaugaggacaaagaucuguuuccccuccuggaaugucugucuagcguggcuacagcccuucaguccggauuccucccuuacugcgagcccgucuaucaaagaugugugaaucugguucagaagacccuggcccaggcuaugcucaacaaugcccaaccugaccaguacgaagcucccgauaaagacuuuaugaucguggcccuggaucuucugagcggccucgcggagggccugggaggaaacauugaacagcuggucgcccgcucuaauauccuuacacugauguaccagugcaugcaagacaagaugccggaggugcggcaguccagcuucgcucuccugggcgaucucaccaaggccuguuuucagcaugugaaaccuugcaucgcugacuucaugcccauucuggggacgaaccuuaaucccgaguuuaucucuguuuguaacaaugccacaugggcgauuggagaaaucuccauucagaugggcaucgagaugcaaccuuauaucccgaugguccugcaccagcucguggaaauuaucaacagacccaacaccccuaagacccugcuggagaauacagccauuaccaucgggcgccuuggauacgugugcccccaggaagucgcuccuaugcugcagcaauucauucggcccugguguacaagccucagaaacauccgcgauaaugaggagaaagacuccgccuuucggggcaucugcacgaugauuucugugaacccuagcggcguuauccaggacuucaucuuuuucugugaugcuguggccuccuggauuaaucccaaggacgaucugagagacauguucugcaaaauucuccacggguuuaagaaccaggucggagaugaaaauuggcgccgguucucugaccaauuuccgcugccucuuaaggagagacuggccgcuuucuauggcguguga

SEQ ID NO: 77122 - RNA, 2664 nt, Artificial Sequence
  derived and/or modified sequence opt5 from TNPO2__Homo_sapiens__NP_001129667
auggacuggcagcccgaugagcaaggccugcaacaggugcuccagcugcuuaaggacagccaguccccuaacaccgccacacagagaaucguccaggauaaacugaagcagcucaaucaauucccggacuuuaacaauuaccugauuuucguucuuacgcggcugaaaucugaagaugagcccacccgcagccucuccgggcugauccugaagaacaaugugaaagcucacuaucagucuuuuccucccccuguggccgacuucauuaagcaggaaugccucaacaauaucggagaugcgagcucccugauuagagcuacaaucggcauccuuauuaccacaaucgccucuaagggggagcugcagauguggcccgaacuccugccucaacuuuguaaccugcucaauagcgaggacuacaauaccugcgagggagccuuuggcgcucugcagaaaauuugugaagauuccagcgagcugcucgacucugaugcccugaaccggccgcuuaacaucaugauucccaaguuccugcaguuuuucaaacauugcuccccuaagauccgcagccacgcuauugccugugucaaucaauuuaucauggacagagcgcaggcccucauggauaacaucgacacauucauugaacaucuguuugcucuugccguggacgaugaccccgagguucggaaaaaugugugccgcgcucuggucaugcuccuggaggugagaaucgaucggcugauuccucacaugcauucuaucauucaguauaugcuccagcgcacccaagaccacgaugaaaacguugcccuggaggcgugugaguucuggcuuacgcuggccgagcagcccaucugcaaggaagugcucgcuucccaccugguccagcuuaucccgauucuggugaacgggaugaaguacagcgagaucgacauuauccuccugaaaggagauguggaggaagacgaggccgucccugauucugaacaggacauuaagcccagauuucauaaaucccggaccguuacacugccucacgaggcugaacgccccgauggcagcgaggacgccgaggacgaugacgaugacgaugcccucuccgacuggaaucugagaaaguguucugcugcggcccuugaugugcuggcuaacguguuccgggaagaacuccugccccaucugcuuccucuccugaaaggccuccuguuccacccggaaugggucgugaaggagagcgggauccugguucuuggagccaucgccgaaggcugcaugcaagggauggugcccuaucugccugagcucauuccccaccugauccagugucuguccgacaaaaaggcucuuguccgcagcauugccugcuggacccucucuagauacgcgcauugggugguuucccagccucccgauaugcaccugaagccgcugaugacagagcuccugaaacggauccuugacggaaauaagagagugcaggaagcugccugcagcgccuuugcuacccuggaggaagaggccuguacggagcucgucccuuaucugucuuacauucuggauacacuuguguucgcuuuuggcaaauaccaacauaagaaccuccugauccuguaugacgccauugggacccucgcggauagcgucggacaccaucugaaucagcccgaauacauccagaaacuuaugccuccccugauccagaaguggaacgagcucaaggacgaagacaaagaucuguucccucugcuugagugccucuccucuguggccacagcucugcaaagcggcuuucugcccuauugugaaccgguuuaccagcgcugcgugacccucguccagaagacccuggcccaagcuaugauguauacacagcacccugagcaguacgaggcccccgacaaagauuucaugauuguggcgcuugaccugcucuccggccuggccgaagggcugggaggccacguugagcagcuuguggcucggagcaauaucaugacgcugcucuuucaauguaugcaggauucuaugcccgaagucagacaguccagcuucgcccugcucggggaccugaccaaggcuugcuuuauucaugugaaaccuuguaucgccgaguucaugccgauucuuggaacaaaccugaaucccgaauuuaucucugugugcaacaaugccaccugggcuaucggcgagauuuguaugcagaugggggcggagaugcaaccuuauguucagaugguccucaacaaucugguggaaaucauuaaccgccccaauacaccuaagacccugcuugagaacacggccaucacaauuggacggcugggcuacgugugcccccaggaagucgcuccuaugcuccagcaauucaucagacccugguguaccucccugcgcaacauccgggauaaugaggaaaaggacagcgccuuuagaggcauuugcaugaugaucggggugaacccgggaggcguugugcaggauuucauuuucuuuugcgacgccgucgcuuccugggugucuccuaaagaugaccuccgcgauauguucuacaagauccugcacggguuuaaagaccagguuggagaggacaauuggcaacaguucagcgagcaguuucccccucuucugaaggaacggcucgccgcguucuauggcguguga

SEQ ID NO: 77123 - RNA, 2580 nt, Artificial Sequence
  derived and/or modified sequence opt5 from TNPO3__Homo_sapiens__NP_001177957
auggagggcgccaagcccacccugcagcucguguaccaagcuguccaggcccuguaucacgacccugauccgagcgggaaagaaagagcguccuucuggcuuggagagcugcagcggucuguucaugcuugggaaaucagcgaccagcuccugcaaauucgccaggauguggaguccugcuacuuugccgcccagacaaugaagaugaaaauccagacgucuuucuaugaacuucccaccgacagccacgcuucccugagagauucucuccugacacauauucaaaaccugaaggaccucagcccugugaucgucacccagcuggcccuugcuauugccgaucuggcgcuccagaugcccuccuggaaaggcugugugcagacacugguugagaaguacagcaaugacgugaccucucuuccuuuucugcucgagauccugacaguccugcccgaagaggugcacucccggagccuccgcaucggggccaacagacggaccgaaauuaucgaggaucuggcuuucuauucuuccacgguugugagccuucugaugaccugcgucgagaaggccggaacagacgagaaaaugcucaugaagguguuucgcugucugggcucuugguucaaucuuggggugcuggauuccaacuuuauggcuaauaacaaacuccuggcccuccucuucgagguccugcaacaggacaagaccagcuccaaucuucaugaagcggccucugauugcguuuguagcgcucuguacgccauugagaacguggaaacaaaucucccucuggcuaugcagcuuuuucaaggagugcugacccucgagacggccuaucacauggccgucgcuagagaggaccuggacaaagugcugaacuacugccggaucuucacagaacucugugagaccuuucuggaaaagauuguuugcacaccgggccagggccuuggggaucugcgcacccucgagcugcugcuuaucugugcgggacacccccaguacgaaguggucgagauuuccuucaauuuuugguauagacucggcgagcaucuguacaagaccaacgacgaagugauccacgggaucuucaaagccuauauucagcggcugcuccaugcucuggcccgccacugccaacuugagccugaucacgaaggaguucccgaggaaacagacgauuucggcgaguuuagaaugcgggugagcgaccuggucaaggaucucaucuuccugauugggucuauggaguguuuugcccagcuguacuccacgcuuaaagaaggaaauccucccugggaggugaccgaagcuguccucuucaucauggccgcgauugcuaagagcguggacccggagaacaauccuacacugguugaggugcuggaaggcgucgugcgccuccccgagaccguucauacagccgugagauauaccucuaucgaacuggucggcgagaugagcgaagugguggaucggaacccucaguuucuugggacggcccugguucucgcuagacugccccuggacaaaaucacagagugccuuuccgagcucugcucuguccaggugauggcccugaagaaacugcucagccaagaacccuccaacggaauuagcucugauccuaccguguuccuggaccgccuugcugucaucuuucggcacaccaauccgauuguggagaacggccagacacaucccugucagaagguuauccaggaaauuuggccugugcuguccgagacccucaauaagcacagagccgacaaccgcaucgucgaacggugcuguagaugccugcgcuucgcggugcgguguguugggaaaggaagcgccgcucugcuucaaccccucgugacacagauggucaauguguaccauguucaccagcacucuugcuuucuguaucugggcuccauccucguggaugaguacgggauggaggaaggauguagacagggccugcuugacaugcugcaagcccucugcauuccuacguuccagcugcuggagcagcaaaacggccuucagaaucaucccgauaccgucgacgaucuguuucgccucgcuacacgguucauccagagaagcccggugacccugcuccgcucccagguggucauuccuauccugcaaugggccauugcgucuacaacccuugaccaccgggaugccaacuguagcguuaugagauuucugcgggaccucauccauacggggguggcuaaugaucacgaagaggacuucgaacugcgcaaggagcugauuggacaggugaugaaccagcuuggccagcaacuggucucccagcuccugcauaccugcuguuucugccugcccccuuacacacugcccgauguggccgagguucuuugggaaaucaugcaggucgacagaccuaccuuuugccgguggcuggaaaauucucucaaagggcugcccaaggaaacaaccgugggagcugugacgguuacacacaaacagcugaccgauuuccacaagcaagugacaagcgccgaggaguguaagcaggucugcugggcccuuagagacuuuacccgccuguuccgguga

SEQ ID NO: 77124 - RNA, 8907 nt, Artificial Sequence
  derived and/or modified sequence opt5 from TNRC18__Homo_sapiens__NP_001073964
auggacggcagagauuucgggccccagcggagcguccacggaccucccccuccccugcucuccggccuggccauggacucucacagagucggggcugccacagcgggaagacuucccgcuagcggccugccugggccccucccuccgggaaaguacauggccggccugaaccuucacccccacccuggcgaagccuuucugggguccuucguugcuucuggaaugggccccagcgccuccucucacgggagcccugugccccucccguccgaucugagcuuucggucuccuacacccuccaaucugccuauggugcagcucugggcugcccaugcgcacgaaggauucagccaucugcccucuggccuuuaucccuccuaccugcaucucaaccaccuggagccuccgagcucugggagcccccuucugagccagcucggacagccuuccaucuuugacacgcagaaaggccaaggccccgggggagauggcuucuaucugccuaccgccggggcucccggaucucugcauagccacgccccguccgcucgcacaccuggcgggggacacagcucuggcgcccccgcgaagggcuccagcucuagagacgggccugccaaagaacgggcuggacgcggcggggagcccccuccccucuuuggaaagaaagauccgagagcccggggcgaagaggcuagcgggccucgcggcgucguggaccugacccaggaggccagagccgaaggacggcaggaucgcggaccgcccagacuugcugagcggcuguccccuuuccucgcggaaucuaagacaaagaaugccgcucugcagccgagcguucuuaccaugugcaacgggggagccggcgacguggggcugcccgcccucgucgcugaggccggacgcggcggggcgaaagaggcugccagacaagaugaaggcgcccggcugcugagacgcacagagacccuccugccuggaccccggccuugucccuccccucuucccccgccucccgcuccucccaagggcccgccugcucccccugccgccacgcccgcggggguguacaccguuuuuagagaacagggacgcgagcaucggguggucgcccccacauucgugccuagcguggaggcuuuugacgagagaccgggccccauucagaucgccucucaggcucgcgaugcccgggcgagagagcgcgaagccgggcggccuggaguccugcaagcucccccuggcucccccagaccucucgaccgcccggaggggcugcgggagaagaauagcguuauuagaucucuuaagcggcccccucccgccgacgcuccuaccgugcgcgccacaagagccucccccgauccgcgggcuuaugugccugcgaaagagcugcucaagcccgaagccgaccccagaccuugcgagcgcgcuccccggggcccugccggaccggccgcucagcaggccgcgaagcuguucggccuggagcccgggagaccucccccuaccggacccgaacacaaauggaagccguuugagcucggcaacuucgcugccacgcaaauggccguccuggcugcccagcaucaccauagccgcgcggaagaggaagcugccgugguugccgcuuccucuagcaaaaaggccuaccuugauccuggggcugugcugcccagauccgccgcgacauguggacggccugucgccgacaugcacucugcugcccacggcagcggggaggcuuccgccaugcagagccucaucaaauauucuggcuccuucgcccgcgaugcuguggcgguuagacccggaggcugcgggaagaaaagcccuuuuggaggccuggggaccaugaagcccgagccggccccuacaucugcuggagccucccgggcccaggcucgccugccccauagcggcggccccgccgccgggggaggcagacaacuuaagcgggacccugaacgcccggagucugcuaaagccuucgggagagaaggaagcggcgcccagggggaggcugaggugcggcaucccccugucggaauugccguggcggucgcucgccagaaggauuccggcggcagcgggagacucggacccggccugguggaccaggaacggucucugucccucagcaauguuaaagggcauggcagagcggaugaggacuguguggaugaccgcgcccggcacagagaagaaagacugcuuggcgcucggcuggacagagaucaagaaaagcuccugcgcgaguccaaagagcuggccgaccuugcucggcuccacccuaccucuugcgcccccaacgggcugaauccuaaccugauggucaccggaggcccggcgcucgccggcagcgggagaugguccgcugaucccgccgcucaucuggccacacacccuuggcuuccccgcucuggaaaugccagcauguggcuggcuggccauccuuacgggcucggacccccgucccugcaccagggcauggcgccugccuuuccgcccgggcugggaggcucucuuccuagcgcuuaccaguucgugcgggacccccaguccggccaacucguugugaucccuagcgaucaucugccgcacuuugccgaacugauggagagagccacggugcccccucucuggcccgcucuguauccucccgggcggucuccgcuucaccaugcccagcagcugcaacucuucucccaacagcacuuucugcgccagcaagaguuccuguaccuucagcagcaggcggcucaagcccucgagcugcagagaagcgcccagcuggugcaggaacggcucaaggcucaagagcaucgcgccgagauggaagagaagggaucuaaaagaggccuggaagcggccgggaaggcuggacuugccaccgcuggcccugggcugcucccccggaaaccucccggacuggccgcuggcccugccggcacauaugggaaggcggugagcccuccucccagccccagagccucucccguugcugcccugaaagcuaaggucauccagaaacuugaggacguguccaaacccccggccuacgccuaucccgcuaccccuagcucccaccccacaagcccucccccugcgucucccccgccuacccccggaauuacgcgcaaggaagaggccccugagaacguggucgagaagaaggaucuggagcucgaaaaagaggcucccagcccguuucaggcccuguucuccgacaucccuccccgguaccccuuucaggcccucccuccccauuauggcagaccuuacccguuccugcuucaacccacagcugccgcggaugccgacgggcuggcuccugaugugccccucccugccgacggacccgagcgccuggcucugucuccugaagauaagccgauucggcuuagccccuccaagaucaccgagccucugagagaaggccccgaggaagaaccucucgccgagcgcgaaguuaaagcggagguggaagacauggacgaggggcccaccgaacugccgccucucgagucuccccugccccuuccugccgcugaggccauggcuacacccagcccugccggaggcuguggcgggggacugcucgaagcucaggcccuguccgcgaccggccagucuugcgccgagccgagcgaaugucccgauuuugucgaggggccugaaccccggguggacuccccuggaagaacagagcccugcacggcugcccuggaucuuggcguucaacugaccccggagacacucguggaagcuaaggaggaaccugucgaggugcccguugccgugccugucguggaggccgugcccgaagaggggcuggcgcaggucgcuccgagcgaaucucagccuacccucgagauguccgacugugauguucccgccggagaaggccagugccccagccuggagccucaagaggcugugcccgugcuuggcucuacaugcuuccuggaagaggccuccagcgaccaguuccugccuucccucgaagauccgcuggccgggaugaaugcucuugccgcggccgcugagcugccccaggcccgcccucuccccucuccuggagcugccggcgcgcaggcccuggaaaaacucgaggcugccgagagccugguccuugaacaauccuuucugcacgggauuacccugcucagcgagaucgcugaacuggagcuugaaagacggucucaggagaugggaggcgccgagcgcgcucugguggccagacccucccucgaaagccugcucgcggccgggucucacaugcugcgggagguucuugacggcccuguggucgauccgcugaagaaccugcgccuccccagagaacugaaaccuaauaagaaauacagcuggaugcggaagaaggaggagagaauguaugcuaugaaauccucucuugaagacauggaugcccuggagcucgacuuccgcaugcggcuggcugaagugcagagacaguacaaggagaaacaacgcgaacucguuaagcugcagcggagacgggauagcgaggaccgcagagaggaaccccaucggucccuugcccgcagaggaccuggccggccccgcaaaagaacgcacgccccgucugcgcugagcccuccccggaagcgcgggaaguccggacauagcucuggcaaacuguccagcaagucccuccugaccucugacgauuaugagcuuggggcuggaauuagaaaacggcacaagggcagcgaagaggaacacgacgcccugaucgggaugggcaaagccagaggacgcaaccagacaugggaugagcaugaggcuuccucugacuuuaucagccagcucaagauuaagaaaaagaaaauggccuccgaucaagaacagcuggcuagcaagcuggacaaagcccucucucuuaccaagcaggauaagcugaaaucccccuucaaguuuagcgacucugcgggcgggaaauccaagacaagcggaggcugugggcgguaccugaccccuuaugauucucuccugggcaagaacagaaaggcccuugcuaaaggccuggggcucagccugaaguccucucgcgagggcaagcacaaacgggccgcuaagacgagaaaaauggaagugggauucaaggcccgcggccaacccaaaagcgcgcauuccccuuuugccagcgaggucuccucuuacagcuauaauacagacuccgaagaggaugaggaguuccugaaggacgaguggccggcucaggggcccucuagcuccaagcucaccccuucucuucugugcagcaugguggccaaaaacuccaaggcugccggaggccccaaacugacaaagcgggggcucgcugccccuagaacccugaaacccaagccggcgaccagccgcaagcagccuuuuugucuucugcuccgggaagccgaggcuagaucuuccuucagcgacucuuccgaggaauccuuugaucaggacgagucuuccgaagaggaagaugaggaggaagaacuggaagaggaagacgaggccagcggaggcggcuaccgccugggggcccgggagagagcucucucccccggacuugaagagagcggccuggggcugcucgcccgcuucgcggcuucugcccugccuagccccacaguuggaccuucccuuucugugguccaacuggaagccaaacagaaggcucgcaaaaaggaggaacggcagagccuccugggcacggaguuugaguacaccgauuccgaaucugaggugaaagugcgcaagagaagccccgccgggcugcuccggccgaagaaaggacuuggcgaacccggcccuucccuggcugcccccacaccuggggcgagaggaccggaccccucuagcccugauaaggccaaacuggcugucgagaagggccggaaagcccgcaagcucagagggcccaaggagccuggauucgaagcuggccccgaggccuccgacgaugaccuguggacccggcgcagaagcgaacggaucuuccuucacgaugcgucugccgcugccccugcucccguuuccacagccccggccaccaaaacgagccgcugcgcuaaagggggaccucugucucccagaaaagacgcgggccgggccaaggaucgcaaagacccuagaaagaaaaagaagggcaaagaggcugggcccggagccggccucccgccuccccgggcccccgcucugccuuccgaagcccgcgcgccccaugcuagcucccugacagccgccaagagaucuaaagcuaaggccaaagggaaggaggugaagaaagagaaucggggaaagggcggggcugugagcaaacucauggaauccauggccgcggaggaagacuuugagccuaaccaggauagcucuuucuccgaagacgagcaccuuccgcgcggaggcgccgucgagagaccccugaccccugcuccccggagcuguauuaucgauaaggacgaacugaaagauggccucagagugcugauuccuauggacgauaaacuucuguaugccgggcacguucaaaccgugcauucucccgacaucuaccgcgucgugguugagggagaacggggcaauagaccgcacaucuauugccucgagcagcugcugcaggaagcuauuaucgaugugcgcccugccagcacacgguuucucccccaggggaccagaauugcggccuacuggucccaacaguaucgcugucuuuacccuggaacagucgugcggggccugcuggaccucgaggaugacggggaucugaucacggucgaguucgacgacggagauaccggccgcauuccccuuucucauauccgccugcucccucccgacuauaagauccagugcgcugaaccgagccccgcccugcuggugccuuccgcuaaacggagaucucgcaagacaagcaaagauaccggcgaggggaaggacggaggcacagccggguccgaagaacccggagccaaagcucggggcagagggcggaagccuagcgcgaaggccaaaggagauagagcugccacccucgaggaaggcaaccccacggacgagguuccuucuaccccgcuugcccuggaacccuccagcacaccuggcuccaagaaaucucccccugagcccguggauaagcgcgcuaaagccccgaaggcgcggccugcucccccucaacccagcccggccccucccgccuuuaccuccugucccgcuccugaacccuucgccgagcugccugcuccggccacaucucucgcgcccgccccucugauuaccaugcccgcuacaagaccuaaacccaagaaggcccgcgcugccgaggaaagcggggcgaaaggaccuagacggccgggcgaggaagccgagcuucuggucaagcucgaccacgaaggggugaccucccccaaaagcaagaaagcuaaggaggcccugcugcuccgcgaggauccuggagcuggcggguggcaggaacccaagucucuucugucccugggaagcuacccucccgccgccggaucuuccgagccgaaagcucccuggccuaaggcgacggacggcgaucucgcccaggaacccgggccuggacugacauuugaggacagcggcaaucccaaaucuccugacaaggcucaggccgaacaagauggggccgaggaguccgaaagcucuagcuccagcuccucuggaagcuccucuagcuccucuagcuccuccucuagcggcagcgagaccgaaggggaggaggaaggcgacaaaaacggagauggcgggugcggaaccggcgggagaaauuguucugcugccuccagccgggcggcuucuccggccuccuccucuagcagcagcuccucuagcuccucuagcuccucuagcuccagcagcuccucuucuuccagcuccucuagcuccucuagcuccuccucuagcagcucuagcuccucuagcuccuccucuagcagcuccucuagcuccucuagcuccucuagcuccuccucuuccagcacaaccgacgaggauucuuccugcagcucugacgaugaagccgcucccgccccuacggcuggacccagcgcccaggcggcccuuccuacaaaggcuaccaagcaggccggcaaagcucgccccuccgcccacagcccggggaagaaaaccccugcgccccagccucaagcucccccuccccagccgacccagccccugcagccuaaggcccaagccggcgcuaaauccagacccaagaagcgggagggaguucaucucccuacaaccaaagaacuggccaagcgccagagacugcccucuguggagaaccggccgaaaaucgcggccuuccucccugcucgccagcuuuggaagugguuuggcaaacccacgcagagacgggggaugaagggaaaagcccgcaagcuguucuacaaggcuauugucagaggcaaagagaugauccggauuggggacugcgccguguuucugagcgccggaagaccuaaucuccccuauaucggccgcauucaauccaugugggaaucuugggggaacaauauggugguucgggucaagugguucuaccacccugaggaaaccagccccggcaaacaguuccaucagggacaacacugggaucagaaguccucuagaagccugccggcugcccuucgcguguccagccagcggaaagacuuuauggagagagcgcuguaucagucuucccauguggaugaaaacgacguccaaacagugagccacaagugucucguugugggccuggagcaguacgagcagaugcugaagaccaaaaaguaucaggauucugaagggcucuacuaucuggcuggaacauacgagccuaccacgggcaugaucuucuccacagacgggguccccgugcuuugcuga

SEQ ID NO: 77125 - RNA, 5889 nt, Artificial Sequence
  derived and/or modified sequence opt5 from TNRC6A__Homo_sapiens__NP_055309
augcgggaacuggaagccaaggcuaccaaggacguggagcggaaccucagccgcgaucuggugcaggaagaggaacagcuuauggaggagaagaaaaagaaaaaggacgauaagaaaaagaaagaagccgcgcagaagaaagcuacagagcagaagaucaagguucccgaacagauuaaaccuuccgugucucaaccgcagcccgccaauagcaacaauggcacguccaccgccacaucuaccaacaauaacgcuaagagagccacagcuaauaaccagcagccucaacagcagcagcaacagcagcaaccccagcagcagcaaccucagcagcagccccaaccucagccgcagcagcaacagccccagcagcaaccucaggcccugccccgguacccucgcgaggugcccccgagauuccggcaccaggagcauaaacaacuccugaagcgcgggcagcacuuuccugucaucgcggccaaucuugggagcgcugugaaaguucugaacucccagucugaaagcuccgcccucaccaaucagcaaccccagaacaauggcgaggugcagaacagcaagaaucagucugacauuaaccauuccacaagcgggucucacuaugaaaacucccaaagagggccugucagcucuaccuccgauagcuccacgaauugcaaaaacgcugugguuucugaccugagcgagaaggaagccuggcccuccgcgcccggcagcgauccugagcuggccucugaguguauggacgcugauuccgccagcucuagcgaauccgagcggaauaucaccauuauggcuucugggaacacagggggcgaaaaggacggccuccgcaauagcaccgggcuggggucccagaacaaauucguggucggcuccucuagcaauaacguggggcauggaagcucuacaggcccguggggguuuucccacggagccaucaucucuaccugccagguguccgucgaugcccccgaguccaagagcgaauccucuaauaacagaaugaaugcuuggggcacgguuagcuccagcucuaacggcgggcuuaauccuuccacacugaacagcgcgucuaaucacggagccuggcccgugcucgagaacaacggccuggcucuuaaagggccugugggauccggcagcucugggauuaauauccaguguagcaccauuggacaaaugcccaacaaucaguccaucaacagcaaggucucuggcggcuccacacaugggaccuggggaagccugcaggagaccugcgaauccgaggugucuggcacacaaaaaguuagcuucuccgggcagccgcagaauauuacgaccgaaaugacaggaccuaacaauaccacaaacuuuaugaccucuagccuccccaauuccggcucugugcagaacaaugagcugccuagcuccaacacgggggccuggcgggucagcacaaugaaucacccccaaaugcaggccccuucuggcaugaacggaaccucccugagccaucucucuaauggcgaauccaagagcgggggaucuuacggcaccacauggggagcuuauggauccaacuacagcggcgacaaguguuccgggcccaacggccaggccaauggagauaccgugaacgcgacacugaugcagccgggcguuaaugggccuaugggaacgaacuuccaagugaauaccaacaaaggcgggggagucugggagagcggcgcugccaauucucagagcacauccugggggucuggcaacggagccaauagcggcgggucccgcagaggauggggcacccccgcucagaacacagggaccaaucuucccucuguggaguggaacaagcugccuagcaaucagcacuccaacgacucugccaauggaaacggcaaaacguuuaccaacggguggaaaagcacagaagaggaagaccaaggcuccgcuaccagccagacaaaugagcagucuuccgucugggccaaaaccggaggcacgguggagagcgaugggucuacagaauccaccggacggcucgaggaaaagggcacaggggagagccagucccgcgacagacggaagaucgaucaacacacccugcuucagucuauuguuaacagaaccgaccuggauccgcgcgugcucagcaauuccggauggggccagacacccaucaaacaaaacacggcgugggacaccgaaacaagcccucggggcgagagaaagaccgauaaugggacagaggccuggggaucuuccgcuacccagacguucaacagcggcgccugcaucgacaaaacaucucccaaugggaacgauaccagcuccgucucuggauggggcgacccuaagcccgcucugcgcuggggagauagcaaaggauccaauugucagggcggcugggaagacgacucugccgcgaccgggauggucaagagcaaccaguggggaaauugcaaggaggaaaaagccgcuuggaacgauucccaaaagaauaaacagggcuggggagacggacaaaagagcucucagggcugguccguuagcgccuccgauaacuggggagaaacaucucggaauaaccauuggggagaagcuaauaaaaagagcuccucuggcggcagcgacuccgauagaagcgugucuggguggaacgagcugggaaaaaccuccagcuuuacauggggcaacaauauuaacccuaauaacucuuccgggugggacgagagcucuaagcccacgccgagccaaggauggggcgauccucccaaguccaaucagucucucggguggggagacagcuccaaaccugucagcucccccgauuggaacaagcagcaggacaucgugggcucuuggggcauuccgccugccaccgggaaacccccuggaacaggcuggcugggcgggcccauccccgccccugcuaaggaagaggaaccgaccgggugggaggaacccagcccugaguccauucgccggaaaauggagaucgaugacgggacaucugcguggggagaucccagcaaguauaauuacaagaacgugaauauguggaacaaaaauguuccuaacggcaauuccagaucugaccaacaggcccagguccaccaacuucugacccccgcuagcgccaucuccaacaaggaagccagcucuggcuccggguggggagagccuuggggcgaaccgagcacgcccgcuaccacaguggacaaugggaccucugccuggggaaaaccuauugauuccggccccagcuggggagaaccuaucgcggcugccucuuccacaagcaccuggggauccagcucugugggcccccaggcccucagcaaguccggcccgaaaucuaugcaggacgggugguguggagaugacaugccucugcccggcaaccgccccacagggugggaggaagaggaagaugucgagauuggaauguggaacagcaauuccucucaggaacuuaacagcucccugaauuggccucccuauaccaagaagaugucuagcaaaggccucuccgggaagaaacggagacgcgagcggggaaugaugaagggcggcaacaaacaagaggaggcuuggaucaauccuuucgugaagcaguuuagcaacauuucuuucuccagagacagcccggaggaaaauguucagucuaacaagauggaucuguccgggggaaugcugcaggacaaacggauggagaucgauaagcauagccucaauaucggcgacuacaaccgcacgguggggaaaggacccggcuccagaccucaaauuucuaaggaaagcuccauggagcggaaucccuacuuugauaaagacgggaucgucgccgaugagagccagaacaugcaguucaugucuucccagagcaugaagcugccucccucuaauagcgcgcuuccgaaccaagcucugggcuccauugccggacucggcaugcagaaucugaacucugugagacagaacgggaauccuagcauguucggaguuggcaacacagccgcucagccccgcgggaugcaacagccucccgcccagccucuguccucuagccaacccaaucuucgggcucaggugccgccuccccuccugagcccccaggucccugugagccugcucaaauaugccccgaacaauggaggccugaacccccuuuuugggccucagcaaguugcgaugcugaaucagcucucucagcugaaccagcugucccaaaucagccagcuucagagacuccuggcccagcaacagcgcgcucagucccaaagaucugugcccagcggcaaucggccucagcaggaccagcaaggacgcccccuguccguccagcagcagaugaugcaacagucuagacagcucgacccuaaccugcuugugaagcagcaaaccccgcccagccagcagcaaccucugcaccagcccgccaugaaguccuuccucgauaaugugaugccucauaccacacccgaacugcagaaaggcccgagcccuauuaacgcuuuuucuaauuuccccaucgggcugaacuccaaucuuaacgucaacauggacaugaauagcauuaaggagccccagucucggcuccgcaaauggaccacgguugauuccaucagcgugaacacaucucuggaccaaaauuccagcaagcacggagccaucucuagcggcuuuagacuggaagaguccccuuucgugcccuacgauuuuaugaacagcuccaccucuccugccagcccgcccggguccauuggagacggcuggccucgggcuaaaucucccaaugggagcuccucugucaacuggccucccgaguuccgcccgggcgagccuuggaagggauaucccaauaucgauccugagacagaccccuacgugaccccuggcagcguuauuaacaaucucuccaucaacacagugagagaagucgaucaccuccgggaccgcaauagcgggucuuccagcucucuuaacaccacgcugcccuccaccagcgcguggucuuccauuagagccagcaauuauaacgugccgcucucuuccacagcucagagcaccagcgccagaaauuccgauucuaagcugacauggagcccuggauccguuaccaacacgucucuggcccaugagcuuuggaaagugccccugcccccuaagaacaucacagcuccgagcagacccccucccggccugaccgggcagaaaccuccccuguccacaugggacaauucuccucuccgcaucggaggcggcugggggaacagcgacgcccgguacacccccggauccagcuggggcgaaucuuccagcgggagaauuaccaauuggcugguccuuaagaaccugacaccgcagaucgauggaucuacgcuccgcacccugugcaugcaacacggcccucugauuacauuucaucuuaaucugccccacgggaacgcgcucgugcgguauuccagcaaagaggagguugugaaggcucagaagucccugcacauguguguccucggaaauaccacaauccuggccgaguucgccucugaggaagagauuagcagauuuuucgcucagucccagucucuuaccccuagccccggcuggcaaucccugggcagcucucagucccgccucgggagccuggacugcucucauagcuuuuccucucggacggaucugaaccacuggaauggagccggccuuagcgggacaaacugcggagaccugcauggcaccucccucugggggaccccgcacuacagcacaucucuguggggaccucccuccagcuccgaucccagaggcaucucuagcccuucccccaucaaugcguuccucucuguggaccaucugggcgggggaggcgaaagcauguga

SEQ ID NO: 77126 - RNA, 3090 nt, Artificial Sequence
  derived and/or modified sequence opt5 from TNRC6B__Homo_sapiens__NP_001020014
augcagaccaacgagggcgaagugagcgaggaauccucuagcaaggucgagcaagaagacuucguuauggaggggcacggaaaaacacccccuccgggcgaggaauccaagcaggagaaagaacaggagagagaggaacagcugauggaggauaagaaacggaagaaggaagacaaaaagaaaaaggaggccacgcaaaaagugaccgaacagaagacaaaggugcccgaggucaccaaaccuucucucagccagcccacagcugccuccccuaucgggucuagccccuccccuccggugaauggaggcaacaaugcgaagcgcguugcugugcccaacgggcagccucccagcgccgccagauacaugccucgggaggugcccccgcgcuuuagaugccaacaggaucauaaagugcugcuuaagcggggacagccucccccucccucuuguaugcugcucggcggcggggcuggacccccuccgugcaccgcccccggcgcuaauccuaacaaugcccagguuacaggggcgcugcuucaauccgaaagcggaaccgcccccguguggucuaaauccacgccucccgcuccggacaacggcaccagcgccuggggagagccuaaugaaucuucccccggguggggcgagauggaugacacaggcgcuagcaccacaggguggggaaacaccccugccaaugcgcccaacgccaugaagccuaauuccaaaucuaugcaggauggcuggggagaaagcgacgggcccgucacgggcgcucgccacccguccugggaggaggaagaggaugggggaguguggaacacaaccggcagccagggcucugccuccagccauaauucugcuagcugggggcaaggaggcaagaagcagaugaaauguucccugaaagggggaaacaacgacucuuggaugaauccucucgccaagcaguucagcaacaugggccugcugucccagacagaagauaaucccagcucuaagauggaccucuccguggggagccugucugauaaaaaguuugacgucgacaagagagccaugaaccuuggcgauuucaaugacauuaugcggaaagaucgcuccggauuuagacccccuaacagcaaggacaugggcaccaccgauuccgggccguauuucgagaaaggaggcucucacgggcuguuuggaaauagcacagcucaaucccggggccuccauacgcccguucagccucugaacucuagccccucccuucgcgcgcaggucccuccccaguucaucagcccucaagugucugccuccaugcugaagcaguuucccaauagcgggcucucuccgggccuguucaacgucggaccucagcugagcccccagcaaauugcuaugcucucccagcugccucagaucccccaguuucaacuugccugccagcugcuccugcagcaacagcagcagcaacagcuucugcagaaucagagaaaaauuucucaagccgugcggcagcagcaggaacaacagcucgcucgcaugguuagcgcccugcagcaacagcagcagcaacagcagagacagccgggcaugaagcacuccccuagccaccccguggggccuaagccccaucuggacaacaugguccccaaugcgcucaacgugggacugccugaucuucaaaccaaaggcccgauccccggguacggaucuggcuucuccagcgggggcauggacuauggaaugguuggcgggaaggaggcuggaacagagucccgguuuaaacaguggaccucuaugauggaaggccugccuagcguggccacacaggaggccaauaugcacaagaacggggcuaucgucgcccccggaaaaaccagaggcggguccccuuacaaccaguucgauauuauccccggcgacacgcucggaggccauacagggccugcuggagauucuuggcugccggccaagagcccucccaccaauaagauuggcuccaaaucuagcaacgcguccuggcccccugaguuccaacccggggugccguggaagggaauccagaauauugacccugaaagcgaccccuaugucacccccggcucugugcuuggcgggacagccaccuccccuaucguugauacagaccaccagcugcuccgcgauaacacgaccggaagcaauucuucccugaacacaagccugcccucuccuggcgcuuggccguacuccgccagcgacaauuccuuuaccaacgugcacagcacaucugcuaaauuccccgauuauaagagcaccugguccccugaccccauugggcauaauccuacgcaccucucuaacaaaauguggaagaaucauaucagcucccggaacaccacaccccugccgagaccucccccuggacuuaccaaucccaaaccuucuagccccugguccucuacagccccgcgcagcguccggggcugggggacccaggauuccagacuggcgagcgccucuacgugguccgacggaggcagcgugcgcccuucuuacuggcucguucugcacaaccugacaccccaaaucgauggcuccacccuucggacaauuuguaugcagcaugggccccuccugaccuuucaccugaaucucacccagggaacagcucugaucagauacagcacgaagcaagaggccgcuaaggcccagaccgcccuucacaugugcgugcugggcaacacaaccauucucgcugaguucgcgacagacgaugaagucucccgcuuucuggcccaggcucagccuccgacccccgccgccacgccuucugcucccgccgcgggguggcaaagccuggaaacaggacagaaccaguccgacccugugggccccgcucuuaaucucuucgggggaagcaccggccugggccaguggucuuccagcgccgggggaucuagcggcgccgaucuggcuggggccucccucuggggaccuccgaacuauucuagcucccuguggggcgugcccaccguugaggacccucaucggauggggucucccgcgccucuucugcccggagaccuccugggcggcgggagcgauuccaucuga

SEQ ID NO: 77127 - RNA, 4077 nt, Artificial Sequence
  derived and/or modified sequence opt5 from TNR__Homo_sapiens__XP_011508249
augggcgccgacggggagaccgugguccugaagaacaugcucaucggaauuaaucugauccuucugggcagcaugauuaaacccuccgaaugccagcucgagguuacaacggaaagagugcaacggcagucuguggaggaagaagggggaaucgcuaacuacaauaccagcuccaaggagcagccugucguguucaaccacguuuauaauauuaacgugccgcuggauaaucuuuguucuagcggccuggaagccuccgcggagcaggaagucucugcugaggacgagacacucgccgaauacauggggcaaaccagcgaucaugagucccaggugacauuuacccaccgcaucaacuuccccaaaaaggccugcccuugugcuagcucugcccagguucugcaggaacugcucuccagaaucgagaugcuggaacgggaggugagcguccuucgcgaccaaugcaaugcuaacuguugccaggagucugccgcgacaggacagcuggauuauauuccccauuguuccggccacggcaauuuuagcuucgaaucuugcggguguaucugcaacgagggaugguuuggcaaaaauuguuccgaaccuuacugcccccucgggugcagcuccagaggaguguguguggacggccagugcauuugugauucugaguauagcggggacgauugcuccgaacugcgguguccuaccgacugcagcucucgcggacuuugugucgauggcgagugcguuugugaggaaccguacacgggcgaggacugcagagaacugcggugucccggggauugcuccggaaagggccgcugcgccaacgggaccugucucugcgaggaaggauaugugggcgaggacugugggcaaagacagugccugaaugcuuguagcggacggggccagugcgaggaaggccugugugugugcgaggaaggguaccaaggaccugacuguucugccgucgcucccccugaggaucuccgcguggccggcaucagcgacagauccauugagcuggaaugggaugggcccauggcgguuacagaguacgugaucucuuaucagccgaccgcccuuggaggccugcagcuccagcaacgggucccuggggacuggagcggcgugacaauuaccgaacuggagcccggacuuacguacaacaucuccguuuaugcugugaucagcaacauucugucucucccuaucacagccaaggucgcuacccaucuguccacaccccagggccugcaguucaaaaccauuaccgaaacaacgguggagguccagugggagcccuuuagcuucucuuuugaugggugggaaaucuccuucauuccuaagaauaacgagggaggcgugaucgcccaaguuccgagcgacgugaccuccuuuaaucagacagggcucaaacccggagaagaguacaucgucaacgugguugcccugaaggaacaggcucgcucuccucccaccagcgcguccgugucuacagucauugauggcccuacccagauccuugugagagacgugagcgauacgguugccuucgucgaguggauucccccgcgggcuaaaguggacuuuauccugcucaaguaugggcuggugggcggagagggcgggagaacaaccuuccgccuucaaccuccccugucccaguacagcguccaggcccuccggccuggaucuagauaugaaguguccguuagcgccgugcgcggcaccaaugagucugauuccgcuacaacccaguucacaacggaaauugacgcccccaagaaccugcgggucgggagcagaaccgcgacaucucuggaccucgagugggauaauagcgaagcugaggugcaagaguacaaaguuguguacuccacccuggccggagaacaguaucacgagguccuugugccucgcggcaucgggcccacaacccgggccacgcugaccgaccucguuccgggcacagaauacggagugggcaucagcgcugucaugaacucucagcaauccgugccugccaccaugaaugcuagaacagagcuggauagcccccgcgaccugauggugaccgccuccucugagacgagcauuucccuuaucuggacaaaggcgucugggcccauugaucacuaucggaucaccuuuacaccuagcuccggaauugccucugaagucaccguuccgaaagacagaaccagcuacacacucacggaucuggagcccggcgcugaauauaucauuuccgugaccgccgagcgcgggcggcagcagagccuggaaucuacaguggacgcuuucaccggauuuagaccuaucucccaucuccacuucagccaugucacaucuuccagcgugaacaucaccuggucugaucccuccccucccgccgaccggcugauucuuaauuacagcccucgcgaugaggaggaagagaugauggaaguuucccuggacgcgacgaagagacacgccgugcucaugggccugcagcccgcuacagaguauaucgucaaccugguggccguucacgggaccgugaccagcgaaccgauugucggcucuaucacaaccggaauugauccucccaaagacaucacaaucagcaaugugacgaaggacuccguuauggugucuuggagcccucccgucgcuuccuuugauuacuaccgggugucuuauagaccgacccaagugggccgccuugacagcuccgucguuccuaacacagugaccgaguucacaauuacccggcucaaucccgccacggaguacgaaaucucucugaacagcgugagagggcgcgaggaauccgagagaauuugcacccugguccauacagccauggauaacccuguggaccucaucgcuaccaauauuacacccaccgaagcgcugcuucaguggaaagcccccguuggagagguggagaacuaugucaucgugcugacacacuuugcuguugccggcgaaaccauccucguggauggggucagcgaggaguuccggcugguggaccugcuuccuucuacgcauuacacagccaccauguaugcuaccaauggaccgcucacauccggcaccauuagcacgaacuuuucuacacugcuggaucccccugccaaucucaccgcguccgaggucacacgccagagcgcucugaucuccuggcagcccccuagagccgagauugaaaacuacgugcuuaccuauaagucuacagacggcagccggaaggagcugaucguugaugccgaagacaccuggauucgccucgaggggcugcuggaaaauacggauuacaccgugcuucuccaagcugcccaggacacaaccugguccagcaucacaucuaccgcguucacgacaggaggcagagucuuuccccacccucaggauugugcucagcaucugaugaacggggacacccuguccggaguguacccgaucuuccucaauggcgagcugagccaaaaacuucagguuuauugcgacaugacaaccgaugggggaggcuggauuguguuucagcggcgccaaaacggccagaccgacuucuucagaaagugggccgauuaccgggucggguuuggaaauguggaggacgaguucuggcugggccucgauaacauccaccgcauuacaucucaggggagauaugaacugcggguggacaugagagauggacaggaagccgcuuuugccagcuacgaccgcuucuccguugaggauucucggaaucuguauaaacuuagaaucggcagcuacaacgggacggcuggagacucccugucuuaucaccaaggccgccccuuuagcaccgaagaucgggacaaugacgucgccgugacaaacugcgcgauguccuacaagggcgccuggugguacaaaaacugucauagaaccaaucucaacgggaaguauggagagagccgccacucucagggcauuaauugguaccauuggaaggggcacgaguucuccaucccuuuuguggaaaugaaaaugcggcccuauaaccacagacugauggcuggacgcaagcggcagagccuccaguucuga

SEQ ID NO: 77128 - RNA, 5208 nt, Artificial Sequence
  derived and/or modified sequence opt5 from TNS1__Homo_sapiens__NP_072174
augagcguguccagaaccauggaggacucuugcgaacuggaucucgucuacguuacagagcggaucauugccgugagcuuccccuccacggcuaacgaagagaauuuucgcucuaaccugagagaaguggcccagaugcuuaagagcaaacacggagggaauuaucuccuguucaaccuguccgagcggcgcccugacaucaccaaacuucacgcgaaaguccuggaguuuggauggcccgaucuccacacacccgcucuggaaaagauuuguucuaucugcaaagccauggacaccuggcugaaugccgauccucauaacgugguugugcuccacaauaagggcaacagagggcggauuggagucgugaucgcugccuacaugcauuauagcaauaucuccgcuagcgccgaccaagcgcuggaucgcuucgccaugaagagauuuuacgaggacaaaauuguucccaucggccagccuucucagcggcgcuaugugcacuacuucuccgggcuucugagcggaucuauuaagaugaacaauaaaccccucuuucugcaccaugucaucaugcacggcauuccuaacuucgaauccaagggcggguguagaccguuucuucggaucuaucaggcuaugcaacccguguacacaagcggaauuuacaauaucccuggcgauucucagaccuccgugugcaucacaauugagcccgggcugcuccugaaaggagacauccugcucaaguguuaucauaagaaauuccgcagcccugccagagaugucauuuuucggguucaguuccauaccugcgcuauccacgaccugggcgugguguuugggaaggaggaucuugacgacgccuucaaagaugaccgcuuccccgaauacggaaaggucgaguuuguguucuccuauggcccggagaagauucagggcauggagcaucuggaaaacgggccuucuguuagcguggauuacaauacguccgacccccucaucagaugggauagcuaugacaacuuuucuggacaccgggaugacggcauggaggaggucguggggcauacccaaggaccucuggauggcucccuuuacgcgaagguuaaaaagaaggacagccugcacgggucuacaggagccgugaacgcuaccagacccacacucagcgccacccccaaucaugucgaacacacgcuguccgugucuagcgauuccggcaacagcacagcuucuaccaaaacagacaagaccgacgagccugucccgggcgccuccagcgccaccgcugcgcugucuccccaggaaaaacgcgagcucgaucggcugcuuuccggguucggacuggaaagagagaagcagggcgccauguaucacacacagcaucuccgcagccggccugcugggggauccgccgugcccucuagcggcagacacguugugccugcccaaguccaugugaaugggggcgcucuggccuccgagcgcgaaacggacauccuugaugacgagcugcccaaccaggauggacacucugcgggcagcauggggacccucuccagccuggacggaguuacaaauaccucugaaggcggguacccggaggcucuguccccucucacaaacggacuggauaaaagcuaccccauggaaccuauggugaauggcgggggcuaucccuacgagucugccucccgggccggaccugcucacgccggccauaccgcucccaugagaccgagcuauucugcccaggaggggcuugcgggauaccaacgcgaaggcccucaccccgccuggccccagccugucacgacaagccauuaugcucacgacccguccgggauguuucggagccagucuuucuccgaggccgaaccccagcugccucccgcuccugugagaggaggcagcucccgcgaggccgugcaacgggggcucaacucuuggcagcagcagcaacagcagcagcaacagcccagaccucccccgcggcagcaggagcgcgcgcaucuggaaagccugguugccuccagaccuucuccccaaccucuugcugagacccccauuccgagccucccugaauuuccccgggccgcuucccagcaggagaucgaacaaucuauugagacccugaauaugcugaugcucgaucuggagccugccagcgccgcugcgccccuucacaagucccagagcguccccggcgccuggccuggagcuucuccgcuguccagccagccccucucuggcuccagcagacagucucacccucugacacaaucccgcagcggguacauccccuccggacauagccugggcaccccugaacccgccccucgggccucucuugagagcgugccgcccgggagauccuauucuccuuacgacuaccagcccugucucgcuggaccuaaccaggauuuccacagcaagucccccgccucuagcucccugccggcguuucugccuacaacgcauucuccgcccggcccucagcaacccccugcuagccucccggggcugaccgcccagccccuucuguccccuaaagaagccacaagcgaccccucucgcaccccugaggaggaaccccucaaucuggagggccugguggcucacagagucgccggagugcaggcgcgggaaaagcagccggcugagccucccgccccucuucgcagacgggccgcuuccgauggccaauaugaaaaccagagccccgaggccacaucuccucgcucccccgggguuagaagcccggugcagugcgucuccccugaacucgcucugaccauugcccugaaucccggaggccggcccaaagagccucaucuccacucuuacaaggaggcguucgaagagauggaagggacgagcccguccucucccccucccuccggagugcgcuccccucccggccuggccaaaaccccucuuagcgcucugggccucaagccgcacaaccccgccgacauccugcugcauccuacagggguuaccagacggcgcauccaacccgaggaggacgaaggaaagguggucgugagacuuucugaggaaccucggagcuauguugaguccguggcuagaacagccgucgccggcccccgcgcucaggauucugaaccgaaauccuuuuccgcgccugccacccaggcuuacgggcacgagauuccccuccggaauggaacgcugggcgggucuuucgugagccccuccccucugagcacaucuucccccauccucagcgccgacuccaccucugugggcagcuuuccuuccggcgagucuagcgaucagggcccgagaacacccacccaaccucugcuugaauccggguuccgcagcggaucucugggccagcccuccccuagcgcccagcggaacuaucagucuuccagcccccucccgaccgucgggucuagcuacuccucuccugacuauagccugcaacauuucuccagcucccccgagucucaggcuagagcccaguuuagcguugcgggagugcacacagugccuggcagcccccaggcucgccaccggacggucgggaccaacacaccucccucuccgggauucggcuggagagccauuaauccuagcauggccgcucccuccucucccagccugucccaucaccaaaugaugggcccuccggggaccggauuucauggcagcacagugucuagcccccagagcucugccgcgaccacgccugggucccccagccuuugucgccacccugcuggaguuuaccaggugucuggccugcauaacaaggucgccacaacccccggguccccuagccucggacggcaccccggcgcccaccagggcaaucuggcuuccgggcuccauagcaacgccaucgcuucuccgggaagcccuucccugggcagacaccuugggggaucuggcagcgugguucccggguccccuugccuggaucggcauguggccuacggaggcuauucuacccccgaagaccgcagaccgacacucagccggcaauccucugcgagcggcuaccaggccccuuccacccccagcuuccccgucucuccugcuuauuaccccgggcuguccagcccugccacaucuccgucccccgauagcgcugccuuucgccagggauccccuacgcccgcccugccugagaaaagacggaugucugugggcgacagagcugggagccuucccaauuaugcgaccauuaacggaaagguuuccagcccuguggccucuggcauguccagcccgucugggggaagcacagucuccuucucucacacccugcccgauuuuagcaaauacuccaugccugacaauucucccgaaacacgcgcuaaggugaaguucgugcaagauaccagcaaauauugguacaagccugagaucucccgggagcaggccauugcccuccugaaagaccaggaacccggcgcuuuuaucaucagagauagccacucuuuccgcggcgccuacgggcucgcgaugaaggucuccagcccgccucccacgauuaugcagcaaaacaaaaagggagacaugacccaugagcugguucggcacuuucuuaucgaaacaggccccagaggggugaaacugaagggauguccuaaugagcccaacuucggcucccucucugcucugguguaucagcauagcauuaucccucuggcccuuccgugcaagcuggucauucccaaucgcgacccuaccgaugaauccaaagacucuagcgggcccgccaacuccacagcugaucuccugaagcagggagccgcgugcaaugugcucuuuguuaacagcguggacauggagucucugaccggcccucaggccaucuccaaagcuacaagcgagacccuugccgcugaucccacgccggccgcuacaaucguccacuucaaggugucugcccaaggcauuacccugaccgacaaucagcggaaacuguucuuuagacgccauuacccucucaacacaguuaccuucugugaucuggacccccaggaaagaaaguggaugaagacggaagggggagcgccugccaaacuuuuuggcuucguggcucggaagcagggguccacaaccgauaacgccugccaccuguuugcugaacucgaccccaaucaaccggccagcgccaucgucaacuucgugucuaaagucaugcugaaugcuggacagaagcgcuga

SEQ ID NO: 77129 - RNA, 4260 nt, Artificial Sequence
  derived and/or modified sequence opt5 from TNS2__Homo_sapiens__NP_056134
auggacggcgggggagugugcgucggcagaggggaucugcucagcucuccccaggcccugggacaacuucugcggaaggagucccgcccuagacgggcuaugaaaccgcgcaaggccgaaccccacagcuucagagagaaaguuuuucggaagaaaccucccgugugugcggugugcaaggucaccaucgacggcacagggguguccugucgcguuugcaagguggcuacgcauagaaaaugugaagccaaggucaccucugccugccaggcucucccucccguggagcugcggcgcaacacagccccuguuagacggauugaacaccuuggaagcaccaaaucccugaaucauucuaagcagcgcagcacacucccgagauccuucagccuggauccccugauggagcggcgcugggaccucgaucugaccuacgugacagagagaauccuugcugccgcguuuccugcccggcccgacgaacagagacaccgcggccaucugcgggagcucgcucacguccugcaaucuaaacacagagauaaguaucuucuguucaaccucuccgaaaagcgccaugaccugacccggcugaauccuaaagugcaggauuuuggcuggcccgagcuccacgccccgccucuggacaaacuuuguagcauuugcaaagcuauggagacguggcugucugccgauccccagcauguggucguucucuacuguaaggggaacaaaggaaagcugggcgugaucguguccgcguauaugcacuacagcaaaauuucugccggggcugaccaggcccuugcuacccugacaaugagaaaguucugcgaagauaaggucgccaccgagcuccaaccuucccagcgccgguauaucagcuacuuuuccggacugcugucuggcagcaucagaaugaacuccagcccccucuuccugcacuaugugcuuauucccaugcugccugccuuugaaccggggacaggauuccagcccuuucucaaaaucuaccagucuaugcaacugguuuacaccuccggcguguaucauauugcuggcccugggccccagcagcuuuguaucagccuggagccugcgcuccugcugaagggagacgucauggugacgugcuaccacaaaggcgggcgcggaacagaccggacccucguuuucagagugcaauuucauacaugcaccauucacggcccccagcugaccuucccgaaggaucagcuugacgaagccuggacagaugagcgcuucccuuuucaggcuucugucgaguucguguuuagcuccucucccgaaaagaucaaggggagcacgccucggaaugaccccuccgucagcguggauuauaauaccacagagccugccguuagaugggacucuuacgaaaacuucaaucaacaucacgaggauuccguggacggaagccugacccacacacggggcccccucgauggcucuccguaugcccagguccagcgcccucccagacagacgcccccugcuccgucccccgaaccucccccucccccuaugcugagcguguccucugacagcgggcauuccucuacccugacaaccgagcccgccgcggagagcccgggacggccucccccuaccgcugccgaaagacaagagcuugaucgccuccugggcggguguggaguugccuccggcgggcggggcgcuggaagagaaacagccauucuggacgacgaggaacagcccaccgugggcgggggaccgcaccucggcgucuacccugggcaucgccccggacugagcagacacugcucuugucggcagggcuaucgcgagccuugcggggugcccaacggcggauacuacagacccgagggcacacuugaacggcgcagacuggcuuaugggggauacgagggcuccccucagggguaugccgaagcgagcauggagaagcggcgccucuguagaucucuguccgagggacuguacccguaucccccugaaaugggcaaacccgccacgggggauuuuggcuaccgggcuccuggauaucgcgaggugguuauccuugaagaccccggccucccugcccuguacccgugccccgcuugugaggaaaagcuggcccucccuaccgcggcccuguacgggcuuagacuggagcgggaggcuggagaaggcugggccagcgaggcugggaaaccccuccugcacccugucagacccggacauccgcugccucuucuccugcccgccugcggccaccaucacgcccccaugccugauuauucuugucugaagcccccuaaagcuggggaagagggccaugaaggaugcagcuacacaauguguccggagggccgcuaugggcaccccggauacccugcgcucgugaccuauuccuacggcggggccgugcccagcuauugcccugcuuacggacgggucccccacucuugcggcuccccgggcgaggggagaggauacccuagccccggcgcccauuccccucgcgccgggucuaucagccccggauccccucccuauccgcaaucucggaagcugagcuacgaaauuccuacagaggaaggcggggacagauauccccuucccggacaccuggcuuccgccggcccucucgcgucugcugagagccuggaaccgguguccuggcgcgagggccccagcgggcauucuacccugccucggucccccagagaugccccuuguagcgccucuuccgagcuuagcggacccucuacgccucuccacaccuccagcccgguucagggcaaggaauccacacgccggcaggacaccagaagccccacaucugcuccuacccagcggcugagccccggggaggcccugccucccgugucccaagcgggaacgggcaaagcuccggaacucccuucugggagcggacccgagccccuggccccuucccccgucucuccuacauucccgcccagcuccccuucugauuggccccaggagcgcagcccuggcggccauuccgacggggccagccccagaucuccggugccuaccacacuucccggacugcggcacgcuccuuggcagggcccccgcgggccucccgauuccccggacggaagcccucucacccccguucccucucaaaugccuuggcugguggccuccccggaacccccucagagcucccccaccccugcuuuuccccuggccgcgucuuacgauacaaauggccuuagccagccuccccugccggagaagagacaccucccugggcccggacagcaaccuggccccuggggcccggaacaggccuccagcccugcucgggggaucucucaucacgucacguucgcuccccugcucuccgacaacgugccccagaccccugagcccccuacacaggaaagccaaucuaauguuaaauuugugcaggauaccagcaaguucugguauaaaccgcaucuguccagagaccaggccauugcccuucugaaggacaaggaucccggagccuuucucauccgcgacucucacagcuuccagggcgcuuacgggcuggcgcugaaagucgccacaccucccccuuccgcucaacccuggaagggagauccuguggagcagcuugugcggcacuuucugauugagaccggcccgaaaggggucaagaucaaaggaugccccucugaaccuuauuucggcagccucuccgcccugguuagccagcauucuaucucccccauuagccucccuuguugccugagaauccccuccaaggacccgcuugaggaaacgccugaggcccccgugcccacaaacaugucuaccgcugccgaucugcuccgccaaggcgcggcuuguagcgugcuguaccugaccuccgucgaaacagagucucuuaccgggccucaggccguggcccgggcuagcuccgccgcgcugagcugcucucccagaccuacaccggcuguugugcacuucaaagucuccgcccagggaauuacgcucaccgacaaucagcgcaagcuguuuuuccggagacauuaccccgugaacagcaucacauuuucuuccaccgauccucaagaccgcagauggacaaaccccgauggcaccacgagcaagauuuucggguuuguugccaaaaagccuggaucucccugggagaaugugugucaccucuucgcugaacuggacccggaucagccugccggcgcuaucgucaccuuuaucacaaaagugcuucuggggcagcggaaguga

SEQ ID NO: 77130 - RNA, 4686 nt, Artificial Sequence
  derived and/or modified sequence opt5 from TNS3__Homo_sapiens__XP_011513778
augugcagcagacagcgguccggcuucggguguaucaccaacugguggaagaugggaacacgccaccccgcccauccugcucaaccggaggaacugacgucuagccuccacgccuuuaaaaauaaggcguucaaaaaguccaaagugugcggcgucuguaagcagauuaucgacgggcagggaauuucuugcagagcuuguaaguacagcugccauaaaaagugugaggccaaaguugugauccccugcggcgugcagguccggcuggaacaagccccuggguccucuacccuuagcuccagccugugucgcgauaagccccucagaccugugauucugucucccacaauggaggaaggacacggccuugaccugaccuauaucacagagcggaucauugcuguuuccuuuccugccggcugcagcgaggaaucuuaccuccauaaccugcaggaggugacccgcaugcugaaauccaagcacggggauaauuaucucguccugaaccuuagcgaaaagagauacgaccugacaaaacucaauccgaagaucauggaugugggauggcccgagcugcacgcuccuccccuugacaaaauguguaccauuugcaaggcccaggagucuuggcugaacuccaaucuccagcauguuguggucauccacugccggggcgggaaaggacgcauuggcguggugaucagcuccuauaugcauuucacgaacgucucugcgagcgccgaucaagcucuggacagauuugccaugaagaaauucuacgaugacaagguuuccgcucugaugcagccuagccagaagcgguaugugcaguuucucucugggcugcuuuccggaagcgugaaaaugaaugccucuccccuguuccuccacuuugucauucugcacggcaccccgaacuucgauacaggcggggugugucgcccuuuucuuaagcuguaccaagcgaugcagcccguuuacaccagcggaaucuauaaugugggcccugaaaaccccuccagaaucugcauugucaucgagcccgcccagcuccugaaaggggacgugaugguuaaguguuaccauaaaaaguaucggucugcuacacgcgaugugauuuucagacugcaauuucacaccggagccguccagggcuacgggcucguguucggaaaggaagaccuggacaaugcuagcaaagaugaccgguucccugauuauggcaaggucgagcuuguguuuuccgccacgccggagaaaauccagggcagcgaacaucuguacaacgaccacgggguuauuguggauuauaauacaaccgacccccucaucagaugggauucuuacgagaaccuguccgccgacggagaaguccuucauacacagggcccuguggaugggagccuguacgcuaagguucgcaaaaagucuuccagcgaccccggaaucccuggcgggccccaagcgauuccggccaccaacuccccugaucacucugaccacacccucagcguguccucugacagcggccauuccacagcuagcgcccggacggauaagaccgaggaaagacuggcccccggaacacgccggggccugucugcucaggagaaagccgaacucgaccagcugcuuuccggguucggacuggaggauccuggcagcucucucaaggagaugaccgacgcgagauccaaauauagcgggacacgccacgucgugcccgcucaggugcauguuaauggagaugccgcccugaaggaccgggaaaccgauauccuggacgaugagaugccucaccacgaccuucauucugucgauagccucggcacgcuguccagcucugaagggccccaauccgcucaccugggcccguuuacaugccauaaaagcucccagaacucucuccugagcgacggauucggcuccaaugugggggaggauccucagggaacccuugugcccgaccugggccucgggauggacggacccuacgaaagagagcgcaccuuuggcucucgggagccuaagcagccgcaaccccugcugagaaagccuagcgucuccgcccagaugcaggcuuaugggcagucuagcuacuccacacaaaccugggugcgccagcagcaaaugguuguggcccaccaguauagcuucgcgcccgauggcgaagcccggcuugucucuagauguccugcugacaaccccggacucgugcaggcccagccucggguuccccugacaccgacgcgcggcaccuccagcagaguggcuguccaaagaggggugggaucuggcccucaucccccugauacacagcagcccuccccgagcaaagccuuuaagccucgguuccccggggaccagguugugaauggagcgggcccugagcugucuaccgggcccucccccggcagcccuacacucgauauugaccaauccaucgaacagcugaaccgccuuauucuggagcucgauccgaccuuugagcccaucccuacgcacaugaaugcccugggaagccaggcuaacggcucugucagccccgacuccgucgggggaggccugcgggccucuagcagacuuccugauaccggggaaggacccucccgcgcuacaggcagacagggcucuagcgccgagcaaccucucgggggacggcugcgcaaacugucccucggccaguacgacaaugaugccgggggacagcugccguucucuaagugcgcuuggggcaaagcggggguggacuaugcccccaaccuuccucccuuuccuagccccgcugaugugaaggaaaccaugacaccgggauacccucaagaccuggacaucauugauggcagaauccucuccagcaaagagucuauguguuccacccccgccuuccccguuagcccugaaacgcccuacgugaagacagcccugcggcacccuccguuuucucccccugagcccccucuguccagccccgcuucccagcauaagggcgggcgcgagccgagaucuugcccugaaacccuuacacacgccgugggaaugagcgagucccccauuggcccuaaaagcaccaugcuccgggcggacgcuucuuccacccccagcuuccagcaggccuucgccucuagcuguacaaucuccucuaaugggccuggacaacgcagagaaagcuccucuagcgcugagcggcagugggucgaauccagccccaagccgauggugucucugcugggcuccgggcgcccuacgggaagcccccucuccgccgaguuuucuggcaccagaaaagauagccccguucuguccugcuucccuccgucugagcuucaggcgcccuuucauagccacgaacugucccucgcugagccucccgacagccuggccccucccucuucccaggccuuccugggcuuugggacagcuccugugggaagcggccuuccgcccgaagaggaucugggggcccuccuggcuaacucucauggagccuccccuacccccagcauuccucucacagcgaccggcgccgcugacaauggguuccugucucacaacuuucuuacggucgcccccggacacagcucccaucacucuccgggccugcaaggccagggggugacacucccuggacagccuccccugcccgaaaagaaacgggcuagcgagggcgauagaucccuggggagcguuucccccucuagcuccggauucucuagcccucauuccggcucuaccaucagcauuccguuucccaaugugcuuccugacuucuccaaggccagcgaggccgcuucuccccugccugauucccccggggacaagcucgucaucgugaaauuuguucaggauaccagcaaguucugguauaaagcggacaucucucgcgaacaagccauugcuaugcugaaggacaaagagccgggauccuuuaucgugcgggauagccacucuuucagaggcgccuacggccucgccaugaaggucgcuacaccucccccuuccgugcugcagcuuaacaagaaagccggggaccuggcgaacgaacucgugcgccacuuccugauugaguguacccccaagggaguccggcugaaaggcugcagcaaugagccuuauuuugggucccuuacagcucugguuugccagcauagcaucacgccccucgcccugccguguaagcuccugauuccugaaagagauccccuugaggaaaucgccgagucuagcccccagaccgcugccaacuccgcggcugaacugcugaaacaaggagccgccugcaaugugugguaccucaacucuguggagauggagagccugacaggccaccaggcuauccagaaggcccuuuccauuacccugguccaagaaccuccgcccgugucuacaguugugcauuucaaggucagcgcucaggggaucacccucacggacaaucagcgcaaacuguuuuuccggagacacuauccugugaacuccguuaucuuuugugcccucgauccccaggaccgcaaguggauuaaagauggaccuucuagcaagguguucggcuuugucgcgcggaaacaaggcuccgccaccgacaaugugugccaucuguucgcugagcacgaucccgaacagccugccagcgcuauugucaacuuugugucuaagguuaugaucgggucccccaaaaagguguga

SEQ ID NO: 77131 - RNA, 2148 nt, Artificial Sequence
  derived and/or modified sequence opt5 from TNS4__Homo_sapiens__NP_116254
augagccaggugauguccucuccccugcucgccggcgggcacgcugucagccuggccccuugcgacgagccgagacggacccuucaucccgcgccuucccccucucugccuccccaauguagcuacuauacaacggaaggauggggcgcucaggcccucauggccccuguuccgugcauggggcccccuggacgccugcagcaggcuccccaaguggaggccaaggcuaccuguuuccuuccuucccccggcgaaaaagcccuggggacaccggaggaucucgacucuuacaucgauuuuagccuggaaucccugaaccagaugauucucgagcuggacccuaccuuccagcuucugcccccuggaacaggcggcagccaggcggagcucgcccaaucuaccauguccaugagaaagaaagaagagagcgaagcucuggauaucaaguauauugaggugacaucugcccggucccgcugccacgacgggccccagcauuguagcucucccuccgucaccccuccguuuggaagccuuagauccggcgggcugcuccugucucgggaugugccccgcgagacgagaagcuccagcgaaucucugaucuucuccggaaaucagggccgggggcaccagcgcccucuucccccuagcgagggacugucucccagaccgccuaacagccccuccauuucuaucccuugcaugggcagcaaggcuuccagcccccauggccuugggucuccucugguugccagcccccggcucgaaaaacgccugggaggccuugcgccgcaaagagggucccggaucucugugcuguccgccagcccugucuccgacgugucuuacauguuuggaagcucccagucucuccugcacagcuccaauagcucucaccaguccagcucucgcucccuggagagccccgcuaacucuagcuccagccuccauucucugggcuccguuagccuuuguaccagacccuccgauuuccaagccccucggaauccgacacugaccauggggcagcccagaacaccucacucucccccucucgcuaaggaacaugccagcuccugucccccuucuauuaccaacagcaugguggacauccccauuguccugaucaauggaugcccggagccuggcuccucucccccucagcgcacgcccggccaccagaacagcgugcaaccgggggccgcuuccccuagcaaucccugcccugcgacacggucuaacucccagacccuuagcgaugcccccuuuacaaccugucccgagggaccugcuagagacaugcagccgaccaugaaauucgugauggauacaucuaaguauugguuuaaacccaauauuacgcgcgaacaggccaucgagcugcuccggaaggaagaaccuggcgccuucgucauuagagacuccagcucuuaccgcggguccuuuggacuggcucugaaaguucaagaagugcccgccagcgcgcagucccggccuggcgaggacagcaacgaucucaucagacacuuccugaucgagucuagcgcuaagggggugcaucuuaagggcgccgacgaggagcccuauuuuggaucccugucugccuucgucugccagcacagcauuauggcucucgcccugccuugcaaacugaccaucccgcagcgcgaacuuggcggggcugauggagccuccgacucuacagauagccccgcguccugucaaaagaaaucugccggcugccauacccucuaccugagcuccgugagcguugagacacugaccggggcucucgccgugcagaaggcuauuucuacgacauucgaacgggacauccugccuacccccaccgucgugcacuuuaaaguuacagagcagggaauuacccuuacagaugugcagagaaaggucuucuuucgccggcauuacccucugacgacccucagauucuguggcauggaccccgagcaacggaaauggcagaaguauugcaagccguccuggaucuuuggguucguggccaaaagccagacagaaccucaagagaaugucugucaccuguuugcggaauacgauauggugcagcccgccucucagguuaucggccuggugaccgcucuccuccaggacgccgagcgcauguga

SEQ ID NO: 77132 - RNA, 12729 nt, Artificial Sequence
  derived and/or modified sequence opt5 from TNXB__Homo_sapiens__NP_061978
augaugcccgcccaguacgcucugaccuccucccuggugcugcuugugcugcucucuacagccagagccggcccuuucagcucccggucuaacguuacgcugcccgcuccccgcccucccccucagcccgggggacacaccgugggcgccggggugggaagcccuuccucucagcuuuaugagcauacagucgaaggcggggagaaacaggugguuuuuacccacagaaucaaucugccucccagcacaggaugcggcuguccucccggcaccgaaccucccgugcucgccuccgagguccaggcucugcgggugcgccuggaaauccucgaggagcugguuaaggggcuuaaggaacaaugcacaggaggcuguugcccggccagcgcucaggccgggaccggacagacggacgugagaacccuguguucucuccauggcgucuucgaucugucccggugcacauguagcugcgagccuggguggggaggccccaccuguucugacccuacagaugcggaaauuccgcccuccagcccuccgucugccuccggcagcugccccgacgauuguaacgaccaggggcgcugcgugagaggacggugcguguguuuuccuggcuacaccgggcccuccugcggauggccuucuugucccggcgauugccaagggcgcggaagauguguccagggcguuugcgugugucgggcuggcuucagcgggccggacugcucccagcgcagcuguccuagaggaugcucucagcggggccgcugugaagggggcagaugcgugugcgaucccggcuauacgggggacgauuguggcaugcgguccugcccuagaggauguagccaacgcggccggugcgagaaugggagaugugucugcaaccccggauacacaggcgaagacuguggggugcgcucuugcccucggggauguagccagagaggccgcugcaaagaugggcgguguguuugcgaccccggcuauaccggagaggacugcggcacaagauccuguccgugggauugcggggaaggaggccgcuguguggacgggcggugcgucuguuggccuggauacaccggcgaggauugcucuaccagaacauguccccgcgacugccgggggagaggccggugugaagauggagagugcauuugugacacgggcuauagcggggaugacugcggagugcgcuccugccccggcgauuguaaucagagagggcggugcgaggacggaagauguguuugcuggccuggcuacaccgggacagauuguggcagccgcgccugcccgcgggacuguagaggacgcggcagaugcgaaaacggggugugugucugcaaugcuggauacucuggcgaggacuguggggugcgguccugccccggagauugccgcggcagaggccggugugaaagcgggcgcugcauguguuggccuggauauaccggcagagacugcgggacacgggccugucccggagauugccgcggcagagggcggugugucgacggacgcugcguguguaacccuggcuuuaccggcgaggauugcgggucuagacggugucccggagacugcagaggccacgggcuuugcgaagauggaguuugugugugcgacgcgggcuacuccggggaggauuguagcacgcgcuccugcccuggaggcugucggggcagagggcaaugccuggacggacgcugugucugcgaggauggcuauucuggggaagacuguggagugcggcagugccccaaugauuguagccagcauggcguuugccaggacgggguguguaucugcugggagggauacgucuccgaagacugcucuauuagaacauguccgagcaacugccacggccgcggccggugugaggaagggagaugccucugugauccuggauauaccggcccgaccugcgccacacgcauguguccugcugacugccgggggagaggacggugugugcaaggcgugugccugugucacguuggguacggaggcgaggauugcggccaggaggaacccccggccuccgcuugcccugggggauguggcccccgcgagcugugcagagccgggcagugugucugcguggaaggauuccggggcccugacugugccauccagaccugccccggggauugucgcggaagaggcgagugccaugacggcagcugugugugcaaggauggguaugcuggagaggacuguggcgaagagguccccacaaucgaagggaugcggaugcaccuccuggaggaaacgaccgugagaacagaguggaccccugcgccgggacccguugaugccuacgagauucaauuuaucccuacaaccgaaggcgcuucucccccuuucacggcccgcgugcccuccagcgccucugcuuacgaccagcgggggcuugccccuggacaggaguaucaggucaccgugagagcgcugcgcggcacauccuggggccucccggcuagcaaaaccauuacaaccaugaucgaugggccccaagaccugcggguuguggccgucacgccuacaacccuugaacugggauggcucagaccccaggccgagguggaucgcuuuguugugucuuacgucagcgcuggcaaucagcgggugagacuggaagugccucccgaggccgacgggacacugcucaccgaccugaugccgggagucgaguauguugugaccgugacagcugaacgcggcagagccgucuccuacccugcgagcgugcgggccaacacggggucuagcccccuuggccugcucggaaccacagaugagcccccucccagcggcccuuccaccacacagggggcucaagccccgcugcuucagcagcgcccccaagaacugggagagcucagaguucugggccgggacgaaaccgggcgccugagaguggucuggacggcucagccugauacauucgccuauuuucagcuccggaugagagugcccgagggaccuggcgcgcaugaggaaguucugcccggggacgugcgccaggcccuugucccgccucccccucccggcaccccuuacgagcugucucuccacggagugcccccgggcgggaagccuagcgaucccauuaucuaucaaggaauuauggacaaggaugaagagaaacccggcaaguccucugggccuccgcggcugggagagcugaccguuacagacagaaccagcgauucccuucuccugcgcuggacagugcccgaaggcgaguucgacucuuuugucauccaguacaaagaucgggacgggcagccucagguggugcccgucgaaggcccucaaagaagcgcuguuaucacgucccuggaccccggacggaaguacaaauucgugcucuauggcuucguggggaagaagcgccacggaccucuggucgccgaggcuaaaauucuuccgcagagcgaucccucuccuggcacacccccucaucuggggaaucucugggugacagaccccaccccggauucccugcaccugagcuggacaguuccugaaggacaguuugacaccuucauggugcaguacagagaucgggacggccgcccccaagucgugcccguugagggcccugagagaucuuuuguggucuccagccuugaucccgaccauaaguaucgguucacgcucuuugggaucgccaacaaaaagcgcuacggaccucugaccgccgauggcacaaccgcuccggaaagaaaagaggaacccccucggcccgaguuccuggaacagccucuccugggggagcuuacagugaccggagucacacccgacucucugcgccucuccuggaccguggcgcagggcccguuugauagcuucaugguucaauauaaggacgcccaggggcagccucaggcugugcccgucgccggagaugagaaugaagugacgguuccuggccuggaccccgacagaaaauacaagaugaaccuguauggccuucgggggagacaacgcgugggaccugaguccgucguggccaagacagcuccccaggaagauguggacgagaccccgagcccuaccgaacucggcacagaggcccccgagucucccgaggaaccucugcugggggaacucaccguuacgggaagcuccccggauucucugagccucuuuuggacagucccccagggcuccuucgacucuuuuaccgugcaguacaaagaucgggacgggagaccucgcgcggugcgggucggaggcaaggagagcgaggugacaguuggcgggcuggaacccggacacaaauacaagaugcaucucuauggccugcacgaggggcaaagagugggacccgucuccgcugugggcguuaccgcgccccagcaggaagagacaccucccgccaccgaaucuccgcuggagccucgccuuggggagcucacggugaccgaugucacacccaacagcgugggacuguccuggaccguuccugaaggccaguucgacagcuuuauugugcaauacaaagauaaggacggccagccccaggucgugccgguggcugccgaucagcgggaggucacaguuuauaaucuggaaccugagagaaaguacaaaaugaacauguaugggcuccacgacggacaacgcaugggcccccugucuguggugaucgucaccgcgccccuuccucccgcuccugccacggaagccuccaagccgccccuggagccucggcucggggagcugacagugaccgauauuacacccgacagcguuggacugucuuggaccgugccugaaggcgaguucgacuccuucgucgugcaguacaaagauagagacgggcagccccaaguugugccugucgcugccgaucagcgcgaagugaccaucccggaccuugagcccagccggaaguauaaauuucugcuuuucggaauccaggauggcaagagacgcuccccugucucuguggaagcuaagacaguugccagaggcgacgcgagccccggggccccuccccggcugggagagcucugggugacggauccgaccccugacucccugcgccuuagcuggacagugcccgagggccaguuugauucuuucgucguucaauuuaaagacaaggaugggccccagguggugccugucgaaggacaugagagauccgugaccguuacaccccuggacgcuggccggaaauacagauuccuccuguacgggcugcuuggaaagaaacggcacggcccucugaccgccgacggcacgacagaagcucgcagcgccauggaugacaccgggaccaagagaccgcccaagccucggcucggagaggagcuccaggugacaaccgucacacaaaauucugugggccucagcuggacgguccccgaagggcaauuugauuccuucgugguucaguauaaagaccgcgauggacagccucaggugguccccguggagggcucucugagagaaguuagcgugccggggcuugacccugcccaucgguacaagcugcuccuguauggacugcaccacggcaaacgcgucggccccauuuccgcuguggcgaucaccgccgggagagaggaaacagagaccgagacaaccgcuccuacgcccccggccccugaaccccaucuuggagagcugaccguggaagaggccacaucucacacccuccaucugagcuggaugguuacagaaggcgaguuugauuccuucgagauucaauacaccgaccgggaugggcagcuccagaugguccgcaucggaggcgacagaaacgauauuacacugagcgggcuugaaucugaccaccgguaucuggugacgcuguacggcuuuuccgauggaaagcaugugggccccguccacguugaggcucucaccgugccugaagaggaaaaacccagcgagccuccgacagccacccccgagccucccaucaagccucgccugggggaacuuaccgugacagacgcgacgcccgacucccugucucucagcuggaccgucccugagggacaauucgaucacuuucuggugcaguauagaaauggcgacgggcagccgaaagcuguucgggugcccggacaugaagagggcgucacaaucuccgggcucgagccugaucacaaguacaagaugaaccuguacggcuuccauggaggccagcgcauggggcccgugucuguugugggagucaccgccgccgaagaggaaacaccuagccccaccgagccguccauggaagcuccugagcccgccgaggaaccccuucugggcgagcugacggugacagggagcucuccugacucccucagccugucuuggaccgugccccaaggaagauucgauuccuuuaccguccaguauaaagaccgggauggcagaccucagguugugcgcgucgggggcgaagagagcgaagucacagugggaggccuugagccggggcggaaguacaaaaugcaccuguauggacuccaugagggcagacgcguugggcccgugucugcggucggagugaccgcuccugaagaggaaagccccgacgccccucuggccaagcuccggcugggccagaugacaguuagagauauuaccuccgacucucuuagccuguccuggacggugcccgaggggcaauucgaucacuuucugguccaguucaaaaauggcgacggacagccgaaggcugugcgcguuccuggccacgaagacggggugacaaucagcggacucgagcccgaucauaaguacaaaaugaaccuguauggcuuucacgggggacagcgggucggcccuguguccgccgucggccuuaccgcucccgggaaggacgaggaaauggccccugcgucuacagagcccccgacccccgaaccucccauuaaaccuagacuggaggagcucacggugaccgaugccacaccggacagccugucccucucuuggaccguucccgaaggacaauucgaucauuuucuggugcaguacaagaauggcgacgggcagccuaaagcuacacgcguccccggacacgaggaucgggugaccaucagcggccuugaaccugacaacaaguauaagaugaaucuguacggguuccacggaggccagagagugggccccguuuccgccauuggggugacagcugccgaggaagagaccccuucucccacggagccgagcauggaagccccugagcccccugaggaaccccugcucggagaacugacagucaccggcuccagcccggauucucuuucccugagcuggaccgugccucaagggcgcuuugacucuuucacaguucaguacaaagaucgggacggaagaccccaggugguccgggugggcggggaggaguccgaagucaccgugggaggccucgagcccggcagaaaguauaaaaugcaucuguacgggcugcacgaaggacgccggguuggcccugugagcacagucggggugacggcuccccaagaggauguugacgaaaccccuucuccgacagagcccggaaccgaggcgccuggacccccugaggaaccccuccuuggggaacugacagugaccggauccagcccggacucccugagccucucuuggacggucccucagggcagauuugauagcuucaccgugcaguauaaggaccgcgauggcagaccccaggccgugcggguugggggacaagaguccaaagucacagugcgcggccuggagccugggagaaaguacaagaugcaucuuuauggacugcacgaaggccggcgccucgggcccgugucugcugucggagugaccgaggacgaagccgagacaacccaggccguuccuacgaugacacccgaaccgcccaucaaaccuagacugggcgagcugaccaugacagaugcuacccccgacagccucucccuuucuuggaccgugccugagggccaguucgaucauuuucugguccaguaccggaacggggacggacaacccaaggccgugcgcguuccuggccacgaagauggggugacaauuagcggacuggagccggaccacaaauauaagaugaaucucuacggcuuccaugggggacagagagucggccccaucuccgugaucggcguuacggcggcugaagaggaaaccccuucucccacagagcugagcaccgaggccccugaacccccggaggaaccucuucugggggagcucacagugaccggauccagccccgauucucugucccugagcuggacgauuccucagggccacuuugacucuuucacaguccaguacaaagaucgggacgggcgcccccaagugaugagagugcggggagaagaguccgaggucaccguuggcgggcucgaaccgggacgcaaguauaaaaugcaucuuuacggccugcacgagggcagacggguggggccugugagcaccgucggagugacagaagacgaggccgagaccacacaggcuguucccacgaccacacccgaaccucccaacaagccuagacugggcgagcucaccgugacagaugccaccccggacucccugucucuuagcuggaugguccccgaagggcaguuugaucacuuccuggugcaauaucgcaauggagacggccagccuaagguugugcggguccccgggcaugaggauggcgugacgaucuccggacucgaaccugaccacaaauacaagaugaaccuguauggcuuucaugggggacagagagucggccccauuagcgugaucgggguuaccgcggccgaggaggaaaccccugcuccgaccgagcccucuacagaagccccugagcccccugaggaaccccugcucggagagcuuaccgugacaggcuccagcccggauucucugagccuguccuggaccauuccccaggggcgcuucgacucuuuuacgguccaauacaaagaucgggacggcagaccucaggugguucgcgugcggggagaagagagcgaagucacagugggcgggcucgagcccggaugcaaguauaaaaugcaccuguacggccuucaugaagggcagagagugggaccuguuuccgcugucggcgugaccgcccccaaggaugaggcugagaccacacaggccgugccuacgaugaccccggaacccccuaucaagccccgccugggggagcucacagucaccgacgcgacaccugacucucugagccuguccuggauggugcccgaaggccaauucgaucacuuucucguucaguaccggaacggagacggccagccgaaagccgugagagucccugggcacgaggauggagugaccaucagcggccuugagcccgaccauaaguauaaaaugaaucuguacggguuccacggaggccagcggguugggccugugucugcuauuggcgucacagaagaggaaacccccuccccuacggagcccagcaccgaagccccggaggcucccgaggaaccucugcucggagagcugacagugaccggcuccucucccgauagccuuucccugucuuggacagugccucaagggcgcuuugacagcuucaccguucaguauaaggauagagacggacagccccaagucgugcgggugcgcggcgaagaguccgaagucacgguugggggacucgagccgggcagaaaauacaagaugcaucuguauggccugcacgaggggcagcgggugggaccugugagcacagucggcaucaccgcgccccugccuacaccccuuccuguggaacccagacugggggagcuggccguugcugcggugaccucugauuccgucggacucagcuggacgguggcccagggcccguucgacucuuuucugguucaguaccgcgaugcucaagggcagccucaggccgugcccgucuccggagaccuucgggccguggcugugagcggccuggauccugccagaaaguauaaauuccuccuguuuggccugcagaacgggaagcgccacggacccgucccgguugaagcgcggaccgcccccgacacaaaaccuucucccagacucggcgagcuuaccgugacagacgcuaccccugauuccguggggcugagcuggacaguccccgaaggagaguucgacucuuuuguugugcaauacaaggauaaagacggccgccuccagguggucccuguggccgcuaaucagagagagguuaccgugcaggggcucgaaccgagccggaaguaccgcuuccugcuuuauggacuguccggcagaaagcggcucggccccauuagcgccgauuccacgacagcgccucuggagaaagaacugcccccucaucucggggagcuuaccgucgccgaggaaaccucuagcucccugcgccugucuuggacaguggcucaaggacccuuugacagcuucguugugcaguacagagauaccgacggccagccgcgggccgucccuguggcugccgaucagcgcacagucacgguggaggaccucgaacccgggaagaaauauaaguuucugcuuuacggacugcucggcgggaaaagacugggaccuguuuccgcucugggcaugaccgcccccgaggaagauaccccugcccccgagcucgccccggaggcucccgaaccucccgaggaaccucggcuuggcgugcugaccgucacagacaccacgcccgauucuaugagacugagcugguccguggcccaagggccuuucgacagcuuugugguucaguaugaggacaccaacggacagccgcaagcucuccuggucgauggcgaccagucuaagauccuuauuuccgggcuggaacccagcacaccuuaccgcuuccuccuguauggacugcacgagggcaagcggcucgggccccugucugccgagggaaccacaggccuugccccugcgggccagaccuccgaagagagcagaccccgccugucucagcucuccgugacggaugugacaaccagcucucugcggcuuaauugggaagcuccgccuggggccuuugacuccuuccugcucagauucggaguucccagcccuagcacacuggagccccauccgcgcccccugcuccaacgggaacugauggucccuggcaccagacacuccgcugugcuucgggaucugcgcucugggacccucuacagccugacacuuuacggacugagaggcccccauaaagccgacuccauccaggggacggcccggacccucucuccugugcuggagagcccccgcgaucugcaguuuuccgagaucagagaaacaucugcuaaggucaacuggaugccuccgcccagccgggccgacuccuucaaagugagcuaucagcucgcggauggaggcgagccucaaucuguucagguggacggccaggcccgcacccagaagcugcaagggcuuauucccggagcuagauacgaagucacagugguuuccgugcggggcuuugaggagagcgaaccucugaccggguuccucacgacaguccccgauggaccuacccagcugagagcccuuaaucugaccgagggcuuugcugugcuccacuggaaaccgccccagaacccuguggacacauaugacguucaagucaccgcccccggggcgccuccccugcaggccgaaacaccgggaucugcuguggauuacccccugcacgaccucgugcugcauacgaauuauaccgccacaguccgcggccuucggggcccuaaccugaccucccccgcuagcaucacauucaccacggggcucgaggccccuagagaucuggaagcuaaggaggugacaccccgcacagcccuucugaccuggacagagccuccgguucggcccgcgggauaccuccuguccuuucacaccccuggcgggcagaaucaggaaauucugcuccccggaggcaucacaucucaucaacugcuugggcuguucccuagcaccuccuauaacgccagacuccaggcuauguggggccagucucugcuucccccggugagcacguccuuuacaaccggaggccugcgcauuccuuucccccgggacugcggggaggaaaugcagaauggagccggcgcuagcagaaccucuacaaucuuucucaacgggaaucgcgagcggccucugaacgucuucugugauauggaaacggacggaggcggguggcugguguuucaaagacgcauggauggccagaccgacuucuggagagauugggaggacuacgcccacggauucggcaacaucuccggggaguuuuggcucggaaaugaagcccugcauagccuuacacaggcgggcgauuacucuaugcggguugaccugcgcgcuggggaugaggccguguucgcccaguaugacagcuuucacgucgacuccgcugccgaauacuauagacuccaccuggagggauaccauggcaccgcuggggauucuaugagcuaucacuccggcagcguguucucugcccgggacagagaucccaacucccuucugauuagcugcgcgguuuccuaccgcggagccuggugguaucggaauugucauuacgcuaaccucaauggccuguacgggucuacaguggaccaccaaggagucagcugguaucacuggaaaggcuuugaguucuccgugccuuuuaccgagaugaagcugagaccccggaacuuccgcucuccggccgggggaggcuga

SEQ ID NO: 77133 - RNA, 1038 nt, Artificial Sequence
  derived and/or modified sequence opt5 from TOB1__Homo_sapiens__NP_001230806
augcagcuggagauccaaguggcccucaacuucauuaucagcuaccuguauaauaaacuucccagacggcgcgucaacauuuuuggcgaggagcuggaaagacuccugaagaagaaauacgaggggcacugguauccugaaaagccguacaaaggauccggcuuccggugcauccauauuggggagaagguugaccccgugaucgagcaggcuucuaaggaaagcggacuugauaucgacgaugugcgcggcaaucugccucaggaccucuccgucuggauugaucccuuugaggugucuuaucagaucggggaaaaaggaccuguuaaggugcuguacgucgacgauaacaaugagaacggcugugagcuggacaaagaaauuaagaauagcuucaaccccgaggcccaaguguuuaugccuaucuccgauccggcgucuagcguuuccagcucucccuccccucccuucggccacagcgcugccgugucuccuaccuuuaugcccagauccacacagccgcucacguucaccacagccaccuuugcugccacaaaauucgggagcaccaagaugaaaaauucuggacgguccaacaaggucgcucgcacaagcccuauuaaucugggccuuaacgugaaugaccugcucaagcagaaagccaucuccucuagcaugcauucccuguaugggcuuggacugggcagccagcaacagccccagcagcaacagcagccugcgcaacccccucccccgcccccucccccucagcagcagcaacagcagaagaccucugcccucucccccaacgcuaaagaauuuauuuucccgaauaugcaggggcaaggaagcucuacgaacggcauguuuccuggcgauagcccccugaaccuguccccucuccaguacucuaaugccuucgacguguucgcugccuacgggggacugaacgaaaagagcuuugucgauggccuuaauuucucccugaacaauaugcaguauagcaaccagcaauuucagcccguuauggcgaauuga

SEQ ID NO: 77134 - RNA, 1035 nt, Artificial Sequence
  derived and/or modified sequence opt5 from TOB2__Homo_sapiens__NP_057356
augcagcuggagaucaagguggcccucaacuucauuaucagcuaccuguauaauaaacuucccagacggcgcgcugaccuguuuggcgaagaacucgaaagacugcuuaagaaaaaguacgaggggcacugguauccugaaaaaccgcugaagggauccggcuuccggugcguccauauuggggagaugguugaucccgugguggagcucgccgcgaagcgcucuggacuggcugucgaagacgugagagccaacguuccugaggaacugagcguguggaucgaucccuuugaggucuccuaccaaauuggcgagaaaggggccgugaagguucucuaucuggacgauucugaaggauguggcgcuccugagcuugacaaagaaaucaagagcuccuucaaucccgaugcccagguguuugucccuaucggcucucaggacagcucccugagcaacucuccgucccccagcuucgggcagucuccuucccccaccuuuauuccucggagcgcucaacccaucacauucacgaccgccucuuuugcggccacaaaauucggauccaccaagaugaagaaaggcgggggagcugccagcggcgggggaguggcuuccucuggcgccggcgggcagcagccgccucagcaaccccgcauggcgagaagcccuacaaauucccuccugaagcacaaaagccuuucucuguccaugcauagccucaacuuuauuaccgccaaucccgcuccccagucucagcugagcccuaacgccaaggaguucguguacaauggaggcggguccccgucucuguuuuucgaugcugccgacggacagggcagcgggacacccggaccuuucggcggcuccggggccggaaccugcaacucuagcuccuuugauauggcucaagucuucggcgggggagcgaauagccucuuucuggagaaaacgcccuucguugagggccuuucuuauaaccugaauaccaugcaguacccuucccagcaauuucagcccguggugcucgccaacuga

SEQ ID NO: 77135 - RNA, 825 nt, Artificial Sequence
  derived and/or modified sequence opt5 from TOLLIP__Homo_sapiens__NP_061882
auggccaccacagugagcacgcagagaggccccgucuacaucggggagcugccucaagacuuccuccggauuaccccgacacagcagcagcgccaaguucagcuggaugcucaggccgcgcagcaacuucaguauggaggcgcuguggggaccgugggaagacugaacaucacagucgugcaggccaagcucgccaaaaauuacggcaugacccggauggaccccuauugccgccugagacuuggguacgcuguuuaugaaacaccuaccgcccacaacggagcuaagaauccccgguggaacaaagugauucauuguacggucccucccggcguggauuccuuuuaccuggagaucuucgacgaacgcgccuuuucuauggaugacagaauugcguggacccacaucacaaucccugagagccuccggcagggcaagguugaagauaaaugguauucccugucugggcgccaaggagacgauaaggagggcaugauuaaucuggugaugagcuacgcccuccugccggcugccauggucaugcccccucagcccguggugcuuaugccuaccgucuaccagcaagggguuggauaugugcccaucacaggcaugccggcugugugcuccccugggaugguccccguggcccugccucccgcggccguuaacgcucagcccagauguucugaggaagaccucaaggccauucaggauauguucccuaauauggaccaggaggugauccggagcguccuggaagcucaacgcggaaacaaagaugccgccauuaauucccuucugcagaugggcgaggagccguga

SEQ ID NO: 77136 - RNA, 1383 nt, Artificial Sequence
  derived and/or modified sequence opt5 from TOM1__Homo_sapiens__NP_001129201
auggagaucugcgacauuaucaacgaaaccgaggaaggccccaaggaugcccugagagcugugaaaaagcggauugucgggaauaaaaacuuccacgagguuaugcucgcccugacagugcuugaaacgugugugaagaauugcggacaucgcuuucacguccugguggcgagccaggacuucguugaguccgugcucgucagaaccauccugccuaaaaacaauccgcccacaauugugcaugauaagguucuuaaccugauccaaucuugggcugacgccuuucggagcuccccugaucucaccggcguggucacaaucuacgaggaccugcgcagaaaggggcuggaguuccccaugaccgaucucgacaugcugucuccuauucacacaccccagcggaccguguuuaauagcgagacgcaguccggacaggauucugugggcaccgacagcucccaacaggaagauagcgggcagcaugccgcuccucuuccggcucccccuauccugucuggagacacacccauugccccuacccccgagcagaucggcaaacuccgcuccgagcuggaaauggucagcggcaacguuagagugaugucugagaugcuuacagaacuggugccgacccaagccgagccugcggaucucgaacugcugcaggagcucaaucggacgugucgcgccaugcagcagagaguccuggagcuuauuccccaaaucgcuaacgaacagcugacagaggaacuccugauugugaaugacaaccuuaauaacguuuuccugcggcacgagcgcuuugaaagauuccggaccgggcagacaaccaaggccccuuccgaggcugagcccgccgcggaccucaucgauaugggacccgacccugccgcuaccggcaaucugagcucucaacuggccgggaugaaccucggauccagcuccgugcgcgcuggccugcagucucuugaagccagcgggagacuggaggaugaauuugacauguucgcccucacacggggauccagccuggcugaucagagaaaagaggucaaguaugaagcgccgcaggccacggacggccuugcuggcgcccuggaugcccgccaacagucuaccggggcuauccccgugacacaggccugccucauggaggacauugagcaguggcuguccaccgauguuggaaacgacgcggaagaaccuaaaggcgugacaagcgaagggaaguuugauaaguuccuggaggagcgggcuaaagccgccgacagacuccccaaucugucuagcccuuccgcugaaggacccccgggcccucccucugggccugcuccccgcaagaaaacccaagagaaggacgaugacaugcuuuuugcccuguga

SEQ ID NO: 77137 - RNA, 1431 nt, Artificial Sequence
  derived and/or modified sequence opt5 from TOM1L1__Homo_sapiens__NP_005477
auggccuucggcaagagccacagagaccccuacgcuaccuccguggggcaucugaucgagaaagccacauuugcgggaguccagacggaagauuggggccaauucaugcacauuugcgacaucauuaacaccacacaggaugggccuaaggacgcuguuaaagcccucaagaaacggaucucuaagaauuauaaccauaaggagauucagcugacccuuagccugaucgauaugugugugcagaauugcggaccguccuuucaaucucucaucgugaaaaaggaguucgucaaagaaaaccuggugaagcuccugaauccccgcuacaaccucccucuggacauucagaauagaauccugaacuuuauuaaaacauggagccagggcuuccccgggggaguugauguguccgaagucaaggagguguaucucgaccugguuaagaaaggcgugcaguuuccucccucugaggccgaagcugagaccgcccggcaagaaacagcucagaucagcuccaauccuccgaccagcguccccacggccccugcgcuuucuuccgugauugcccccaagaacagcaccgugacacuggucccugagcagaucggcaaacuccacucugagcuggauaugguuaagaugaaugugcgcgugauguccgcuauucuuauggaaaacacccccgggagcgagaaucaugaagacaucgagcugcuccagaaacuguacaagacaggaagagaaaugcaagagcggaucauggaucugcucgucgugguugagaacgaagacgugaccgucgagcugauucaggugaaugaagaucuuaacaacgccauccugggcuaugagcgcuucacgagaaaucagcaacggauucucgaacagaacaaaaaucagaaggaggcuacaaacaccacaucugagccguccgccccuagccaggaccugcuugaccugucccccucuccucgcaugcccagagcgacccucggggaacugaauaccaugaacaaucaacugagcggacucaacuuuucccugcccagcucugauguuacaaauaaccuuaagccuucccugcacccgcagaugaaucuccuggcccuugagaacacggaaauucccccuuucgcucagcggaccagccagaaucugacaucuagccacgccuacgacaacuuucucgagcauuccaauucuguguuccugcaacccgucagccugcagaccaucgcugccgccccuuccaaccagagccuucccccgcugccuucuaaccaccccgcuaugacaaaauccgaucuucagccucccaauuauuacgaagugauggaguuugacccucuggcgcccgccgucaccacggaggcuaucuacgaagagaucgaugcccaucaacacaagggcgcccagaacgacggggauuga

SEQ ID NO: 77138 - RNA, 438 nt, Artificial Sequence
  derived and/or modified sequence opt5 from TOMM20__Homo_sapiens__NP_055580
auggugggcagaaacagcgccaucgcugccggggucugcggagcgcuguucauuggcuacuguaucuauuuugaccggaagcgcagauccgaucccaauuucaaaaaccggcuccgcgagagacggaagaaacagaagcuggcuaaagaacgcgccgggcuuucuaagcugccugaccucaaggaugccgaggcuguucaaaaauuuuuccuggaagagauucagcuuggagaggaacugcucgcccagggcgaguacgaaaaggggguggaccaccugaccaaugcuaucgccgugugcggacagccgcaacagcugcuccagguccugcagcaaacacuucccccucccguguuucagaugcugcucacgaaacugccuaccauuagccagagaaucguuuccgcgcagucucuugccgaggaugacguggaauga

SEQ ID NO: 77139 - RNA, 930 nt, Artificial Sequence
  derived and/or modified sequence opt5 from TOMM34__Homo_sapiens__NP_006800
auggcccccaaguucccugacagcguggaggaacugagagcugccggcaacgaguccuuucggaaugggcaguacgcggaggcuucugcccucuauggacgcgcccugagaguccuucaagcucagggcagcuccgauccggaagaagagucuguucuguacagcaaccgggccgcuugccaccucaaagacgggaauugucgcgauugcaucaaggacuguaccuccgcccuggcgcuugugcccuucucuauuaaaccucugcucagacgggccagcgcuuaugaggcccuggaaaaguaccccauggcuuauguggauuacaaaacaguccugcagaucgacgauaacgugacguccgccguugagggaauuaaucgcaugaccagagcgcucauggacagccugggcccugaauggcggcuuaagcugcccucuaucccucucgugccggucuccgcccagaagcgcuggaacagccugcccucugagaaucauaaagagauggcuaaguccaaaagcaaggaaacaaccgccaccaaaaacagagugccuucugcuggggauguugagaaggcccgggugcuuaaggaagagggaaaugaacuggucaaaaagggcaaccacaaaaaggccauugagaaauauuccgagagccuccugugcuccaaucuggaaucugcuacauacagcaaccgcgcgcucuguuaccuggugcuuaagcaauauacagaggccgugaaagacugcaccgaagcucugaagcucgauggcaagaaugucaaagccuuuuacagacgggcccaggcucauaaggcccugaaagacuauaaguccagcuucgcggauaucucuaaccuucugcagaucgagccccgcaaugggccugcucagaaacucagacaagaaguuaagcagaaccugcacuga

SEQ ID NO: 77140 - RNA, 1086 nt, Artificial Sequence
  derived and/or modified sequence opt5 from TOMM40__Homo_sapiens__NP_001122389
augggcaacgugcuggccgcuagcucucccccugccgggccgcccccucccccugcgcccgcucucgucggacugccuccgcccccucccuccccucccggcuucacccuuccgccucucgggggaagccucggcgccgggacauccacgucuagaagcuccgagcggacccccggagccgcuacagccucugcuagcggcgccgcggaagacggcgccugcgggugucugccuaaucccggaaccuuugaggaaugccaccgcaaguguaaagagcuuuuccccauccagauggaaggcguuaagcugacagugaacaaagggcucuccaaucauuuucaagugaaccacaccgucgcucugagcacaauuggagagucuaauuaccauuucggcgugaccuauguugggacgaagcagcuguccccuaccgaggccuuuccggugcucgucggagauauggacaacagcggcucucugaaugcucaggugauccaccagcuuggccccgggcugagauccaaaauggccauucaaacacagcagagcaaguucguuaacuggcaaguggauggagaauaccggggcucugacuuuaccgcggccgucacacucgggaauccugaugugcuggugggauccggcauccuugucgcucauuaucugcagagcauuacccccugccucgcccucgggggagagcugguuuaccaccgcagaccuggcgaagagggcacggugaugucccuggcugggaaguauacacugaacaauuggcuugccaccgugacacugggacaggccggcaugcacgcuaccuacuaucauaaagcgucugaccagcuccaggucgggguggaguucgaagccagcacccggaugcaagauacauccguuagcuuuggauaccagcuggaccuucccaaggcuaaccugcuguucaaaggcucuguggauuccaauuggaucgucggggccacgcuggagaagaaacugccgccucucccccugacccuugcccugggcgcuuuucucaaccaccgcaagaauaaguuccaguguggauuuggccugacaaucggguga

SEQ ID NO: 77141 - RNA, 1827 nt, Artificial Sequence
  derived and/or modified sequence opt5 from TOMM70A__Homo_sapiens__NP_055635
auggccgcuagcaagcccguggaggccgcggucguugcugccgccgugccuuccucuggcagcggggugggaggcgggggaaccgcuggcccggggacaggaggccugcccagauggcagcucgcccuggcugucggcgccccucuucugcucggggcgggagccaucuaccuguggucccggcaacagcgcagacgggaagcucgcggcagaggggacgccucuggacuuaaacggaacagcgagcgcaagacgcccgaaggcagagcuuccccugcccccgggucuggacacccugagggcccgggcgcgcaucuggauaugaauagccucgaccgggcccaggcugccaaaaacaaggggaauaaauauuucaaggcuggaaaguacgaacaggccauucaaugcuauaccgaggccaucucccugugucccacagagaaaaacguggaucugagcaccuuuuaccagaaucgcgcugcggccuucgaacagcuccagaaguggaaagagguugcucaagacugcacaaaggccguggaacugaacccuaaauaugucaaggcccuuuuuagacgggcuaaggcccacgagaaacuggauaauaagaaagagugucucgaagacgugaccgcgguuugcauucuggagggcuuccagaaccagcagucuaugcuucuggcugauaaggugcucaaacugcuggggaaggaaaaagccaaggagaaguacaaaaaucgcgaaccccucaugccuagcccccaauuuaucaaguccuauuucucuuccuuuacagacgauauuaucagccagccgaugcugaaaggagagaagucugacgaggauaaagacaaggaaggcgaggcccuugaagucaaggagaacuccggguaccugaaagcuaagcaguacauggaagaggagaauuaugauaaaaucauuagcgaauguuccaaggagaucgacgccgaaggaaaauacauggcugaggcccuccugcuuagagcgaccuucuaucugcucauuggcaacgccaaugcugccaagccugaccuggauaaggugaucucucugaaagaagcuaacgugaagcuccgggccaaugcgcugauuaaacgcggcagcauguacaugcaacagcagcagccccuucuguccacgcaagacuuuaacauggccgcugauaucgacccucagaacgccgaugucuaucaucacagagggcagcucaagauucugcuugaccagguugaggaggcuguggccgauuucgacgaaugcauccggcugagacccgagagcgcccucgcucaagcgcagaaauguuuugcccuguaccgccaggcuuauaccggaaauaacucuucccagauccaagccgccaugaagggcuucgaagaggugauuaagaaauuuccccggugcgcugagggguacgcccuguacgcgcaggcucucacagaucagcagcaauucggaaaggccgacgaaauguaugauaaauguaucgaccuggagccugacaaugccaccacauacguccauaagggccuucugcagcuccaguggaaacaagaucuggacagagggcuggaacuuauuagcaaggcuaucgagauugauaacaaaugcgacuucgccuaugaaaccaugggcacgaucgaggugcagcgcggaaauauggagaaggcgaucgauauguuuaacaaggcuauuaaucucgccaaaucugaaauggagauggcccaccuguacagccugugugacgcugcccacgcucagacagaaguugccaagaaauauggccucaagccgcccacccuguga

SEQ ID NO: 77142 - RNA, 4137 nt, Artificial Sequence
  derived and/or modified sequence opt5 from TONSL__Homo_sapiens__NP_038460
augagccuggagagagaacuccggcagcuguccaaggccaaagcuaaggcccaacgcgcgggccagagacgggaggaagcugcccuuugccaccagcugggggagcuccuggccggacauggccgcuacgcugaagcccuugagcagcacuggcaagagcugcagcucagagaacgggcugacgauccccuggggugugccguggcgcaucgcaaaaucggagagagacuggccgaaauggaggacuauccugcugcccuccagcaccagcaucaauaccuggagcuugcucacucucugcggaaccacaccgaacuccagcgcgccugggcgacaauuggcagaacgcaucuggauaucuaugaccacugccagagccgggaugcccuucugcaggcucaagccgcuuucgagaagucccucgccauugucgacgaggaacuggaagggacccuggcccagggagagcucaaugagaugcgcacaagacuguaccuuaaccugggccucaccuuugaaucucugcagcaaacagcucuuuguaaugauuauuuccggaaaagcaucuuucuggcggagcagaaccaucucuacgaagaccuguuccgcgccagauauaaucugggcaccauucacuggcgggcugggcagcacucccaggccaugagaugccucgagggagcccgcgaaugugcucauacaaugcggaagagauuuauggagucugagugcuguguugugaucgcccaagugcugcaggaucuuggcgacuuccuggcggcuaagcgcgcccucaaaaaggccuaccggcuggggagccagaaaccgguccagagagcugccaucugccaaaaccuucagcacgugcuggcuguugugcgccuccagcagcaacuggaagaggccgaaggacgggauccccagggcgcgauggucauuugugagcagcugggggaccucuuuuccaaggccggagauuucccuagagcugccgaggcuuaccagaaacaacugcgcuuugccgaacuucuggaccggcccggcgcggagagagccaucauucaugugagccucgcuaccacgcugggcgacaugaaggaucaccauggggccguucgccacuaugaagaggaacugcggcuuagaucuggaaaugugcucgaggaggcuaagaccuggcugaacaucgcccugucccgggaagaggccggcgacgcuuacgaacuccuggcgccuugcuuccagaaagcccuuagcugugcucagcaagcccagcgcccccagcugcagagacaaguccuccagcaucugcacacagugcagcugcggcuucagccucaagaggccccggaaaccgagacaagacuccgcgagcugucuguggcugaagaugaggacgaagaggaagaggccgaggaagcggcugccaccgccgaguccgaagcucuggaggccggggaagucgagcucagcgagggagaagaugacacggauggccugacaccccagcuugaggaagacgaggagcugcaggggcaccucggacggagaaagggcucuaaauggaaucgcagaaacgauaugggcgaaacccugcugcaucgggcgugcauugaggggcagcuucgcagaguucaagaccucgugcggcagggacacccucugaauccccgcgauuauugcggcuggacaccucugcacgaggcuuguaacuacgggcaucucgaaaucgugagauuucugcuugaccacggagccgccgucgacgaucccggcgggcagggcugcgaaggaauuaccccgcugcaugacgcucucaauuguggccacuucgagguggccgagcugcugcuugaacgcggggcuuccguuacccuccggacaagaaagggacugagcccucuggagacgcuccaacagugggugaaacuguaucggcgcgaucuugaccuggaaaccagacagaaggcccgggcgauggagaugcuccugcaggccgcugccuccggccaagauccccauucuagccaggcuuuucacacaccuuccagccugcuuuucgaccccgaaaccucucccccucuguccccgugccccgagccucccagcaacucuacaagacucccugaggccagccaggcccacguccgcgugucccccgggcaggcugcgccggccauggcucggccuagacgcucucggcauggacccgccagcuccucuagcuccagcgaaggcgaggauucugccgggccugcuagacccucccaaaaacgcccucgguguagcgccaccgcgcagagaguugcugccuggacgcccggcccggccuccaaucgcgaagcugccacagcgucuaccagccgggcugccuaccaggccgcuaucagaggagugggcuccgcccagucucggcuggggccuggaccuccccgcggccacagcaaggcucucgcgccccaagccgcccugaucccggaggaagagugccuugcuggggacuggcuggagcucgauaugccccugaccagaucccggcgcccuagaccccggggaacaggcgacaacagacgcccuagcucuaccuccgggagcgauucugaagagucccggcccagagcccgcgcuaagcagguccggcugacauguaugcagagcugcucugccccugugaacgccggccccagcucccuugcuagcgaaccgccuggaucucccuccacgccuagagucagcgagcccuccggcgacucuagcgcggccgggcagccgcugggaccugcucccccuccucccauucgcgugcggguucaagugcaggaucaucucuuccugauccccgucccgcacuccucugacacccauagcguggccuggcucgccgagcaggcugcccaaagauauuaccagacauguggccugcuuccccgccugacccucagaaaagaaggggcgcugcuggcuccucaggaccuuauucccgauguucugcaguccaaugacgaggugcucgccgaagucacaucuugggaucugccuccccucaccgaccgguaccgcagagccugccaaagccugggacagggcgagcaccaacaggugcuucaggcuguggaacugcaggggcugggccucuccuuuagcgccuguucucuggcgcuugaucaggcccagcugacgccucuccugcgggcucucaagcugcacaccgcccuucgcgagcugagacuggcuggaaaccggcucggcgacaaaugcguugccgagcuggucgcugcccuugggacaaugccgucccuggcgcuccuggaucucagcucuaaucaucugggacccgaaggccuuagacaacuggccauggggcugccuggacaggcuacccuccagucccuggaggaacuugaccugagcaugaacccccucggcgauggcugcgggcaaucucuggccucccuccugcacgcuuguccucuucugagcacacugcgccuccaggccugcggauucggccccuccuuuuuccugagccaucagaccgcccuugggucugcuuuucaggacgcggagcaccugaagacgcucagccuguccuauaaugcccugggagcuccggcccucgcccggacacuucaaucucugccugcuggcacccugcuccaccuggaacuuagcuccguggccgcggggaaaggagauucugaccugauggagcccguguucagauaccucgccaaggagggcugugcucuggcccaucugacacucagcgcuaaccaccuuggcgauaaggccguccgcgaccugugccggugucugucccucugccccucucugaucagccuugaccuguccgcgaauccugaaauuagcugugccucucucgaggaacugcuguccacccuccagaaaagaccccaggggcuuagcuuucugggacugucuggcugcgcugugcaggggccucucggacugggccuuugggauaagaucgccgcucaacugcgggagcuccagcuguguucccgcagacugugcgccgaagaccgggaugcucuccgccagcuucagccgagcagacccgggccuggagaguguacccuggaccauggcuccaaacuguucuuucggcgccucuga

SEQ ID NO: 77143 - RNA, 2298 nt, Artificial Sequence
  derived and/or modified sequence opt5 from TOP1__Homo_sapiens__NP_003277
augagcggcgaccaucugcacaacgauucccagaucgaggccgacuucagacucaaugauucucacaagcauaaagacaagcacaaagaucgggaacaucgccacaaggagcacaaaaaggaaaaggacagagagaaaagcaagcauuccaacucugaacacaaagauagcgagaagaaacauaaggagaaggaaaagaccaagcacaaagacggguccucugagaagcacaaagauaagcauaaagaccgggauaaggaaaagcgcaaagaggagaaggugagagcuagcggagacgccaaaauuaagaaagaaaaggagaauggcuuuuccucucccccucaaaucaaggaugaaccggaggacgacggguacuucguucccccuaaagaagauauuaagccccugaaacggccucgcgacgaggaugacgcggauuauaagcccaaaaagaucaagacagaggacacgaaaaaggagaaaaagagaaaacuugaagaagaggaagauggaaagcugaagaaaccuaagaacaaagacaaggauaaaaaggucccggagcccgacaauaaaaagaagaaaccuaagaaagaggaggaacagaaguggaaauggugggaagaggaacgguaccccgagggcauuaaguggaaguuucucgagcacaaagggccuguguucgcucccccguaugaaccucugcccgagaacgugaaguuuuacuaugauggaaaagucaugaaacuuagcccuaaagccgaagagguggccaccuucuuugcuaagaugcuggaccaugaguacacaaccaaggaaaucuuccgcaaaaacuuuuucaaggacuggagaaaagagaugacaaaugaagagaagaauaucauuaccaaccucuccaaaugcgauuuuacacagaugagccaguauuucaaggcccaaaccgaagcucggaagcagaugucuaaagaggagaagcugaaaaucaaggaagagaaugaaaaacugcucaaggaguacggcuuuuguauuauggacaaccacaaagaacgcaucgccaauuucaagauugagccucccggccuguucagagggcggggaaaccaucccaagaugggcaugcuuaaacgcagaaucaugccggaggauauuaucaucaauugcuccaaggacgcgaaaguucccagcccucccccugggcacaaguggaaagaagugcggcacgauaacaaggucacguggcuggugucuuggaccgagaacauucagggauccaucaaguacauuaugcucaaucccagcuccagaaucaaaggcgaaaaggacuggcagaaauaugagacagcccgccggcugaagaaauguguugauaagauuagaaaccaauaccgcgaagacuggaagucuaaagagaugaaggugcggcagagagcugucgcccuuuauuuuaucgauaaacuggcucuccgcgccgggaaugagaaggaagagggagaaaccgcggacacagugggcugcuguagccugcggguggagcauaucaaccugcacccggagcucgauggccaggaauacgucguugaguucgacuuucuggggaaagauuccauuagauauuacaauaaggugccuguggaaaagcgcgucuucaaaaaccuucagcuguuuauggagaauaagcaacccgaagacgaccucuucgaucggcugaacaccggaauccuuaauaaacaucugcaggaccucauggagggccugacggccaagguguuuagaacauauaacgcuagcauuacccugcagcaacagcucaaagagcugacagccccugaugaaaauauccccgcuaagauucuuucuuacaaccgcgccaaucgggccguugcuauccugugcaaccaccagagagcgccucccaagaccuucgagaaauccaugaugaaucuccagaccaagaucgacgccaaaaaggaacaacuggcugaugcccggcgcgaccuuaaaagcgccaaggcugaugccaaagugaugaaggacgcgaagacgaaaaaggucguggagucuaaaaagaaagcuguucagagacuggaggaacagcucaugaagcuggaggugcaggccacagaucgggaagagaacaagcaaauugcccuggggaccagcaaacucaacuaccuggacccgagaaucacagucgcuugguguaagaaauggggagugccuauugaaaagaucuauaauaaaacccagcgcgagaaguuugccugggcuauugauauggccgacgaagauuacgaguucuga

SEQ ID NO: 77144 - RNA, 4596 nt, Artificial Sequence
  derived and/or modified sequence opt5 from TOP2A__Homo_sapiens__NP_001058
auggaggugagcccccugcagccugucaacgaaaauaugcaaguuaacaagaucaaaaagaaugaggacgccaaaaagagacucuccguggaacggauuuaccagaaaaagacccagcuggagcacauccuucugcgcccggauacauauauuggcucuguggaacucgucacgcagcaaauguggguguacgacgaggauguugggaucaacuauagagaggugaccuucguccccggacuguacaagauuuuugacgaaauccuugugaaugcugccgauaacaaacagcgggacccuaagaugagcugcauccgcguuacaauugaucccgagaauaaccugaucuccauuuggaauaacggcaaagggaucccuguggucgaacauaagguggagaaaauguaugugcccgcgcucauuuucggacagcugcugaccucuagcaauuacgacgaugacgagaagaaggucacaggcgggagaaacggauauggcgcuaaacucuguaauaucuuuuccaccaaguucacaguugaaaccgccucucgggaguacaaaaagauguuuaaacagacguggauggauaacaugggccgcgccggggaaauggagcugaagccuuucaauggagaagacuauaccugcauuacauuucaaccggaucuuagcaaauucaagaugcagucccuggacaaggacaucguggcucucauggugagacgggccuaugauaucgcuggcagcaccaaagacgucaagguguuucugaacgggaacaaacuucccguuaagggauuccgcucuuacguggauauguaucugaaagacaagcucgaugagacaggcaauucccugaaggucauucacgaacaggugaaccauagaugggaaguuugucugaccaugagcgagaaaggguuucagcaaaucucuuucguuaauuccauugccacgagcaagggaggccggcacgucgacuacguggcggaucagaucgucacaaaacucguggacguugugaagaaaaagaacaagggcggggucgccgugaaagcucaucagguuaagaaucacauguggauuuuugugaacgcccugaucgaaaauccuaccuucgauucucaaacaaaagagaacaugacccuucagcccaaguccuucggaucuaccugccagcuguccgaaaaauuuaucaaggcugccauuggcugugggaucgucgagucuauucucaauugggugaaguucaaagcccaggugcaacugaacaagaaaugcagcgccguuaagcacaaucgcaucaaagggauuccuaaacuugacgaugcuaacgacgccggcgggagaaauuccacagaguguacgcugauccucaccgaaggagacagcgcuaaaacacuggccgucucuggccugggcgugguggggcgggauaaguauggagucuuuccccuccgcggcaagauccugaacgugagagaggccucccauaaacagauuauggaaaaugcugagaucaacaacauuaucaagauugugggacuucaguacaagaagaauuacgaggacgaggauagccugaaaacccuccgguacggaaagaucaugauuaugacagaccaggaucaagacggcagccacaucaaggggcugcuuaucaacuucauucaucacaauuggccgagccugcucagacaccgcuuucuggaggaauuuaucaccccuauugugaaagucuccaagaacaaacaggagauggcguucuacucucugcccgaauuugaggaguggaaaagcuccacgccuaaucauaagaaguggaaggugaaauauuacaagggccucggaacaagcaccucuaaagaagcgaaggaguauuucgcugauaugaaacggcacagaauccaguucaaguacuccggccccgaagacgaugccgccauuagccuggcuuuuucuaagaaacagaucgacgaucgcaaggaguggcuuaccaacuucauggaagaccggagacaacgcaaacugcucgggcugcccgaggauuaucuguacggacagacaaccacauaucuuacguacaaugacuuuaucaacaaggagcucauucuguucuccaauagcgacaacgaacgguccaucccuucuaugguugauggccugaaaccggggcagagaaaggugcucuuuaccugcuucaaacgcaaugacaagcgggaggucaagguggcccagcuggcgggaagcguugcugaaauguccucuuaccaucacggcgagaugagccuuaugaugacaauuaucaaccuggcccaaaauuucgugggguccaacaaucucaaccugcugcagcccauuggccaguuuggaaccagacuucauggcgggaaagauagcgccucuccucgcuauaucuucacaaugcucuccagccuggcucggcugcucuuucccccuaaggacgaucacacccugaaauuccuuuacgacgauaaccaaagagucgaacccgagugguauaucccgauuaucccuauggugcugauuaauggagccgagggcaucgggacgggauggucuuguaagauucccaacuuugacgugcgggaaaucgucaauaacauccgcagacucauggauggcgaggaaccucugcccaugcugccuuccuacaaaaauuucaaggggaccauugaggaacuugcucccaaccaguauguuaucagcggcgagguggccauucucaauucuacaaccaucgagauuagcgaacugccggugcggacauggacccagacguacaaggagcagguccuggaaccuaugcucaacggaacagagaaaaccccuccccugaucacagacuauagagaguaccacaccgauaccacagugaaguuuguugugaaaaugacggaagagaaacuugcggaagccgagcgcgucggccugcauaagguguucaagcuccaaaccucccugacaugcaauagcaugguucuguuugaccacguggggugucuuaagaaauacgauaccguccucgacauucugcgggacuucuuugaacugagacucaaguauuacggacugcgcaaagaguggcuucugggcaugcucggggcugagucugccaagcugaacaaucaggcuagauucauccuggagaaaaucgauggaaagauuaucauugaaaacaagcccaaaaaggaacuuaucaaagugcugauucagcggggcuaugacuccgauccgguuaaggccuggaaagaggcgcagcaaaaggugcccgacgaagaggagaaugaagagagcgauaacgaaaaggagacagaaaaauccgacucugucaccgauagcgggccuacguucaauuaccuccuggacaugccccucugguaucugacaaaggagaaaaaggaugagcuuugccgccugagaaacgaaaaagagcaggaacucgacacccugaagcggaaauccccuucugaucuguggaaggaggaccuugccaccuuuaucgaggaacuggaggcuguggaagccaaggagaaacaggacgaacaggugggccuccccggaaagggcgggaaagcuaagggcaaaaagacacaaauggccgagguccugccuagcccccgcggacagagaguuaucccgcggauuaccaucgagaugaaggccgaagcugagaaaaagaacaaaaagaaaauuaagaaugaaaacacagagggguccccucaggaagauggaguggagcucgagggccugaagcaacgccuugagaaaaagcagaaaagagaacccggcacgaagaccaaaaagcagacaacccuggcguucaagccuaucaaaaaggggaaaaagcggaaucccuggucugacagcgaauccgaucgcagcucugacgaguccaacuuugaugugccgccuagagaaacagagccccggagagccgcuaccaaaacgaaguucaccauggaccucgauagcgacgaggauuuuucugacuucgaugagaaaacagacgaugaagacuuugucccuuccgacgccagcccucccaagaccaagacaucucccaaacuguccaauaaggaacugaaaccgcaaaagagcgugguuuccgaucuugaggccgacgaugugaaaggaagcgucccccugucuagcuccccucccgcuacccauuucccugacgagacagaaauuaccaaccccgugccuaagaagaauguuacggugaaaaagacagccgcgaaaucucagagcuccaccucuaccacaggcgcuaagaaacgcgccgccccgaaggggaccaagcgggaucccgcucucaacagcggagucucccagaaaccugaccccgccaagacgaaaaauagacgcaagcggaaaccuucuacaagcgaugacuccgauagcaacuuugagaagaucgugucuaaggcggucaccuccaaaaagagcaaaggcgaaucugacgauuuccacauggacuuugauuccgcuguggcccccagagccaagagcguucgcgcuaaaaagccgaucaaauaccuggaggaauccgacgaggacgaucucuucuga

SEQ ID NO: 77145 - RNA, 4866 nt, Artificial Sequence
  derived and/or modified sequence opt5 from TOP2B__Homo_sapiens__NP_001059
auggccaagagcggcgggugcggagcuggcgccggggugggaggcgggaacggagcgcugaccugggucaauaacgcugccaaaaaggaggaauccgagacagccaauaaaaacgacucuagcaagaaacucuccguugaaagaguguaccagaagaagacgcaacuggagcacauccuucugcggcccgauaccuauauuggcucuguggaaccucucacacaguucaugugggucuacgacgaggaugugggcaugaauugucgcgagguuaccuuugugccggggcuguauaaaaucuucgacgaaauucuugucaacgcugccgauaauaagcagagagacaaaaacaugacaugcaucaaggugagcauugaucccgaguccaauaucaucucuauuuggaacaauggaaaaggcaucccuguuguggaacauaaggucgagaagguguacgugcccgcucugauuuuugggcagcuccugaccagcuccaacuaugacgaugacgagaaaaaggucacaggaggccggaauggguacggagccaaacuguguaacaucuucagcaccaaguuuacgguugaaaccgcgugcaaagaguauaagcacucuuucaaacaaacauggaugaauaacaugaugaagaccuccgaagccaagauuaaacauuuugauggcgaggacuacacauguaucaccuuccagccugaucucagcaaguuuaaaauggaaaagcuggacaaagacauuguggcucuuaugacgcgcagagccuacgaucuggcuggcucuugccgcggggugaaggucauguucaacggaaagaaacuccccgugaauggcuuucgguccuauguugaccuguacgugaaggauaaacuugacgagacaggggucgcccugaaggugauccacgagcucgcgaacgaaagaugggauguuugucugacccugagcgagaaaggauuccagcagaucucuuuugucaauuccauugccacaaccaagggcgggcggcauguggacuauguggucgaucaagugguuggaaagcucaucgaaguggucaaaaagaaaaacaaggcuggcgugagcguuaaaccuuuccaggugaagaaucacauuugggucuucaucaacugccugauugagaauccgaccuuugacucccagacaaaggaaaacaugacgcuucagcccaaaucuuucggcagcaagugucaacuguccgagaaauuuuucaaggccgcuagcaauugcgggaucguggagucuauccucaacugggugaaauuuaaggcccagacccagcugaauaaaaaguguuccagcguuaaguacucuaaaauuaagggaaucccuaaacuugaugacgccaacgaugcuggcgggaagcacagccuggaaugcacacucauucugaccgagggagacuccgcgaaaucucuggccgucagcggccucggggugaucggccgcgacagauauggaguguucccccugcggggcaagauucuuaauguccgcgaggcuucccauaagcaaaucauggaaaacgccgaaaucaauaacauuaucaaaauuguggggcugcaguacaagaaaagcuaugaugacgccgagucucucaagacacugagauacggaaaaaucaugauuaugaccgaucaggaccaggauggcucccacaucaaggggcuucugauuaacuuuauccaucacaauuggccuagccuccugaagcacggauuccuggaggaauuuaucacgcccauuguuaaggcuucuaaaaacaaacaagagcucuccuucuacagcaucccggaauuugacgaguggaagaaacauauugagaaucagaaggccuggaagaucaaauauuacaagggccuggggacauccaccgcgaaagaagcuaaggaguauuucgccgauauggaacggcaccgcauucuuuuuagauacgccggcccugaggacgaugcugccaucacccuggcuuucucuaaaaagaaaaucgacgaucggaaggaauggcucacaaacuucauggaggacagacgccagcggagacugcauggacugcccgagcaguuucuuuauggcaccgccacaaagcaccucacguacaaugauuucauuaacaaagaacugauccuguuuagcaauuccgacaacgagcgcucuauuccuagccucguggacggguucaagcccggacaacggaaaguccuguuuaccugcuucaagagaaaugauaaacgcgaagugaagguugcgcagcuugccggcuccguggcugagaugagcgccuaucaucacggggaacaggcucugaugaugacaaucgucaaccucgcccagaauuuugugggaucuaacaauauuaaccugcugcaacccaucggccaguucgggacccggcuucacggcggaaaggacgcggccuccccuagauacaucuuuacaaugcucagcacccuggcucgccuccuguucccggccguugaugacaaucugcuuaaauuucuguacgaugacaaccagcggguggagcccgagugguauauuccuaucauucccaugguccucaucaacggcgcugaagggauuggaacgggcugggccuguaagcugccuaauuacgaugccagagagaucgugaacaaugugcgccggaugcuggacgggcuugauccccauccgaugcucccuaacuauaaaaauuucaagggaaccauccaggaacugggccaaaaccaguacgcugucucuggggagauuuuuguuguggacagaaauacaguggaaaucaccgagcugcccguccggacauggacccagguguauaaagagcaaguucucgaaccuaugcugaacggcacggauaagacacccgcgcuuauuuccgacuacaaggaguaucacaccgauacaaccgugaaauucgucgugaagaugaccgaagagaaacuggcccaggcugaggccgccggacuccauaagguuuucaaacugcagacaacgcugaccugcaauagcauggugcuuuuugaccacaugggcugucucaagaaguacgaaacaguccaggacauccugaaagaguucuuugaucugcgccucucuuacuaugggcugagaaaggaauggcuugugggaaugcugggcgcugagagcaccaaacucaacaaucaagcccgguucauucuggaaaagauccaggggaaaauuacaaucgagaacagauccaagaaggaccugauccagaugcuuguucagcgcggauacgagagcgauccugugaaagcguggaaggaagcucaagagaaagccgccgaagaggacgaaacccagaaucagcacgaugacucuuccagcgauuccggcacgcccucuggcccggacuuuaacuauauucugaauaugagccucuggucccugacaaaggagaaagucgaggaacucaucaagcagcgggaugcuaaagggagagaggugaacgaccugaagcgcaagucuccuagcgaucuuuggaaagaagaccuggccgcguucguggaggaacucgacaaggucgagucccaagagagagaagauguucuggcuggaaugucuggcaaagccauuaaggggaaagugggaaagcccaaggugaaaaagcugcagcuugaggaaaccaugcccagcccuuacggccggcgcaucauuccggagaucaccgccaugaaagcugacgccuccaagaaacugcucaagaagaaaaagggggaucuggacacagcugccgucaaaguggaguuugaugaagaguucagcggagcgcccguugaaggcgccggcgaggaagcucucaccccuucugugcccaucaacaaggggccuaaacccaagagagagaagaaagagccuggaacacggguccgcaagacgcccaccuccagcggcaaaccgucugccaagaaagugaagaaaagaaauccuugguccgacgaugaaagcaagucugaguccgaccuggaagagacagaacccguugugauuccucgggauagccuucugcgcagagcugccgccgagcggcccaaguauaccuuugacuucuccgaggaagaggaugacgaugcugacgacgaugacgaugacaacaaugaucucgaggaacugaaagucaaggcgagcccgaucacaaacgacggggaagaugaguuugugccuucugacggacuggauaaagacgaguacaccuucagccccggcaaguccaaagccacgccugaaaagucucuucaugauaagaaaagccaggacuucgggaaucuguuuuccuuccccucuuauagccaaaaguccgaggaugacucugcuaaauuugacagcaacgaagaggauuccgccagcgucuucucucccuccuuuggacucaagcagaccgacaaagugccuagcaagacaguugccgcuaagaaaggcaagccgucuuccgauaccgugcccaaaccuaagcgcgcccccaaacagaagaaggucguggaggcgguuaauagcgacuccgauucugaguucggcauuccuaaaaagacaaccacacccaaagggaagggaagaggcgcuaaaaagcggaaagccagcggguccgaaaacgaaggagacuacaauccuggcagaaagaccagcaagacgacaucuaaaaagccgaaaaagaccuccuuugaucaggacagcgauguggacaucuuccccucugauuuuccuaccgagcccccuagccugccccgcacagggcgggccagaaaagaagucaaguacuucgcugaguccgacgaggaagaggacgauguggacuuugccauguucaacuga

SEQ ID NO: 77146 - RNA, 3006 nt, Artificial Sequence
  derived and/or modified sequence opt5 from TOP3A__Homo_sapiens__NP_004609
augaucuuccccguggccagauacgcucugcgguggcuccgcagaccugaggaccgggccuuuagccgcgcggcuauggaaauggcccugagaggcguccggaagguucuuugcguggccgagaaaaacgaugcugccaaggggauugcugaccugcucuccaauggacgcaugagacggcgcgaaggccugucuaaauucaacaagaucuaugaguuugauuaccaccuuuaugggcagaaugugaccauggucaugacaagcguguccggacaucugcucgcccacgacuuccaaaugcaguuuagaaaauggcagucuuguaacccgcugguucuguucgaagcggagauugagaaguacugccccgaaaauuuuguggauaucaagaaaacgcucgagcgggaaacccgccagugucaagcccuggucauuuggacagacugcgauagagagggcgagaacaucggguucgaaaucauucauguguguaaggcuguuaaaccuaaucuucaggugcugcgggcccgcuuuagcgagaucacaccccacgcugucagaaccgccugcgaaaaccucaccgagccugaccagcggguguccgaugcgguggacgucagacaggaacuggaucuucgcauuggagccgcuuucacacgguuucaaacccugagacuccagcgcaucuuccccgagguucuggccgagcagcugauuucuuauggcagcugucaguuuccuacgcucggcuucgugguggaacgguucaaggcuauccaagccuuugucccggagauuuuccauagaaucaaagugacccacgaccacaaggaugggaucguugaauuuaauuggaagcgccaucggcuguucaaccacacagccugccuugugcuguaccagcucugugucgaggaccccauggcuaccgugguugaagugagauccaaaccuaagagcaaauggcgcccccaggcgcuggacacagucgagcuugagaagcuggccucucggaaacucagaauuaaugcuaaggaaaccaugcgcaucgccgagaaacuguauacgcaaggauacauuuccuacccucggacagaaaccaacaucuuucccagagaucugaaucucacagugcuggucgagcagcagaccccggacccucgguggggcgccuucgcucagagcauucuugaacgcgggggacccaccccuagaaacggcaauaagucugaucaagcccauccucccauccaccccacaaaguauacgaacaaccugcagggggacgagcagcggcucuacgaguuuaucgugagacacuuccuggcgugcuguucccaggaugcucaaggacaggaaaccacaguugagauugacaucgcccaggaacgcuuuguggcccauggccuuaugauucuggcucggaauuaucucgaugucuacccguaugaccacuggagcgauaaaauccugcccguguacgagcagggcucucauuuccaaccuuccaccguugagaugguggacggggaaacaucucccccuaagcugcucaccgaggccgaucugauugcucuuauggaaaaacacggaaucggcacggacgccacacaugcggagcacaucgaaaccauuaaggccagaauguaugucgggcugacccccgacaaacgcuuucucccgggacaccugggcauggggcugguggagggauacgauuccaugggcuacgagaugucuaagccugaccuuagagcugaacucgaggccgaucugaagcugaucugcgacggcaaaaaggauaaauucgugguucuccggcagcagguccagaaguauaaacaaguguuuauugaagcuguggccaaggcgaagaaacuggacgaggcccuugcucaguacuucgggaacggaacagaacuggcccagcaagaggauaucuaucccgcuaugccugagcccauucgcaagugcccucaguguaauaaagacaugguccucaagaccaaaaagaacggcggguucuaccugagcugcaugggauuucccgaauguagauccgccguguggcugccggauagcguucuugaggccucucgggacuccagcgugugcccugucugucagccccaucccguguaucgccucaagcugaaauucaagagaggcucucugccuccgacaaugccccucgaauuuguuugcuguaucgggggcugcgaugacacgcugcgggagauucuugaucugcgcuucagcggaggcccucccagagcuucccagccuucugggcggcuccaagcgaaucagagccugaaccgcauggacaauucccagcacccccagccugccgacagcagacaaaccggaucuuccaaagcucuggcccagacacuucccccgccuaccgccgcuggcgaaagcaacucugugacauguaauugcgggcaggaggccguccuccugaccgugcggaaggagggacccaacagaggccgccaguuuuucaaauguaaugggggcuccugcaacuuuuuccugugggcggauagcccuaaucccggagcuggcgggccgccugcccucgccuaccggccccugggagcuucccuuggcugcccucccgggcccggaauccaucugggcggguuuggcaacccuggagacggcucugggagcggaacguccugucucugcucucaaccgagcguuaccagaacagugcagaaggauggccccaauaaagggcgccaguuccacaccugugccaagccucgggaacaacagugcggauuuuuccagugggucgacgagaacacagcgcccggcaccuccggggcuccuagcuggacgggcgauagaggacgcacacuggaaucugaggcccgguccaagagaccccgcgccagcagcuccgacaugggcagcaccgcuaaaaagccucggaaauguucucugugccaccagccggggcauacaagacccuuuuguccucaaaaccgguga

SEQ ID NO: 77147 - RNA, 2589 nt, Artificial Sequence
  derived and/or modified sequence opt5 from TOP3B__Homo_sapiens__NP_001269042
augaagaccgugcugauggucgccgagaaacccagccucgcucaguccaucgccaagauucugucuagaggcagccuuuccucucacaaagggcugaacggagcgugcagcguucaugaauacacaggcacguucgcugggcaaccugugcgguuuaagaugaccuccguguguggacacgucaugacacucgacuuccugggcaaauauaauaagugggauaagguggacccggccgagcuguuuucucaggcccccaccgaaaagaaggaggcuaacccuaaacuuaauaugguuaaguuccuccagguggaagggcgcggaugcgauuacaucguccuguggcuggacugugauaaagagggcgagaacauuugcuuugaagugcucgacgccguucugcccgugaugaauaaggcucauggcggggagaagacagucuucagagcccgguuuagcuccaucaccgauacagacauuuguaacgcgauggccugccuuggagaaccugaucacaaugaggcucugagcguggacgcccgccaggagcucgaucugagaaucggcugugcuuucacccgguuucaaacgaaauauuuccaggggaaguacggagaccuugauucuucccugaucagcuuuggccccugccagaccccuacacucggguucuguguggaacgccaugacaaaauucagucuuuuaagccggagaccuauuggguccugcaagccaaaguuaacacagacaaggauagaucccugcuccuggacugggaucgggugcgcguguucgacagagaaaucgcgcagauguuccuuaauaugaccaaacuggagaaggaagcccaggucgaggcuacgagccggaaggagaaagccaagcagcgcccccucgcucugaacacaguggaaaugcuuagaguugccucuuccagccugggaaugggcccucaacacgccaugcagaccgcugagcggcucuacacacagggcuauauuuccuacccccgcaccgaaaccacacacuacccugagaauuuugaucugaaagggucucugagacaacaggcgaaccaucccuauugggccgacacggugaagcggcuccuggcugaaggaaucaauagaccgcgcaaaggccacgaugccggggaccauccucccauuaccccuaugaaaagcgccacagaggcugagcuuggaggcgaugccuggcggcuguacgaauauaucaccagacacuucauugcgacagucucccacgacugcaaguaccuccagagcaccaucucuuuucgcaucgggcccgagcuguucacguguuccggaaaaacagugcuuagccccggcuuuaccgaaguuaugccuuggcagucugugccgcuggaggaaagccucccuaccugccaacggggcgaugcuuuccccgucggggaggugaagaugcuggagaaacagacaaaucccccugacuaucugaccgaagccgagcucauuacacugauggaaaagcauggaaucggcacggacgccuccauucccguccacaucaacaacauuugccagagaaacuacgugaccguugagucugggcgccggcuuaaaccgacaaaucugggaaucgugcucguccauggcuauuacaagaucgaugcugagcuggugcugccuaccauuagaagcgccguugaaaagcagcuuaaccucaucgcucaagggaaagccgacuaccgccaggugcugggccacacacuggaugucuuuaagcggaaauuccauuauuuuguggacuccauugcgggaauggaugagcucauggaagugagcuucucuccccuggccgcuaccggcaagccucuuuccagaugugggaaaugccaccgcuuuaugaaguacauccaggccaagcccagccggcugcacuguucucauugcgacgagacguauacccucccucagaauggaacaauuaaacuguacaaggaacugagauguccccuugaugacuucgagcucguucugugguccagcggcucccgggggaaaucuuauccgcugugcccuuacuguuauaaccacccucccuuucgcgauaugaagaaaggaaugggcugcaaugaguguacccaucccagcugccaacacucccucucuaugcuggggaucggccagugugucgaaugcgagagcggagugcuugugcuggacccgacauccggccccaaguggaaagucgcuugcaacaaguguaaugugguugcccacugcuucgaaaacgcgcauagagugcgggucagcgccgauaccuguucugugugcgaggcugcccuccuggacguugauuucaauaaggcuaaauccccucugcccggggacgaaacgcagcacaugggauguguguuuugcgacccugucuuccaggagcuuguggagcucaagcaugccgccagcugucaccccaugcauagaggcgggccuggacgccggcaaggcagagggcgcggcagagcucggagacccccgggaaaaccuaacccccgccggccuaaggauaaaaugucugcgcuggccgcuuacuuuguuuga

SEQ ID NO: 77148 - RNA, 4569 nt, Artificial Sequence
  derived and/or modified sequence opt5 from TOPBP1__Homo_sapiens__NP_008958
augagcagaaacgacaaggagcccuucuuugugaaauuccugaaguccucugauaauagcaaaugcuuuuucaaggcccucgaauccaucaaagaguuucagucugaagaguaccugcaaauuaucaccgaagaggaggcucuuaagauuaaggaaaacgaccggagccuguauaucugugauccuuucuccggcgucguuuuugaccaccucaaaaagcuggggugccgcauugugggaccccagguggucaucuucuguaugcaucaccagagaugcgugccccgggccgagcauccuguuuacaauauggugaugucugaugucacaaucagcuguacgucccuugaaaaagagaagcgcgaggaagugcacaaauauguucagaugaugggcgggagaguguaccgggaccugaacgucagcgugacccaucucauugcgggagaggugggcucuaagaaguaucuggucgcugccaaucugaaaaagcccauccuccugccuuccuggauuaaaacacuuugggaaaagagccaagagaaaaagaucacccgcuacacagauauuaacauggaagacuuuaaaugccccaucuuccugggguguauuaucugcguuaccggacucuguggccuggauagaaaggaggugcagcagcuuacagugaagcacggcgggcaguauaugggacaacugaaaaugaaugagugcacccaccucaucguccaggaaccuaagggccagaaauacgagugugccaagcgguggaacgugcauugcguuacgacccagugguuuuucgacucuauugaaaaaggguuuugccaagaugaguccaucuacaagacagaaccgcgccccgaggcuaagaccaugccuaauagcucuacacccaccucccagauuaacacgaucgacagcagaacacuguccgaugugucuaauauuagcaacaucaaugccuccugugucagcgagucuaucugcaacucccugaauagcaaacucgaaccuacccuggagaaccuugaaaaccuggacgugucugcuuuccaggcccccgaggaccuccuggauggaugucggauuuaucuuugcggcuucagcgggcgcaagcuggacaaacucagacggcugaucaauuccggaggcggcguucgcuuuaaccaacugaaugaagaugugacacacgucauugugggggacuacgaugacgagcucaagcaguucuggaacaaaucugcgcauagaccgcacgucgugggagccaaguggcugcuugaguguuuuagcaagggcuauaugcuguccgaagaaccuuacauccacgcuaauuaucagcccguugaaauuccugugagccauaaacccgagucuaaggccgcucuccugaaaaagaaaaacuccagcuucucuaagaaggauuuugcccccuccgagaaacacgaacaggcggacgaggaucuucugagccaauacgaaaauggguccucuaccgucguggaggccaagaccagcgaagcucggccuuucaacgacuccacacaugccgagccgcucaaugauucuacgcacaucagccugcaggaggaaaaccaguccagcguuucucauugcgugcccgacgucuccaccaucacagaggaaggacuguuuagccagaaaucuuuccucgugcugggcuuuuccaaugagaacgaaagcaauauugcuaacaucauuaaggagaaugccgggaaaaucaugucucuucugagcagaaccguggccgacuaugcuguugucccucuccugggaugugagguggaagcgacagugggcgaggucgugaccaacacguggcugguuacaugcauugauuaccaaacccuuuucgaccccaaguccaacccucucuuuacccccgugccggucaugacaggcaugaccccucuggaagauugugugaucagcuucucucagugcgccggggcugagaaagaaucccugacauuucucgccaaucugcuuggagccagcguucaggaguacuucgugcgcaaguccaacgcuaagaaaggcauguucgccucuacgcaccugauucucaaggagagagggggaagcaaauaugaagcggcuaagaaauggaaucugcccgccgucaccaucgccuggcugcuugagacagcucggaccggcaagcgcgccgacgaaucccacuuucucaucgagaacucuacaaaggaggaacggagccuggagaccgaaauuacgaaugggaucaaccuuaauuccgauaccgcugagcauccuggcacaagacuccagacccaccgcaaaacagugguuaccccgcuggacaugaaccgguuccaaucuaaggccuuuagagcgguggucagccagcaugcccgccagguggcugccuccccugcugugggacagccccuucaaaaagaaccgagccugcaccucgauacgccuucuaaguuccuguccaaagacaagcuguuuaagcccagcuucgaugucaaagacgcccuugcggcccucgagacacccggccggccuucucagcagaagagaaaaccguccacaccccugagcgagguuauugugaagaaucugcaacucgcucuggccaacucuucccgcaaugcuguggcccuuagcgccuccccucagcugaaagaagcucagagcgagaaggaagaggcgcccaagccucuccacaaagucgugguuugugugucuaagaaacugagcaagaaacaguccgaacugaacgggaucgccgcuucucuuggagccgauuaccgguggagcuuugacgagaccgucacccauuucauuuaucaaggcagacccaaugauaccaaccgggaguacaaguccgugaaagaacgcgggguucacaucgugucugagcauuggcuccuggacugcgcccaggaaugcaagcaucugccugagagccucuauccccacacauacaauccgaagaugucccuggacaucucugcuguccaggauggaagacuuuguaacagccggcugcucuccgccgugagcucuacgaaagacgaugaaccugacccccugauucuggaggagaacgauguugacaauauggcgaccaacaauaaggaauccgcuccuagcaacggcucugggaaaaaugauuccaagggcgugcuuacacagacccuggagaugagagaaaacuuucaaaaacagcuccaggagaucaugagcgccacauccauugucaagccccagggacaacgcaccucucugagccgguccggcugcaauagcgccucuuccacgccggacagcacaagaucugcucgcagcgggagaucccgggugcucgaggcccugcgccagucuagacagaccgugccugaugucaacaccgaacccagccaaaaugagcagaucauuugggacgauccuacagcgcgggaggagcgcgcuagacuugccuccaaccugcaguggcccucuugucccacccaguauagcgaacuccaaguugacauccagaaucuggaggauuccccuuuccagaagccgcugcacgacagcgagaucgccaaacaggcugugugcgaccccggaaacauucgggugacagaagccccuaagcaccccaucucugaggaacuugagacgccuauuaaagauucccaucugauccccaccccucaagcuccgagcauugccuuuccccucgcgaauccucccgucgccccucacccccgcgaaaagaucaucacaauugaggagacccaugaggaacugaaaaagcaguacaucuuccagcucuccucucugaacccgcaggaaagaauugacuacugucaccuuaucgagaagcugggcgggcucgugauugaaaaacaaugcuuugauccuacauguacccauaucguugugggacacccccugcggaaugagaaguaucuggcuagcgucgccgcuggcaaaugggugcuucaccgcuccuaccuggaggccugcagaacggccgggcauuucguucaggaagaggacuaugaauggggcucuagcuccauucucgaugugcugaccggaaucaacguccagcagcggagacucgcucuggcggccaugcgcuggcggaagaaaauccaacagagacaggagagcggcauuguggagggggcuuucucuggauggaaggucauccuucacguggaccaaucccgcgaagccggcuuuaagcggcugcugcagagcgggggagccaaaguucuccccggccauucugugccucuguucaaggaggcuacacaccuguuuuccgaucugaacaaacucaagcccgacgauagcggggucaauauugccgaagcggcugcccagaacguguacugucugagaaccgaguauaucgccgacuaccucaugcaggaaucuccuccgcacguugagaauuauugccugcccgaggcuauuagcuucauccaaaacaauaaagaacuuggcacaggacugucccagaagcgcaaggccccuaccgagaaaaacaagaucaaacggcccagagugcauuga

SEQ ID NO: 77149 - RNA, 2943 nt, Artificial Sequence
  derived and/or modified sequence opt5 from TOPORS__Homo_sapiens__NP_001182551
augaucauggccagcgcugccaaggaguucaaaauggacaacuuuucccccaaggcgggcaccucuaaacugcagcaaacagugccugcugaugccagcccggacuccaagugccccauuugucucgauagauucgacaaugucucuuaccuggaucggugccuucacaaauuuuguuuccgcugcguucaggaauggagcaagaacaaggccgaguguccucugugcaaacagcccuuugacuccaucuuccauucugugagagcugaagaugacuuuaaggaguaugugcuccggccuagcuacaauggguccuucgucacgcccgaucgcagauuucgguaucgcaccacacugaccagagaacggaacgccagcguguacucuccuuccggaccgguuaaucgcagaacaaccacacccccugacagcggcgugcuuuucgaggggcugggaauuucuacccggccccgcgaugucgagaucccucaguuuaugagacaaauugcugugcggcgccccacgaccgccgacgaaagaucccuccggaaaauccaggagcaggauaucauuaacuucagacgcacacuguaucgggcgggcgccagaguucgcaauaucgaagacgggggacgguacagagacauuagcgcugaguuuuuccgccggaacccggccugucugcacagacucgugccuuggcugaagcgcgagcuuaccguccuguucggcgcucauggcucucucgugaauaucgugcagcacauuaucauguccaacgucacacgguaugaucuggaaagccaagccuuuguuuccgaccuuagacccuuccugcucaaucgcaccgagcauuuuauucacgaguucaucucuuuugcgcggagcccuuucaacauggccgcuuuugaucagcacgccaauuacgacugccccgcucccuccuacgaagaagggagccauucugauuccagcgugaucacgauuucuccugacgaggccgagacacaggaacuggauaucaacguggccaccgucagccaggcuccgugggacgaugagacacccggaccuuccuauucuagcuccgaacaagugcacguuaccaugagcucucugcucaauaccuccgacagcucugaugaggaacuggugacaggcggggcgacgucccagauucagggaguccaaaccaacgacgaccuuaacaaugauagcgacgauuccucugacaacugugugaucguuggcuucgugaaaccccuggccgagagaacaccugagcucgucgaacugagcuccgauucugaggaccuugggagcuacgaaaagauggagaccgugaagacacaggaacaggagcaguccuauagcucuggagauuccgacgucagccggugcucuagcccccauagcgugcugggcaaagaugagcaaauuaauaagggccacugugacucuagcacccgcaucaaauccaagaaagaagagaagagaagcacgucucucuccagcccgcggaaccucaauuccucuguuagaggggaucgcguguacagcccuuauaaccaccggcauagaaaacgcggaagaucccggucuagcgacucccgcucucagagcagauccggccacgaucagaagaaucaucggaagcaccaugggaaaaagcgcaugaaaagcaagagaucucggucccgcgaaagcucuagaccccggggacgcagagacaaaaagcgguccagaacacgcgacagcucuuggucccggagaagccagacccugucccugagcucugagagcaccucccgcucucggagcagauccucugaucacggcaagcgccggagcagaucccgcaaccgggacagauacuaucugcggaauaacuacgggucucgcuacaaaugggaguauacauacuauagcagaaauaaggaucgggacggauacgaauccagcuaucgcagacggacccuuucuagagcucacuacucccgccaauccucuuccccugaguuucggguccagagcuucuccgaaagaacaaacgcccgcaaaaagaauaaccauucugagcggaaauauuacuacuaugaaagacaccgcagccggucccugagcucuaauagaucccgcacggccagcaccggcacagauagagugcggaacgagaagcccggcgggaagcgcaaauacaagaccagacaucucgagggaacaaacgaaguugcucagccuucucgggaguuugccagcaaagcgaaggacucccacuaucagaaaucuagcuccaagcuggauggcaauuacaagaacgaaucugacaccuucagcgauucccgcagcucugacagagagacgaaacacaagcggagaaaacgcaagacccggucccuuagcguggaaaucgucuaugaggggaaagcuacagauaccacaaagcaucacaaaaagaagaaaaagaaacauaagaaaaagcacaagaaacaucacggagacaaugccuccagaucucccguggugauuaccaucgauagcgacuccgacaaggauucugagguuaaagaagacacggagugcgauaacagcggcccgcaagacccucugcagaaugaauuucucgcccccucccuggagcccuucgaaacaaaggaugucgugaccauugaggcugaguucggggugcuggacaaagaaugcgauaucgccacacucagcaacaaucugaacaaugcuaacaagaccgucgacaauauuccuccgcuugccgcgucuguggagcagacccuggauguucgcgaagaguccacauuugugagcgaccucgagaaccagcccucuaauaucgucucccugcaaacggaaccuagccggcagcugcccucuccuagaaccagccuuauguccgugugucucggccgggauugcgacaugucuuga

SEQ ID NO: 77150 - RNA, 999 nt, Artificial Sequence
  derived and/or modified sequence opt5 from TOR1A__Homo_sapiens__NP_000104
augaagcugggcagagccgugcucgggcugcuucugcucgcucccagcgucguucaggccguggagccuaucucccugggacuugcgcuggcuggcgugcucaccggguacauuuauccgcggcuguacugccuguucgccgaauguugcggacaaaaacgcucucucagcagagaggcccugcagaaggaccuugaugacaaccuguuuggccagcaccucgcuaaaaagaucauucugaaugccgucuucggguuuaucaacaaucccaaaccuaagaagccccuuacacugucccuccauggauggacgggcaccggcaaaaacuucgugucuaagauuaucgcugaaaauaucuaugaagggggacugaacagcgauuacguucaccuguuuguggccacacuccauuucccucacgcguccaauauuacccuguauaaagaccagcuucaacuguggauccggggcaacgucucugccugugcucgcagcauuuuuaucuucgaugaaauggacaagaugcaugccgggcucauugaugcuaucaaacccuuucuggacuacuaugaucuuguggacggaguuuccuaccagaaggccauguucauuuuucugagcaaugcgggcgccgagagaaucacagauguggcucucgacuucuggcggucugggaagcagcgcgaggauaucaaacugaaggacauugaacacgcccuguccgucagcguguuuaacaauaaaaacucuggauucuggcacuccagccucaucgacagaaaucugauugauuacuucgugccuuuucuuccgcuggaguauaagcaucucaaaaugugcauccgggucgaaaugcagucucgcggcuacgagauugacgaggauaucguuuccagaguggcugaagagaugaccuucuuucccaaggaggagcggguguucagcgacaaaggcuguaagacagucuuuaccaagcuggauuauuacuaugacgauuga

SEQ ID NO: 77151 - RNA, 1752 nt, Artificial Sequence
  derived and/or modified sequence opt5 from TOR1AIP1__Homo_sapiens__NP_056417
auggccggcgacgggagacgggcugaggccgugcgcgaaggauggggcgucuacguuacccccagagcgccuauccgggaggggcgcggaagacuggcuccgcagaacggcgggagcuccgaugcccccgccuaucggacaccucccucucgccaaggaagacgggaagugcgcuucagcgacgagccucccgaaguguacggcgauuuugagccucucgucgcuaaggagagauccccggugggcaaacggacgcgccuggaagaguucagaucugacagcgccaaggaagagguucgggaguccgcuuauuaccuucgcucuagacagcggagacagccccgcccucaggaaaccgaggaaaugaaaacacggagaaccacacgccugcaacagcagcacagcgagcagcccccucuccaacccuccccggugaugacccggagagggcugcgcgauagccauucuuccgaagaggacgaggccagcucucagacagaucuuucccagaccauuagcaagaaaacgguccggucuauccaggaagcgccuguguccgaggaccugguuauuagacuccgccggcccccucugagauauccccgcuacgaagccaccagcgugcaacagaaggucaauuuuuccgaggaaggagagacagaggaagaugaccaggauucuagccacuccagcgugaccacagugaaggcucggucuagagacuccgaugagagcggcgacaaaaccacgcggucuagcucccaauauaucgaaucuuucuggcagagcucccagagccagaacuuuacagcccaugacaagcaacccucuguccuguccagcggguaccagaaaaccccucaggagugggcuccgcagacagcccgcauuagaacccggaugcaaaaugauucuauccucaaguccgaacugggaaaccagagccccuccaccucuagcagacagguuacaggccagccucaaaaugcguccuucgugaaacgcaaccggugguggcuucugccccucaucgccgcucuggccucugggagcuuuugguucuuuuccacgccugagguggagaccacagcuguccaggaauuucagaaucagaugaaccaacuuaagaauaaguaccagggacaggacgagaaacuguggaagagaagccaaaccuuucucgaaaaacaccugaacucuucccauccccgcagccagccggccauucugcuccugacagccgcuagagaugcggaggaggcccuucggugccugucugaacagaucgcugacgccuauuccagcuuccgcucugugagagccauucggaucgauggcaccgacaaggcuacgcaggauagcgacacaguuaaacucgagguggaucaagaacuguccaauggcuuuaagaacgggcagaaugccgcggucgugcaccgcuucgagagcuucccugcuggaucuacccuuauuuucuacaaauauugugaccacgaaaacgccgccuucaaggauguugcucuggugcucaccguccugcuggaggaggaaacacucggcaccucccuggggcuuaaggagguggaagagaaagucagagacuuucugaaggugaaauucacaaauagcaacacgcccaacuccuacaaucauauggacccugauaagcucaacggacuguggucucggaucagccaccuuguucugcccgugcagccugaaaaugcccucaaacgcggcauuugccuguga

SEQ ID NO: 77152 - RNA, 396 nt, Artificial Sequence
  derived and/or modified sequence opt5 from TOR1AIP2__Homo_sapiens__NP_071742
auguucagcgacaacucccacugccccgauuguggccagcaaugguuuccuucucuggagcucgggcauuggcuguaccagaccgaacuuguggagaaugaaugcuaucaggucuuccuggacagaaucaaccgggccgauuacuguccggagugcuaucccgacaauccugcuaaccgcagccucguucugcccugguccuuuccucuugaaugggcgccccagaaucugacaagauggacguucgagaaggccugucacccuuuucuccugggaccgccccuggugcggaaacgcauucaugauucuagaguggcuggcuucaacccugcccuccaacugauccuuacccggacagacaagacccugaauaaaaagcucgggcagaacaaauga

SEQ ID NO: 77153 - RNA, 1011 nt, Artificial Sequence
  derived and/or modified sequence opt5 from TOR1B__Homo_sapiens__NP_055321
augcugagagccggcuggcuccgcggggcugccgcgcuggcccuucugcucgcugcccggguggucgcugccuucgagcccaucaccguuggacuggcuauuggcgccgcgagcgccaucacaggguaccuuuccuauaacgacauuuacugcagauuugcugaauguugccgggaggaacgcccucugaaugccucugcucucaagcuggaucuggaggaaaaacucuucggacagcaccuggccacggaggugaucuuuaaggcgcuuaccggcuucagaaacaauaaaaacccgaagaaaccccugacacucagccugcaugggugggccggaaccggcaagaauuuugugucccaaauugucgcugagaaccuucacccuaagggccugaaaucuaauuucgugcaucucuuuguuagcacacugcacuucccccaugaacagaagaucaaacuguaucaggaccagcuccaaaaguggauccgggggaacguguccgccugugcuaauucugucuuuauuuucgaugagauggacaaacugcacccuggaaucauugaugccaucaagcccuuucuugacuacuaugaacagguggauggcguuagcuaccgcaaggccauuuucaucuuucuguccaacgcugggggagaccucauuaccaaaacagcgcuggauuucuggagagccggccggaagcgcgaggacauccagcuuaaagaucuggagccugugcucagcgucgggguguucaauaacaagcacucuggacuguggcauuccggccugaucgacaaaaaucucauugauuauuuuaucccguuccugccccuugaauacagacacgugaagaugugcguccgggcugagaugcgcgccagaggcagcgccauugacgaagacaucguuacccggguggcugaggaaaugacguuuuucccucgcgaugagaaaauuuacucugacaagggguguaagaccgugcaguccagacuggauuuucauuga

SEQ ID NO: 77154 - RNA, 966 nt, Artificial Sequence
  derived and/or modified sequence opt5 from TOR2A__Homo_sapiens__NP_001078816
auggcugcugccaccagaggcugccggcccugggggagccugcucggacugcuuggccugguguccgcggcugccgccgcuugggaccucgccucucugcgcuguacacuuggggcuuucugcgagugugauuuuagaccugaccugccgggacucgaaugcgaucuggcccagcaccuggcgggccaacaucucgccaaggcucuggucguuaaagcccuuaaggcuuucgugcgggaccccgccccuacgaaaccccuggugcucagccugcacggguggaccggaacaggcaaguccuacgucucuagccuucuggcgcauuaucucuuucagggcgggcugcgcuccccuagagugcaccauuucucucccguucugcacuuuccucacccgagccauaucgagcgguacaaaaaggaucucaaguccugggugcagggaaaccugaccgccuguggccgcagccuuuuccuguuugacgaaauggauaaaaugcccccugggcucauggagguccugagacccuuccuuggaucuuccugggugguuuauggcacaaauuaccggaaggcuauuuuuaucuucauuagcaacaccgggggagaacagaucaaucaaguggcccuggaggcuuggcgcucuagacgggaccgcgaggaaauucuccugcaggagcuggaaccugucaucuccagagccgugcucgauaacccccaccauggcuuuagcaauucuggcaucauggaggagcggcugcuugacgccguggucccguuccugccucuccagcgccaccacguuagacauugcgugcugaacgaacuugcucagcuggggcucgagccccgggaugaagugguccaagcggugcuggacuccacaaccuuuuucccugaggaugaacagcuguucagcuccaauggauguaaaacgguugccucuagaauugccuuuuuccucuga

SEQ ID NO: 77155 - RNA, 1395 nt, Artificial Sequence
  derived and/or modified sequence opt5 from TOX2__Homo_sapiens__NP_001092266
augagcgacggcaaccccgagcugcucuccaccucucagacauacaaugggcaaagcgaaaacaaugaggauuaugaaaucccuccgauuacgcccccuaaccugcccgagccuucccuucugcaccucggagaccaugaagccucuuaccacagccugugccauggccuuacccccaaugggcugcucccugcuuauuccuaccaggccauggaucugccggcgaucauggugucuaacaugcuggcucaggacagccaccuccuguccggacagcuucccacaauucaagagaugguccauagcgagguugccgccuaugauucuggcagaccugggccccugcucggacggccugcuaugcuggccucccacaugagcgcucuuucucagucccagcugaucagccagaugggcauucgcuccuccaucgcccacagcucccccucuccgccuggcagcaaguccgcgacccccagcccuucuuccagcacacaagaagaggaaucugaggugcauuucaaaaucagcggggagaagagacccuccgccgaccccggaaagaaggcuaaaaauccuaagaagaaaaagaaaaaggauccgaacgaaccccagaaaccugugucugccuacgcucucuuuuuccgggacacccaggccgcgauuaagggccagaaucccagcgccacauuuggggaugucuccaagaucguggcuagcaugugggacucucugggagaggaacaaaaacaggccuauaagcgcaaaaccgaggcugccaagaaagaauaccugaaggcccucgcugcguacagagccucccugguuagcaaaucuuccccugaucagggcgagacgaaaagcacccaagcuaaucccccggccaagaugcuuccucccaaacagccuauguaugccaugcccgggcuggcuuccuuccucacaccuucugaccugcaggccuuucggagcggagcgucccccgcuucucuugcccgcacccugggcagcaagucccuccugccgggccugagcgccucuccucccccucccccguccuucccccucagcccuacacugcaccagcaacuuucucugcccccucaugcucagggggcccuccugucucccccugugagcaugucucccgcuccgcagccucccguccuuccuacccccauggcccuccaggugcaacuggcgaugagcccguccccucccggaccucaggauuuuccccacauuagcgaguuccccucuuccagcggcuccuguucuccugggccgagcaaccccacguccucuggagacugggacagcuccuacccuucuggcgaaugcgggaucagcacauguucccugcugcccagagauaaaagccucuaucugaccuga

SEQ ID NO: 77156 - RNA, 1731 nt, Artificial Sequence
  derived and/or modified sequence opt5 from TOX3__Homo_sapiens__NP_001073899
auggacgugagauucuaccccgccgcugccggcgauccugcgagccuggacuuugcucagugccucggguauuacggauauuccaaguucggcaacaauaacaauuacaugaacauggccgaggccaauaacgcuuucuucgccgcuucugaacaaaccuuucacacaccgagccugggggaugaggaauuugagauucccccuaucacgcccccucccgaauccgacccugcccuuggaaugccggauguccugcuccccuuucaggcgcugucugacccucuucccagccagggcuccgaguucaccccucaguuucccccgcaaucucuggaucucccuagcaucacaauuucccggaaucugguugagcaggacggggugcugcauagcucuggacuccacauggaucagucccauacccaggugagccaauaucgccaggaccccucucugaucaugagauccauuguccacaugacagaugccgcucggagcggcgugaugccucccgcccagcuuaccacaaucaaccagucucaacuguccgcucagcucggccugaaucuugggggagccagcaugccccauaccuccccuucuccgcccgcgagcaaauccgccacgccuagccccucuuccagcaucaacgaagaggacgcugaugaagccaaucgcgcuauuggcgagaagagagccgccccugacucugggaaaaagcccaaaaccccgaagaagaaaaagaaaaaggacccuaacgagccccagaaaccuguuagcgcuuacgcgcuguucuuucgggauacacaagccgcuaucaagggacagaaucccaacgccaccuucggcgaaguguccaagauugucgccucuaugugggacagccucggggaggaacagaaacagguguauaagcgcaaaacagaggcugccaagaaagaauaccugaaggcgcuggcugccuacagagccucccucguuagcaaagcugccgcugagucugccgaggcgcaaaccauccgguccgugcagcagacgcuggccagcacaaaucuuaccucuucccugcuccugaacacaccucuuagccagcacggaaccgucuccgcuucuccccaaacccugcagcagagccucccgcgcuccauugccccuaagccccugacaaugagacugcccaugaaccagaucgugacgucugugaccauugcugccaauaugccuagcaacaucggcgcgccgcucaucuccagcaugggcacaaccauggucgggucugcccccuccacacaaguuagcccuucugugcagacccagcagcaccaaaugcagcugcagcaacagcagcagcaacagcagcagcaaaugcagcagaugcagcaacagcagcuucaacagcaucagaugcaccagcaaauucagcagcagaugcaacagcagcauuuucagcaccacaugcaacagcaucugcagcagcaacagcagcaccuccaacagcagaucaaucagcaacagcugcagcagcaacuucagcagcggcugcagcuccaacagcugcagcauaugcaacaccagucccagcccagcccucgccagcauucucccguggcuagccaaauuacguccccuauccccgccauuggaagcccgcagccugcuucucagcagcaccaaucccagauccagagccagacacaaacccagguccugucccaggugucuaucuucuga

SEQ ID NO: 77157 - RNA, 1797 nt, Artificial Sequence
  derived and/or modified sequence opt5 from TOX4__Homo_sapiens__NP_001290452
auggagaccuuccacacacccagccugggcgacgaagaguuugaaaucccuccgauuucccucgauucugaccccagccuggccguguccgaugucguugggcauuucgacgaucuugcugacccuucuagcucccaggauggaucuuuuagcgcccaauacggcgugcagacgcuggacaugcccguggggaugacccacggacucauggagcagggcgggggacugcuuuccggcggccugacaauggaucucgaccauagcaucgggacccaguauucugcgaacccucccgucacaauugaugugccuaugaccgacaugacauccggacugaugggccacagccaacugaccacgaucgaucagucugaacucuccagccagcuggggcuuucucugggaggcgggaccauucucccgcccgcucaguccccugaggacagacugagcacaacccccuccccuacaucuagccuucaugaggacggaguugaagauuuccggcgccaacugcccucccagaagaccguggucguggaggccggcaaaaagcagaaagccccgaagaaaagaaagaagaaagacccuaaugaaccccagaagccuguuagcgcuuacgcccucuuuuuccgggauacgcaagcugccaucaaaggccagaaccccaaugcgacauuuggggaggugucuaagaucgucgccuccaugugggacagccugggagaggaacagaaacaaguguauaagcgcaagaccgaggcugccaaaaaggaauaccugaaagcucucgccgcguauaaggauaaccaggagugccaggccacaguggaaaccgucgagcuggaccccgcuccuccgucucagacccccagcccucccccuauggccacaguugaucccgcuuccccggccccugccucuauugagcccccugcucuuagccccuccaucguggugaauagcacgcugucuuccuacgucgcgaaccaagccagcucuggcgcugggggacagccuaauauuaccaaacucaucauuacaaagcagaugcugcccuccagcaucaccaugucccagggcgggauggugacaguuauuccggccaccguggucacgucuagaggacuucaacugggccagacaagcaccgccaccauccagccuucccagcaagcucagaucgugacacggucuguucuccaggccgcggcugccgccgcugccgcugccagcaugcagcugcccccuccccgccugcaaccgcccccucuccagcagaugccccaaccucccacccagcaacaggugacaauucugcagcagccucccccgcuucaggcgaugcagcaaccucccccucagaaagucagaaucaaccugcagcagcaacccccgccucuccagauuaaguccgugccccugccuacgcuuaagaugcagaccacacuggucccucccaccguggaaagcucucccgagcggccgaugaauaacucccccgaagcccacacaguugaggcuccuagccccgaaaccaucugugagaugauuacggacguggucccugagguggaaucucccucccaaauggauguugagcucgugagcggcucuccugucgcccugagcccgcagccccgcugcgugagauccgggugugaaaauccucccaucgugagcaaagacugggauaacgaguauugcucuaaugaauguguugucaagcacugccgggacguguuccuggcuuggguggccucccgcaacagcaauaccgucguguuuguuaaauga

SEQ ID NO: 77158 - RNA, 1581 nt, Artificial Sequence
  derived and/or modified sequence opt5 from TOX__Homo_sapiens__NP_055544
auggacgugagauucuaucccccuccggcccagcccgcugccgcgccugaugcucccugccugggcccuagccccugucucgacccuuacuacugcaacaaguuugauggggagaauauguauauguccaugaccgaaccgucucaagacuacguccccgccagccaguccuauccuggacccucucuggagagcgaagauuucaacaucccucccauuacaccgccuucccuucccgaccacucucugguucaucucaaugagguggaaagcggcuaccacucccugugucauccuaugaaccacaaugggcuucugcccuuucauccccagaacauggaucucccugagaucacggugagcaauaugcugggacaggacggcacccugcucucuaacuccauuagcgucaugccggauauccggaaucccgaggggacacaauauucuucccacccucagauggccgcuaugcgccccagaggacagccugccgacauucggcagcaacccggcaugaugccgcacggccagcugaccacaaucaaccagagccagcuuucugcucaacuggggcucaauaugggaggcuccaacgugccucauaauagccccuccccucccgggucuaaaagcgccaccccuucccccagcagcuccguucacgaagaugagggagacgauacaagcaagaucaacggcggggaaaaacgcccggcgucugacaugggaaagaaaccuaagacccccaagaaaaagaaaaagaaagaccccaaugagccucagaagccggugagcgccuacgcucuguucuuuagagauacgcaggccgcuauuaagggccaaaaccccaacgccaccuucggcgaggucuccaaaaucguggcgucuaugugggacgggcuuggagaggaacagaagcagguuuacaaaaagaaaacagaagccgcuaagaaagaguaucugaagcagcucgccgcuuaccgggccagccugguguccaagagcuauucugaaccugucgaugugaaaaccucccaacccccucagcugauuaauagcaagcccucuguguuucauggcccuucccaggcccacagcgcucucuaccuguccucucacuaucaucagcaacccgggaugaacccgcaccuuacagcgaugcauccuagccugccccgcaauaucgccccuaaacccaacaaucagaugccggucaccguuuccauugcuaacauggccgugucuccucccccuccccuccagaucucucccccucugcaccagcaucuuaauaugcaacagcaccagccgcugacgaugcagcaaccccucggaaaccagcugccuaugcaagugcaguccgcccugcacagccccacaaugcagcagggcuucacccuccagccugacuaccaaacaauuaucaaucccaccucuaccgcugcccaggucgugacacaggcgauggaguauguuagauccgggugccggaacccuccgccccagccuguggauuggaauaacgacuacuguagcucuggaggcaugcaacgcgauaaggcucuguaccuuacguga

SEQ ID NO: 77159 - RNA, 363 nt, Artificial Sequence
  derived and/or modified sequence opt5 from TP53AIP1__Homo_sapiens__NP_001182123
augggcagcuccucugaggccagcuucagauccgcccaggccucuugcagcggggcgcggcgccaaggacugggcagaggggaccagaaccucuccgugaugcccccuaauggacgggcucagacccacacaccgggcugggucucugauccccugguucuuggggcccaggugcauggaggcugucgcggcaucgaagcccugagcguguccagcgggucuugguccagcgcuacggucuggauucucaccggacugucuagaccuuuucuucccggcgccacagugcugcgggaccgcccucucggguccgcuuucgagcugagcuacgaucaaaagaaagcuccccugagacuccaguga

SEQ ID NO: 77160 - RNA, 5928 nt, Artificial Sequence
  derived and/or modified sequence opt5 from TP53BP1__Homo_sapiens__NP_001135451
augcccggagagcagauggacccuaccgggucccaacuggauuccgacuucucucaacaggauaccccgugccucaucauugaagacucccagcccgagucccaagugcuggaagaugacucuggaagccacuuuuccaugcuuucuagacaucugccuaaccuccagacgcacaaggagaaucccguccuggauguugugagcaacccugaacagaccgccggcgaggagagaggggacggaaauuccggcuucaacgaacaucuuaaggagaauaagguggcugaucccgucgacagcucuaaccuggauaccuguggguccaucagccaggugauugaacaacucccucagcccaaucgcaccucuuccguucugggaaugagcguggagucugcccccgcggucgaggaagagaaaggcgaggaacuggaacagaaggagaaagagaaggaagaggacacauccggcaacaccacacacagccucggggcugaagauaccgccuccucucagcugggauuuggcgugcuugagcugagccaaucccaggacguugaagagaauacggugccuuacgaggucgacaaggaacagcuccaaagcgugaccacaaacucuggguauaccagacuguccgauguggacgccaauacagcuaucaaacaugaggaacagagcaacgaggauauucccaucgccgaacagucuagcaaggacaucccugucaccgcucagcccuccaaagauguucacguggugaaggagcaaaauccgccucccgcccggucugaggacaugccuuucagccccaaagcguccgucgccgcuauggaagccaaggagcagcuuagcgcucaggaacugauggagucuggacuccagauucaaaagucccccgagccugaagugcugagcacgcaggaggaucuguuugaccagucuaacaaaacaguuuccagcgauggcugcuccaccccgucucgcgaagaagggggauguagccucgccuccacacccgcgaccacccugcaccuucugcagcucucuggccaaagaagccuggugcaggacucccuuagcacaaauucuuccgaucuggucgccccuagccccgacgcuuuccggucuacgccuuuuaucgugcccuccagcccgaccgaacaggagggccgccaggacaagccuauggauacaucuguucucagcgaggaagggggagagcccuuccagaagaagcugcaguccggcgaaccuguggagcuggaaaaucccccucuccugcccgagagcaccgucucuccgcaggccuccacaccuauuagccaauccacccccguguuucccccugggucucuuccgauccccagccagccucaguucucccaugacauuuuuauccccucuccuagccuggaggaacaguccaacgauggcaagaaggacggcgauaugcacucuagcucccucacggucgagugcagcaaaacaucugaaauugagcccaaaaacuccccugaagaccuggggcuuagccugaccggagauucuuguaagcucaugcuguccaccagcgaguacucucaaucccccaaaauggagagccuguccagccauagaaucgacgaagauggcgagaacacacagaucgaagacaccgagccgaugucuccugugcucaauagcaaguucguucccgcugagaacgauuccauucugaugaauccugcccaggacggcgaagugcagcuuucucaaaacgaugacaaaacaaagggggacgauacggacacccgggaugacaucagcauucuggccacaggaugcaaaggccgcgaggaaaccgucgcugaggauguguguaucgaccucacaugcgauuccgggucucaggcgguucccagcccggccaccagauccgaagcucugucuagcgugcuggaccaggaggaggccauggaaauuaaggagcaccacccugaagagggauccagcggcucugaagucgaggagauccccgaaacgccuugugagucccagggggaggaacuuaaggaagagaauauggagagcgugccccuccaucugucucugaccgaaacacaaucccagggccucugccugcagaaagagaugcccaagaaagaauguagcgaggccauggagguggaaaccuccguuaucucuauugauagcccucaaaaacuugcuauccuggaccaggagcucgaacacaaagagcaggaagccugggaggaggcgacauccgaagauagcucugucgugauuguggacgucaaggagccgagcccccggguggauguuagcugcgaaccucuggagggaguggaaaagugcucugacagccaguccugggaggacaucgcucccgagauugaaccuugugccgagaaccgccuggauaccaaagaagagaagucugucgaauaugagggcgaccuuaaaagcgggacggccgagacagaacccguggagcaagauuccucucagccuagccucccgcugguuagagcugacgauccccugcggcucgaccaggaacugcagcaaccucagacccaggagaagacauccaauagccuuaccgaggauucuaaaauggccaacgcuaagcagcuguccagcgacgccgaagcgcaaaagcucggaaaacccuccgcccaugcuucucagagcuuuugcgaguccucuagcgaaaccccuuuccacuucacacugcccaaggagggcgauaucaucccgccucugacgggggccacaccgccccuuauuggacaucucaaacuggaaccuaagcgccacuccacacccaucggcauuagcaauuacccugagucuaccaucgcuacauccgacgugaugagcgagucuauggucgaaacccacgauccgauucugggguccggcaaaggagacagcggcgccgcgcccgacguggaugacaagcucugucugagaaugaaacuuguuucuccugagacggaagccagcgaggaaucccugcaguuuaaccucgagaagcccgcuacaggggagcggaagaauggaucuaccgccguggcugaaagcgucgccuccccucagaaaaccaugagcgugcuguccugcaucugugaggccagacaagaaaacgaggcucgcucugaagaucccccgacaaccccuauucggggcaaucugcuucauuuccccagcucccagggggaggaggaaaaggagaaacucgaaggagaccacacaaucagacagucucaacagccuaugaagcccaucagcccugugaaagaucccgucuccccggcgucucagaagaugguuauucagggcccuagcagcccccaaggggaggccauggugacggacgugcuggaggaucagaaggaaggccgcagcaccaacaaagagaaccccucuaaggcucugaucgaacggccuucccagaauaacauuggaauccagacaauggagugcagccucagagucccggaaaccgugucugccgccacacaaaccauuaaaaauguuugugagcagggcacguccaccguggaccagaacuuugggaagcaggaugcuacaguccaaaccgagcgcggaagcggcgaaaaacccgugucugccccuggggacgauacagagucccugcauagccagggagaagaggaguucgacaugccccagccuccccacggccacguucuucaucggcacaugagaaccauccgcgaagugcggacacuggucaccagagugaucacggauguuuauuacguggacgggacagaggucgaacgcaaggugaccgaggaaaccgaggaaccuauuguggagugccaagagugugaaacagaggucuccccgagccagaccggcggaucuagcggcgaccucggggauaucuccucuuuuagcuccaaggcgucuagccugcaucggacguccucuggaacaagccuguccgcuaugcacagcucuggcuccagcgggaaaggagccggcccccuuagaggcaagaccucugggacagaaccugccgacuucgcucugcccuccagccggggaggcccugggaaacucagcccccgcaagggaguuucucagaccggcacaccggugugcgaggaggauggggacgccggacugggcauuagacagggcgggaaagcgccugugacaccccggggaagaggccgccgggggagacccccuagccgcacgaccggaacaagagaaaccgcuguccccggcccucucgggaucgaggauauuuccccgaaucugagccccgacgauaagucuuuuucccgggugguuccucgcgugcccgacagcacaagacggaccgaugucggagccggcgcccuucgcagaucugacagcccugaaauccccuuccaagcugccgcuggcccguccgaugggcuggacgccucuagcccuggaaacuccuuugugggccuccggguuguggcgaaguggucuagcaauggguauuucuacuccggaaaaaucacgcgcgaugucggcgccgggaaguacaaacugcuguuugacgacggauaugagugugaugugcuuggcaaggacauucugcucugcgaucccaucccucuggacacagaagucaccgcucucagcgaggaugaguacuucucugccggcgugguuaaagggcauagaaaggaauccggagagcuguauuacagcauugaaaaagagggccagcggaagugguauaagcgcauggcugugauccuuucccuggaacaggggaacagacuccgggagcaguacggacugggccccuaugaggccgucacaccucugaccaaagccgcugacauuucucuugauaaucugguggaagggaagagaaaacgccggagcaacguuuccucucccgcgaccccgacagccagcuccuccucuuccacgaccccuacaagaaagaucaccgagagcccccgcgcuucuaugggagugcucuccggcaaacggaagcugaucacaagcgaagaggaaagaucucccgccaagcgcggccggaaauccgccaccgucaagccugugggggcuggagaguuugugagcccgugcgagucuggcgacaauacgggggaacccagcgcccucgaggaacaaagaggaccucugccccuuaacaaaacacuguuccugggcuacgcguuccuccugaccauggcuaccacauccgauaaacuugccagccgcuccaaacugccugacgggcccaccggaucuagcgaggaggaagaggaauuucucgagauuccucccuucaauaagcaguacacagaaucccagcugcgggccggcgcuggcuauauccucgaggauuuuaacgaggcccaguguaauacggcguaccaaugccugcuuauugcugaccagcacuguagaacccggaaguauuuccugugccuggccucugggaucccguguguuagccacgucugggugcaugacuccugccacgccaaccagcuccagaacuaccgcaauuaucugcuuccugcuggauacucucuggaggagcaacggauucucgauuggcagccccgggaaaacccuuuucagaaucugaaagugcuccuggucagcgaccaacagcagaacuuccuugagcugugguccgaaauccugaugacaggcggggccgcuagcgugaagcagcaucacucuuccgcccauaauaaagauauugcgcucggaguuuuugacguggucgugaccgaucccagcuguccggccucuguucugaagugcgcugaggcccuucaacugccuguggucucccaggagugggugauccagugucucaucguuggcgaacgcauuggguucaaacagcaccccaaguauaagcacgacuacgugagccauuga

SEQ ID NO: 77161 - RNA, 3405 nt, Artificial Sequence
  derived and/or modified sequence opt5 from TP53BP2__Homo_sapiens__NP_001026855
augagauucggcagcaagaugaugcccauguuucugaccguguaccucuccaacaaugagcagcacuucacagaagucccuguuacgccggagaccaucugccgggacgugguggaucuguguaaagaacccggggagucugacugccaucuugccgaagucugguguggaagcgagcgcccuguggcugauaacgagagaauguuugacguucugcaacgguucggcucccagcgcaaugaagugagauuuuuccuccggcacgagagacccccugggagagauauugucucuggaccccggagccaggacccuucccugaagcgcaacggcgugaaaguuccgggggaauauagacggaaggagaauggagugaacucuccccgcauggaucuuacacuggccgagcuccaggaaauggcgagcagacaacagcagcagaucgaggcucaacagcagcugcuggccaccaaagaacagcggcucaaguuucugaagcaacaggaccagcgccaacagcagcaggucgccgagcaagaaaaacuuaagagacugaaagagauugcugagaaucaggaagccaagcucaaaaaggugcgggcucugaagggccauguggagcagaaaagacuuuccaacggcaagcuggucgaagagaucgaacagaugaauaaccucuuccaacagaaacagcgcgagcugguucuggccgugagcaagguggaggaacucacacggcagcuggagaugcuuaaaaaugggagaauugauucucaccaugacaaccaauccgcggucgccgaacuggaucgccucuacaaggagcugcagcuucggaauaaacugaaccaggaacagaaugcuaagcuccaacagcagagagagugccugaacaagcgcaacagcgagguggccguuauggacaaacgggugaaugaacugagagaucgccucuggaagaaaaaggcugcccugcaacagaaagagaaccuuccugucucuuccgacggaaaucugccccagcaggcggccagcgcuccuucucggguggccgcuguuggccccuauauccaauccagcaccaugccgagaaugccuucccgccccgaacuccuggugaagccugcccuucccgacgggucucuggucauccaggccagcgagggacccaugaagauucagacacucccuaacaugcgguccggcgcugcgagccagaccaaagggucuaagauccacccggugggacccgauugguccccuagcaaugccgaccuguuucccucucaaggcagcgcuuccgucccucagucuacgggcaacgcccuggaucagguggacgauggggagguuccccucagagaaaaagagaagaaagugcggccguucagcauguuugacgccgucgaucaguccaaugcuccucccagcuucggaacccugcgcaagaaccaaucuuccgaagacauucuuagagaugcccagguggcgaauaagaacguugcuaaagugccucccccuguccccacaaagccgaaacagaucaaucugccuuacuuuggccaaaccaaccagccucccagcgacauuaagcccgaugggucuucccagcagcucagcacaguggugccguccaugggaaccaaacccaagccugccggccaacagccccggguucugcugucuccuagcauccccuccgucgggcaggaccagacgcuuucuccuggaagcaagcaagaguccccgcccgccgcugccgugagaccuuucacaccccagccuagcaaagacacccuccugcccccguuccgcaagccucagacaguggcugccucuuccauuuauagcauguacacccagcaacaggcgcccggcaaaaauuuucagcaggccguccaaucugcucugaccaagacacacacgcggggcccucauuucuccagcguguaugggaaacccguuaucgccgcugcccagaaccagcaacagcaccccgaaaauaucuacucuaacagccagggaaagccuggcuccccggagcccgagaccgaaccugugagcucuguccaggagaaccaugaaaaugagcgcauuccccgcccucucucccccacaaaacugcuuccuuuucugagcaacccguacagaaaucaauccgaugcggaccucgaagcccugcggaagaagcugucuaacgcuccccgcccucuuaaaaagagaagcuccaucaccgagcccgaggggccuaauggacccaacauucagaaacuccuguaucagcggacaaccaucgccgcuauggaaacgauuucugugccgagcuacccuuccaagucugccagcguuacagccuccagcgagucucccguggaaauccagaaucccuaucugcacgucgagccugaaaaagaggugguuucccucgugcccgagagccugucuccugaagaugucggcaacgcuuccaccgagaauagcgacaugccggcgcccucuccugggcuugauuacgaacccgagggcgugccugacaacucccccaaucugcaaaacaauccggaggaaccuaaccccgaggccccucacgugcucgaugucuaucuggaagaguacccucccuaucccccgccucccuaccccagcggagaaccugagggcccgggggaggacuccguuagcaugagacccccugaaaucaccggacaggugucucugcccccuggcaagcgcacaaaucuucggaagaccgggagcgagcgcauugcucauggaaugagagugaaauucaacccccucgcccugcugcucgauuccucucuggaaggcgaguuugaccuuguccagcggaucauuuacgaaguggaugacccuagccugccgaacgaugaggggaucacagcccuccacaaugcuguuugugccggccauacggagauugugaaguuccugguccaguuuggagugaacguuaaugcggcugacuccgacggcuggacaccccugcacugcgccgccucuuguaacaaugugcaagucugcaaauuccuuguggaaagcggggcugccguuuuugcgaugaccuauuccgauaugcagaccgcugccgacaagugugaggaaauggaggaaggauacacacagugcucucaauuccucuauggcgugcaggagaaaauggggaucaugaacaagggagucaucuacgcccugugggauuaugagccucagaaugacgaugaacugcccaugaaggagggcgacuguaugaccauuauccaucgcgaagaugaggacgagauugaaugguggugggcuagacucaacgauaaagagggguacgugccucggaaucugcuuggccuguaucccagaaucaagccgcgccagcggagccucgccuga

SEQ ID NO: 77162 - RNA, 1182 nt, Artificial Sequence
  derived and/or modified sequence opt5 from TP53__Homo_sapiens__NP_000537
auggaggaaccccagagcgacccuuccguggagccgccccugucucaagaaaccuucagcgaucucuggaagcugcuuccugagaacaauguccugucuccccucccuucccaggccauggacgaucugaugcuuagccccgacgauaucgaacagugguuuacagaggacccuggcccggaugaggcucccagaaugccugaagccgcgcccccuguugcucccgccccggccgcuccuacgcccgccgcuccugcccccgcgcccuccuggccucugucuagcuccgugccgagccagaaaaccuaccaagggucuuauggauuccggcucggcuuucugcacuccgggacagccaagagcgugaccugcacauacucucccgcucugaacaaaauguucugucagcucgccaagaccugcccuguccagcuguggguggacuccacacccccucccggaacccgcguuagagcuauggccauuuauaaacagagccaacauaugacggaggugguccggcgcuguccgcaccaugaaagaugcucugauuccgacggccuugcgccuccccagcaccugauccggguggaggggaaucuccgcguugaguaccuggaugacagaaacaccuuucggcauagcguggucgugccuuaugaacccccugaggugggauccgauuguacaaccauucacuacaauuauaugugcaacucuagcuguaugggcggcaugaaucgcagacccauccuuacaauuaucacccuggaagacuccagcgggaaccuccugggacgcaauucuuucgagguccggguuugcgccuguccgggcagagaccggcgcacggaagaggagaaccugagaaagaagggggaaccucaccaugagcucccucccggauccacaaaacgggcucugcccaauaacaccagcucuagcccgcagcccaagaaaaagccucuugauggcgaauacuuuacacugcagaucagagggcgcgagcgguucgaaauguuuagagagcucaaugaggcccuggaacuuaaagacgcucaagccggaaaggagcccggcggcucccgcgcccacucuagccaucugaaguccaaaaaggggcagagcaccucucggcacaaaaagcucauguucaaaaccgaaggaccugauuccgacuga

SEQ ID NO: 77163 - RNA, 570 nt, Artificial Sequence
  derived and/or modified sequence opt5 from TP53I11__Homo_sapiens__NP_001245253
auggccgcuaagcagcccccuccgcugaugaaaaagcacagccaaaccgaccucguguccagacugaaaacacggaagauccuuggcgucgggggagaggaugacgauggcgaaguucaucgcucuaaaauuagccaggugcuggggaacgagaucaaguucacgauuagagaaccccucggacugcggguguggcaguuugucuccgccgugcuuuucucuggcaucgcgauuauggcucuggccuuuccugaccagcucuacgaugccguuuucgacggggcucaagugaccagcaagacacccauccgccuguauggaggcgcccugcucuccaucucucugauuauguggaaugcucuuuacaccgccgagaaagucaucauuagauggacacugcucaccgaagcgugcuauuuuggcgugcaguuccugguugugacagccacccuugcugagacggggcugaugagccucggaauccugcugcuccuggucucccggcuucuguuuguggugauuagcaucuacuauuacuaucaggucggccgcagaccuaagaaagccuga

SEQ ID NO: 77164 - RNA, 1182 nt, Artificial Sequence
  derived and/or modified sequence opt5 from TP53I13__Homo_sapiens__NP_612358
auggccccgccuccgcccagcccucagcuccuccugcuugcugcccuggcgagacuccugggccccuccgaggugauggcugggccugccgaagaggccggagcucacugccccgaaucucuuuggccucugccgccccaagucagcccucggguuaccuacacacgcgugucccccggccaggccgaggacgugacguuccucuaucauccuugugcucaccccuggcugaagcugcagcucgcccugcuugcguacgccugcauggcuaacccgucucugaccccugauuuuagccucacacaggacagaccccugguccuuaccgccugggggcuggcucucgaaauggccuggguggagccugcgugggccgcucauuggcugaugcggcgcagacggcgcaaacaaagaaagaaaaaggccuggaucuauugugagucccugucuggacccgcucccagcgaaccuacaccgggccgggggcgccucugcagacggggauguguucaggcccuggcccuugcuuucgcgcugcgcuccuggagacccccuggcaccgaggugacaagccagggcccccggcagccuucuuccagcggggccaaacgcagacggcucagagcugcccugggaccccaaccgacccgcucugcccuucgguuuccuuccgcuagccccggcucucugaaggccaagcaguccauggcggggauuccuggaagagaaagcaaugcucccuccgucccuacggugucucuccugcccggcgcccccgggggaaacgccagcucccgcaccgaggcucagguuccuaauggccagggcagccccgggggaugcguguguucuucccaagccagccccgcuccucgggccgcggccccgcccagagcugcccgcggcccuacaccccggaccgaggaagcugccugggcggccauggcucugacauuccuccugguccuucugacccucgccacgcugugcacaagacuucaccgcaacuuucggagaggggagucuaucuacuggggaccuaccgcugauagccaggacacaguggccgccgugcugaaacgccggcuccugcagcccuccagacgggucaagcgcucuagacggagaccucugcugcccccgaccccugauagcggccccgaaggggaguccagcgaauga

SEQ ID NO: 77165 - RNA, 747 nt, Artificial Sequence
  derived and/or modified sequence opt5 from TP53I3__Homo_sapiens__NP_001193731
augcuggccgugcacuucgacaagcccggcgggccugagaaccucuacgucaaagaaguugcuaagccgagccccggagagggcgaagugcugcuuaaaguggccgcguccgcucugaauagagccgaucucaugcagcggcaagggcaguaugacccucccccuggagccucuaacauccugggccuugaggcuagcgggcaugucgccgaacugggacccggcugccagggccacuggaagauuggggauaccgcuauggcccuccugccuggaggcgggcaggcgcaauacgugacaguuccggagggacugcucaugcccaucccugagggccugacgcuuacccaggccgcugccauucccgaggcuuggcugacagccuuucagcuccugcaucuuguggggaauguccaggcgggagacuaugugcugauccacgccggccucuccggcguugggaccgcugccauucaacugacacgcauggcuggagccaucccucuggugaccgccggcucucagaaaaagcuccagauggcugaaaagcugggggcggccgcuggauucaacuacaaaaaggaagauuuuagcgaggccacacuuaaauucaccaagguccaggccaaugcuggcgaguguuuucauggggccaacuccgcgucucugcuccacggagggcccccgacgagcgcugccggcuccggccaaaaucugccuagcgacagaaaccccggaggcccuuga

SEQ ID NO: 77166 - RNA, 495 nt, Artificial Sequence
  derived and/or modified sequence opt5 from TP53INP1__Homo_sapiens__NP_001129205
auguuccagagacugaacaagauguuugugggcgaggucagcuccucuagcaaucaagaacccgaguucaacgaaaaagaggacgaugaauggauccucguugacuuuauugauaccugcacaggguucuccgccgaggaggaagaggaagaggaggacaucucugaagagagcccuacggaacacccguccguguuuucuugucugcccgcuagccuugagugccuggccgauaccuccgacagcuguuuccuccaguuugaaucuugcccuauggaggaguccugguucauuacacccccucccuguuuuaccgcgggaggccugacaaccaucaagguggaaacaagcccuauggagaaucuucugauugaacauccgucuauguccgucuacgcugugcacaacagcugccccgggcucucugaggccacccggggaacggaugaacugcauuccccuagcucuccccgcgccagaaaauccugucuguga

SEQ ID NO: 77167 - RNA, 663 nt, Artificial Sequence
  derived and/or modified sequence opt5 from TP53INP2__Homo_sapiens__NP_067025
auguuccagagacugagcucccucuuuuucucuacccccagcccuccggaggaccccgauugcccucgggccuuuguguccgaagaggacgaagucgauggcuggcugaucauugaccuucccgauucuuacgcugccccucccagcccuggggcggcuccggcccccgccggacgcccucccccugcucccucccugauggacgagucuugguucguuacaccgccugccuguuuuacggcugaaggccccgggcucggaccugccagacugcaaagcagcccccuugaggaucugcucaucgagcaccccuccaugucuguguaugugaccggcuccacaauuguccuggaaccugggagcccgucuccccugccugacgcggcccuccccgauggagaccuguccgagggcgaacuuaccccugcucggcgcgagcccagagccgcucggcaugccgcgccgcugccugcccgcgcugcccuccuggagaaggcuggccaggugagacggcuucagcgcgccagacagcgggccgaacgccacgcucugagcgcgaaagccguucaaagacagaaccgggcucgcgagucuagaccccggagauccaagaaucagagcuccuucaucuaccagccuugccaacgccaguuuaacuauuga

SEQ ID NO: 77168 - RNA, 762 nt, Artificial Sequence
  derived and/or modified sequence opt5 from TP53RK__Homo_sapiens__NP_291028
auggccgcugccagagcgaccacacccgcugacggcgaggaaccugccccggaggccgaagcucuggccgcugcccgggagcgcagcuccagauuccucucugggcuggaacuugugaagcagggagcggaggcccgggucuuucgcggcagauuccaagggcgggcugccguuaucaaacaccgcuuucccaagggauacagacauccugcucuggaggcccggcucggccgcagacggacggugcaggaagcgcgcgcccugcuuagaugccggcgcgcugggauuagcgcccccguggucuucuuuguggauuaugcuuccaacugucuguacauggaggaaaucgagggaucuguuaccgugagagacuauauucagagcacaauggagaccgagaaaacaccucagggccucuccaaucuggccaagaccaucggccaaguccuggcccggaugcacgaugaagaccucauucauggggaucugacaaccucuaacaugcuucugaaacccccucucgaacagcugaauaucgugcuuaucgacuucggacugagcuuuauuuccgcucucccggaggauaagggcguugaccuguacgugcuggaaaaggcguuccucagcacgcaccccaacaccgagacagucuuugaggccuuccugaaaucuuauuccaccagcucuaagaaagcuagaccugugcuuaagaaacuggaugaagugcgccuccgggggagaaagcgcuccauggucggauga

SEQ ID NO: 77169 - RNA, 375 nt, Artificial Sequence
  derived and/or modified sequence opt5 from TP53TG3C__Homo_sapiens__NP_001192188
augagagccagccccugcaucucccagccugcugccucuuggcacccgcggcccagcgcgcugcgcccuaccgcuggcuccgggcccgacacaagaacgccuggaaccguggaggauggcucugcccccuguccugccuuccggagcccggcugucucccccugcggggaggaaccuuguugcuuucaaauuucucccgccgaagagacacucgaacugggacgccuuguuagcccuggcaacugugacacccugucccccagagcugccggguucuacgcgugccaugugcggagccucaucccgugucgcucuacaaagggaagauggccucugaccgccuccgcugccggccuuagcucuuuuuccggcuga

SEQ ID NO: 77170 - RNA, 1668 nt, Artificial Sequence
  derived and/or modified sequence opt5 from TP63__Homo_sapiens__NP_001108450
augaacuucgagaccagcagaugcgccacacugcaguacugucccgacccuuauauccagcgguuuguggaaacgccggcucacuucuccuggaaggagucuuacuaucgcagcaccaugucccagucuacacagaccaaugaauuucucagccccgaggucuuccagcauauuugggauuuucuggaacaaccuaucugcuccguucagcccauugaccuuaacuucguggaugagccuucugaggacggcgccacaaauaagaucgaaauuagcauggauuguaucagaaugcaggacuccgaucugagcgaccccauguggccucaguacaccaaccucgggcugcuuaauucuauggaucaacagauccagaacggauccagcucuacauccccguauaauaccgaccacgcgcagaacagcgugacggcucccucuccuuacgcccaacccuccagcaccuuugaugcccuguccccuucucccgcuauuccgagcaauacagacuauccuggcccccauuccuucgaugucagcuuucagcagucuuccaccgccaagagcgcuacauggaccuacucuacggagcucaaaaagcuguacugccaaaucgccaaaacauguccuauucagaucaaggugaugaccccuccgccccagggggcgguuauucgggccaugcccguguauaagaaagcugaacacgucacagaggugguuaagcgcugccccaaccaugagcugagcagagaguucaaugaaggacagaucgccccucccucccaccucauucggguggaaggcaacucucacgcucaauacgucgaggacccuaucaccgggcgccagagcgugcuggugcccuaugaaccgccucaggucggaaccgaguuuacaacgguucuuuacaauuucauguguaacuccagcugcgugggcggcaugaauagacggcccauccugauuaucgugacccucgagacacgcgacgggcagguccugggaagacgguguuuugaagcccgcauuugcgcguguccuggcagagaucggaaagccgacgaggauucuauccgcaagcaacagguguccgacagcaccaaaaacggggauggaacaaagagacccuuccggcagaacacccauggcauucagaugacgucuaucaagaaaagacgcuccccugacgaugaacuucuguaucuccccguucgggggagagagacauacgaaaugcugcugaagaucaaagagagccucgagcugaugcaauaucuuccgcagcacaccauugaaaccuaccgccagcagcaacagcagcaacaucagcaucugcuccagaagcagacauccauccaaucuccuagcuccuacggaaauucuagcccuccccugaacaaaaugaacuccaugaauaaacuucccagcgugucucagcugauuaauccgcagcagcggaacgcucucacccccacaacgaucccugacggcaugggcgccaauauucccaugauggggacccacaugccuauggcuggagauaugaacggccugucccccacacaagcccugccucccccgcucagcaugccuucuaccucccacugcacacccccucccccguauccuaccgacugcagcaucgucagaaucuggcaaguguga

SEQ ID NO: 77171 - RNA, 1911 nt, Artificial Sequence
  derived and/or modified sequence opt5 from TP73__Homo_sapiens__XP_011540366
auggcccagagcaccgcuacaucccccgacggcgggacgaccuucgagcaccuguggucuagccucgaaccugauuccacauacuuugaccugccgcaaucuagcagaggaaacaaugagguggucggcgggaccgauuccucuauggacguuuuccaucuugaaggaaugacaaccagcgugauggcccaguuuaaccugcucuccagcacaauggaucagaugucuucccgggcggcuagcgccucucccuauaccccugagcacgccgcuuccgugcccacgcauagcccuuacgcccagcccucuuccaccuucgacacaaugagcccugcuccggucauccccuccaauaccgauuauccuggcccccaccauuuugaagugacauuccaacagucuagcaccgccaaguccgcgacguggacauacagcccucugcuuaaaaagcuguauugccagauugccaaaaccugucccauccagauuaagguuucuacaccgccucccccugggaccgcuauccgcgccaugcccguguacaaaaaggcugagcacgucaccgacgugguuaagagaugccccaaccacgagcucggacgggauuuuaaugaaggccaauccgccccugcgagccaucugauucgcguggagggcaacaaucugucucaguaugucgacgauccggugacagggagacagagcguggucguucccuacgaaccuccccaggugggaacggaguucaccacaauccucuacaacuuuauguguaauuccucuugcgugggcgggaugaaccggcgcccuauccugauuaucauuacccuugagaugagagacggacaaguccugggccggcgcagcuucgaagggagaaucugugccugccccggacgggaucgcaaagcugacgaggaccacuauagagaacagcaggcccucaaugaguccagcgcuaagaacggcgccgccucuaaacgggcuuuuaagcaauccccgccugcggugcccgcccugggcgcugggguuaaaaagcgcagacauggagaugaagacacauacuaucuucaggugcggggcagagagaauuucgagauucugaugaagcucaaagaaagccuggagcugauggaacucgucccucagccccugguggauucuuaccgccagcaacagcagcuucugcagcggccuucccaccuccaacccccgagcuaugggccuguucugucccccaugaacaaggugcacggaggcaugaauaaacuucccucugucaaccagcugguggggcagccuccgccccauagcuccgccgccaccccuaaccucggacccgucggcccuggcaugcugaauaaccacgggcaugcugugcccgccaauggagagaugucuagcucccacagcgcgcagucuaugguuuccggcagccauuguacgccucccccgccuuaccacgcugaccccucucugguguccuuucucacagggcugggaugcccuaacuguaucgaauauuucaccagccaaggccuucagucuauuuaccaucugcagaaucucaccaucgaggaucugggggcccuuaagauccccgagcaguacagaaugacaauuuggcgcggccugcaagaccucaaacagggacacgauuauagcaccgcccagcaacugcugcgguccagcaacgcugccacaaucucuauuggcggguccggagaacuccagagacagcgcgucauggaggcugugcacuuccggguuagacauacgaucaccauuccgaaucgcggcgggccuggaggcgggcccgacgaaugggccgauuuuggcuucgaccugccugauugcaaggcgcggaaacagcccaucaaggaggaauuuacagaggccgagauccacuga

SEQ ID NO: 77172 - RNA, 1263 nt, Artificial Sequence
  derived and/or modified sequence opt5 from TPBG__Homo_sapiens__XP_011534399
augcccggcgggugcagcagaggaccugccgcuggcgacgggcggcugcgccucgccagacuggcgcuugugcugcucggaugggucuccucuagcuccccgaccucuagcgcuuccucuuucagcuccagcgcccccuuucuggccucugcuguuuccgcccagccuccccuuccugaucaaugucccgcucugugcgaguguagcgaagccgcgcggacagugaagugcgugaaccgcaaucucacggaggucccuaccgaccugccggccuacgugagaaaccuguuccucacaggcaaucagcuggcuguucuucccgccggggcuuuugcccggcgcccuccccuggcggaacucgccgcucugaaccuuucuggauccagacuggaugaggugcgggccggcgcuuucgaacaccucccuagccugcgccagcuggaccucucucauaauccccuggccgaucuuuccccguuugccuucagcggcuccaacgcuucugucagcgcgccuagcccccugguggagcucauccugaaucacauuguuccucccgaggacgaaagacagaaccgguccuuugaggggaugguggucgccgcccuucuggcuggacgcgcccuccaaggccugagacggcuggaacucgcuucuaaucauuuccuguaucuuccccgcgaugugcuggcccagcucccuucccugagacaccuugaccugagcaacaauucucucgugagccugaccuacgucuccuuucggaaccugacacaucucgagucucugcaccuugaggauaaugcgcugaaaguucuccacaacgggacccuggcugaacugcagggacuuccgcauaucagaguguuccucgacaauaaccccugggugugugauugccacauggccgacauggucacauggcugaaggagaccgaagugguucagggcaaagaucgccugacgugugccuauccugagaagaugcggaacagagugcuccuggaacuuaauagcgcugaccuggacugcgaucccauucucccucccucccugcaaaccagcuacgucuuucuggggaucgugcuugcccucauuggagcuaucuuccugcugguucucuaucugaaccgcaaaggcaucaagaaguggaugcauaauauucgggacgccuguagagaucacauggagggcuaccacuaucgcuacgagaucaacgcggacccgcggcuuacaaaucugucuuccaacagcgauguguga

SEQ ID NO: 77173 - RNA, 2667 nt, Artificial Sequence
  derived and/or modified sequence opt5 from TPCN1__Homo_sapiens__NP_001137291
auggagagcugcuacaucgcccaggcuggccuggaacuccugggguccucuagcucccccacccuuacaucucaaagcgccgagauuacggaagacgcguccaacggaggcgugucugagcagcacccuuggccgagcggguucgaaagagagcugaagcccgagaccaucuccagcccuggauaucauauucuccgggcuacaggcgaagagaauauggccgucucucuggaugacgauguuccccuuauccugacccucgacgaagggggauccgccccucuggcucccagcaacggccugggccaggaggagcucccuucuaaaaaugggggauccuacgccauucacgauagccaggcuccgucucuguccagcggcggggaauccucucccagcuccccugcccauaacugggagaugaauuaucaagaagcggccaucuaccuucaggagggagaaaacaaugacaaguuuuucacacaccccaaagaugcuaaggcccuggcugccuaucucuuugcgcauaaccaccuguucuaccuuauggagcuggccaccgcucuccugcugcuccugcuuagccugugugaggccccugcugugcccgcccuccgccugggcaucuaugugcacgccacacuugaacuguuugcucucauggucgugguuuucgagcugugcaugaaacugagauggcucgggcugcauaccuuuauucggcacaagcgcacgauggugaagaccucuguccuugugguucaguucguggaagcgaucgucgugcuggugagacagaugucccauguccggguuacacgcgcccucagauguauuuuucugguggacugccgguacuguggaggcgugcgcagaaaucuucggcaaaucuuccagagccugccgccuuuuauggauauucuccugcugcuccuguucuuuaugaucauuuucgcuauccuuggcuucuaccuguuuucucccaacccuagcgaccccuauuucuccacccucgaaaauucuaucgucagccuguuugugcugcuuacaaccgccaacuuccccgauguuaugaugccuuccuacagccgcaauccguggucuugcguguuuuucauugucuaucucuccaucgaacuguacuuuauuaugaaccugcuccuggccgugguuuucgacacguuuaaugauaucgagaaaagaaaguucaaaagccuucugcuccacaagcggacagcuauucagcacgccuaucgccugcugaucucucagagacggcccgcggggaucuccuacagacaauuugagggacuuaugcgcuucuauaaaccucggaugagcgcuagagaacgcuaccucaccuuuaaggcccugaaccagaacaauacaccccugcucucccugaaggacuucuacgacauuuaugagguggccgcucuuaaauggaaggccaaaaagaaccgggaacauugguucgaugagcugccuagaaccgcucuccugaucuuuaaaggcauuaauauccuggucaagucuaaagccuuccaguacuuuauguaucuuguggucgcggugaacgggguuuggauucucguggaaaccuucaugcugaagggaggcaauuucuucagcaagcacguccccugguccuaccugguguuucucacaaucuaugggguugagcuguuccuuaaaguggccggacugggcccggucgaguaccucucuagcggcuggaaccuguuugacuucuccgugacgguguuugcuuuccuggggcuucucgcccuggcucugaauauggaaccuuuuuauuucaucguuguccuccgcccccugcaacuucugcggcucuuuaagcugaaagagagauaccgcaacgugcuggauaccauguuugaacuucugccucggauggccagccucggacugacacuccugauuuucuacuauucuuuugcgaucgugggcauggaguucuuuugugggauugucuuccccaauugcuguaacaccuccacaguggccgacgcuuacagauggcgcaaucauaccguuggaaaccggacgguggucgaggaaggcuauuacuaucuuaauaacuuugauaauauccugaacagcuucgugacacucuuugagcugaccguugugaacaauugguacauuaucauggaaggggucaccucucagacaucccacuggagcagacuguauuucaugaccuuuuacauugugacaaugguugugaugacgaucaucgucgccuucauucuugaggcuuucguguuucggaugaacuacucucgcaagaaucaggacagcgaaguggauggcggaaucacccuggagaaagagauuuccaaggaggagcucgucgccguucuggaacucuauagagaggcccggggcgcuagcucugacgugacaagacugcuugaaacccugucccagauggagcgcuaccaacagcauagcaugguguuccucgggcggagaucccgcacaaagucugaucugagccugaaaauguaucaggaggaaauccaggagugguacgaggaacacgcgagagaacaagagcagcagcggcagcuuuccucuagcgccgcuccugccgcccaacagcccccgggaucccgccagagaucucagaccgucacguga

SEQ ID NO: 77174 - RNA, 2259 nt, Artificial Sequence
  derived and/or modified sequence opt5 from TPCN2__Homo_sapiens__NP_620714
auggccgagccccaggcugaaagcgagccucugcucggcggggccagaggaggcgggggagacuggccggcgggccugaccacauaccgguccauccaaguggggcccggagcugccgcccgcugggaucuuugcauugaccaggcugucguuuucaucgaagaugccauucaguauagaucuaucaaccaccggguggacgcuagcuccauguggcuguaccgcagauauuacucuaaugugugucagcggacgcucagcuuuaccauuuuccugauccuuuuucuggccuucaucgagacaccuuccucucucaccagcacagcggauguccgcuauagagccgcucccugggaaccucccugcggccugaccgaguccguggagguucugugucuccugguguuugccgcugaccuuagcgucaagggcuaccuguucgggugggcccauuuucagaaaaaccucuggcugcuuggauaucuggugguucucguggucucucugguggauuggacagugucccugagccucgucugccacgaaccucugcggauucgcagacuucugcggccguucuuucuccugcaaaauucuuccaugaugaagaaaacccuuaaguguauccgcuggagccugcccgagauggcgucuguuggccuccugcuggccauucaucucugccuguucacgauguuugggaugcuucuguucgcuggaggcaaacaggacgaugggcaggacagagaacggcucaccuacuuucaaaaccugccugagucccuuacaagccugcucgugcugcugaccacagccaauaaccccgaugugaugaucccugcuuacuccaagaaucgcgccuaugccauuuucuucaucgucuuuaccgugauuggaucucucuuccugaugaaccuucugacggcuaucaucuacagccaguuuagaggcuaucucaugaagucccugcagacaagccuguuccggagacgccuuggcacccgggcggccuuugagguucucucuuccauggugggggaaggaggcgcuuucccccaggccgucggggugaaaccgcaaaaucugcugcagguucuccagaaggugcaacuggacagcucucacaaacaggccaugauggagaaggucagaagcuacggauccgugcuucugucugcugaagaguuucagaaacucuucaacgaacuggaucgcagcgucgugaaggagcauccuccccggccugaguaucagucccccuuucugcaaagcgcccaguuccuuuuuggccacuacuauuucgacuaccucgggaaucugauugcgcuggcuaaccucguuucuaucuguguguuucugguccuugacgccgaugugcugcccgccgaaagagacgauuucauucucggaauccugaauugcguuuucauuguguacuaucugcuugagaugcuccugaaggucuuugcucugggccuccgcggcuaccuguccuauccuagcaacguguucgacgggcuucugacagugguucuccugguccuggaaaucucuacccuugccguguaccggcucccgcaccccggauggagaccugagauggugggccugcugucccucugggauaugacccgcaugcugaauaugcuuaucgucuuucgguuccugagaauuauccccagcaugaaacucauggcugugguugccuccacagugcuggggcugguccagaacaugcgcgcguuuggaggcauucuugugguuguguauuacgucuucgccaucauugggaucaaccuguuucggggcgugaucguugcucucccuggaaauucuagccuggcccccgcuaacggcuccgccccgugugggucuuucgaacagcucgaguauugggcgaauaacuuugacgauuucgccgcugcccuggugacgcuuuggaaucugauggucgugaacaauuggcaaguguuucucgacgcuuacagacgguacagcggaccuugguccaagauuuauuucguccugugguggcugguuagcucugugaucugggugaaccuuuuucuggcccucauucuggagaauuuccuccauaaaugggauccccgcucccaccuccagccucuugccggcacccccgaagcuacauaccagaugaccgucgagcugcuguucagagacauccuggaggaaccuggggaagaugagcugacagagcggcuuagccagcauccccaccuguggcucugcagauga

SEQ ID NO: 77175 - RNA, 675 nt, Artificial Sequence
  derived and/or modified sequence opt5 from TPD52__Homo_sapiens__NP_001020423
auggacugcagagagauggaucuguacgaagacuaucagagccccuucgauuuugacgccggcgugaacaaguccuaccucuaucugucuccuagcggaaauuccucuccgcccgggagcccuacccuucaaaaauucggccugcuccggacagaucccgucccugaggaaggggaggacguugcugccacgaucuccgcgaccgaaacacugucugaggaggaacaggaggaacuucgcagagagcuggcuaagguggaggaagagauucagacccucagccaggugcuggccgccaaagaaaagcaccuggcugagaucaaacggaagcucggaauuaacucccugcaagaacuuaagcagaauaucgccaaaggcuggcaggaugucacagcuaccagcgccuacaagaaaacaucugagacccugucccaggcggggcaaaaggccagcgcugccuuuucuuccgugggaagcguuauuacgaaaaagcucgaggacgugaagaacucucccaccuucaaauccuuugaagagaaggucgaaaaucugaaaagcaaggugggcggcacaaaaccugcugggggagauuucggcgagguucuuaacuccgccgcgaaugccucugcuaccacaaccgaaccgcugcccgagaagacgcaggagagccucuga

SEQ ID NO: 77176 - RNA, 435 nt, Artificial Sequence
  derived and/or modified sequence opt5 from TPD52L1__Homo_sapiens__NP_001003396
auggaggcccaggcucaaggccugcucgaaaccgagccccugcaggggacagacgaagaugccguggcgagcgcugacuucuccucuaugcuuagcgaggaagagaaggaggaacugaaagccgagcucguccagcuggaagaugagaucacgacccuuagacagguucuguccgccaaggagcggcaccucguggaaauuaaacaaaagcugggaaugaaccugaugaaugagcucaaacagaacuuuucuaagagcuggcaugacaugcagacaaccacagcuuacaagaaaacccacgaaacacugucccaugccggccagaaggcuaccgccgcguucucuaauguggggacggccaucagcaaaaaguuuggagauauguccuauagcauucgccacucuaucuccaugccugcuaugagacggaaauga

SEQ ID NO: 77177 - RNA, 492 nt, Artificial Sequence
  derived and/or modified sequence opt5 from TPD52L2__Homo_sapiens__NP_001230821
auggacagcgccggccaggggguggcugccagaacccccgcggucgagggacugacagaagcugaggaagaggaacuccgggccgagcugacgaagguugaggaagagaucgugacccuucgccaagugcuggccgcuaaagaaagacacugcggcgagcucaagcggcgccuggggcuuuccacacugggagagcucaaacagaaccugucuagaagcuggcaugauguccagguguccucugccuacaagaaaacccaggaaacacugagccaagcuggccagaagaccuccgccgcgcucucuacaguugggagcgccauuucccggaagcugggagacaugcgcaauagcgcuaccuucaaaucuuuugaggauagagugggcacgaucaaguccaaagucgugggcgaccgggaaaacgggagcgauaaucuuccuucuuccgccggaagcggcgacaagccgcugucugaucccgcuccuuucuga

SEQ ID NO: 77178 - RNA, 774 nt, Artificial Sequence
  derived and/or modified sequence opt5 from TPGS2__Homo_sapiens__NP_001258879
auggaggaagaggccagcucccccggccuggggugcucuaagccucaccucgaaaaacugacccuuggaaucacacggauucuggagagcuccccgggcgugacggaagucaccaucauugagaagcccccugcugagagacauaugaucucuagcugggaacagaaaaacaauuguguuaugcccgaggacgugaagaacuucuaccucaugacaaauggguuucacaugaccugguccgugaaacuggaugccucugacgaucaaccugaaaagccccauuucgacagccgcuccgucauuuuugagcuugauagcugcaacggaucuggcaaggugugucugguuuauaaauccgggaagccugcgcucgcugaggacacagaaaucugguuccuggauagagcccuguacuggcacuuucucaccgacacauucaccgccuauuaccggcugcuuaucacgcaucugggacucccgcaguggcaguaugcuuuuaccagcuacggcauuucuccccaggccaaacaaugguucuccauguauaagccuaucacauacaauaccaaccugcuuacagaggaaaccgauagcuuugugaauaaacuggaccccucuaaggucuucaaguccaaaaacaagauugugaucccuaaaaagaaaggccccguucagccggcugggggacagaagggcccuagcgggcccuccggaccuucuacgagcuccacaagcaaaucuuccagcggcucugggaaucccacccgcaaguga

SEQ ID NO: 77179 - RNA, 1335 nt, Artificial Sequence
  derived and/or modified sequence opt5 from TPH1__Homo_sapiens__NP_004170
augaucgaggacaacaaggaaaauaaagaucacagccuggagagaggccgggccucccucauuuucucucugaagaacgaagucgggggacuuaucaaagcucugaagauuuuucaggagaaacaugugaaucuccugcacaucgaaagccgcaaguccaagagacggaacucugaguucgagauuuuuguugacugcgauaucaaucgcgaacaacuuaacgacaucuuccaucugcucaaaagccacaccaaugugcuguccgugaaccugcccgauaauuuuacacucaaggaggacggcauggaaacggucccuugguucccgaaaaagauuucugaucuggaccauugugccaacagagugcuuauguacgggagcgagcuggaugcggaccaccccggauuuaaagauaauguuuaucggaagcgcagaaaguacuucgcugaccucgccaugaacuauaaacacggcgauccuauccccaagguggaguuuaccgaagaggaaauuaaaacaugggggaccgucuuccaggagcugaauaaacuuuacccuacacaugccugccgggaauaucugaagaaccucccccugcuguccaaguacuguggauaucgcgaggacaauaucccucagcucgaggacgugagcaacuuucugaaagaaagaaccggcuucucuauucggccgguugcuggcuaccuuagcccccgcgauuuucuguccgggcucgccuucagaguguuccacugcacacaguacguccggcauucuuccgacccuuuuuauacccccgagccugauacgugucacgaacugcuuggacacgugccccugcucgcugagccgagcuucgcccaauuuucucaggaaaucggccuggcgucccugggggccagcgaggaggcugugcagaagcucgcuaccugcuacuucuuuacagucgaguucggacuguguaagcaggacggccaacuucgcguuuuuggggccggacugcucuccucuauuagcgaacugaaacaugcccuuuccggccacgcgaaggugaaaccuuucgaucccaagauuaccugcaaacaggaaugucugaucacaaccuuucaggacguguauuucgucagcgagucuuuugaagaugccaaggagaagaugagagaguucacgaaaacaaucaagcggccuuuuggcgugaaauacaaccccuauaccagauccauccagauucucaaggacacaaaaagcaucaccucugcuaugaaugaacugcaacaugaucuggacguugugagcgaugcccucgcuaaggucucccgcaagcccucuauuuga

SEQ ID NO: 77180 - RNA, 1473 nt, Artificial Sequence
  derived and/or modified sequence opt5 from TPH2__Homo_sapiens__NP_775489
augcagcccgccaugaugauguucagcuccaaguacugggcuagacggggcuuuucucuggacagcgccgugccugaggaacaccaacuccugggguccucuacccuuaacaaaccgaauagcggaaagaacgaugacaaaggcaauaagggguccucuaaacgcgaggcggcuacagaaagcggaaagacggccgucguuuucucccugaagaacgaggugggcgggcucgugaaagcccugagacuuuuucaggaaaagcgggucaauauggugcauaucgagagccgcaaaucuagacggcgcuccagcgagguugaaauuuucguggauugcgaguguggaaagaccgaauuuaacgagcugauccagcuccugaaauuccagacaaccauugucacacugaaucccccugagaacaucuggaccgaagaggaagaacucgaagacgugcccugguuuccuagaaagauuucugagcuggauaagugcucccaccggguucuuauguauggcagcgagcuggacgcugaucaucccggcuucaaagacaauguguaccgccaaagacggaaguauuuugucgauguggccaugggguacaaauauggacagccuaucccgcgcguggaauacacagaggaagagaccaagacguggggcgucguuuucagagaacucucuaaacuguaucccacccacgcuugucgggaguaccuuaagaacuuuccucugcucacaaaauacugcggguaucgcgaggacaaugugccccagcuggaagauguguccauguuccugaaggagagaagcggauuuaccguccggccuguggccggcuaccucucccccagagacuuccuggcggggcuugccuaucgcguuuuccauuguacacaguacauccggcacggaucugauccgcuguauaccccugaacccgacacgugccacgagcuccugggccaugugccucuucuggcugaccccaaguuugcccaauucagccaggaaauuggccucgcuucccugggggccagcgaugaggacguccagaaacuggcgacauguuacuuuuucaccaucgaguuuggacucugcaagcaggaaggccaacugagagccuauggggcuggacuucugucuuccauuggcgagcucaaacacgcccugagcgauaaggcuugugugaaagccuucgaccccaagacaaccugccuucaggaaugucugaucaccacauuucaggaggccuacuucguuucugagagcuuugaagaggcuaaggagaaaaugcgcgauuucgcgaaguccauuacgcggccuuuuucuguguacuucaacccguauacccaaagcaucgagauucucaaagacacaagauccaucgaaaaugucgugcaggaucugcgcagcgaccugaacaccgucugcgaugcccucaauaagaugaaccaguaccuggggaucuga

SEQ ID NO: 77181 - RNA, 750 nt, Artificial Sequence
  derived and/or modified sequence opt5 from TPI1__Homo_sapiens__NP_000356
auggcccccagcagaaaguucuuugugggcgggaacuggaaaaugaauggacggaagcagucccugggcgagcucaucgggacccugaacgcugccaaagucccugcggacacagaaguugugugcgcuccgcccacggccuacauugauuucgcccgccaaaagcuggacccuaaaaucgcuguggccgcucagaauuguuauaaggucaccaacggagccuuuacaggcgagauuucucccgggaugaucaaggauugcggagcgaccugggugguucugggccacagcgaaagacggcauguguucggcgaguccgacgaacucauugggcagaaagucgcccacgcucuggccgagggacuuggcgugaucgcuuguaucggggagaagcuggaugaacgcgaggccggaauuacagaaaaaguuguguuugagcagaccaaggucaucgcggacaaugugaaagauuggucuaaggugguccucgccuacgagccuguuugggcuauuggcacagggaagaccgccacgccccaacaggcucaggaagugcaugagaaacugagaggauggcuuaagagcaacguguccgacgccgucgcccagucuacccggaucauuuauggcggcagcgugacaggggcuaccugcaaagaacucgcgucccaaccugauguugacggauuccuggugggcggggccagccuuaagccggaguuugucgauaucauuaaugcuaaacaguga

SEQ ID NO: 77182 - RNA, 585 nt, Artificial Sequence
  derived and/or modified sequence opt5 from TPK1__Homo_sapiens__NP_001035947
auggagcacgccuucacaccccuggaaccucuccugagcaccggcaaccuuaaguacugccuggugauccucaaucagccgcuggacaacuauuuuagacaucuuuggaauaaagcucugcuccgggccugugcggaugggggagcuaaccgccuguacgacauuacggagggcgaaagagaguccuuccugcccgaauuuaucaauggggauuucgacucuauucggccugagguccgcgaguauuacgccaccaagggaugcgaacucaucagcacacccgaucaggaccacaccgauuuuacaaaaugucugaagaugcuucagaaaaagauugaggaaaaggaccugaaaggcaagcauagacuccacguugauaccgggauggagggagacuggugcggccugaucccugugggccagcccuguaugcaagugacaaccacggggcuuaaauggaaccugaccaaugauguccucgccuucggaacacugguguccaccucuaacacauaugacggcagcgggguugugaccgucgagacggaucauccucugcucuggacaauggcuaucaaguccuga

SEQ ID NO: 77183 - RNA, 855 nt, Artificial Sequence
  derived and/or modified sequence opt5 from TPM1__Homo_sapiens__NP_000357
auggacgccaucaagaaaaagaugcagaugcugaaacucgauaaggagaacgcucuggacagagccgaacaagcggaggcugauaaaaaggccgccgaagaccggagcaagcagcuugaggaugaacuggugucccuccagaaaaagcugaaaggcaccgaggacgagcuugauaaguacucugaagcucugaaagacgcccaggagaagcucgaacuggcugagaagaaagccacagaugcggaggccgacgucgcuagccugaaucgccggauucaacucguugaagaggaacuggauagagcccaggagcgccuugcuacggcccugcagaagcucgaagaggcggagaaagccgcugacgaauccgagagagggaugaaggugaucgaaucucgggcccagaaagaugaggaaaagauggagauucaagagauccagcugaaagaagcuaagcacauugccgaggacgccgaccgcaaguaugaagagguggcuagaaaacuugucaucaucgaaagcgaucuggagcgggcggaggaacgcgccgagcucuccgaaggacaggugagacagcuggaggagcaacugcggauuauggaccagacccucaaggcucugauggccgccgaagauaaauacucucagaaggaggaccgcuaugaagaggaaaucaaaguucuuagcgauaagcugaaggaggcugagacaagagccgaguucgcggaacgguccgugaccaaacucgaaaagagcauugacgaucuggaggacgaacuuuacgcucaaaaacugaaguauaaagccaucucugaggagcucgaucaugcccugaacgacaugacauccauguga

SEQ ID NO: 77184 - RNA, 855 nt, Artificial Sequence
  derived and/or modified sequence opt5 from TPM2__Homo_sapiens__NP_001288155
auggacgccaucaagaaaaagaugcagaugcugaaacucgauaaggagaacgcuauugacagagccgaacaagcggaggcugauaaaaagcaggccgaagaccggugcaagcagcuggaggaagaacagcaagcccuucagaaaaagcugaaaggcaccgaggaugaaguggagaaguacagcgaauccgucaaagaggcucaggagaagcucgaacaggccgagaagaaagcuacagacgccgaagcggauguugccucucugaaucgcagaauccaacuuguggaggaagaacuggaccgggcucaggagcgccucgccacggcucugcagaagcuggaagaggccgaaaaagcggccgaugagagcgaaagagggaugaaggugauugagaaccgggcuaugaaagacgaggaaaagauggagcuccaggaaaugcaacugaaagaggccaagcacaucgcugaagauuccgaccgcaaguaugaggaggucgccagaaaacuugugauucuggaaggagagcucgaacggucugaggagcgcgccgaaguugcugagagcaaguguggcgaucuggaagaggaacuuaaaaucgugaccaauaaccugaagucccucgaggcgcaggccgacaaauacucuacaaaggaggacaaguaugaagaggaaaucaaacugcuggaggaaaagcucaaagaggcugagaccagagccgaguucgccgagcggagcgucgcuaagcuggagaaaacaauugaugaccuugaggaaacccuggccuccgcgaaggaggagaauguggaaauccaucagacacucgaucaaacccugcuugagcugaacaaucucuga

SEQ ID NO: 77185 - RNA, 747 nt, Artificial Sequence
  derived and/or modified sequence opt5 from TPM3__Homo_sapiens__NP_001036816
auggccggcaucaccacaauugaggcugugaagagaaaaauccagguccugcaacagcaggccgacgaugcggaagaacgggcugaacgccuccagagagagguugaaggggagcggcgcgccagagagcaagccgaagcugagguggccagccugaaccggcgcauucagcuuguggaagaggagcuggacagagcucaggaacggcucgccacggcgcugcagaaacuugaggaagccgagaaggcugccgaugaauccgagcgcggaaugaaggucaucgagaauagagcucugaaagacgaagagaagauggaacuccaagagauucagcugaaggaagccaaacacaucgcggaggaggccgaucggaaguacgaagagguggcucgcaaacugguuaucauugaaggcgaccucgagagaaccgaggagcgggccgagcuggcugaaucuaagugcagcgagcuugaagaggagcugaaaaacgugacaaauaaccucaagucccuggaagcccaggccgagaaguauucucagaaagaagauaaguacgaggaagagaucaaaauucuuaccgacaagcugaaagaggcugaaacacgcgcggaguucgccgaaagaagcgucgcuaagcucgagaaaaccaucgaugaccuggaagauaagcugaaguguacaaaagaggagcaucucugcacccaacggaugcuggaccagacgcuucuggaucucaaugaaauguga

SEQ ID NO: 77186 - RNA, 855 nt, Artificial Sequence
  derived and/or modified sequence opt5 from TPM4__Homo_sapiens__NP_001138632
auggaggccaucaagaaaaagaugcagaugcugaaacucgacaaggaaaacgcuauugauagagccgagcaagcggaagcugacaaaaaggccgccgaggauaagugcaaacagguggaagaggagcugacccaccuucagaagaaacugaagggcacagaagacgagcucgauaaauacagcgaagaccugaaggaugcucaggagaaacuugagcugacggaaaagaaggccuccgacgcugagggggaugucgccgcgcucaaucggcgcauccaacugguugaagaggaacuggacagagcccaggagcggcucgcuaccgcccugcagaaacuugaggaagcugagaaggccgcggaugaaucugagcgcggaaugaaagugauugaaaacagagccaugaaggacgaggagaaaauggaaauccaggagaugcaacugaaggaagcuaagcauauugccgaggaagcugaucggaaauaugaggagguggcccgcaagcucgucauccuggaaggcgagcuugaaagagccgaggagcgggcugaagugagcgagcugaaauguggggaccucgaagaggaacugaagaauguuacaaacaaucugaaaucccucgaggcggccucugagaaguacagcgaaaaggaggacaaauaugaagaggaaaucaagcugcuuuccgauaaacugaaggaggcugagacccgcgccgaguucgccgaaagaacaguggcuaaacucgaaaagaccauugacgaucuggaggaaaaacuugcccaggcgaaggaggagaacgucggacugcaccagacacucgaccagacccugaaugaacugaacugcaucuga

SEQ ID NO: 77187 - RNA, 738 nt, Artificial Sequence
  derived and/or modified sequence opt5 from TPMT__Homo_sapiens__NP_000358
auggacggcaccagaacaagccuggauaucgaggaauacuccgacacggaggugcagaagaaccaaguccucacccuggaagaguggcaggauaaauggguuaaugggaagacagccuuccaccaggaacagggacaucaacuucugaaaaagcaccucgacaccuuucugaaaggcaagucugggcuucggguguucuuuccccugugcggaaaggcuguggagaugaaaugguucgccgaucgcggccauagcgucguggggguugagauuuccgaacucggaauccaggaguuuuucacagaacagaaccugucuuauagcgaggagccuauuaccgaaaucccgggcacaaagguguuuaaauccucuagcggcaauauuucccuguacuguugcagcaucuucgaccuccccagaaccaacaucgggaaguuugauaugauuugggaccggggagcgcuggucgcuaucaauccuggcgaucgcaaauguuaugccgacacgauguucucucuucuggggaagaaguuucaguaccuccugugcgugcuuuccuaugaucccaccaaacacccuggacccccuuucuacguuccgcaugccgagauugaaagacuguuuggcaagaucuguaacauucggugccucgagaaaguggacgcuuucgaggaacgccacaagagcugggggaucgauugucuguucgagaaacuguaucuccugacagaaaaguga

SEQ ID NO: 77188 - RNA, 2802 nt, Artificial Sequence
  derived and/or modified sequence opt5 from TPO__Homo_sapiens__NP_001193673
augagagcccuggcugugcucagcgucacccugguuauggccugcacagaggcguucuuucccuucaucucccggggcaaggaacuucugugggggaaaccugaggaaucucgcgugagcuccgugcucgaggaaucuaagagacuggucgacacggcuauguacgccaccaugcagcggaaccuuaaaaagcgcggcauucugagcccggcccaacuccuguccuuuucuaaacugcccgagccuacaagcggagugaucgcuagagccgcugagauuauggaaaccuccauccaggccaugaagcggaagguuaaucucaaaacacagcagagccaacaccccaccgaugcgcugucugaggaccuucuguccauuaucgccaacaugagcgggugucucccuuauaugcugcccccuaagugcccgaauacaugucuugcuaacaaauaccgccccaucaccggagccugcaauaacagagaucauccucgguggggcgcuucuaauacggcccuggcgcgcuggcuucccccuguguaugaagacggguucucccagcccagaggauggaacccgggcuuucuguacaauggcuucccucugcccccuguccgggaggugacccgccacguuauucaggugagcaacgaggucgugacagaugacgauagauauucugaccuccugauggccugggggcaguacaucgaucaugacauugcuuuuacaccccaauccaccagcaaggccgcuuucggaggcggggccgauugucagaugaccugcgaaaaucagaaccccuguuuuccuauccagcuuccggaggaagcccggcccgcugcgggaacggccugccugccuuucuaucgcuccucugcugccuguggcacaggggaccaaggagcccucuuuggcaaucugagcaccgcuaaccccagacagcagaugaauggccuuacauccuuccuggaugccagcaccguguacgggucuuccccugcgcucgagcggcaacugagaaacuggaccagcgcugaaggacugcuccgcguccacgcccggcugagagacucuggccgcgccuaccuucccuuuguuccgccucgggcucccgccgcuugcgccccugagcccgggauuccuggagagacaagaggccccuguuuccuggcgggggacggacgcgccagcgaagugccgucccucacggcucugcauacccuuuggcugcgggagcacaacagacucgccgcugcccugaaagcgcugaaugcccacuggucugcugaugccguguaucaggaagcucgcaaggucgugggcgcccuccaucagaucauuacacugcgggacuacaucccuagaauccuuggccccgaggccuuccagcaauauguugggcccuacgaaggauaugauagcaccgcuaacccuacaguguccaaugucuuuagcaccgcggccuuccgcuuuggccacgcuacgauucauccgcuggugcggagacucgacgccucuuuccaggagcaccccgaucugccugggcuguggcuucaccaggccuuuuucucccccuggacacuccugcggggaggcgggcuggacccucucauccgcggccugcuugcuagacccgccaagcugcagguucaagaucagcucaugaacgaggaacugaccgagcggcuguuugugcuuagcaauucuuccacccucgaccuggcgagcauuaaccugcagagaggacgcgaucauggccucccuggguacaaugaauggcgggaguucugcggacugcccagacuugaaacaccggcugaccuguccaccgccaucgccucucgcagcgucgcugauaaaauucucgaccuguauaagcacccugacaacaucgauguguggcugggcgggcuugccgagaauuuucuccccagagcgcggacaggaccucuguucgcuugccugaucggcaaacagaugaaggcccuccgcgacggggauugguuuuggugggagaacucccaugucuucacggacgcccaaagacgggaacuggagaaacacucucuuagccgcgugauuugugauaauaccggccugacaagaguucccauggacgcuuuucaggugggaaaguucccggaagauuucgaguccugcgacagcaucaccggcaugaaccucgaggccuggcgggaaacauuuccucaggaugacaaauguggguuccccgagucugucgaaaauggagauuuugugcauugcgaggaauccggccgcagaguucugguguacagcugucggcacggguacgagcugcagggacgcgagcaacuuaccugcacgcaggaaggcugggacuuccagccuccccucuguaaggaugucaacgagugcgcugacggggcccaucccccuugucacgcgucugccagaugccggaauaccaagggcggauuucaaugucugugcgcugacccguaugaacugggcgaugacgggagaacaugcguggauuccggacgccucccccgggugaccuggauuagcaugucucuggccgcucuccugaucggcggguucgccggacucacaagcaccguuauuuguagauggacgcgcacaggcaccaaauccacacugccuaucagcgagaccgggggcggaacccccgaacugcggugcggcaagcaccaggccgucgggacaucuccucagagagcugcggcccaggacuccgagcaagagagcgcuggaauggaaggccgcgauacgcaucggcuucccagagcccuguga

SEQ ID NO: 77189 - RNA, 1692 nt, Artificial Sequence
  derived and/or modified sequence opt5 from TPP1__Homo_sapiens__NP_000382
augggccugcaggccugccuccuggggcuuuucgcucugauccucagcggaaaguguuccuacucucccgagccugaccaaagacggacccugccgcccggcugggugagccuugggcgcgccgauccugaagaggaacugucccucacauuugcgcugagacagcagaacgucgagcggcugucugaacucguucaggcugugagcgaccccuccucuccucaauauggaaaauaccugacgcuugagaauguggccgaucugguccgccccagcccucucacccugcacacagugcagaaguggcuucuggccgcuggcgcccagaaaugccauuccguuauuacccaggacuuccucacauguuggcugagcaucagacaagcugagcugcuccugccgggggccgaauuucaccauuaugugggaggccccaccgagacacacgucgugcggucuccucaucccuaccagcuuccucaggcgcuggcuccccacguugauuucgugggcgggcuccaccgcuuuccgccuaccuccagccugagacagcggcccgaaccucaagucacgggaaccgugggccuucaucugggggugacacccucugucauucgcaagagauauaaccucaccucccaggacguuggaagcggcacaucuaauaacucccaggccugcgcccaauuccuggagcaguacuuucacgauagcgaccuggcucaguucaugcggcucuuugggggaaauuucgcccaucaggcguccguggcccgcguggucggccaacagggcagagggcgggcuggaaucgaggccucucuggaugugcaguaucuuaugagcgcuggcgccaacauuuccaccuggguuuacagcucucccgggcgccacgaaggacaggagccuuuucugcaauggcucaugcugcuuuccaaugaaagcgcccugccgcacgugcauacggucucuuacggcgacgaugaggacagccucuccucugcuuauauccagagagugaacacagaacugaugaaagcggccgcucgggggcugacccuccuguucgccagcggagauuccggcgccggcuguuggagcguuucugggagacaccaguuucgccccacauucccugcuuccagccccuacgugaccaccgucggaggcacaucuuuccaggagccuuuucuuaucacgaaugagauuguggacuauaucuccgggggaggcuucagcaacgucuuuccccggccguccuaccaagaagaggccgugaccaaguuccugucuagcuccccucaucugcccccuucuagcuauuuuaaugcguccgggagagcuuaccccgacguugccgcccucagcgauggcuauuggguggucucuaaccgcgugccuauucccuggguuuccggaacaagcgcuucuaccccgguguucggcgggauccugucccuuauuaaugaacaccggauccucagcggaagaccuccccugggcuuucugaacccccgccucuaccagcagcauggggccggacuguucgacgucacacggggcugccacgagucuugucuugaugaagagguggaggggcagggcuuuugcagcggaccuggcugggacccggugaccggguggggaacgcccaauuucccugcucugcucaagacacugcugaaccccuga

SEQ ID NO: 77190 - RNA, 3750 nt, Artificial Sequence
  derived and/or modified sequence opt5 from TPP2__Homo_sapiens__NP_003282
auggccaccgcugccacagaggaacccuucccuuuucacggccugcucccgaagaaagagacgggggcggcuagcuuccugugcagauaccccgaauaugacggacggggcgugcuuaucgccguccuggauaccgggguugacccuggagcccccggcaugcaagugacaaccgaugggaagccuaaaauuguggacaucauugauacaaccggauccggcgacgucaacacagcuaccgagguggaacccaaggauggcgagaucguugggcucucuggacgcgugcugaaaauuccugccagcuggacgaauccguccggcaaguaccauaucgggaucaagaacggauaugacuuuuaccccaaagcucuuaaggagcggauucaaaaagaaagaaaggagaaaaucugggauccuguccaccgcguggcccuggcggaagccuguagaaagcaggaggaguucgacguugcuaauaacggcucuagccaggccaauaagcucauuaaagaggaacugcagucccaaguggaacugcucaacucuuuugagaagaaauauagcgaucccgggccugucuacgacugccugguguggcaugauggagaaguguggcgggcuuguaucgacuccaaugaggacggcgaucuuagcaagucuaccguccugcgcaacuauaaagaggcccaggaauacggcuccuucgggacagcggagaugcucaauuacagcguuaacauuuaugacgauggaaaucugcuuucuaucgugaccuccggcggggcccacggaacacauguggcuagcauugccgcuggccacuuucccgaggaaccggaaagaaacggggucgccccuggagcccagauccugucuaucaagauuggcgacacccggcucuccacgauggagacaggcaccgggcugauccgcgcuaugauugaggugaucaaucacaaaugcgaucugguuaacuacagcuauggagaagcgacacauuggcccaauuccggcagaauuugugaggugaucaacgaagccgucuggaagcacaacaucauuuacgugucuagcgcugggaauaacggaccuugccucuccaccguuggcugucccgggggcaccacaagcucugugaucggagucggcgccuaugugucccccgacaugauggucgccgaguacagccugcgggaaaaacuuccugcuaaucaguauacguggucuagccgcgggccguccgccgauggagcgcugggcgugucuauuagcgcucccgggggagccaucgccuccguuccuaacuggacccucagaggcacacaacugaugaaugggaccagcaugucuucccccaacgcuugcggcggaauugcccuuauccugagcggccucaaggcuaauaacaucgacuacacagugcauucuguccggcgcgcccuggagaauaccgcggugaaggccgauaacauugagguuuucgcucaggggcacggaaucauucagguggacaaagccuacgauuaucugguccagaauacguccuuugcuaacaagcucggcuucacagugaccguggggaauaacagaggaaucuaccugcgggacccuguucaagucgccgcgcccagcgaccacggcguggggauugaaccgguguuuccugagaauaccgaaaacuccgagaaaaucucucuucagcugcaucucgcccugacaagcaacuccucuuggguccagugucccagccaccuugagcugaugaaucaaugcagacauauuaacauccgcguggauccucggggccucagagaaggacugcacuauaccgagguuuguggcuacgacaucgcuucccccaaugccgggccucuguuccgcgugcccauuacagcugucaucgccgccaaggugaacgaaagcucucauuaugaucucgcuuuuacggacguucacuucaagccgggacagauucggagacacuucaucgaggugccugaaggcgcgaccugggccgaggucacagugugcuccugcagcucugagguuuccgcuaaauuugugcugcaugccguccagcuugugaagcagcgcgccuaccggagccacgaguucuauaaauuuuguucucugcccgaaaaggggacccucacagaggcuuuccccgugcugggaggcaaagccauugaauuuugcaucgcgagauggugggcuagccuguccgaugucaauaucgacuacaccauuagcuuccaugggaucguuuguacggccccucaacuuaacauucacgccucugaaggcaucaaucgcuuugaugugcaguccagccucaaguacgaggaccuggcuccgugcauuacccugaagaacugggugcagacacuccggcccgucuccgccaaaaccaagccucugggaucuagagaugugcuucccaauaaccgccagcuguaugagaugguucucacauacaauuuccaccaaccuaaaagcggcgaagugacccccuccuguccucugcugugcgagcuucucuaugaaucugaguuugacagccagcuguggaucaucuucgaucagaacaagcggcagaugggguccggagacgcguacccccaucaauauucucugaaacucgaaaagggcgauuacacgauuagacugcagauccggcacgagcagauuagcgaccuugagcgccugaaggaccucccguuuaucgucucccauagacugagcaauacacugucucuugauauucacgaaaaccauuccuucgcucuccuggggaaaaagaaaagcucuaaucugacccucccucccaaguauaaccagcccuuuuucgugacaucccugcccgacgauaaaaucccgaagggagccggcccuggcuguuaccuugccgggagccugacccucucuaaaaccgagcugggaaagaaggcugacguuauccccgugcacuacuaucugauuccuccucccacaaaaacgaagaacggcuccaaagauaaggaaaaagacagcgagaaggagaaggaucuuaaagaagaguucaccgaagcccuccgggaccugaagauccaauggaugacaaaacuggauuccagcgacauuuacaaugagcucaaggaaaccuauccuaacuaccugccgcuuuaugucgcuagacugcaccagcucgaugccgagaaagagcgcaugaagcggcugaaugaaaucguggacgcggccaacgcuguuauuucucauaucgaucagacagcccuggcuguguacauugccaugaagaccgaccccagaccugacgccgcuacgaucaaaaaugauauggacaagcagaaaagcacacuugucgaugcgcugugccgcaaggggugugcccucgcugaccaucugcuccacacccaggcccaggauggagccaucuccaccgacgcugagggcaaagaagaggaaggggagucuccccuggauagccuugccgagacauuuugggaaaccacaaaguggacggaccuguucgauaacaaggugcucaccuuugcguauaaacacgcucuggugaauaagauguacggaagaggccugaaauucgccacaaaacuugucgaggaaaagccuaccaaggagaacuggaaaaauugcauucagcugaugaagcuccugggcuggacacauugugccuccuuuaccgaaaacuggcuccccaucauguacccuccggacuauugcguuuucuga

SEQ ID NO: 77191 - RNA, 513 nt, Artificial Sequence
  derived and/or modified sequence opt5 from TPPP2__Homo_sapiens__XP_005267381
auggccagcgaggcugaaaagaccuuccacagauuugccgcguucggcgaguccucuagcuccgggacagaaaugaacaauaaaaacuuuucuaagcugugcaaagacuguggaaucauggauggcaagacggugaccagcacagacgucgauauuguuuucuccaaagugaaggcuaagaaugcccggaccaucacauuucagcaauucaaagaggccgugaaggaacucgggcagaaacgcuuuaagggaaaaucucccgacgagguccuggagaacauuuacggccuuauggaagggaaggauccugcuaccacaggagccaccaaggcuacgaccgugggcgccguugacagacugacagauaccagcaaauauacaggcacccauaaggagcgguucgacgaauccgggaaaggaaagggcaucgcggggcgcgaggagaugacggauaauacaggauacgugagcggcuauaaagggucuggaaccuacgacaagaaaacaaaguga

SEQ ID NO: 77192 - RNA, 531 nt, Artificial Sequence
  derived and/or modified sequence opt5 from TPPP3__Homo_sapiens__NP_057224
auggccgcuagcaccgacauggccggccuggaggaauccuucagaaaguuugcgauccacggggaucccaaggcuucuggacaggagaugaacggcaagaauugggccaaacucugcaaggacuguaaaguggccgaugggaaaagcgucacaggaacggacguugauauuguguucuccaaggugaaaggcaagucugcucgggucaucaacuacgaagaguuuaaaaaggcccuggaggaacuugcuaccaaacgcuucaagggaaagagcaaagaggaagccuuugacgcgauuugccaacugguggccgggaaggagccugcuaauguuggcgugacaaaagccaagaccggcggggcugucgauagacucacagacaccucccgguauacaggaucucauaaagaacgcuucgaugagagcggcaaggggaaaggaaucgccggcagacaggacauucuggaugacuccggguacgugagcgcguauaagaacgccggaaccuacgaugcuaagguuaaaaaguga

SEQ ID NO: 77193 - RNA, 660 nt, Artificial Sequence
  derived and/or modified sequence opt5 from TPPP__Homo_sapiens__NP_008961
auggccgacaaggcuaaacccgccaaggcggcuaacagaaccccuccgaaaagccccggcgauccuuccaaggaccgggccgccaaacgccugucucucgagagcgaaggggcuggagagggcgccgcugccucccccgaacugucugcgcuugaggaagccuucagacgguuugcugugcacggggaugcccgcgcuacaggaagagagaugcauggcaagaauuggagcaagcugugcaaagacugucaggucaucgaugggcggaacguuacggugaccgacguggauauugucuucuccaagaucaaaggaaagucuugccgcacaauuaccuuugagcaauuccaggaagcccucgaggaacuggcgaaaaagagauuuaaggacaaaagcuccgaggaggccgugcgggaaguucaccgccuuaucgagggcaaggcuccuauuaucagcggcgugacaaaagccaucucuucccccaccgucagcagacugacagauaccacgaaguucaccgggucucauaaagaacgguuugacccuuccggaaagggcaaagggaaggcuggacgcguggaucucguugacgagagcggcuacgugucuggguauaagcacgccggaacauacgaucagaaaguccagggcggcaaguga

SEQ ID NO: 77194 - RNA, 828 nt, Artificial Sequence
  derived and/or modified sequence opt5 from TPRG1__Homo_sapiens__NP_940887
augagcaccaucggcuccuucgagggguuucaggccgugucucugaagcaagaaggagacgaucagcccagcgagacagaccaccucuccauggaagaggaagauccuaugccgagacagauuucucggcagagcuccgucacggagucuacccuguaccccaacccuuaucaucaacccuacaucagccgcaaguauuucgcuacaagaccuggcgccauugagaccgcgauggaagaccuuaaggggcacguugcugagacauccggagaaaccauccagggcuuuuggcugcucacaaaaauugaucauuggaauaacgagaaggagcggauccugcuugugaccgacaaaacgcugcucaucugcaaguacgauuucauuaugcugagcugugugcagcugcagcgcaucccccucucugccgucuauagaauuugccuggggaaguuuaccuucccuggaaugucccuugacaaacggcaaggcgaaggccugcgcaucuacugggggagcccggaggaacagucucuccuguccagauggaaucccuggagcacagaggugccuuaugccaccuuuacagaacaccccaugaaguacaccucugagaaauuccuugagauuuguaagcuguccggauuuaugagcaaacucguuccugcuauccagaacgcccauaaaaauuccacgggcucugggcggggaaagaagcugauggugcugacagaacccauucucaucgagaccuacacaggccugaugagcuucaucgggaaccgcaauaaacuuggauauucccuggcuagaggcagcauuggcuuuuga

SEQ ID NO: 77195 - RNA, 7092 nt, Artificial Sequence
  derived and/or modified sequence opt5 from TPR__Homo_sapiens__NP_003283
auggccgcugugcugcagcaaguccucgagcggaccgaacugaacaaacuucccaagagcguucagaauaagcuggagaaguuccucgccgaccagcaguccgaaaucgauggccugaaggggcggcacgagaaauuuaagguggaaucugagcaacaguacuucgagauugaaaagcgccuuagccauucccaggagagacuggugaacgaaacacgggagugccagucucuccgccuggagcuggaaaagcucaauaaccaacugaaggcgcuuacggagaagaauaaggaacuggagaucgcucaggacagaaacauugccauccagagccaguuuacccggacaaaagaagaacucgaggccgaaaagcgcgaucugauuagaaccaaugagcggcuuucccaagaacuggaguaucucacagaagacgucaagcgccugaacgagaaacugaaggagucuaauaccacaaaaggagaacuccagcugaaacuugaugagcugcaggcuagcgacguguccguuaaauacagagaaaagcggcucgagcaagaaaaagagcugcuucacagccagaacaccuggcugaauacggagcucaagaccaagacagaugaacugcuggcccucggccgcgagaaagggaacgaaauccuggagcuuaaguguaaucuggagaacaaaaaggaagaggugucuagacucgaagaacagaugaauggacugaaaaccuccaacgaacaucuucagaagcacgucgaggaccugcucacaaagcugaaagaggcuaaggaacaacaggccagcauggaggaaaaauuccauaacgagcugaaugcgcacaucaagcucucuaaccuguauaaauccgccgcugaugacagcgaagccaagucuaaugagcuuacccgggcuguggaggaacugcacaagcuccugaaagaggccggcgaagcgaacaaggccauucaggaucaucugcuugagguugaacaguccaaagaccaaauggagaaggagaugcucgagaaaaucgggcgccuggagaaggaacuggagaaugcuaacgaucuccugagcgccacgaagagaaaaggagcuauucuuuccgaggaggaacuggccgccaugucuccuacagcugcggccguggcuaagaucgucaaaccgggcaugaagcucaccgaacuguacaaugccuauguggagacacaggaccagcugcuucucgaaaaacuggagaacaagcggauuaauaaauaccuggacgagaucgugaaggaagucgaggccaaggcucccauucucaaaagacagcgcgaagaguaugaacgggcccaaaaggcgguugcuagccuguccgugaaacuugagcaggccaugaaggagauccagagacugcaggaagauaccgacaaagccaacaagcaaagcucugugcucgagcgcgauaaucggagaauggaaauccaggucaaggaccugucccagcaaauucgcgugcugcuuauggagcucgaagaggcucggggcaaccacguuaucagagaugaggaagugagcucugccgacauuagcuccucuagcgaggucaucucccagcaucuggugagcuaccgcaauauugaggaacugcagcagcaaaaccagcggcuccugguugcucuuagagagcugggggaaacccgcgagcgggaggaacaggaaacaacgucuuccaaaaucaccgagcuccagcugaagcuggagagcgcccuuacagaacucgagcaacugagaaaaucucggcagcaccagaugcagcugguggauuccaucguccgccaaagagacauguaccggauucuccugagccagaccacaggaguggcgaucccucuucacgccuccucucuggaugacgucagccucgcuuccacccccaagagaccuucuacgagccagacaguguccacccccgccccuguuccggugauugaaagcaccgaggcuaucgaagccaaagcggcccugaagcaacugcaggagauuuuugagaauuauaagaaagaaaaggcugagaacgagaagauccagaacgagcagcuugaaaagcugcaagagcaggucacagaucuccgcucucagaauaccaaaaucuccacacagcuggacuucgccagcaagcgguacgagaugcuccaagacaacguggaaggcuauagacgcgagauuacgucucugcaugaaagaaaucagaaacuuaccgcuacaacccagaaacaggagcaaaucauuaacacaaugacccaggaucugagaggggccaaugagaagcucgccguugcugaagugcgcgcggagaaccugaaaaaggaaaaagagaugcugaaacuuuccgaagucagacugagccagcagcgggagucucuccuggccgagcaacgcggacagaaucuccugcuuacgaaccugcagaccauccaaggcauucucgaaagaagcgagacagaaaccaaacagcggcuguccagccagaucgagaagcuggaacacgagauuucucaucuuaagaaaaagcuggagaaugaaguggagcagcgccacacacucaccagaaaccuggacgugcaacuccuggauacgaaacggcagcuugacacagaaaccaaucugcaucugaacacaaaggagcuccugaaaaaugcucagaaggaaaucgccacccuuaagcagcaccuguccaacauggagguucaagucgccagccaguccucucagcgcaccgggaaaggacagcccagcaauaaggaggauguggacgaucucgugucccaacugagacagacagaggaacaggucaacgaccucaaagaacggcugaagacgucuaccagcaacguggagcaauaccaggcuaugguuacaucccuugaggaaucucugaauaaagagaaacaggugaccgaagaggucagaaagaacaucgaagugcgccugaaagagagcgccgaguuucagacacaacucgaaaagaaacugauggagguugaaaaggagaaacaggaacuucaggaugacaagcggagagcgauugaguccauggagcagcaacugagcgaacucaagaaaacccugucuuccgugcagaaugagguccaggaagcucuccagcgcgccagcacggcccugucuaacgagcaacaggcucggagagauugccaggaacaggccaagaucgcgguggaggcucaaaauaaauaugagcgcgaacuuaugcugcacgccgccgacguugaggcucugcaggccgcuaaggaacagguguccaaaauggccagcguccggcaacaucucgaggagacaacccagaaggcggaaucucagcugcuugaguguaaggccuccugggaagagagagaacgcaugcugaaagaugaggugagcaagugcgugugucggugcgaggaccucgaaaaacagaacagacugcuccacgaccaaauugagaagcuguccgauaaagucguugcuagcgugaaggaaggcgugcagggcccucuuaaugucucucugagcgaggaagggaaaucccaggagcagauccuggagauucuccgguucauccgcagagaaaaggagaucgccgaaacccgguuugagguggcucaaguugaaucucugcgcuacagacagcggguggagcuucuggagagagaacuccaggagcugcaggacagccugaacgccgaacgcgagaagguccaagugacagccaaaaccauggcucagcaugaggaacucaugaagaaaacagagacgaugaauguugugauggaaaccaacaagaugcuucgggaggaaaaagagagacuggagcaggaucugcaacagaugcaggcgaagguccgcaagcucgaacuggacauucuuccccugcaggaggccaaugcugaacucuccgagaaaucuggaaugcugcaagccgaaaagaaacugcucgaggaggaugugaagcgguggaaagccagaaaccagcaccuuguuagccagcagaaggacccugauacagaagaguaucgcaagcugcuguccgaaaaagaggugcacaccaagcggauccaacagcucacagaagagauuggcagacugaaagcugagaucgcccgcucuaaugcgagccuuaccaacaaucagaaccugauucagucccucaaggaagaccugaacaaagucagaacggagaaggaaaccauccaaaaggaucuggacgcuaaaaucauugauauccaggagaaggugaaaacaauuacccaggugaagaaaaucgggcggcgcuacaagacacaauacgaggaacucaaagcccagcaggacaaggucauggagaccagcgcccagucuuccggagaucaucaagaacagcacguuagcgugcaggagaugcaggaacuuaaggagacacugaaucaagcugagaccaaaucuaagucccuggaaagccagguggagaaccuccagaaaacgcuguccgaaaaggagacagaagccagaaaucuucaggagcaaaccguccagcugcagucugagcucagccggcugcgccaggaccugcaagacagaaccacacaggaggaacagcuccggcaacagauuaccgaaaaagaggaaaagacgagaaaggcgaucguggcugccaaauccaagaucgcccaucuugcuggcguuaaagaucagcugacaaaggagaacgaggaacugaaacagcgcaauggggcccucgaccaacagaaggaugagcuggacgugcggauuaccgcucuuaagagccaguaugaaggaagaaucucucgccuggagcgggagcucagagaacaccaggagcggcaucuggaacaacgcgaugagccccaggaaccguccaacaaagucccugagcagcagagacaaauuacacugaagaccacacccgccagcggcgagcggggcaucgcgucuaccagcgacccucccacggccaauauuaaacccaccccugugguuuccacaccgucuaaggugaccgcugccgcuauggccgggaacaaaagcacaccccgcgccuccaucagaccuauggucacccccgcuacggugacaaauccuaccacaacccccaccgcgacagucaugccgacgacccagguggaaucucaggaggccaugcaaagcgaaggaccuguugagcacgugcccgucuucggcuccacaagcgggucugugcgguccaccagcccuaacguucagcccuccauuucucagccuauccucacagugcagcaacagacccaggcuacggccuuuguccagcccacacaacagagccacccgcagaucgaaccugccaaucaggagcuuuccucuaacauuguggaggugguucaaagcucccccgucgaacgccccagcaccucuaccgcuguguucggaacaguguccgccaccccuuccucuagccugccgaagagaacacgggaggaagaggaagauagcacgaucgaggcgucugaccaggucagcgaugacaccguggagaugccccugccuaagaaacucaaguccguuacacccgugggcaccgaagaggaagucauggcugaggagucuacagauggggaaguggagacccagguuuacaaucaggacagccaagacuccauuggcgaaggagugacgcagggcgauuauaccccuauggaggacagcgaagagacaucccagucucugcaaaucgaucuugggccccugcagagcgaccagcagaccacaaccuccucucaagauggacagggcaaaggggacgaugucauugugaucgacagcgaugacgaggaagaggaugacgaugaaaacgacggagagcaugaagacuacgaggaggaugaagaggacgaugacgaugacgaagaugacacaggcaugggggaugagggcgaagacuccaaugagggaacgggcucugccgaugggaacgacggauaugaggccgaugacgcugaaggcggggacggaaccgauccuggcacagagaccgaagagagcaugggaggcggagagggcaaucaccgcgccgcggacucccagaacagcggggaaggaaacaccggcgccgcugagucuuccuuuagccaggaaguuucuagagagcaacagcccuccagcgccucugaacggcaggcuccgagagccccucagagcccccgccggccuccccauccgcucccucccagacugacaauccacgcuccuccccaagagcuggggcccccugugcagcgcauucagaugacgcggagacaauccgucggacgcggccuccagcuuaccccggggaucggcggaaugcagcagcauuucuucgaugacgaggaucggacagugcccuccaccccuacacugguggucccccacagaaccgacggcuuugccgaagcgauucacagcccucaaguugccggggugccccgcuuccgguuuggaccuccggaggauaugccccagacgucuagcucccauucugaccugggccagcucgcuagccagggcgggcuggggauguacgaaacaccucuuuuccuggcccacgaggaagaguccggcgggagaucugugcccaccaccccucuccaagucgcugcccccgugacaguuuuuaccgagagcacaaccuccgaugccucugaacaugcuagccaguccgugccgauggucacgacaagcaccggaacacugucuaccacgaaugagaccgcgacaggcgacgauggggacgaaguguucguugaggccgaauccgagggaaucagcucugaggcuggccuggaaauugacucccagcaggaggaggaaccugugcaagccagcgaugaguccgaccuccccucuaccagccaggaucccccuuccuccucuagcgucgacacaagcucuagccagcccaagccuuuucgccgggugagacuucaaaccacacugcgccagggggucagaggacggcaguucaaccgccagagaggcgugucccacgccaugggcgggcggggaggcaucaauagagggaacaucaauuga

SEQ ID NO: 77196 - RNA, 2136 nt, Artificial Sequence
  derived and/or modified sequence opt5 from TPRN__Homo_sapiens__NP_001121700
auggccgcucugggcagacccgggagcggaccucgggccgcggugccggcuuggaagcgcgagauccucgaaagaaaacgggccaagcuggccgcucuuggcgggggagccggccccggggcugccgagccugaacagcgcguccuggcggagucccucggaccccugagagaaaacccuuucaugcuucuggaggccgagcggcgcagaggcggcggggcugccggagcucggcuccuggaacgcuacagacggguucccggcgugcgcgcccugagagcggacucugugcucauuaucgagaccgucccuggguuuccgcccgccccucccgcuccuggagccgcucaaauucgggccgccgaagugcugguuuauggcgcucccccggggcgcgugagcagacuucuggagcgguucgauccucccgcggccccuagacgccggggaucccccgagagagcucgcccucccccgcccccucccccucccgccccgccucggcccccucccgccgcuccuucucccccggccgcgccuggccccagaggcgggggagcuagccccggcgcccgccgguccgacuuucuccagaaaacagggucuaauagcuucacgguccacccuagaggacugcaucgcggcgccggggcucggcuucuguccaacggacacagcgccccggaacccagagcuggcccugccaaucgccucgcgggcucucccccuggguccggacaguggaagcccaaaguggagagcggcgauccuucucugcaucccccgccuucccccgggaccccuagcgccacacccgcuucuccgccugccuccgcuacccccagccagcggcaaugcguuuccgccgcgacaucuaccaacgacagcuuugaaaucagaccugcccccaagcccgugauggagacaauuccucugggagaucuccaggcucgggcccuggcuucccuucgcgccaauagcagaaacucuuucauggucaucccgaaguccaaagccagcggcgcucccccucccgaagggcggcagucuguggagcugccuaagggcgaccucggacccgcgagcccuucccaggagcugggcucucaaccggugcccgggggagauggcgccccugcucuugggaaaagcccccuggaagucgaggcccagugggccguugaagagggagcuuguccuagaaccgccacggcgcucgcugaccgcgccauccgguggcagagacccuccagcccgccucccuuucugcccgccgcuucugaagaggccgagccugcggaaggccugcgcgugcccgggcucgcuaagaacuccagagaguacgugcggccuggccugccggucaccuucauugaugaaguggacagcgaggaagcuccccaggccgccaaacuuccuuaucugccccacccugcccgcccccuccauccggcuagaccuggaugcguugccgagcugcaaccccggggcucuaauacauuuaccguggucccuaagcgcaagcccgggacacuucaggaucagcacuucucccaagcgaauagagagccucggccccgcgaagccgaggaagaggaggcuagcugucugcucggaccgacccugaaaaagagauacccuacggugcacgaaaucgagguuauuggcggguaucuggcccuccagaaauccugccugacaaaggcuggaucuagccggaaaaagaugaaaaucuccuuuaacgacaagucucuucagaccacauucgaauaccccagcgaguccagccuggaacaggaggaggaaguggaucaacaggaggaagaggaagaggaggaagaggaagaggaagaggaggaagagggcucuggguccgaagagaagcccuuugcccucuuccugccucgcgccaccuucgucagcucugugagaccggaguccagccggcugcccgaaggcucuagcggacuuuccagcuauaccccuaaacauucugucgcuuuuuccaaguggcaggagcaggcgcucgaacaagcccccagagaggcugaaccucccccuguggaggccaugcugacaccggccagccagaaugaccuguccgacuuccgcucugagcccgcucucuacuuuuga

SEQ ID NO: 77197 - RNA, 828 nt, Artificial Sequence
  derived and/or modified sequence opt5 from TPSAB1__Homo_sapiens__NP_003285
augcugaaccuccugcuucuggcccuccccgugcuggcuagcagagccuacgcggcuccugccccgggccaggcccuucaacgggucgggaucguuggaggccaggaggcuccccgcuccaaguggccuuggcaagugucucugagagugcacgggcccuauuggaugcauuucugcggaggcagccucauucacccucaguggguccugaccgccgcucauuguguggggcccgacguuaaagaucuggccgcgcuccgggugcagcugcgcgaacagcaccuuuacuaucaggaccagcugcucccugucuccagaaucauugugcauccgcaauuuuacacagcccagaucggagcugauauugcccugcuugagcuggaggaacccguuaaugugucuagccacguccacacggugacccucccucccgcuuccgaaacauucccucccggcaugccgugcugggugaccggcuggggagacgucgauaacgacgagcggcugccucccccuuuuccccugaagcagguuaaagugcccaucauggagaaucauaucugugaugccaaguaucaccucggggcguacacaggcgacgaugugcgcauugucagagacgauaugcugugcgccgggaacacccggcgcgacucuugucagggagauagcggcgggccucuugugugcaaaguuaauggaacauggcugcaagcuggcguggucuccuggggcgaagggugugcccagccgaacagacccggaaucuauacccgggugacguacuaccucgacuggauucaucacuauguuccuaagaagcccuga

SEQ ID NO: 77198 - RNA, 828 nt, Artificial Sequence
  derived and/or modified sequence opt5 from TPSB2__Homo_sapiens__NP_077078
augcugaaccuccugcuucuggcccuccccgugcuggcuagcagagccuacgcggcuccugccccgggccaggcccuucaacgggucgggaucguuggaggccaggaggcuccccgcuccaaguggccuuggcaagugucucugagagugcgggaccgcuauuggaugcacuucugcgggggaagccucauucauccccaguggguccugaccgccgcucacugugugggcccugauguuaaagaccuggccgcgcucagagugcagcugcgggaacagcaucuuuacuaucaggaucagcugcuccccgucucccgcaucauugugcacccucaauuuuacacagcccagaucggggcugacauugcccugcuugagcuggaggaaccgguuaaugugucuagccauguccacacggugacccugcccccugcuuccgaaacauuucccccuggaaugcccugcugggugaccggcuggggcgaugucgacaacgaugagagacucccgccucccuucccucugaagcagguuaaagugcccaucauggagaaucacaucugugacgccaaguaucaucucggggcguacacaggagaugacgugcggauuguccgcgaugacaugcugugcgccggcaacaccagacgggauucuugucagggggacagcggaggcccccuugugugcaaaguuaaugggacauggcugcaagcuggaguggucuccuggggcgaaggcugugcccagccuaaccgcccggggaucuauaccagagugacguacuaccucgacuggauucaccauuauguucccaagaagccuuga

SEQ ID NO: 77199 - RNA, 729 nt, Artificial Sequence
  derived and/or modified sequence opt5 from TPSD1__Homo_sapiens__NP_036349
augcugcuccuggcuccccagaugcuuagccugcuccugcuugcccugccugugcucgccuccccggcguacgucgcucccgccccuggccaagcccugcagcagaccgggaucguuggaggccaggaggcucccagaucuaaguggccuuggcaagugagccugcgggugcgcgggcccuauuggaugcacuucugcggaggcucccucauucauccucaguggguccugacagccgcucacuguguggaaccggacaucaaagaucuugccgcgcugagaguucagcuccgggagcagcaucuguacuaucaagaccagcuucugcccgugucucgcauuaucguccacccucaguuuuacauuauccagacgggggccgauaucgcucuccuggaacuggaggaacccgugaacauuagcucccauauccacaccguuacacucccucccgccucugagaccuucccgccuggaaugcccugcugggugacaggcuggggcgacgucgauaauaacgugcaucugccuccucccuauccccuuaaggagguggaagucccgguuguggagaaucaccuguguaacgcugaauaccacaccgggcuccauacaggacacagcuuucaaauugugagagacgauaugcugugcgccggcuccgagaaucacgacagcugucagggggauucuggaggcccccuugucugcaaagugaacgggaccuga

SEQ ID NO: 77200 - RNA, 966 nt, Artificial Sequence
  derived and/or modified sequence opt5 from TPSG1__Homo_sapiens__NP_036599
auggcccugggcgcuugcgggcuccugcuucugcucgccgugcccggagucagccugagaacccuucagccuggcugugggcggccgcaaguuuccgacgcgggaggccgcaucgucgggggacacgcugcccccgccggcgcuuggccuuggcaggccucucugagacuccggcgcgugcaugugugcggcgggagccugcugucuccccagugggugcucacagcugcccacuguuucuccggaagccugaacuccucugauuaccagguucaucuuggcgagcuggaaauuacgcucagcccucacuuuuccaccgugagacaaaucauucugcauagcucucccuccgggcagccuggaacaagcggcgacaucgcgcuugucgagcugucugugccgguuacccucuccagccggauucugcccgugugccugccugaagccucugaugacuucugucccgggauccgcugcugggucacaggauggggcuauaccagagagggcgaaccucugcccccgccuuacucccuccgggaggugaaggugagcgucguugauacagagaccugucgcagagacuaucccgggccuggaggcuccauccuucagcccgauaugcugugcgcucgggggcccggagacgccugucaggaugacucuggcgggccucucgugugccaagugaauggagcuuggguccaggccggcauugugagcuggggcgaaggguguggacgcccgaacagacccggcguuuacacgcgggugccugcguaugucaauuggauccgcagacacauuaccgccuccgggggaagcgagucuggcuacccccggcugccucuucuggcuggguuuuuccuccccggccuguuucugcuccugguguccugcguucuucuggccaaaugccuccugcacccgagcgcugauggaacaccuuuccccgccccugacuga

SEQ ID NO: 77201 - RNA, 417 nt, Artificial Sequence
  derived and/or modified sequence opt5 from TPT1__Homo_sapiens__NP_001273202
auggugagcagaaccgagggcaacaucgacgauucccugauugggggaaaugccucugcugaaggccccgagggggaaggaacagagagcacggucaucaccggcguugacauugugaugaaccaccaucuccaggaaacauccuucaccaaggaggccuacaaaaaguauaucaaagauuacaugaagucuauuaaagggaagcuggaggaacaacggccugagcgcgugaagccguuuaugacaggagcggcugaacagaucaaacacauccuugccaauuucaagaacuaucaguuuuucauuggcgagaauaugaaccccgacggcauggucgcccugcucgauuacagagaggacggggugaccccuuauaugaucuuuuucaaagauggacuggaaauggagaagugcuga

SEQ ID NO: 77202 - RNA, 1236 nt, Artificial Sequence
  derived and/or modified sequence opt5 from TPTE2__Homo_sapiens__NP_001135440
augaacgagagcccccagaccaaugaguucaagggcacaacggaagaagccccugcuaaagaguccccgcacaccucugaauuuaagggggccgcgcuggugagccccaucuccaaaucuaugcucgagagacugagcaaguucgaggucgaagacgcugagaacguugccuccuacgaauggacacaucuugugcggcugcuccgccugauuauccuuauuagaaucuuucaucugcuccaccaaaaacggcagcuggagaagcugaugcgcagacucgugucugagaauaagcggcgcuacaccagagauggauucgaccuggaucuuacauacgucaccgaacggauuaucgccaugagcuuuccuuccagcggccgccagucuuucuauagaaaccccaucgaggaagugguucgguuucuggacaaaaagcaccgcaaucauuacagaguguauaaccucugcuccgagcgggcuuacgauccuaaacacuuccacaaucgcgucagcagaauuaugaucgacgaucauaacgugcccacacugcacgaaaugguuguguuuaccaaggaggucaaugaguggauggcccaggaccuugaaaacauuguggcuauccauuguaaagggggaaagggccggacggggaccauggugugcgcccugcucauugcgucugagaucuuccugacagccgaagagucccuguauuacuuuggagaaagacgcaccaauaagacacacagcaacaaauuccaaggcgucgagaccccuucucagaaucgguacguuggcuauuuugcucaggugaagcaccucuacaacuggaaucugccgcccagacgcauucuuuucaucaaacgguucaucauuuauuccaucagaggggaugugugugaccugaagguccaggugguuauggagaaaaagguggucuuuagcuccacgucucucggaaacugcagcauucugcaugauaucgaaacagacaaaauucuuaucaacguguacgauggcccuccccuguaugacgacguuaaggugcaauucuuuuccagcaaucucccuaaguacuaugauaacugucccuucuuuuucugguuuaauaccucuuucauccagaacaaucgccugugccugccgcggaacgagcucgacaauccucacaaacagaaggccuggaaaauuuaucccccugaauuugcugucgagauccuguucggggaaaaguga

SEQ ID NO: 77203 - RNA, 1602 nt, Artificial Sequence
  derived and/or modified sequence opt5 from TPTE__Homo_sapiens__NP_954868
augaacgagagccccgacccuaccgaucuggccggcgugaucauugaacucgggccgaaugacucuccccagacauccgaguucaagggagcuacggaagaggccccugcgaaagaaagcguccuggcuagacuuuccaaguuugagguugaggaugccgaaaacguggccucuuacgacagcaaaaucaagaaaauugugcacuccaucgucucuagcuucgcuuuuggccuguucgggguguuucucguucugcuugaugugacccugauucucgccgaccugaucuucacagauuccaagcuguauaucccccucgaguaccggagcauuucucuggcuaucgcccuguuuuuccuuauggacguccuccugcgcguguuuguugaaagacggcaacaguauuucuccgaucuuuuuaauauucuggacaccgcgaucauugugauccuccugcuggucgaugugguguacauuuucuuugacaucaagcuccugcgcaacaucccuagauggacacaucuucugcggcuccugcgccuuauuauccugcucagaauuuuccaccuguuccaucagaaacggcagcuggagaagcucauccgcagacgggucagcgagaauaaacgcagauauacccgggauggauuugaccuggaccuuacauacguuaccgaacgcauuaucgccaugucuuuccccuccagcggcagacaaucuuuuuaucggaacccuaucaaggagguggugagauuccuggauaaaaagcaccgcaaucauuaccgggucuacaaccucugcuccgaaagagcuuaugacccgaagcacuuucacaaucgcgugguucggauuaugaucgaugaccauaacgugcccacgcugcaccagauggucguguucaccaaagagguuaaugaauggauggcccaggaucuugagaacauuguggcuauccauuguaaagggggaacagacagaaccggcacaauggucugcgccuuucugauugcgagcgagaucuguuccaccgccaaggaaucucucuacuauuucggcgagcgccggacggauaagacacacagcgaaaaauuucaggggguggagaccccuucccaaaagagauacgucgcuuauuucgcccaggugaaacaccuguacaauuggaaccugcccccucgccggauccucuuuauuaagcauuucaucauuuauagcauccccagauacguucgcgaccugaagauucagaucgaaauggagaaaaagguggucuuuucuacaauuucccuuggaaaaugcagcgugcuggauaauaucaccaccgacaagauccucauugauguuuucgacggccugccgcuguacgacgaugugaaaguccaguucuuuuauucuaaccuuccuacauacuaugacaacuguagcuucuacuuuuggcuccacacguccuucaucgagaauaaccggcuguaucugcccaagaaugaacucgauaaccugcauaagcaaaaagcuagacggauuuacccuucugacuuugccguggagauccuuuucggggaaaagaugaccagcuccgaugugguugccggaagcgacuga

SEQ ID NO: 77204 - RNA, 2244 nt, Artificial Sequence
  derived and/or modified sequence opt5 from TPX2__Homo_sapiens__XP_011527001
augagccaggugaaguccucuuacagcuaugacgcccccuccgauuucaucaacuuuucuagccuggacgaugagggcgacacccaaaauauugauuccugguucgaagagaaagcuaaccucgaaaauaagcugcuugggaaaaacggaacaggcgggcuguuucagggaaagacgccucucagaaaagccaaucugcagcaggcgaucgucaccccgcuuaagcccguugacaacacauacuauaaggaggcugaaaaagagaaucugguggagcaaucuauuccuagcaacgccugcuccagccucgaaguggaggccgcuaucucucggaagacccccgcccagccucagcgcagaucccugcggcugagcgcucagaaagaucucgaacaaaaggagaaacaccaugucaagaugaaggccaaacgcugugcgacacccgugauuaucgacgagauccugccuucuaagaaaaugaagguuuccaauaacaaaaagaaaccggaagaggaaggcagcgcccaccaggauaccgcugagaagaaugccucuucccccgaaaaggcuaaagggagacauacagugccuugcaugcccccugccaagcagaaauuccuuaagagcaccgaggagcaggaacuggagaaauccaugaagaugcaacaggaagucguggagaugcggaagaaaaacgaagaguuuaagaaacucgcgcuggccggaauuggccagcccguuaagaaaucugugagccaagucacgaaguccguggacuuccacuuucgcaccgaugagagaaucaagcagcauccgaaaaaucaggaagaguacaaggaagugaacuucacaagcgagcuucggaaacacccuucuucccccgcucgcgucaccaagggcuguacaauuguuaaaccuuuuaaucugagccaggggaagaagagaaccuucgacgaaacggugucuacauaugugccccucgcccaacaggucgaggauuuucacaaacggacccccaaccgcuaccaucugagaagcaagaaagacgacaucaaccugcucccuuccaagucuagcgugacaaaaauuugccgggauccgcagacccccguucugcagaccaagcaccgcgcuagagccgugacauguaaauccacggccgagcuugaagcugaggaacuggagaagcuccaacaguauaaguucaaagcgcgggagcuggacccuagaauccuugaaggaggccccauucugccuaagaaacccccggucaagccucccaccgagccuaucggguuugaucucgaaaucgagaaacgcauucaggaacgggagagcaagaagaaaacagaggacgaacauuucgaguuccacucuagacccugcccuaccaagauccuggaagaugugguuggagugcccgagaaaaagguccugccgauuacagugccuaaaucccccgccuuugcucucaagaaucgcauccggaugcccaccaaggaagacgaggaggaagaugagccugucgugauuaaagcccagccgguuccccacuacggcgugccuuucaagccccaaaucccugaagccagaacggucgagaucugucccuuuagcuucgacucucgcgauaaagaacggcagcugcagaaggagaaaaagauuaaggagcuucagaaaggggaagugccuaaguuuaaagcucugccccucccgcauuucgacacaaucaaccugccugagaagaaaguuaagaaugugacccaaauugaacccuuuugccuugagaccgauagacgcggagcccugaaagcgcagacauggaagcaccagcucgaggaagaacugcggcaacagaaggaagcugccuguuucaaagccagaccuaacaccgucaucucccaggagcccuuugugccgaagaaagaaaagaaaagcguggcugagggccuguccggcucucucguucaggagccuuuccaacuggccacagaaaagcgcgcuaaggagcggcaggaacuugagaaaagaauggccgaagucgaggcgcagaaggcccagcaacuggaggaagcucggcuccaggaggaggagcagaaaaaggaggaacuggcccgccugagacgggagcuugugcauaaagcuaaucccauuagaaaguaccaggggcucgaaaucaagagcuccgaccaaccucugacggugcccgucucucccaaauuuagcacccgcuuccacugcuga

SEQ ID NO: 77205 - RNA, 543 nt, Artificial Sequence
  derived and/or modified sequence opt5 from TRA2A__Homo_sapiens__NP_001269688
augagcaacagacggcgccacaccggcuccagagccaaucccgacccuaacacaugccuggggguguucggacucucucuguacacgaccgagcgggaucuucgcgaagucuuuagcagauauggcccgcuguccgggguuaaugugguguacgaccagcggacaggacgcucuagaggcuucgcuuuugucuauuucgagcggaucgaugacagcaaggaagccauggagcgcgcgaacgggauggaacucgauggaagacggauucgcguggacuacuccaucaccaaaagagcucauacacccaccccuggcauuuauaugggccggcccacacacucugggggaggcgggggaggcgggggaggcggcgggggaggcgggggaggccgcagacgggauagcuacuaugacagaggguacgaucgcggauacgaccgguaugaggauuacgacuauagauaccgccgguccccuagccccuauuacucuagauaucgcucccggagcagaucucgcuccuacagcccucggagauacuga

SEQ ID NO: 77206 - RNA, 567 nt, Artificial Sequence
  derived and/or modified sequence opt5 from TRA2B__Homo_sapiens__NP_001230808
augagcaccagacggcgccacgugggcaacagagccaaucccgacccuaacugcugucugggggucuucggacucucccuguacacaacggagcgggaucuucgcgaaguguuuucuaaguauggcccgaucgcugacguuagcauuguguacgaucagcaauccagacggucucgcggguucgccuuugucuauuucgagaauguggacgaugcgaaagaagcuaaggagagagccaacggaauggaacuggacggccggcgcaucagaguugauuuuagcauuaccaaacggccccauacaccuacccccgggaucuacaugggacgcccuacauauggcuccucuagacggcgcgacuacuaugauagaggcuacgaccggggguacgaugacagagauuauuacagccgcuccuaucggggaggcgggggaggcgggggaggcuggagagccgcucaggaccgcgaccagauuuaccggagacgcagccccucuccuuauuacucccggggcggguauagaagccgcucucgguccagaagcuacucuccgcgccgguacuga

SEQ ID NO: 77207 - RNA, 1371 nt, Artificial Sequence
  derived and/or modified sequence opt5 from TRABD2A__Homo_sapiens__NP_001074293
augagccccugguccugguuccugcuccagacccugugccuucugccuacaggcgccgcuucuagacgcggggccccgggaacggcgaacugugagcucaagccccaacagagcgaacucaauuccuuucuuuggaccaucaaacgggacccucccucuuacuucuuuggcacaauucacgugccuuauaccagagucugggauuucauccccgacaacagcaaggaggcuuuucugcaguccucuauuguuuacuucgaacucgaucugacagacccuuauaccaucagcgcccugacauccugccagaugcucccgcaaggggagaaucugcaggaugugcuuccccgggacauuuacugucgccugaaaagacaucucgaauaugugaagcugaugaugccucuuuggaugacccccgaucagcggggaaaaggccuguacgccgacuaucucuuuaacgcuaucgccgggaauugggagcgcaagagaccugucugggugaugcugaugguuaacagccugacggagguggauaucaagucucggggaguccccgugcucgaccuguuccuugcucaggaagccgagcgccugagaaaacaaaccggcgcgguugaaaagguggaggagcagugccacccgcucaauggccugaacuuuucccaggucccuaauuucauuaacgccacacuucccccucaggaacggaucaccgcucaagagauugauagcuaccugcgcagagaacucaucuacaaacggaaugagcgcauugggaagagagugaaagcccugcuggaagaguuucccgacaagggauucuuuuucgcuuucggcgccgggcauuuuaugggaaacaauacagugcucgauguccugcggagagagggcuaugaaguugagcacgcgcccgccgggcgcccuauccauaagggaaaaucuaagaaaaccuccacgcggccgacacuuagcaccauuuucgcucccaaggugccuacacuggaagugcccgccccugaggcugucucuuccggccacagcacccugcccccgcugguguccagaccuggcucugccgacacccccagcgaagccgagcagcgcuuucggaaaaagagacgccggucccagagacgcccucggcuuagacaauucagcgaccuguggguucgccucgaggaaucugauaucgugccccagcugcaggucccugugcuggaccggcacaucuccacagagcucagacugccccggcgcgggcauagccaccauucucagaugguugcuagcuccgcgugucuuucucuguggacgccgguguuuuggguccucgugcuggccuuccaaaccgaaacaccucugcuuuga

SEQ ID NO: 77208 - RNA, 1131 nt, Artificial Sequence
  derived and/or modified sequence opt5 from TRABD__Homo_sapiens__NP_079480
auggacggcgaggaacagcaacccccucacgaggccaacguggaaccggucguucccagcgaggcuuccgaaccugugcccagagugcugucuggggauccucagaaucucagcgacgucgaugccuucaaccugcuucuggagaugaagcucaaacggcgcagacagcggcccaaucugccucgcaccgugacacagcuuguugcggaggacggauccagaguguacgucgugggcacggcucauuuuucugaugacagcaagcgggauguugugaaaaccauccgcgaaguccaaccggacgugguggucguugagcugugccaguauagaguguccaugcucaagauggaugaaucuacacugcugcgggaggcccaggagcucagccuggaaaaacuucagcaagccgugcgccagaacgggcugauguccggacucaugcagaugcugcuucugaaggucagcgcucacauuaccgagcagcucggcauggcccccgggggagaauuuagagaggcuuucaaggaagccucuaaagugccuuucuguaaguuucaucugggcgaccggcccaucccuguuacauucaaacgcgcgauugccgcucuguccuuuuggcaaaaggugagacucgccuggggccugugcuuccuuagcgaucccaucucuaaagacgaugucgagcgguguaagcagaaggaccugcucgagcagaugauggcugaaaugauuggggaguuuccggaccugcaccgcaccaucguguccgaaagagauguuuaccuuacauauaugcugcggcaagccgcgagacgccucgagcugccucgggccagcgacgcugaacccagaaaaugcgugccuucugucguggucggagugguuggcauggggcaugugcccggaaucgagaagaauugguccaccgaucugaacauucaggagaucaugacggugcccccuccgagcgucuccggccgcguuucucggcucgccgugaaagcugccuucuuugggcugcuuggauacagccuguauuggaugggcagacgcaccgccucccucguccugagccuucccgcugcgcaguacugucugcagcgggugacagaagccagacacaaguga

SEQ ID NO: 77209 - RNA, 939 nt, Artificial Sequence
  derived and/or modified sequence opt5 from TRADD__Homo_sapiens__XP_011521722
auggccgcuggccagaacgggcacgaggaaugggugggaagcgccuaccuguucgucgaguccucucucgacaagguugugcugagcgaugcguaugcucauccccaacagaaaguggccgucuacagagcccuucaggcugcccuggcugaauccggcgggucuccugacgugcuccagaugcugaagauccaccggagcgauccgcaacuuauuguucagcugcgcuuuugcggaagacagcccuguggccgguuccuccgcgccuauagagagggggcgcugcgggccgcucugcagcgcucccucgccgcugcccuggcgcaacauucugugccucuucagcuggaacucagagccggagcugagcggcuggacgcccuucuggcugaugaggaacgcugccucagcuguauccuggcccagcagcccgacagacugcgggaugaggaacucgccgagcuggaggacgcgcuucgcaaucugaaaugcggcuccggcgcuagagggggagauggcgaagucgccagcgcuccucuccaacccccugugccgucucuguccgagguuaagcccccucccccucccccgccugcccagaccuuucuuuuccaggggcaacccguggucaaccggccucugagccucaaagaccagcagacauuugcccgcucugugggacugaaguggagaaaggugggccggucccugcagagagggugucgcgcucuccgggaucccgcccuggacagccuugcguacgaauaugagagagaaggacuguacgagcaggcuuuccaacuccugcgccgguuuguccaggccgagggcagacgcgccacgcuucagcggcugguugaagcucucgaggaaaaugagcugaccucucuggccgaagaucuccugggccuuacagaccccaacgggggacuggcuuga

SEQ ID NO: 77210 - RNA, 885 nt, Artificial Sequence
  derived and/or modified sequence opt5 from TRAF1__Homo_sapiens__NP_001177876
augaagcaguggaaagccagacugggcugcgggcucgagagcggacccauggcucuggaacaaaaccuuuccgaccugcagcuccaggccgcgguggaggucgcuggcgaucuggaaguugacuguuaccgggccccuugcucugagagccaggaggaacuugcccugcaacacuucaugaaggagaaacuccuggcugaacuggaggggaagcuccgcguguuugaaaauaucguggccguccugaacaaagagguggaggcuucccaucuugcccuggcgaccucuauucaccagagccagcucgauagagaacggauccugucccuugagcagcgcguuguggaacugcaacagacacucgcccagaaggaccaggcucugggaaagcuggagcaaucucucagacugauggaagaggccagcuucgauggcacguuucuuuggaaaauuaccaaugucacacggcgcugucaugaguccgcuugcgggagaaccgugagccuguucucuccggccuuuuauacagcgaaguacggauauaaacucugucugcggcuuuaccugaacggcgacggcaccgggaagcgcacacaccucucccuguucaucguuauuaugagaggagaauaugaugcccugcuccccuggccuuuucggaauaaagugaccuucaugcugcuugaccagaacaaucgcgagcaugcuaucgaugccuuuagacccgaccugagcucugcuuccuuccagcggccucaaagcgaaacgaacgucgccucuggcugcccccucuuuuucccucuguccaaacuucagagcccgaagcacgccuacgugaaggaugacaccauguuucugaaguguaucguggagacauccaccuga

SEQ ID NO: 77211 - RNA, 1506 nt, Artificial Sequence
  derived and/or modified sequence opt5 from TRAF2__Homo_sapiens__NP_066961
auggccgcugccagcgugacacccccuggcucccuggagcuccugcagccgggguucucuaagacccuucugggaacgaaacucgaagcgaaguaccugugcagcgcuuguagaaacguccuucggcgccccuuucaagcccagugcggccacagauauuguuccuucugccuggccucuauccucagcuccgggccucagaauugugcugccugcguucaugagggaauuuacgaagagggcaucucuauucuggaaagcuccagcgcuuuucccgacaacgccgcgcggcgcgagguggagucucugccugccgugugucccuccgaugggugcaccuggaaaggaacacucaaggaauaugagagcugucacgaaggcagaugcccucugaugcuuaccgaguguccggcuugcaaaggccugguccggcucggggagaaggaacgccaucuggagcacgaaugccccgagagaucucuuuccugucggcauugccgcgccccuuguugcggagcugacgugaaggcccaccacgaaguuugucccaaauucccucugacaugcgauggcugugggaagaaaaagauccccagagagaaauuucaggaccaugugaagaccugcggaaagugucgggucccgugccgcuuccacgcgauuggcugucucgagacaguggaaggggagaaacaacaggaacaugagguucaguggcugagagaacaccuggccaugcuccugagcucugugcuugaggcuaagccucugcucggagaucagucccacgccggcagcgagcugcuucaacggugcgaaucccuggagaaaaagaccgcuacguuugaaaauaucgucugcgugcucaaccgcgagguggaaagagucgccaugaccgccgaggcuuguucucggcagcauagacuggaccaggauaaaaucgaggcgcugagcuccaagguucagcaacucgaacgcagcauuggccugaaagaccuugccauggcugaucuggagcagaaggugcucgaaauggaggccucuacauacgacgggguguucaucuggaagauuuccgauuuugcccggaaaagacaggaggcugucgccggacgcauccccgcgauuuucagcccugcuuuuuauaccucucgguacggcuauaagaugugccugagaaucuaccuuaauggggacggaacaggccgcgggacccaccugagccucuucuuugugguuaugaaaggacccaacgaugcccugcugcgguggcccuucaaucaaaaggugacgcucaugcugcuugaccagaacaauagagaacaugucauugacgccuuccgcccugaugugacauccucuagcuuucagcggccgguuaacgacaugaauaucgcuuccggcuguccccuguucugcccugugagcaaaauggaggccaagaacucuuacgucagagaugacgcuaucuuuauuaaggccaucguggaucucaccggccuguga

SEQ ID NO: 77212 - RNA, 1458 nt, Artificial Sequence
  derived and/or modified sequence opt5 from TRAF3__Homo_sapiens__NP_001186356
auggagagcuccaagaaaauggacucucccggcgcccugcagaccaacccuccgcucaagcugcacacagauagaagcgcugggacgcccguguucgucccugaacaaggaggcuacaaagagaaguuuguuaaaaccguggaagacaaguauaagugcgagaaaugucaucuugugcugugcucccccaagcagacagaaugugggcaccgguucugcgagucuuguauggccgcgcuccugagcuccucuagcccuaaaugcaccgcuugucaggaguccaucgucaaggauaaaguguuuaaggacaauugcuguaagcgcgaaauucuugcccugcagaucuacugcagaaacgagagccggggaugugccgaacaacucaugcugggccaucugcucguucaccugaaaaaugauugccauuucgaggagcuucccugcgugcgcccugacuguaaggaaaaaguccugagaaaggaucuccgggaccacguggagaaggcuugcaaauaucgcgaagccacauguucucacugcaaaucccagguuccgaugauugcucugcaagugagccuucugcagaacgagucugucgaaaagaauaaguccauccagagccuccauaaccagauuuguucuuuugagaucgagaucgaaagacagaaagagaugcugcggaauaacgaauccaagauucugcaccuccagcgcgugaucgauagccaagccgagaaacugaaggaacuugacaaagagauuagacccuuccggcagaauugggaggaagcggauuccaugaagucuagcguggagucccugcagaaccgcgucaccgaacucgagagcguugacaagucugccgggcaaguggcuagaaauacaggacugcuugaaucccagcugagccggcaugaucagaugcucucugugcacgacauccgccuggccgacauggaucugagauuucagguccucgagaccgcuagcuacaacggcgugcugauuuggaaaauccgggacuauaagagacgcaaacaagaggccguuaugggcaagacgcuuucccuguacucucagccuuucuauaccggguacuuuggauacaaaaugugcgcgcggguguaucucaauggcgaugggaugggaaagggcacacaccugagccuuuucuuugucauuaugagaggggaauacgacgcccugcuccccuggccuuucaagcagaaagugacccugaugcugauggaucagggauccagccgccggcaucucggcgacgcuuuuaagcccgauccgaacucuuccagcuucaaaaagccuacaggcgagaugaauaucgccucugggugucccguuuucguggcucaaaccguccuggaaaacggaacguauaucaaagacgauacaauuuuuaucaaggugauugucgacaccuccgaucuuccugaccccuga

SEQ ID NO: 77213 - RNA, 1878 nt, Artificial Sequence
  derived and/or modified sequence opt5 from TRAF3IP1__Homo_sapiens__NP_001132962
augaacgccgcuguggucagacggacccaagaggcccugggcaagguuauccgcagacccccucucacagaaaaacugcuuagcaagccgcccuuccgguaccugcacgacauuaucacggaggugauucgcaugaccggguuuaugaaaggacucuauacagaugcggaaaugaaguccgacaaugugaaagauaaggacgcuaagaucucuuuccugcaaaaagccauugaugucgugguuauggugagcggcgagccucuucuggccaagcccgcuagaaucgucgccgggcaugaaccugagcggaccaacgagcuccugcagaucauuggaaaaugcugucugaauaagcucuccucugacgaugcugugcgcagaguucuggccggcgaaaaaggggaggugaagggacgggcgagccuuacaucccgcucucaggaacuggacaacaagaaugucagagaggaggaaagccgggugcacaaaaacaccgaggaucgcggcgacgccgaaaucaaggagagauccacaagccgggaucgcaaacagaaggaggaacucaaagaggacagaaagccccgggaaaaagauaaggacaaggagaaagcuaaggaaaauggcgggaacagacaucgcgagggagaacgggagagagccaaagcucgcgcccggccugacaaugagagacaaaaggaucgcggcaaccgggaaagagaccgcgauucugagcggaaaaaggaaaccgagagaaaguccgaagggggaaaagagaaggagcgccugcgggacagagaucgggaacgcgacagagauaaaggcaaggaccgggauagacgccgggugaaaaauggggagcacagcugggaccuugauagagaaaagaaccgcgagcaugacaagccggagaaaaagucugcguccagcggagaaaugucuaaaaagcuguccgacggcacguuuaaagauagcaaggccgagaccgaaacagagauuuccaccagagcuucuaagagccucacaaccaaaacguccaagcggcgcagcaaaaauucugucgaaggcgacuccacaagcgaugccgagggggacgcuggacccgccggccaggauaagucugagguuccugaaacccccgagaucccuaacgaacugagcuccaauauuagacggaucccccgcccggggucugccagaccugcucccccucgggugaaacgccaggacagcauggaggcgcugcagauggauagauccggaagcggcaagacagugucuaacgucauuaccgaaucccacaacagcgacaaugaggaggaugaccaauucgugguugaagccgcuccccagcucucugagauguccgaaaucgagauggugaccgccgucgaacuggaggaggaagagaaacacgggggacuugugaagaagauccuggaaacgaaaaaggauuacgagaaacuccagcagagccccaagccuggcgagaaagaacggucccuguuugagucugccuggaagaaggaaaaagacauuguuagcaaggagaucgaaaaacuucgcacauccauucaaacccugugcaagucugcucucccgcugggcaaaaucauggauuauauucaggaggacguggacgccaugcagaacgagcugcaaauguggcauagcgaaaauagacagcacgcggaggcucuccagcaggaacaacggaucacagauugugccgucgagccccugaaggccgaacuugcugagcuggagcagcucaucaaggaccagcaggauaaaauuugcgccgugaaggcuaacauccugaaaaaugaagagaagauucagaaaauggucuacuccaucaaccuuaccagcagacgcuga

SEQ ID NO: 77214 - RNA, 1695 nt, Artificial Sequence
  derived and/or modified sequence opt5 from TRAF3IP2__Homo_sapiens__NP_001157753
augaacagaagcauccccguggaggucgacgaauccgagccuuacccgucucagcugcucaagcccauuccugaauauagccccgaggaagaguccgagccucccgccccuaauauccggaacauggcucccaauucucugagcgccccgaccaugcuucacaacuccucuggcgauuucagccaagcgcauuccacacugaaacucgcuaaucaccagcgcccuguuagcagacaggugacgugccugcggacccaggugcuugaagacucugaggauuccuuuugucgcagacaucccgggcugggaaaggccuucccuagcggcugcucugccgucuccgaacccgcuagcgagucugugguuggggcccucccggcugagcaccaauuuuccuucauggaaaaacggaaccaguggcuggugagccagcuguccgccgcgucuccugacacaggacaugauagcgacaaguccgaucagagccuccccaaugccucugcugacucccugggcgggagccaagagaugguccagcgcccucagccccacagaaaccgggccggacuugaucugcccaccauugacacaggcuacgauucucagccucaagacgugcucggcauccgccagcuggaaagaccgcuuccccugaccagcguuuguuauccucaggaucucccccggccucugcgcuccagagaguuuccccaauucgaaccgcagcgguacccugcuugcgcccagaugcugcccccuaaucucucuccccacgcgccuuggaacuaucauuaccacugucccgggagcccggaccaucaggugccuuauggacacgacuacccccgcgccgcuuaccaacaggucauucagcccgcccugccuggccagccgcuucccggggcuuccgugagaggacugcacccugugcaaaaagucauccucaauuaucccagcccuugggaucaugaggagcggcccgcccagagagacugcucuuuuccuggccugccccgccaccaggaucagccgcaucaccaaccucccaaccgggccggggcuccuggagaaucccuugagugucccgcggaacugagaccgcagguuccucagcccccuagccccgccgcugugccccgcccuccgucuaaucccccugcccggggcacacucaagaccuccaaccugcccgaggaacugagaaagguguucaucacguacagcauggacaccgccauggaggucgugaaauuuguuaauuuccuccuggugaacggcuuucagacagcuauugauaucuucgaggaccgcauucgggggaucgauauuaucaaguggauggaaagauaucuucgcgacaccgucaugauuaucguggccaucuccccuaaauacaagcaagauguugagggagcggaaucucagcuggacgaggaugaacauggccuccacacaaaauauauucaccggaugaugcagaucgaguuuauuaagcaagggagcaugaacuucagauucauccccgugcuguuuccuaaugcuaagaaagagcaugucccgaccuggcuucagaacacgcacguguacuccuggcccaagaauaaaaagaacauucugcuccgccugcugcgggaagaggaauaugucgccccucccagaggaccucuccccacacuucaggugguuccgcuguga

SEQ ID NO: 77215 - RNA, 1413 nt, Artificial Sequence
  derived and/or modified sequence opt5 from TRAF4__Homo_sapiens__NP_004286
augcccggcuucgacuacaaguuucuggagaaaccuaagagacggcuccugugcccgcuuugugggaaacccaugcgcgaaccugugcaggucagcacaugcggacacagauucugugauaccugccugcaagaguuucucuccgaaggcguuuucaagugucccgaggaccagcugccucuugauuaugccaaaaucuaccccgacccugaacuggagguccaggugcucgggcugccgauucggugcauccauucugaggaaggaugucgcuggagcggcccccugagacaccuccaggggcaucugaacacgugcuccuuuaaugugauuccuugucccaaccggugcccuaugaaacuuucucgcagagaucugcccgcucaccuccaacaugacuguccgaagcggcgccugaagugcgaguucugcggaugugauuuuagcggcgaagccuaugagucccacgagggcaugugcccucaggaaucuguguacugugagaauaagugcggggcgagaaugaugcggcgccuucuggcucagcacgccaccagcgaaugucccaaaagaacacagccuugcaccuauuguacaaaggaguucguuuuugacaccauccaaucccaucaguaccagugcccccggcuccccguggccuguccuaaccagugcggagucggcacaguggcucgcgaagaucugccggggcaccugaaagacagcuguaauaccgcccucguucugugccccuucaaggauucuggaugcaagcauagauguccuaaacuugcuauggcccggcacguggaggaguccgucaagccccaccuggcgaugaugugcgcccucgugagcagacaacgccaggaacugcaggagcuucggagagaacuggaggaacucucugugggcuccgacgggguccugauuuggaaaaucggaagcuauggccgccggcugcaagaggcuaaggccaaaccuaaccucgaguguuuuucucccgcuuucuacacgcauaaguacggcuauaaacugcagguuuccgccuuucuuaaugggaacggaagcggcgaagggacccaccugucccucuacaucagagugcugccgggagcguucgauaaucuucuggaguggccuuucgcccgccgggugacauuuucucuccuggaccagagcgaccccggccuggcuaagccucagcaugucaccgaaacauuccaccccgauccuaacuggaagaauuuucaaaaacccgggaccuggagaggaucccucgacgagagcucucugggcuucggcuauccgaaguuuauuucccaucaggauauccgcaaacggaacuacgugagagacgaugccguuuucauucgcgcugccguggaacuuccucggaagauccugagcuga

SEQ ID NO: 77216 - RNA, 1674 nt, Artificial Sequence
  derived and/or modified sequence opt5 from TRAF5__Homo_sapiens__NP_665702
auggccuacagcgaggaacacaagggcaugcccugcggguucaucagacagaacuccggaaauucuauuagccuggacuuugagccuuccaucgaauaucaauucguggagcggcucgaagaacgcuacaaaugugcuuuuugccauucuguccugcacaacccgcaucagaccggcugugggcacagauucugccagcauuguauucuuagccugcgggagcucaauacaguucccaucugcccuguggauaaggaagugauuaaaucccaggaggucuuuaaggacaacuguugcaaacgcgaagugcugaaucuuuauguuuacuguucuaacgcccccggaugcaaugcgaaggugauccugggcagauaucaagaucaccuccagcagugucuguuccagccuguccaaugcagcaacgagaagugccgggagcccgugcugcgcaaagaccucaaggaacaccuguccgcuagcugucaguuuagaaaagagaagugccuuuacuguaaaaaggauguuguggucaucaaucugcagaaccaugaagagaaucucugcccugaauauccgguguucugucccaacaauugcgccaagauuauccugaaaacggagguggacgagcaccuugccgucuguccugaagcugagcaggauugccccuuuaagcauuacgggugugccguuaccgacaaacggcgcaaccugcaacagcacgaacacucugcucucagagagcauaugcggcuggugcuggaaaagaaugugcagcucgaggagcaaauuuccgaucugcacaaaagccuugaacagaaggagucuaaaauccagcagcuggccgaaacaauuaagaagcucgagaaagaguucaagcaauuugcgcagcuguucggcaaaaacggcuccuuucuuccuaacauccaggucuucgccagccauauugacaagucugcuuggcuggaggcccaggugcaccaacuccugcagaugguuaaucagcagcaaaacaaauucgaucugcgcccccucauggaggcuguggacaccgucaagcagaagaucacacugcuugaaaauaacgaucagagacuggccgugcucgaggaagagaccaauaaacaugacacacacaucaacauucacaaggcgcagcuguccaaaaaugaggaacgguuuaaacuucuggagggaaccugcuacaacgggaagcucaucuggaagguuacggacuauaagaugaaaaagcgcgaagccguggauggacauaccgucagcauuuucucccaaucuuuuuacacaagcagauguggcuaucggcugugcgcuagagccuaccugaauggggacggauccggccgcgggagccaccucucucuguauuucguggucaugcggggagaguuugauucccuucugcaguggccguucagacagcgcgugacccucaugcugcuggaccaaagcggcaaaaagaacaucauggaaacauuuaaaccugaucccaauucuagcuccuucaagcggccugacggcgagaugaacauugcuucugggugccccagauuuguugcccauagcgugcuugagaaugccaagaacgcuuacaucaaagaugacacccucuuccugaaggucgcgguggaucugacggaccucgaagaucuguga

SEQ ID NO: 77217 - RNA, 1569 nt, Artificial Sequence
  derived and/or modified sequence opt5 from TRAF6__Homo_sapiens__NP_665802
augagccugcucaacugcgagaauagcuguggcucuagccaguccgaaucugacugcuguguggccauggcuagcuccugcucugccgucaccaaggaugacagcguugggggaacagcguccacgggcaaccuguccucuuccuucauggaggaaauccaaggguacgauguggaguuugaucccccucuugaaagcaaauaugaguguccgauuugccugauggcucucagagaggccgugcagacccccuguggacaccgguucugcaaggccuguaucauuaaaucuauccgcgacgcuggccauaagugcccugucgacaaugaaauucugcuugagaaccagcuguuucccgauaauuucgccaaaagagaaauccucucccugauggugaaguguccuaacgaggggugccugcacaagauggagcuccggcaucuggaagaccaccaggcucauugcgaguuugcccuuauggauuguccccaaugccagcgcccuuuccagaaauuucacaucaauauucacauccugaaggacuguccgagacggcagguuagcugcgauaacugugcggccucuauggcuuucgaagacaaagagauucaugaucaaaauugcccccucgccaacgugaucugugaauacugcaauacaauucugauccgcgagcagaugccuaaccacuaugaccuugacugucccaccgcuccuauucccugcacauuuuccaccuucggaugucaugagaagaugcagagaaaucaccuggcccggcaccuccaggaaaacacacaaagccauaugcgcaugcuggcgcaggccguccacucccugucugugaucccggauagcggcuacaucuccgagguuagaaauuuucaggaaaccauucaucaacucgagggccggcuggugcgccaggaccaccagaucagagaacuuacggcuaaaauggagacccagagcauguaugucucugagcugaagcggacaauucgcacccucgaagauaagguggccgagaucgaagcucaacagugcaacgggauuuacaucuggaaaaucggaaacuucggcaugcaucugaagugccaggaggaagagaaaccuguggucauucacucccccggguuuuauacaggaaagccuggcuacaaacuuuguaugagacugcaccuccagcugcccaccgcccaacggugcgccaauuacaucagccuguucguucauacgaugcagggggaguaugacucucaccuccccuggccuuuccagggaacaauuagacugaccauccuugaucagagcgaagcuccggugcgccaaaaccaugaggaaauuauggacgcgaagcccgagcugcucgccuuucagcggccuacaauccccagaaauccuaaaggcuucggcuacgugaccuuuaugcaccuggaggcccuucgccagcggaccuucaucaaggaugacacacugcucgucagaugugaaguguccacgcgcuuugauauggggucucugcggagagagggauuccagccccgcagcaccgacgcuggcguuuga

SEQ ID NO: 77218 - RNA, 2013 nt, Artificial Sequence
  derived and/or modified sequence opt5 from TRAF7__Homo_sapiens__NP_115647
augagcuccggcaagucugccagauacaaccgguucagcgggggacccuccaaucugccuaccccggacgugacaacgggcacccgcauggagacaaccuuugggcccgcuuucucugccgucacaaccaucacaaaagcggauggaaccagcacguauaagcagcacugcagaaccccuuccucuagcuccacacucgcuuacagcccccgggacgaagaggauucuaugccucccauuuccaccccucgcagaagcgacucugccaucuccguucggagccugcauucugaauccagcaugucccuucgcucuacauuuagccugccggaggaagaggaggaacccgagccucucguguucgccgaacaacccuccgugaaacuguguugccagcuuuguugcagcgucuuuaaggauccugugauuaccacguguggccacacauucugcagacggugugcucugaaaucugagaagugccccguugacaacgugaagcucaccgucgugguuaauaacaucgccguggcugagcagauuggggaacuguuuauccauugucgccacggaugcagagucgccggcuccggcaaaccgccuaucuucgagguggauccccggggguguccuuuuacaauuaagcugagcgcgcgcaaagaccaugaaggaucuugcgauuauagacccgugcggugccccaauaacccuagcuguccgccccuccugcgcaugaaucuugaggcccaccugaaggaaugcgagcacaucaaauguccucauuccaaguacggcugcaccuucauugggaaccaggacaccuaugagacacaccucgaaacguguagauuugagggacugaaggaguuccuucaacagaccgaugaccgguuucaugagaugcacgucgcucuggcccagaaagaucaggaaaucgcuuuccucagaucuaugcugggcaagcugagcgagaaaauugaccaacucgagaagucccuggaacuuaaauucgacguucuggaugagaaucagagcaagcucucugaagaccugauggaguuucgccgggaugccuccaugcuuaacgacgaacugagccacaucaaugcgagacucaacauggggauucugggaucuuacgauccccagcagaucuucaaaugcaagggcacauuugugggccaucaagggccuguguggugucugugcgucuauuccaugggagaccuccuguucagcggcuccucugauaagaccaucaaagugugggacacauguaccacguacaagugccagaaaacacuugaggggcacgauggaauuguucuggcccucuguauccagggcugcaagcuguacagcggguccgcugacugcaccauuaucgugugggauauucaaaaucuucagaaagucaacaccauccgcgcccaugacaaucccguguguacacugguuucuagccacaacgugcucuuuuccggaagccugaaggcuaucaaggucugggacauugugggcaccgagcugaaacucaagaaagaacugacaggccuuaaccauuggguccgggcccugguggccgcucagucuuaucucuacuccgggagcuaucagacgaucaagauuugggauaucagaacccuggacugcauucacguucugcaaacaucuggaggcuccguguacagcaucgcggucaccaaucaccauaucgugugugggacauaugagaaccuuauucacguuugggauaucgaaucuaaagaacaggugcgcacccucacgggacaugucggcaccguguacgcccuggcugugauuagcacaccggaccagaccaagguuuucuccgccagcuaugaucggucucugagagucugguccauggacaauaugaucugcacacagacccuccugcgccaccaagggagcgugacggcccuugcugugucccggggcagacuguuuucuggagccgucgauagcacagugaagguuuggaccuguuga

SEQ ID NO: 77219 - RNA, 1749 nt, Artificial Sequence
  derived and/or modified sequence opt5 from TRAFD1__Homo_sapiens__NP_006691
auggccgaguuccuggacgaucaggaaaccagacucugcgacaacuguaagaaagagauccccguguuuaauuucacaauucacgaaauccauugccaacggaacauuggcauguguccuacgugcaaggagccguuucccaaaagcgauauggaaacccacauggcugccgagcauugucaggucacaugcaaguguaauaaaaagcuggagaagcgccuucugaaaaagcacgaagagaccgaaugcccucucagacuggcgguuugucagcauugcgaccuugagcuguccauccucaaacugaaggagcacgaagauuacuguggggcucggacagagcugugcggaaacugcggccgcaaugugcucgugaaagaccugaagacccaccccgaagucugugggagagagggagaagagaagcggaacgagguggccauuccucccaaugccuaugaugaaucuuggggccaggacgggaucuggaucgcuagccaacuucugcgccagauugaggcccucgauccuccgaugagacugccccggcgcccucuuagagcuuucgaauccgacguuuuucauaaccggacaaccaaucagcgcaacaucacggcccaggugucuauucaaaauaaccuguucgaggaacaggagagacaggagcggaaucgcggacagcaacccccuaaagaaggcggcgaggaaagcgcgaaccucgauuuuaugcuggcccugucccuccagaaugaggggcaggcuucuagcgucgccgaacaagacuucuggagagcugugugcgaggccgaucagucccacggaggcccccggagccugucugacaucaagggggcggccgacgagauuaugcuuccgugugaauuuugcgaggaacuguacccugaggagcuccugaucgaucaucagaccuccuguaaccccagcagagcccuuccuucucugaacacaggauccagcucuccccgcggcguugaagaacccgacgugauuuuccagaauuuucuccaacaggcugcuuccaaccagcuggauagccugauggggcucuccaauucucacccugucgaagagagcaucaucauuccgugcgaguucuguggagugcagcuggaggaggaagugcuuuuucaccaucaagaccagugcgaucagcggcccgccaccgccacaaaccacgucaccgagggcaucccuagacuggacucccagccccaagaaacgagcccugagcucccccgccggagaguucgccaucagggcgaucugucuuccggguaucuugacgauacaaaacaggaaaccgcuaauggaccgacaagcugucugccucccucucggccuauuaacaauaugaccgcgaccuacaaccagcucagcagauccacaucuggcccccgcccugggugccaacccagcuccccgugugugccuaagcugagcaauucugacucccaggauauccagggacggaacagagacagccaaaauggcgccauugcucccgggcacgugucugucauccggcccccucagaaccuguauccggagaauaucgugcccuccuucagcccuggacccuccggccgcuacggcgccucugggagaagcgagggaggccggaacucccgcguuacgccugccgcugccaauuauagaucucggaccgcgaaagcuaagcccagcaaacagcagggggccggagacgccgaagaggaagaggaagaguga

SEQ ID NO: 77220 - RNA, 2862 nt, Artificial Sequence
  derived and/or modified sequence opt5 from TRAK1__Homo_sapiens__NP_001036111
auggcccugguguuccaguuuggccaacccgucagagcucagccucucccggggcugugccacggaaaacuuauccggaccaacgccugugacguuugcaauagcacagaucugcccgagguggaaauuaucucccuccuggaggaacagcuuccucauuacaagcugcgcgcggacacgauuuauggcuacgaucacgacgauuggcuccauacaccccugaucucuccugacgcuaacauugaucugaccaccgagcagaucgaagagacacucaaguauuuccugcuuugugccgagagaguggggcaaaugaccaaaacauacaaugacaucgaugccgucacccggcugcucgaagagaaggaacgcgaccuggagcuugcugccagaauuggacagagccugcucaaaaagaacaagacgcugaccgagcggaaugaacugcucgaggaacagguggagcacauccgcgaagagguuucccagcugagacaugagcuuucuaugaaagaugaacugcuccaauuuuauacaagcgcugccgaggaauccgagcccgaaucugugugcagcaccccucugaagcggaacgaguccagcuccuccguccagaauuacuuccaccuugacagccugcagaaaaagcucaaagaucuggaggaagagaacgugguucugcgcucugaagcgucccagcucaagacagagaccauuacguaugaagagaaggagcaacagcuggugaaugacugugucaaagaacuuagagacgccaacgugcagaucgcuagcauuucugaggaacuggccaagaaaacagaggaugcugcccggcaacaggaggaaaucacccaccuccugucccagauuguggaccuucagaagaaagcgaaggccugcgcugucgagaaugaggaacugguucaacaucucggcgccgcuaaagaugcccagcgccagcugacagccgaacugagagagcucgaggacaaguacgcugaauguauggagaugcugcacgaagcgcaggaggaacuuaagaaccugcggaauaaaaccaugccgaacaccacaagccgcagauaccauucccucgggcuguuucccauggauucucuggccgcugagaucgagggaacgaugcggaaggaacuucaacucgaggaagccgagagcccugacaucacccaccagaaaagaguguucgaaacagugcgcaauauuaaccaggucgugaagcagcggucccugacccccagcccuaugaacauccccggcucuaaucaauccagcgccaugaacucucugcucagcuccugcguuucuacaccgagaagcuccuuuuauggcagcgauauugggaaugugguccuggacaacaaaaccaauucuaucauucuugagacggaggcugccgaucugggaaacgacgaacgcuccaagaagccuggcacacccgggaccccuggaagccacgaucucgagaccgcgcugcggagacugucucuucgccgggaaaauuaccucuccgagagacgcuucuuugaggaggaacaggaacggaaacugcaggagcuggcugaaaagggcgagcucagaagcgggucccugacacccaccgagucuaucaugagccuuggaacacauucccgcuucucugaauuuacgggcuucagcggcauguccuuuagcucucgguccuaucugcccgagaaacuccagaucgugaagccucuggaagggagcgccacccugcaccauuggcaacagcuugcccagccgcaccucggaggcauucuggaccccagaccugggguugugacaaaaggauuccggacccuggacgucgaucucgacgagguguacugucugaacgauuucgaagaggacgauacaggcgaccauaucucucuuccccgccuggcuaccuccacgccuguccaacaccccgagaccagcgcccaccauccggggaagugcaugucucagacaaauagcaccuuuacauucaccacgugucggauucuccacccuuccgaugaacugacaagagugacccccagccugaacucugcuccuacacccgccugcggauccaccagccaucuuaaguccaccccuguugcgacacccugcacgccgagacgccucucucuggccgagagcuuuaccaauacacgggaauccaccacaaccaugucuacgagccugggccucguguggcugcuuaaagagagaggcaucuccgcugccgucuaugacccucagucuugggaucgcgcugggagaggaagccugcuccacuccuacacacccaagauggccgugauucccagcaccccuccgaacucucccaugcagaccccuacauccagcccucccucuuucgaauuuaaauguaccucucccccuuaugacaauuuccuggcgagcaagcccgccucuuccauccugcgggagguucgcgagaaaaacgugagaagcuccgaaagccaaacagaugucucugugagcaaucuuaaccugguggacaagguucggcgcuuuggcgucgcuaagguggugaacuccgggagagcccacgucccgacgcucaccgaggaacagggaccucugcucugcgggcccccuggccccgcuccggcccuggugccucggggccuuguucccgagggacugccucuccgcugucccacagugaccucugccaucggcgggcugcagcugaauagcggaauuagacggaaccgcuccuuccccacaauggucggcucuagcaugcagaugaaagcuccugugacccuuacguccgggauccugaugggagcgaagcucucuaaacaaaccagccugagauga

SEQ ID NO: 77221 - RNA, 2745 nt, Artificial Sequence
  derived and/or modified sequence opt5 from TRAK2__Homo_sapiens__NP_055864
augagccagucccaaaacgccaucuucaccucucccacaggcgaggaaaaucugaugaacagcaaucacagagacuccgagucuauuacggaugugugcagcaacgaagaccucccugaggucgaacugguuucccuucuggaggagcagcucccgcaguaccggcugaagguggauacccuuuuucuguaugaaaaucaggacuggacacaaucuccccaucagcgccagcacgcuagcgaugcccucuccccugugcuggcggaggaaaccuucagauacaugauccuggggacagaccgggucgagcagaugaccaaaacauauaacgauauugacauggugacccaucuccuggcugagcgcgauagagaccuugaacuggccgcccggaucggacaagcucuccugaagcgcaaucacguucuuagcgagcagaacgaaucucuggaggaacagcucggccaggccuuugaucaagugaaucagcugcagcaugagcuguguaaaaaggacgagcuccugagaauugucuccaucgcuagcgaagagucugaaacggauuccagcugcucuacaccccuucgguucaacgaguccuuuagccugucccaagggcuccugcagcuugaaaugcugcaggagaaacucaaggagcuggaagaggaaaauauggcccugcgcucuaaggcgugucacaucaaaaccgagaccgugacauacgaagagaaggagcagcaacucguuagcgacugcgugaaagaacugagagagaccaacgcccagaugucccggaugacggaagaacuuagcggaaagucugacgagcugauucgcuaucaggaggagcucuccagccugcuuucucagaucgucgaucugcaacacaaacucaaggaacaugugauugagaaggaggaacugaaacugcaccuccaggcuagcaaggacgcccagagacagcugacaauggagcuucaugaacugcaagaucggaauauggagugucucggcaugcugcacgaaucccaggaggaaaucaaagagcugcgcucuagaagcgggccuaccgcucaccuuuacuucucccagagcuauggagccuuuacaggcgagucucucgcggccgaaauugagggcaccaugcggaagaaacugucccuggacgaagagagcucucucuucaagcagaaagcucaacagaagagaguguuugauaccguccgcaucgccaacgacacacgggggagauccauuagcuuccccgcucugcuuccuaucccgggauccaaucgcucuagcguuaucaugacggccaagcccuuugaauccggccugcagcaaaccgaggauaaaucucuccugaaccaggggagcuccagcgaggaaguggccggaucuucccagaagaugggccagccugggcccagcggagacucugaucuggcuacagcgcuucaucggcucucccugagacgccaaaacuaccugagcgagaaacaguucuuugccgaagaguggcagcggaagauucaggugcucgcugaccaaaaagagggcgucucuggcugcgugaccccuacagaaagccuggccucccuuuguaccacgcagagcgagaucacagaucugucuuccgccagcugccucagaggguucaugcccgaaaagcugcagauuguuaagccgcuggagggaucccagacccuuuaccacuggcaacagcucgcucagccuaaucugggcaccauccuggacccccgcccuggggugauuacaaaaggauucacccaacuccccggcgacgccaucuaucauaucucugaucuggaagaggacgaggaagaggggauuacauuucagguccagcagccccuugaaguggaggaaaagcugagcacguccaaaccuguuaccggaaucuuccucccgcccauuacaucugcgggcggcccugugaccgucgcuacagccaaccccgggaagugucugagcugcaccaauuccacguuuaccuucacaaccugucggauccugcacccuucugauauuacacaagugacccccagcuccggauuuccgagccuuucuugcggcuccagcgggucuuccagcucuaacacggccgucaauuccccugcucucagcuacagacuguccaucggagagagcaucacaaaccgccgggacucuaccacaaccuucagcuccaccaugucucuggccaaacuccugcaggagagaggcauuagcgcuaagguguaucauucccccaucucugaaaauccucuucagccccugccuaagagccucgccauucccuccacaccgccuaacucucccagccacucccccugcccuagcccgcugcccuuugagccucggguucaccugucugaaaauuuccuugcgucccgccccgccgagacguuucugcaggaaauguacgggcucagaccuagccggaaucccccugaugugggccaacugaaaaugaaccucgucgacagacugaagcgccuuggaaucgcucgggugguuaaaaaccccggcgcccaggagaaugggagaugucaggaggcugaaauuggaccgcagaagccugauucugccguguaucugaacuccggcagcucccuccuugggggacugcgcagaaaucaaucucugcccgucaucaugggcagcuucgcggccccugugugcaccuccagccccaaaaugggggugcugaaggaggacuga

SEQ ID NO: 77222 - RNA, 1125 nt, Artificial Sequence
  derived and/or modified sequence opt5 from TRAM1__Homo_sapiens__NP_055109
auggccaucagaaagaaaagcaccaagucucccccugugcugucccacgaguucguccuccagaaccaugcugacauuguuagcugcguggccaugguguuucugcuuggccugauguucgaaaucacagcgaaggcuuccauuaucuuugucacgcuccaauacaaugugacccugccggccacagaggaacaggccaccgagucuguuagccuuuauuacuaugggauuaaagaucuggcuacaguguucuuuuacaugcucgucgccaucaucauucacgcugugauccaggaauauaugcuggacaaaauuaaccggcgcaugcauuucuccaagaccaagcacucuaaauuuaaugagagcggacagcuguccgccuucuaccucuuugcguguguuuggggcacauucauccugauuagcgagaacuauaucucugaucccaccauucuuuggagagccuacccucauaaucugaugacguuucaaaugaaguucuuuuacaucucccagcucgcuuauuggcugcacgccuuccccgaacuuuacuuccagaaaaccaagaaagaggacaucccucggcagcugguguauauugggcucuaccuguuucacaucgcuggagccuaucugcucaaccugaaucaucuuggccugguccuccuggugcuucacuacuucguggaauuucuguuccauauuagccgccucuuuuauuucucuaacgagaaguaccaaaagggguuuucccugugggcgguccuguucguucucggaagacugcuuacacugauccucagcgugcugaccgugggcuuuggccuugcccgggcugagaaucagaaacuggauuucucuacagggaacuuuaauguccucgccgugcgcauugcuguucuggccuccaucugcgugacccaggccuucaugauguggaaguuuaucaacuuccagcugagacgguggcgcgaacacagcgcuuuccaagcgcccgccgucaaaaagaaaccuacggugacaaagggaagauccucuaaaaagggcaccgagaaugggguuaacggaacacucaccagcaauguggcugacuccccgcggaacaagaaagaaaagagcucuuga

SEQ ID NO: 77223 - RNA, 1110 nt, Artificial Sequence
  derived and/or modified sequence opt5 from TRAM1L1__Homo_sapiens__NP_689615
augggccugagaaagaaaagcaccaagaaucccccugugcucucccaggaguucauccugcaaaaccacgccgacauugucucuugcguugggauguuuuuccuucugggacucguguuugaaggcacagcugaggccagcaucguguuccugacgcuucagcauuccgucgcggugccggcugccgaggagcaggccaccgggucuaaaagccuguacuauuacggaguuaaggaucucgcuacaguguuuuucuauaugcuggucgccauuaucauucacgcuaccauccaggaauacgugcuggacaaaaucaacaagcggaugcaauuuacaaaggccaaacagaauaaguucaacgaguccggccaguuuucuguuuucuacuuuuucagcuguauuugggggaccuuuauccucauuuccgagaauugccugagcgaucccacacuuaucuggaaagcgcgcccucauucuaugaugaccuuccagaugaaguucuuuuauauuucccaacuggccuauugguuccacgcuuuucccgaacucuacuuccagaaaacgaagaagcaggacaucccuagacagcugguguacauuggacuucaucuguuucacaucaccggcgccuaucuccuguaccugaaccaccucggccugcuucugcucguccugcauuauuucguggagcuucugagccacaugugugggcucuuuuacuucucugaugaaaaauaucaaaagggaaucucccugugggcuauuguguuuauccugggccggcucgucacacugauuguuagcgugcuuaccgugggguuccaucuggccggaucucagaaucgcaaccccgacgcgcucacaggcaaugucaacgugcuggccgcuaaaaucgccguucuuuccagcuccugcaccauucaggcuuacgugacguggaaucugaucacacucuggcugcaaagaugggucgaggauucuaacauccaggccagcuguaugaagaaaaagcggucccgcagcucuaaaaagagaaccgagaauggggugggaguugaaacauccaaccggguggacugcccuccgaagcgcaaagaaaagagcucuuga

SEQ ID NO: 77224 - RNA, 1113 nt, Artificial Sequence
  derived and/or modified sequence opt5 from TRAM2__Homo_sapiens__NP_036420
auggccuucagacggcgcaccaagagcuacccccuguuuucccaggaguucgugauccacaaccaugcugacauuggcuuuugccucguccuguguguucuuaucgggcugauguucgaagugacagccaaaacggcguuucucuucauucugccucaauauaauaucucugugccgaccgcugauagcgagacaguccacuaccauuauggacccaaggaccuugugaccauucuguuuuacaucuucaucacaauuauccuccacgccguugugcaggaauauauucuggauaaaaucuccaagagacugcaucucucuaaagucaagcacagcaaguuuaacgaguccggccagcuggugguuuuccacuuuaccucugugauuuggugcuucuacgucguggugacagaaggguaucuuaccaauccucggagccugugggaggacuacccccauguccaccucccuuuucagguuaaauucuucuaccugugucaacuugccuauuggcugcaugcucuccccgagcuguacuuucagaaggugcgcaaagaagagaucccuagacagcugcaguauauuugccucuaccuggugcacaucgccggagcuuaucuucugaaccucucccggcugggccuuauccugcuccugcugcaauacagcacggaguuccucuuucacaccgcccgccuguucuauuuugcggaugaaaauaacgagaagcuguucucugccugggcugccgucuuuggggugacaagacuguucauucucacccuggcuguucuugccaucggauuuggccuggcgcggauggaaaaucaggccuucgacccggagaaaggcaacuuuaauacacucuucugucgccugugcgugcugcuccuggucugugcugcccaggcuuggcuuauguggagauuuauucauucccagcugcggcacuggcgcgaauacuggaacgagcaaagcgccaagagacgggugcccgccaccccucgccuccccgcuagacugaucaagcgggaaucuggguaccaugagaauggaguugugaaagcggagaacggcacguccccuagaacaaagaaacuuaagagccccuga

SEQ ID NO: 77225 - RNA, 1956 nt, Artificial Sequence
  derived and/or modified sequence opt5 from TRAP1__Homo_sapiens__NP_001258978
auggccagagagcugcgggcucuccugcuuuggggccgcagacugcggccccuccugcgcgccccugcgcuugcugccgugcccgggggaagcaccuccaagcacgaguuccaggccgagacgaaaaagcugcucgacaucgucgcuagaucucuguacagcgaaaaagagguuuuuauucgggaacugaucuccaacgccucugaugcucucgagaagcugcgccauaaacuugugagcgacggccaagcccugccggagauggaaauucaccuccagacaaaugcggagaaggggaccaucacaauucaggauaccggaaucggcaugacacaggaagaacugguguccaaccuugggaccaucgccagaucuggaagcaaggcuuuccuggacgcccuccaaaaucaggcugaggccuccagcaaaauuaucggccaguuuggcgucggguucuauucugcguuuaugguggccgaucggguugaaguguacucccgcagcgcugccccuggaucucugggcuaucaguggcuguccgacgggagcggagucuucgagauugcugaagccucuggcgugagaacagggaccaagaucauuauccaucucaaauccgauugcaaggaguuuagcuccgaagcccggguucgcgacguggucacgaaauacucuaacuucgugagcuuuccccuguaucuuaauggaagacggaugaacacccugcaagcuauuuggaugauggauccuaaggacgugcgcgaguggcagcacgaggaguucuacagauaugucgcgcaggcccaugauaagccccgguacacacuccacuacaaaaccgacgcuccucugaauaucagauccaucuuuuauguuccggauaugaagcccagcauguucgacgugucucgcgagcuuggcuccagcguggcccuguacucucggaaaguccucauucagacaaaggccaccgacauccugccuaaauggcugagauuuauucgcggcgugguugauagcgaagacaucccccucaaccugucccgggagcuucugcaagaaucugcucucauuagaaagcugcgcgaugugcuucagcagcggcugaucaaauucuucaucgaccaaagcaagaaggaugccgagaaauaugcgaaguuuuucgaggacuacgggcucuuuaugagagaaggaauugucacggcuacagagcaggaagugaaagaggauaucgccaagcugcugcgcuaugaauccagcgcccucccuucuggccagcugaccucccuuagcgaguacgcuucucggaugagagccgggacacgcaauauuuauuaccugugugcucccaaccggcaccucgccgagcauuccccguacuaugaagcgaugaaaaagaaggacaccgagguucuguucugcuuugaacaguucgaugagcugacccuucuccaccugagagaguuugacaaaaagaaacugaucagcguggaaacagauauugucguggaccauuacaaggaggaaaaauucgaggaccgguccccugccgcugaaugucucucugagaaggagacggaagaacugauggccuggaugcgcaauguccuuggaagcagagugaccaacguuaaggugacacugcggcucgauacccaccccgcuauggucacagugcuggaaaugggcgccgcgagacacuuucugcgcaugcaacagcuugccaaaacccaggaggaacgggcucagcuccugcaaccuacgcuggagaucaaucccagacaugcccucaucaagaaacugaaccagcuucgcgcuuccgagcccgggcuggcccagcuccugguugaccagauuuaugaaaaugccaugaucgcugcgggacugguggaugacccuagagccauggucggccggcuuaacgagcuccuggugaaggcucuggaacgccacuga

SEQ ID NO: 77226 - RNA, 3780 nt, Artificial Sequence
  derived and/or modified sequence opt5 from TRAPPC10__Homo_sapiens__NP_003265
auggacgccagcgaggaaccccugccuccggugaucuacaccauggagaacaagcccauugucacaugcgcuggcgaucagaaucucuucacguccguuuauccuacccugucucaacagcuucccagagaaccuauggaguggcggcgcagcuacgggagagcccccaaaaugauccaccuggaauccaacuuugugcaguucaaggaggagcuccugccuaaagaaggaaauaaggcgcuucugacauuuccguuccuccauauuuauuggaccgaguguugcgacacagaaguguacaaagcuaccgucaaggaugaccugacaaaguggcagaacgugcugaaagcccacucuagcguugauuggcucaucgugauugucgagaaugacgccaagaaaaagaacaaaaccaauauccugccccggacguccaucguggauaagauucgcaacgacuuuuguaauaagcaaucugauagaugcguugugcuuagcgacccucugaaagauuccagccggacccaggagucuuggaacgcuuuccucacaaagcugcgcacccuucugcucauguccuuuacgaaaaaucugggcaaguucgaagacgauaugagaacccugcgggagaaacgcacggaacccggguggagcuuuugugaguauuucaugguccaggaggaacucgccuuuguguucgagaugcugcagcaauuugaagacgcucuugugcaguacgacgagcuggaugcccucuucucucaguaugucguuaacuucggagcgggcgacggggccaauuggcugacauuuuucugccagccugugaaguccuggaacggacuuauccugagaaaacccauugauauggaaaagcgggagagcauccaacgcagagaagcuacccuccuggaccugcggucuuaccucuuuucccgccaguguacacugcuucuguuccuccagagaccgugggagguggcccaacgggcucuggagcuucugcauaauugcguccaggaacucaagcugcuggaggugagcguuccucccggcgcccucgauuguuggguguuucuguccugccuugaaguccugcagagaauugagggcuguugcgaccgcgcgcagaucgauucuaacauugcccacaccguggggcucuggagcuacgcuaccgaaaaacugaagucccugggauaucuuugcggccucguuagcgagaaagggccuaacucugaggaccugaaucggacaguggaucugcucgccggacugggcgcugaaagacccgagacggccaacaccgcccaaucccccuacaagaaacuuaaggaagcucugagcucugucgaggcguucgagaagcauuaucucgaccugagccacgccacaaucgaaauguacaccuccaucgggcgcauucggucugcuaaauuugugggaaaggaucuggccgaguucuauaugcggaaaaaggccccucagaaagcugaaaucuaccuucagggcgcccucaagaauuaucuggcggagggcugggcucugccgauuacacacacccgcaagcagcucgccgaaugucaaaaacaucuggggcagaucgagaacuaccuucagacgagcucccugcucgccagcgaccaccaucugacagaggaggaacggaagcacuuuugccaggaaauucuggacuucgcuucucaacccuccgauagcccuggacacaaaaucguccuucccaugcauucuuuugcccagcucagagaccugcacuucgauccuuccaaugcugugguucaugugggcgggguccuguguguggagaucaccauguacagccagaugcccguuccggugcacgucgaacagauuguggugaacguucauuuuuccaucgagaaaaauucuuaucgcaagaccgccgaguggcucacaaagcacaagaccagcaacggaauuaucaauuucccucccgaaacagcgccuuuccccgucucccaaaacucucugccugcccuugagcuguacgaaauguuugagcggagccccuccgacaauagccucaacacgaccggcauuaucugcagaaaugugcacaugcugcugcgccggcaggaaucuuccagcucucuugagaugccguccgggguggcucucgaggaaggagcccauguccugagauguagccacgugacacuggagccuggcgcuaaccagaucaccuuccggacacaagccaaagaacccggcaccuauacgcuccgccagcugugcgcgucuguugggagcgugugguuuguccuuccccauauuuacccuaucgugcaguaugauguuuacucccaggagccgcaacugcacguggagccccucgccgacagccugcuggcuggcauuccucagagagucaaguucaccgugacaaccggacacuauacaaucaaaaauggggauucucuucagcuguccaacgccgaagcuaugcucauucugugucaggccgagagccgggccguuguguacuccaacaccagagaacaaucuagcgaggcugcgcuccgcauccaguccucugacaaggucacgagcauuucccugcccguggccccugcuuaccaugugaucgaauuugagcuugagguccugucucuccccagcgccccugcccugggaggcgaauccgauaugcuggggauggcugagccccaccggaaacauaaggacaaacagagaacaggccgcugcaugguuaccacagaucacaaggugagcaucgacuguccguggucuauuuauuccaccgugaucgcccuuaccuucagcgucccuuuuagaacaacgcauucucugcucuccagcggaacccggaaguacgugcagguuugcgugcaaaaucugucugaacucgauuuccagcuguccgacagcuaucuugucgacacaggcgauuccaccgaccugcagcucgugccccugaacacacaaagccagcagccuauuuacucuaaacagagcguguuuuucguuugggagcugaaguggaccgaggaacccccgccuucccuucacugucgcuuuucugucggguucagccccgcguccgaggaacaacugucuaucagccucaaaccuuauacguacgaguuuaagguggaaaauuucuucacacuguauaacguuaaagcugagauuuuuccucccuccggaauggaauacugcagaaccggcucucucugcagccuggaggugcuuaucacccggcuguccgaucugcucgaggucgacaaggaugaagcccugacagagagcgacgaacacuucucuaccaaacuuauguacgaggugguggauaauuccagcaacugggccgucugugggaagucuugcggaguuaucuccaugcccguggcugcccgcgcgacacauagagugcacauggaggucaugccgcuguuugcuggcuaucucccccugccugacgugagacucuucaaguaccugccccaucacagcgcccauuccucucagcuugaugccgacagcuggauugaaaaugauucccugagcguugacaaacacggggaugaccagccugacucuuccagccugaagucucgcggcagcgugcacuccgcuuguucuagcgagcauaaaggacuccccaugccuagacugcaggcccuuccggcuggccaagucuuuaacuccucuagcgggacacaggugcugguuauccccucccaggaugaccacgugcucgaagucagcgugaccuga

SEQ ID NO: 77227 - RNA, 3402 nt, Artificial Sequence
  derived and/or modified sequence opt5 from TRAPPC11__Homo_sapiens__NP_068761
augagccccacccagugggacuucccuguggagcugugcuguagaccgauggccuuugucacacucacgggccuggauguuguguacaacgcugugcaccgggccgucugggacgcguucugcgcuaaucgcagagccgaucgggugcccaucuccuuuaagguucuuccuggggaccaugaauaucccaaaugucgcccuaagagaaccucuuacgagugguauauucccaaaggaauccugaagacaggcuggaugaacaaacaccucaaucuggugccugcccuugucgugguuuucuacgaacuggauugggacgagccgcaauggaaggaaaagcagagcgagugcgcuacccggguggagauuguccgccagucccuccaggggagaaacacaaaaguggccgugguccugauccaaaagaaaacaccccugccucccggagaagauguuauugcuucugagcgggccgcggcccucuguaaugcuugcgaacugagcggcaagucccuuuuugugcugccucauaccgaccaccucgugggguauaucauccgccuggagaacgccuucuacgagcaugcucagaccuauuacuacacggaaauuagacgggucaaaucucacaaggaguuucuuaauaagaccacacaccagcuucucuucgugcgccaucaguuuaaaaucgccuucuuuagcgaacugaagcaagauacccagaacgcgcugaaaaauuauagaacagccuacaaccucguucacgagcugcgggcucaugaaaccaauauucuugagaucaagacgauggccggauucauuaacuauaaaaucugucgccugugcuuucagcacaauacaccccucgacgcuauugcccaguucagaaagcacaucgaucuguguaaaaagaagaucggcuccgccgagcuuagcuucgaacaugacgcuuggaugucuaaacaauuucaggcguucggcgaucuguuugacgaggccauuaagcucgggcugaccgcuauccagacacaaaacccgggauucuacuaucagcaggccgccuacuaugcucaggaacggaaacaacuggccaagacccucugcaaucacgaggcguccgugauguacccuaaccccgacccucuggaaacccagacaggcguccuugauuuuuacgggcagagaagcuggcgccaggggauucugucuuucgaccucuccgaucccgagaaagagaaggugggcauccuggcuauucaacuuaaggaacggaacguugugcauagcgagaucaucauuacgcugcucucuaaugccgucgcccaguuuaaaaaguauaaaugucccagaaugaagucccaccugauggugcagaugggggaagaguacuauuacgcuaaagacuauaccaaggcccugaagcuccuggauuacgucaugugcgacuaucgcagcgaaggaugguggacacuucugaccuccgugcucacaaccgcucugaaaugcucuuaccugauggcccagcuuaaggauuacaucacguauagccucgagcugcugggccgggcguccacacucaaagacgaucaaaagagcagaauugagaaaaaccugaucaauguucuuaugaacgaaucuccugacccggagcccgauugugacauucuggccgugaagaccgcucagaagcucugggccgaccgcaucucccuggcuggcagcaauaucuucaccauugggguccaggauuuugugccuuucguucagugcaaagccaaguuucaugcgcccucuuuccacguggacgucccugugcaauuugauaucuaccugaaagccgacuguccccacccgauucgguucagcaagcugugcguguccuucaacaaucaggaauauaaccaguuuuguguuaucgaggaggcuucuaaagccaaugaaguccucgagaaccugacacaaggaaagaugugccuggugccuggcaaaaccagaaagcuccuguucaaguuuguggcuaaaacagaagaugucgggaagaaaauugagaucacgagcguggaccuugcccugggaaaugaaaccggccgcuguguugugcucaacuggcagggaggaggcggcgaugccgcuuccagccaggaggcgcugcaggccgcucggucuuucaagagacgccccaaacugccugacaaugagguccauugggauuccauuaucauccaagccagcacaaugauuaucucucgggugcccaacauuuccguucaccuucuccaugaaccucccgcccugaccaaugagauguacugccugguggucacagugcagagccacgaaaagacccagaucagagacguuaagcucacggcugggcugaaaccgggacaggaugccaaccuuacccaaaagacacacgugacccugcauggcacagagcucugugacgaauccuauccugcgcugcugaccgauauucccgucggggaccuucaccccggagagcagcucgagaaaaugcuguacgugcggugcggcacgguggggucucgcauguuucuggucuauguuagcuaccucaucaacacaaccguggaagagaaggaaaucguguguaaaugccauaaggacgagacagucaccauugaaaccguguucccuuuugauguugcugugaaguucgucuccacaaaauuugagcaccuggagagaguguacgccgacaucccguuccuucugaugacggaucuccugucugccagccccugggcucugaccauuguuuccagcgaacuucagcuggccccuucuaugacaaccguggaccagcucgagucccaagucgauaaugugauccugcagacaggcgaaagcgcgucugagugcuuuugucuccagugccccucccugggaaacauugagggcgggguugcuaccggacauuauaucaucagcuggaagcggacgucugccauggaaaauauuccuaucauuacaaccgugaucacccuuccccacgucauuguggagaacaucccucugcacgugaaugccgaccuccccagcuucggcagaguccgcgaaucccugccgguuaaauaccaucugcaaaacaagacagaucuugugcaggacguggagaucagcgucgaaccuucugaugcuuuuauguucuccgggcugaaacagauucggcucagaauccugcccggaaccgagcaggagaugcucuauaauuucuacccucugauggccggcuaucaacagcuucccagccugaacauuaaucuccugcgcuuuccgaacuucacaaaucagcugcuuagacgguuuaucccuacguccauuuucgugaagccccaggggcgccugauggacgauaccucuaucgcugccgcguga

SEQ ID NO: 77228 - RNA, 438 nt, Artificial Sequence
  derived and/or modified sequence opt5 from TRAPPC1__Homo_sapiens__NP_067033
augaccgugcacaaccuguaccucuucgacagaaauggcgucugccugcauuauagcgaguggcaccggaagaaacaggccgggauccccaaggaagaggaauacaaacuuauguauggaaugcuguuuuccauucgcucuuucguuagcaagauguccccucucgauaugaaagacggcuuucuggcuuuccaaacaucuagauacaaacuucauuauuacgagacgccgaccgggaucaagguggugaugaacacagaucugggagucggccccauucgggacgugcuccaccauaucuauagcgcccuguacguugaacugguggucaagaauccucucuguccccuggggcagaccgugcaguccgagcuuuuucgcucuagacuggauagcuacguucggucccucccuuucuuuagcgcgcgcgcuggauga

SEQ ID NO: 77229 - RNA, 525 nt, Artificial Sequence
  derived and/or modified sequence opt5 from TRAPPC2__Homo_sapiens__NP_001122307
augagcuccuggaagcaggacagaucuggccugcggagcaccgagcucaacgugcuggaauaccaaccccuuugcgccguccgcucccacauccugaaaacaaugucugggagcuucuauuuuguuauugugggacaucacgauaauccuguguucgagauggaauuucucccggcuggcaaggccgaguccaaagacgaucauagacaccugaaccaguucaucgcgcaugcugcccuugaccuggucgaugaaaauauguggcucucuaacaauauguaccugaagacgguggacaaauuuaacgagugguucguuagcgccuuugugaccgcugggcacaugcgguucauuaugcugcacgauauccgccaggaggacggaauuaagaacuuuuucacagaugucuaugaccucuacaucaaguuuuccaugaaucccuucuaugaaccuaauagccccaucagaucuuccgccuuugaucggaaagugcaguuccugggcaagaaacaucuucugagcuga

SEQ ID NO: 77230 - RNA, 660 nt, Artificial Sequence
  derived and/or modified sequence opt5 from TRAPPC4__Homo_sapiens__NP_057230
auggccaucuucagcguguacgucguuaacaaggcuggcgggcugauuuaucagcucgacuccuacgcccccagagcggaggcugagaaaaccuuuucuuauccucuggaucuucugcucaagcugcacgacgaacgggugcuuguggccuucggacaacgcgauggcaucagagucgggcaugccgugcuggcuauuaauggaauggacguuaacggccgguacacagccgaugggaaagaagugcucgaguaucugggaaauccggcuaacuaccccgucagcauccgcuuuggcagaccucggcugacguccaaugaaaagcucaugcuggccucuauguuccacagccuuuuugcgauuggcucccagcugucucccgagcaggggagcuccggaaucgagaugcucgaaaccgacacauucaaacugcauugcuaucagacccuuacaggcaucaaguuugugguucuggccgauccucgccaagcugggauugacagccuccugagaaagaucuacgagauuuacucugauuucgcccugaaaaaccccuuuuauucccucgaaaugccuauccggugugagcuguucgaccagaaucuuaagcuggcucucgagguggccgaaaaagcgggaaccuuuggcccggggagcuga

SEQ ID NO: 77231 - RNA, 3447 nt, Artificial Sequence
  derived and/or modified sequence opt5 from TRAPPC9__Homo_sapiens__NP_001153844
augagcgugcccgacuacaugcaaugcgccgaggaucaccaaacccugcucgucguugugcagccugugggcaucgucuccgaagagaacuucuuuagaauuuauaagcggaucuguucugugagccagauuuccguucgcgacucucagagagugcuguacauccgguaucgccaucacuacccgcccgaaaauaacgaguggggagauuuccaaacacauagaaaagucguggggcuuauuacgaucaccgacugcuuuagcgcuaaggauuggccucagacauucgaaaaauuucacguucagaaggagaucuauggcuccacccuguacgacucuagacucuucguguuugggcugcagggagagauugucgaacaaccccgcacagauguggccuucuauccuaauuacgaggacugucagaccguggaaaaacggaucgaggauuuuauugagagccuuuucaucguccuggaauccaagcggcucgaccgcgcgacagauaagagcggcgacaaaauuccccugcugugcguuccuuuugagaagaaagauuucguggggcucgacaccgacucuagacauuacaagaaacggugucagggacgcaugagaaagcacgugggcgaucugugccuucaggcuggcaugcugcaagacucccucguccacuaucauaugagcguggaacugcuucggucuguuaacgauuuucuguggcucggggccgcccuggagggacuguguuccgcuagcgugaucuaccacuauccgggcgggacgggaggcaagucuggggcccgcagauuccagggauccacccuccccgcugaagccgcgaaucggcauagaccuggcgcccaggagguccugauugaccccggcgcucuuacaaccaacgggaucaauccugauacaagcaccgagaucggacgcgccaaaaacugccugucccccgaagacauuaucgauaaguacaaagaggcuauuucuuauuacagcaaguauaaaaaugccggcgugaucgaacucgaggcguguauuaaggccguucgggugcuggcuauccaaaagagauccauggaagccagcgaguuccuucagaacgcugucuacaucaaucugcgccagcucucugaggaagagaagauucagcgguacuccauccugagcgaacuguaugagcucauuggguuucacagaaagucugccuucuuuaaacgcguggccgcuaugcaaugcgucgcgccgagcaucgccgaaccuggauggcgggcuuguuacaagcugcuucuggagacgcuccccggcuauucccugucucuugacccuaaagauuucagcagagggacacaccgcggaugggccgccgugcagaugcggcugcuccaugagcugguuuacgcuuccagacgcaugggcaaccccgcccugagcgugcggcaccucucuuuucugcuucagaccaugcuggacuuccucuccgaucaggaaaagaaagacgucgcgcaaagccuggagaauuauacaucuaagugccccggcaccauggaaccuauugcucugcccgggggacuuacccucccgccugugcccuuuacaaagcugccuaucguuagacaugugaaacugcucaaccugcccgccucccuucggccgcacaagaugaaaagccugcucggccagaaugucuccacgaagucuccuuucaucuacagccccauuaucgcccauaaccgcggggaggagagaaacaaaaagauugacuuucagugggugcagggagaugugugcgaaguucaacugauggucuauaauccuaugcccuucgagcugcggguggaaaacaugggccuucucaccuccgggguggaguuugaaucucugccugcugcccugagccuccccgcugaguccggccuguacccggucacacuugugggaguuccucagaccacaggcaccaucacggugaauggguaccacacaaccgucuucggaguguuuagcgacugucugcucgauaaccugcccggcauuaagaccucuggguccacaguugaggugauccccgcccugccuagacuucagauuagcaccucucucccgcgcuccgcgcacagccugcagcccucuagcggagacgaaaucuccacaaaugucagcgugcaacuguauaacggcgagucucagcagcucaucauuaaacuggaaaauaucgggauggagccucuugaaaagcuggagguuacguccaaagugcucaccacaaaggagaaacuguacggcgauuuccugagcuggaaacuugaagagacccucgcccaauucccccugcagccuggaaaggucgcuacauuuaccauuaacaucaaagugaagcuggacuucuccugccaggaaaaucuccugcaggaucuuucugacgauggcauuagcguguccggguuuccccugucuagcccuuuccggcaagucguuagaccccgcguggagggaaaaccggugaacccucccgaauccaauaaggccggcgacuauucucaugucaaaacgcucgaggcugugcugaacuuuaaguacagcgggggaccuggccacaccgagggguauuacagaaaucugucccuuggccugcauguugaaguggagcccagcgucuucuuuacacgggugucuacccucccggccacauccacccgccagugucaucugcuccuggauguuuucaacagcacggaacacgagcuuacagugucuaccagauccagcgaggcgcugauccuccacgccggagaaugccagcggauggcuauccaggucgacaaauuuaauuucgagucuuuuccugaaucccccggcgagaaggggcaauucgccaacccuaagcagcuggaagaggagcgcagagaagcucggggacuggagauucacagcaaacuuggcaucuguuggcgcauucccucccugaagagaagcggggaagccucuguggagggacuccugaaccagcucguucuggaacaucuucagcuggcuccccuccaaugggaugugcuggucgacggccagccuugcgaccgggaggccguggcggccugucaggugggggauccgguccgccuggagguuagacuuacaaaucggagccccagauccgugggcccuuuugcucugaccgugguccccuuccaagaccaccagaacggagugcauaauuaugaucuccacgacaccguuucuuucgugggcagcuccacauuuuaccuggaugccguccagccuucugggcagagcgccugccucggagcucugcuuuuccuguacacgggcgacuuuuuccugcacauccgcuuucaugaagauuccaccucuaaagagcugcccccuagcugguucugucucccguccgugcacguuugcgcccuugaagcgcaggcuuga

SEQ ID NO: 77232 - RNA, 561 nt, Artificial Sequence
  derived and/or modified sequence opt5 from TRAT1__Homo_sapiens__NP_057472
augagcggcaucuccgggugccccuucuuucuguggggacuccuggcccuucugggccucgcucuggugauuucucuuaucuucaacauuagccacuacgucgagaagcagagacaagacaaaauguauuccuacucuagcgaucauacccggguugacgaauauuacaucgaggauacaccuauuuaugggaaucuggacgauaugaucuccgaaccgauggacgagaacuguuacgaacagaugaaggcccgccccgagaaaucugugaauaagaugcaggaggcgacgccuagcgcucaggccaccaacgaaacacaaaugugcuaugccucccucgaucacagcgugaaaggaaagagacggaagccccgcaaacagaauacccauuuuucugacaaggauggcgacgagcagcugcacgcuaucgaugccuccgucagcaaaacaacccugguggacucuuucuccccugaaagccaggcuguugaggagaacauucaugaugaccccaucagacucuuugggcugauucgggccaagcgcgaaccuaucaauuga

SEQ ID NO: 77233 - RNA, 1176 nt, Artificial Sequence
  derived and/or modified sequence opt5 from TRDMT1__Homo_sapiens__NP_004403
auggagccccugagagugcucgaacuguacagcggcgucgggggaaugcaccaugcccuucgggaguccugcaucccugcucagguuguggccgcgauugacgugaacaccgucgcuaaugaaguguauaaguacaacuucccgcacacacaacugcucgccaaaacgaucgagggcauuacccuggaagaguuugaucgccuuucuuucgacaugauccugaugagcccucccugucagcccuuuacaagaauugggcggcagggagauaugaccgacucccgcacaaauucuuuccuccauauccuggauauccugccuagacuccagaagcugcccaaauauauucuucuggagaacguuaagggcuuugaagugagcuccacccgggaccuccugauccaaacaauugagaauugcggguuccaguaccaggaauuucuucugucuccuaccagccucggaaucccgaacucccgccugagauauuuccugauugccaaacuccagagcgagccccugccuuuucaagcucccggccagguccuuauggaguucccuaagaucgaaucugugcacccccagaaguacgccauggauguugagaauaaaauucaggaaaagaacguggagccgaauaucuccuuugacggcagcauccaauguucugggaaagaugcuauucuguucaagcucgaaacggccgaggagauccaucggaaaaaccagcaggacuccgaucugagcgucaagaugcuuaaggacuuucuggaagaugacaccgacgugaaucaauaucuccugccucccaaaucucugcuccgcuacgcgcugcuucuggauauugugcagccuacaugcagacgguccgucuguuucaccaagggauacggcagcuauaucgaggggacaggauccguucuccagaccgccgaagacguccagguggagaacauuuacaaaucucugacgaaucuuagccaagaagaacagaucacaaagcugcucauccugaaacugcgcuauuucacccccaaggagauugcuaaccuccugggcuuucccccugaguucggguuuccggagaaaaucacagugaagcagagauaccggcuucugggaaauucccucaacgugcacguuguggccaagcugauuaaaauccuguaugaauga

SEQ ID NO: 77234 - RNA, 1386 nt, Artificial Sequence
  derived and/or modified sequence opt5 from TRDN__Homo_sapiens__NP_001238916
augaccgagaucacagccgaaggaaacgcuagcacgaccacaaccgugauugacuccaagaaugggucuguccccaaaagcccuggaaagguucugaaaagaacagugaccgaggauaucgugacaaccuucuccucuccggccgcguggcuccuggucauugcucuuaucauuacguggagcgccguggccaucguuauguuugaccugguggauuacaagaacuucuccgcuucuagcaucgccaaaauuggcuccgacccccucaagcugguccgggaugcuauggaagagaccacagacuggaucuauggguuuuucagccuucugucugauauuaucuccagcgaagacgaggaggaugacgauggagacgaagauaccgacaagggcgagauugacgaaccuccccuccgcaaaaaggagauccacaaagauaagacagagaaacaggaaaagccugagagaaagauucaaaccaaagugacgcauaaggaaaaagagaaggggaaagaaaagguucgggagaaagagaagcccgaaaagaaagccacacacaaggagaaaaucgaaaagaaagagaagccugaaaccaagacacuggcgaaagagcagaagaaagccaagaccgcugagaaaucugaagagaagaccaagaaagaagugaagggaggcaaacaggagaaggucaaacagacagccgcuaaggugaaggaagugcagaaaacgccguccaagcccaaagagaaggaggacaaagaaaaggccgcggucagcaaacaugagcaaaaggaucaguacgccuuuugccgcuauaugaucgacauuuucguucacggcgaucugaagccugggcagucucccgcuaucccucccccgcucccuaccgaacaagccuccagacccaccccugcuagccccgcccuggaggagaaagaaggagagaagaaaaaggccgagaaaaaggugacauccgaaacaaagaaaaaggcugaaaaagaggacauuaagaaaaagucugagaaggaaaccgcgaucgauguggagaaaaaggaacccggcaaagccagcgagacgaagcaggggacagucaaaauugcugcccaggccgcugccaagaaggacgagaaaaaggaagauuccaaaaagaccaaaaagccugcggagguggaacagccgaaaggaaagaagcaagagaaaaaggaaaaacauguugagcccgcuaagagcccuaaaaaggaacacucugugcccuccgacaagcaggucaaagccaagaccgagcgggccaaagaggaaaucggcgcugugagcaucaagaaagccguuccugggaagaaggaggagaaaacaaccaagacaguggaacagggcaaaaagaaauga

SEQ ID NO: 77235 - RNA, 1659 nt, Artificial Sequence
  derived and/or modified sequence opt5 from TREH__Homo_sapiens__NP_001287994
augcccggcagaaccugggagcugugccuccugcuucugcucgggcugggacuuggcagccaggaagcccugccuccgcccugugaguccgaaaucuacugccacggggagcuccugaaccaagugcagauggcuaagcuguaucaggacgauaaacaguucgucgacaugccucucucuauugcccccgaacaaguucugcagacauuuacggagcuuagccgggaucauaaucacuccaucccucgcgagcagcugcaggcguucgugcaugaacacuuucaagcuaagggacaggagcuccagcccuggaccccugccgacuggaaagauucuccgcaguuccugcaaaagauuagcgacgccaaacuuagagcuugggccggccagcugcaucagcucuggaagaagcuggggaaaaagaugaaacccgaagugcugucccacccugagcgguuuucucucaucuacagcgagcaccccuucauugucccuggaggccgcuuuguggaauuuuauuacuguuauggccauguucccaacgggggaagaguguacuaucugcaacggucccagccgccucuucugacacucaugauggauugcuaccugacccacacaaaugacaccgcuuuccuucaggagaacaucgaaacacuggcccucgagcuggauuucuggaccaagaaucgcacggucagcgugucucuggaaggcaaaaacuaccuccugaauagauauuacguucccuaugggggaccucggcccgaguccuacagcaaggacguggagcuugcggauacccugcccgaaggcgaccgcgaggcccucugggcugaacugaaggccggggcugagucuggaugggauuuuuccagcagauggcuuaucggcggcccuaaccccaauucucuguccgggauucggacaagcaaacucguccccguggaccugaacgccuuccugugucaggcggaagaacucauguccaauuuuuauucucgccugggaaacgacagccaagccaccaaguacagaauccuucggucccagcgccuggcugcccucaauacagugcugugggaugagcagaccggcgcuugguucgacuaugaucuggagaaaaagaaaaagaacagagaguucuacccuagcaaucuuacgccccucugggccgggugcuuuucugacccuggagucgccgauaaagcucugaaguaccuggaagacaaccggauucucacauaucaguacggcauccccaccucccugcaaaagacagggcagcagugggauuucccgaacgcgugggccccucuucaggaccugguuauuagaggacucgcuaaagccccgcugcgccgggcccaagagguggcuuuucagcuggcccagaauuggaucagaaccaacuucgauguguauagccagaagucugcgauguacgaaaaauaugacgucagcaauggcggccaaccugggggaggcggggaguacgaggugcaggaaggauuuggcuggaccaacgggguugugcuuaugcuccuggaucgcuauggcgaccggcugacauccggagcuaagcucgccuuccuggagccccauugucuugccgcuacgcugcucccuucucugcugcuuagccuccugcccugguga

SEQ ID NO: 77236 - RNA, 678 nt, Artificial Sequence
  derived and/or modified sequence opt5 from TREM1__Homo_sapiens__NP_001229518
augagaaagacccggcuguggggccuccuguggaugcuuuucgugagcgagcugcgcgccgcuacaaaacucacggaagagaaguacgaacugaaagaggggcagacccuugacgucaagugcgauuauacacuggaaaaauuugccuccucucaaaaggcguggcagaucauuagagacggagagaugcccaagacccucgcuuguacagagcggccuagcaaaaacucccacccgguucaggugggccgcaucauucuggaagauuaccaugaccacgggcugcucagagugcggauggucaaucuucagguggaggauucuggacuguaucaaugcguuaucuaccagcccccuaaggaaccccauaugcuguucgaccgcauuagacucguggucaccaaaggcuuuagcgggacaccuggauccaacgaaaauucuacccagaacguguauaagauucccccuacgaccacaaaagcccuguguccgcuuuacaccagcccccggacaguuacccaggccccucccaaguccacggcugaugugagcacaccugacucugagaucaaucugaccaacgucacagauaucauccgcuauuccuuccaagugcccggcccgcucguguggacccugagcccucuguuucccucucucugcgccgagagaauguga

SEQ ID NO: 77237 - RNA, 660 nt, Artificial Sequence
  derived and/or modified sequence opt5 from TREM2__Homo_sapiens__NP_001258750
auggagccccugagacuccugauccuucuguucgugaccgaacucagcggcgcccacaacacaacggucuuucaggggguugcuggacaaucccuucaggugucuugcccuuacgacagcaugaagcauuggggccggcgcaaagccugguguagacagcugggggagaagggaccgugccagcggguggucuccacccacaaucuguggcuccugucuuuccugcgcagauggaacggcagcacagcgauuaccgaugacacacucgggggaacccugacaaucacccuucggaaucugcaaccccaugaugcuggccucuaucagugucagucccugcacggcucugaagccgacacgcuucgcaaagugcugguugaggugcucgccgauccucuggaccauagagaugcuggggaccugugguuucccggagaaagcgaguccuucgaggaugcccacgucgaacacagcauuucucgggcugagcgccaugugaaggaagacgauggcagaaaauccccuggggagguucccccuggaaccagcccggccugcauccucgcgacauggcccccuggccugcuugugcugcucuggcaggagaccacacugcccgaacacuguuuuucuuggacccuugaggccgggacgggauga

SEQ ID NO: 77238 - RNA, 600 nt, Artificial Sequence
  derived and/or modified sequence opt5 from TREML1__Homo_sapiens__NP_001258736
augggccugacccuccugcuucugcuccugcuugggcuggagggacagggcaucguggggagccuccccgaaguccugcaagccccuguuggauccucuauucuggugcagugccacuacagacuccaggacgugaaggcucagaaagucuggugucgguuccugccggagggcugccaaccccuugugagcuccgccguugaucgcagagcgccugcugggcggcgcacauuucugacggaccucggaggcggccugcuucagguggaaauggucacccugcaggaggaagaugccggggaguauggauguaugguggacggcgccagagggccccagauccuccaucggguuucucugaacauucugccucccgaggaagaggaagagacacacaagaucggaagccucgcugagaaugccuucuccgauccugcuggcucugccaacccgcuggaacccagccaagacgagaaauccauuccucuuaucuggggcgcggugcugcucgucggacugcuuguggccgcugugguccuguuugccguuauggcuaagcgcaaacaggaaagccuccugucugggcccccuagacaguga

SEQ ID NO: 77239 - RNA, 966 nt, Artificial Sequence
  derived and/or modified sequence opt5 from TREML2__Homo_sapiens__NP_079083
auggcccccgcuuuccugcuccugcuucugcucuggccucagggcugcgugagcgggccguccgccgacucugucuacaccaagguuagacugcuugagggagaaacacugagcgugcaauguuccuauaaaggcuacaagaaccggguggaggggaaagucuggugcaagauccgcaaaaagaagugugaacccggauuugcgagaguguggguuaaaggcccucgguaucuccugcaggaugacgcucaggccaagguggucaauauuacgaugguggcccugaaacuccaggauucugggcgcuacuggugcaugagaaacaccagcggaauccuguauccccuuaugggcuuccaacuggacguuuccccugcuccccagacagagcggaauauuccuuuuacccaccucgauaacauccugaagucuggcacagugaccacagggcaggccccgaccagcggacccgacgcuccuuucacgaccggcgucaugguguuuacacccgggcuuauuacccugccucgccuccuggccuccacaagacccgcgagcaaaaccggauacucuuucacggccacauccaccacaagccagggcccgcggcgcaccauggggucucaaaccgugacagcuuccccuagcaaugccagagauucuuccgcuggacccgaaagcaucuccacgaagucuggcgaccugagcacccgguccccuacaaccggccucugucugacaagccgcucucuucugaacagacuccccuccaugcccagcauccggcaucaggaugucuauucuaccguucuggggguggugcuuacgcugcucguccugaugcugauuaugguguacggauuuuggaagaaacgccacauggccagcuacuccaugugcucugacccuagcacaagagauccgcccggccggccugagcccuauguugagguguaccucaucuga

SEQ ID NO: 77240 - RNA, 3603 nt, Artificial Sequence
  derived and/or modified sequence opt5 from TRERF1__Homo_sapiens__XP_006715208
augggcgaccagcaacuguacaagaccaaccacguggcccaugggagcgagaaucucuucuaucagcagcccccucugggaguccacuccggccuuaaccauaauuacgggaacgcuguuacaggaggcgggauggaugccccgcaggcgucucccaucagcccucacuuuccccaagacacgagagauggacugggccucccugugggcuccaaaaaucuggggcagauggacaccucucggcagggaggcugggggagccaugcuggacccggcaaccacgugcagcuucgcgggaaucuggccaacuccaauaugauguggggagccccugcucaagccgaaccgacagauggcuaucaguacaccuauucucaggcuagcgagauuagaacacagaagcucaccuccggcguccugcacaaacuggacagcuucacacaaguguuugccaaccagaaucuccggauccagguuaacaauauggcgcaagugcugcauacccagucugccgucauggauggggcucccgacuccgcccuucgccagcugcucagccagaagccuauggaacccccugcucccgccauuccgucuagauaccaacaggugccucagcagccccacccuggauucacgggcgggcuguccaaacccgcgcuucaaguuggacagcaucccacccagggccaccuguauuacgauuaccagcaaccucucgcccaggugccgguccagggcggacagccccugcaagcuccucagaugcugagccagcacaugcaacagaugcagcagcaucaauauuaucccccucagcagcagcaacaggccggccagcagcggaucucuaugcaagagauucagacacagccccaacagauccgcccgucccagccucagcccccuccccaacagcagcagccucaacagcuccagcugcagcaaagacagggcagcaugcagaucccccaguacuaccaaccgcagccuaugaugcagcaccuucaagaacagcagcagcaacagaugcaucugcagccucccuccuaucaccgggacccccaucaguacaccccggagcaagcucacacagugcagcucauuccccuggggucuaugagccaguauuacuaccaggagccucaacagcccuauucccacccucuuuaccagcaaagccaucugucucagcaccagcagcgcgaagauucccaacucaagaccuauagcucugacagacaggcccaggccaugcugagcucccauggagaucuggggcccccugacacggggaugggagaccccgcuucuagcgaucucacacggguguccagcacccugccgcaccgcccucuucugucucccuccggcauccaccucaacaauauggggccucagcaucaacagcugagccccucugcgauguggccgcagaugcaccuuccugacggcagagcccagcccggauccccugagagcuccggccaacccaagggggcuuuuggagaacaguucgaugccaaaaacaagcugacaugcucuauuugucucaaagaguuuaagaaccugcccgcccugaauggccauaugcggagccacgggggaaugcgcgcuuccccuaaccucaaacaggaggaaggcgagaagguccugccgccccagccucaacccccucuucccccuccgcccccucccccucccccgccucagcugccucccgaagccgagucucucacccccaugguuaugcccgugagcgugccugucaagcugcugccgcccaaaccuuccagccagggguucaccaauucuacaguggcggcucccuccgccagagacaagccugccagcucuauguccgaugacgaaaugcccguucuugagaucccgcggaaacaucaaccuagcgugcccaaggcugaggaaccucucaaaacgguccaggagaagaaaaaguuuagacaccgccccgaaccucuguucauucccccgccucccucuuacaaccccaauccugccgcuagcuauuccggcgccacccuguaccagagccagcuccggucuccgagagugcugggagaucaccuucugcucgaccccacacaugagcugccucccuauaccccucccccuaugcuguccccgguucgccaaggcagcgggcuuuucuccaacgugcucaucucuggacacggccccggggcgcauccucagcugccccugacaccucucacccccacgccgcggguccugcuuugcagaagcaauuccauugauggaucuaacgugacagucaccccuggccccggggaacagaccguggacguugagccccgcaucaauaucggccugcgguuccaggccgagauuccugaacuccaagauaucagcgcucuggcccaggacacacacaaggcuacccugguguggaaacccuggccugagcuugaaaaccaugaccuccagcagagagucgagaaucugcugaaccucuguugcuccucugcccugccgggaggcgggacaaauagcgaauuugcgcuucacucccuguucgaggccaagggagaugugaugguugcucucgagaugcugcugcuucgcaaacccgugcggcucaagugucacccucuggccaacuaccauuacgcuggcagcgacaaauggacgucucuggaaagaaagcucuuuaauaaggcccuggccaccuauuccaaagauuuuauuuucguccaaaagauggugaaaagcaagacaguggcucagugcguugaguacuauuacaccuggaaaaagaucaugcgccuugggcggaagcacagaacacggcuggcggaaauuaucgacgauugugucaccucugaggaggaagaggaacucgaggaagaggaggaagaggaccccgaagaggaucgcaaauccacgaaggaagaggagagcgaagugccuaaaucucccgagccgccucccgugccuguccuggcccccaccgaaggaccuccccugcaggcucuuggccaaccguccgggagcuuuaucugcgagaugccuaacuguggcgccguguucuccagcagacaggcccugaacggacaugcucggauucacggcgggacaaaucagguuaccaaggccagaggagcgauccccucuggcaaacagaagcccgggggaacacaaagcggcuauugcuccgugaagucuagcccuucccacucuaccacgagcggcgaaacagacccgaccacaauuuuucccuguaaagagugcgggaaggucuucuuuaaaaucaagucccgcaacgcucauaugaaaacccaccggcagcaggaggaacagcaaagacagaaggcccagaaagccgcuuucgccgcggagauggcugccaccauugaacgcacaacgggaccugugggcgcccccgggcuccugccucucgaucagcugucucuuaucaagcccaucaaggacguugauauucuggacgaugacgugguccaacagcucggaggcgugauggaggaggcugaaguuguggacaccgaucugcugcuugacgaucaggacagcguccugcuccaaggggaugccgagcuguga

SEQ ID NO: 77241 - RNA, 915 nt, Artificial Sequence
  derived and/or modified sequence opt5 from TREX1__Homo_sapiens__NP_009179
augcagacccugaucuucuuugacauggaggccacaggccuccccuucagccaaccuaaggugacggaacugugccuucuggcuguccacagaugugcccucgaguccccgcccaccucucaggggccucccccuacaguucccccuccgccccgggugguggauaaacugagccuuugcgucgcgccuggaaaggcuuguucccccgccgccucugaaauuaccggccugagcacagcugugcucgccgcucaugggcgccagugcuuugacgauaaccuggccaaucugcuccuggcguuccuuagacggcagccucaacccuggugucugguugcccacaacggagaccgcuacgauuuuccgcuccugcaggcugagcuugccaugcugggccucaccuccgcucuggacggggccuucugcguggauucuaucacagcgcugaaagcccucgaaagagcuagcuccccuagcgagcauggaccccggaagucuuauucccugggcagcauuuacacccgccuuuauggccagucuccucccgacucccacacggccgagggggauguccuggcucuccugagcaucugucaguggagaccccaagcccuucugcgguggguggacgcccaugcucgcccuuuuggaaccauuagaccgauguacggcguuacagcgucugcccggaccaaaccccgcccuuccgcugugacaaccacggcccaccucgccacaaccagaaauacaagccccucccugggggaaucucggggaaccaaggaucugccucccgucaaggacccgggcgcucucagccgcgaggggcugcuugccccucugggacuccuggcgauccuuacccuggcuguggccacacucuauggccugucccuggccacgcccggcgaauga

SEQ ID NO: 77242 - RNA, 711 nt, Artificial Sequence
  derived and/or modified sequence opt5 from TREX2__Homo_sapiens__NP_542432
augagcgaggcccccagagcugaaaccuucguguuucuggaccucgaggccacaggccugccuuccgucgaaccggagaucgcggaacuuucucuguucgcuguucaccggagcucccucgagaaccccgagcaugaugaaucuggggcccuggugcuuccucgcgugcuggacaagcucacgcugugcaugugucccgagagaccuuuuaccgccaaagcuagcgaaauuacaggacuguccucugagggccucgcccggugccgcaaggcuggguucgauggagccgucgugagaacccugcaggcguuucuuagccggcaagccggccccaucugucugguugcucacaauggguucgacuacgauuuuccucuccugugcgccgagcuucgcagacugggagcucggcucccgcgcgacacagugugucuggauacccugcccgcccucagaggccuggaccgggcgcauucccacggcacacgcgccagagggcggcagggauauagccuuggcucucuguuccaucgcuacuuuagagcugaaccuuccgccgcucacagcgccgagggggauguccacacccuccugcuuauuuuccugcaucgggccgcugaacuccuggcgugggccgacgagcaggcuagaggaugggcccacaucgaacccauguaucugccucccgaugacccgucucucgaggccuga

SEQ ID NO: 77243 - RNA, 3075 nt, Artificial Sequence
  derived and/or modified sequence opt5 from TRHDE__Homo_sapiens__NP_037513
augggcgaggacgaugccgcucugagagccgggagccggggacucuccgaccccugggcggauucugugggcguccgcccuagaaccacagaacggcacaucgcuguucauaagcgccuggugcuugccuucgccgugagccuggucgcucuccuggccgugacgaugcuugcuguucugcucucccugagauuugacgagugcggggccucugcgaccccgggagccgauggcgggcccagcggauucccugaacggggcggcaacgggucccugcccggaucugcucgcagaaaucaccaugccggcggggacagcuggcagccugaggcuggaggcguggccucccccgggacaaccagcgcgcaaccuccgucugaagaggagcgggaacccugggagccuuggacacagcuccgccuguccggacaccuuaaaccccugcauuacaaccucaugcugaccgccuuuauggaaaauuucacauuuagcggcgaggucaacguggagauugcuuguagaaaugccacccgguauguugugcuucacgcuucucgcgucgccguggaaaaggugcagcuggccgaggauagagcuuucggcgcggucccuguugccggguuuuuccucuacccccagacgcaagugcugguggucgugcugaaccggacccucgacgcucagcgcaauuauaaccugaaaaucauuuacaaugcccuuaucgaaaacgagcugcucggauuuuucagauccagcuauguucugcacggcgaacggagauuucuuggggugacacaguucucuccgacccaugcccgcaaggcuuuuccuugcuucgaugagcccauuuacaaagccacauucaagaucuccaucaagcaccaggcgaccuaucugagccucuccaauaugccugucgagacgucuguguuugaagaggacggauggguuacagaucauuucagccaaacaccccugauguccaccuacuaccuggcuugggccauuuguaacuuuaccuaucgggaaaccacaacgaaaagcggcguggucgugagacucuacgcccgccccgacgcuauccggagagggucuggagauuaugcccugcacauuaccaagcgccuuaucgaguucuacgaagacuauuuuaaagucccuuacucccugccgaagcucgaccugcuugcugugcccaaacacccuuaugccgcgauggagaauuggggccugagcauuuucguugagcagcggauccuccuggaucccucugugagcuccauuucuuaccugcucgacgucacaauggugaucguucaugaaaucugccaccagugguuuggcgaucuggugaccccugucuggugggaggacguguggcuuaaggaaggguucgcccauuacuuugaguucgugggaacagauuaucuguaccccggcuggaacauggaaaagcagagauuucucaccgacguucugcacgaggucaugcugcuugaugggcucgcuagcucccauccggugagccaagaggugcugcaggccacggacauugaucgcgucuucgacuggaucgcuuauaaaaagggagccgcgcugauucggaugcucgccaauuuuaugggccacucuguguuccagagagggcugcaagauuaccuuacaauccacaaauauggcaacgcugcccgcaacgaccuguggaauacccucuccgaagcucugaagcggaacggaaaauacguuaauauucaggaggugauggaccaguggacccugcagaugggcuauccugucaucacaauccuugggaacaccacagccgaaaauagaauuaucauuacgcaacagcauuucaucuacgauauuagcgccaagaccaaagcucucaagcugcagaacaauucuuaccuguggcagaucccccucacaaucgugguuggaaaccggucccacgugagcuccgaggcgauuaucugggucucuaauaagagcgagcaucaccgcauuaccuaucuggacaaaggcuccuggcuucuggggaacaucaaucaaacaggauacuuuagagugaacuaugaucuccggaauuggagacugcugauugaccagcuuauccgcaaccacgaaguucucucugugagcaaucgggccggccugauugaugacgcuuucucccuggccagagccggguaccucccucagaacaucccccuggagaucauucgcuaucuuagcgaagagaaggauuuucugccuuggcaugcugccucuagagcgcucuacccccuggacaaacugcuugaucggauggaaaacuauaauaucuucaacgaguacauucucaagcaggucgcuaccacguacaucaaacugggcuggccgaagaauaacuuuaauggaucccuggugcaagccagcuaucagcacgaggaacuccgcagagaggugauuaugcuggccuguucuuucggcaacaagcauugccaccagcaggcuuccacccuuaucagcgacuggaucucuagcaaucggaaccgcauuccucugaaugucagagauaucguuuacuguacaggggugucccuccuggacgaagaugugugggaguuuauuuggaugaaauuccauagcaccacagccgucucugaaaagaaaauccugcuugaggcgcugaccugcuccgacgaccggaaccuccugaaucgccuccugaaccuuagccucaauuccgaggugguucuggaucaagacgcuauugaugugaucauccacgucgccagaaacccccacggacgggaccuggccuggaaguuuuuccgcgauaaauggaagauucugaauacgagauauggcgaagcucuuuuuaugaacucuaagcugaucagcggggugacagaguuccucaacaccgaaggagagcugaaagaacucaagaauuuuaugaaaaacuacgacggcguugccgcugccuccuucucucgggcgguggagacagucgaggccaaugugagauggaagaugcuguaucaggaugaacuuuuccaguggcuggggaaagcucuccgccauuga

SEQ ID NO: 77244 - RNA, 729 nt, Artificial Sequence
  derived and/or modified sequence opt5 from TRH__Homo_sapiens__NP_009048
augcccggcccuuggcugcuccuggcccuugcucugacccucaaccugacaggggugccgggaggcagagcccagcccgaggcggcucaacaggaagccgucacggccgcugagcacccugggcuugacgauuuccugcggcagguugaacgccuccuguuucugagagagaauauccagcggcuccaaggagaccagggcgaacauagcgccucccagauuuuccagucugauuggcugagcaagcgccaacaccccgggaaaagagaggaggaagaggaagagggaguggaggaagaggaagaggaagagggcggcgcuguggggccucauaagcggcagcaccccggacgcagagaggacgaagccuccuggucugucgaugugacccagcauaaacggcagcacccuggccgcagaagcccguggcuugcguacgccguucccaagcggcaacacccugggcgcagacuggcugaccccaaagcccagcgguccugggaggaagaggaagaggaggaggaacgcgaagaggaucucaugccugaaaagagacagcaucccggaaagcgggcucugggcgggccgugcggaccucaaggcgccuauggccaggcggggcuucugcucggacugcuggacgaucucucuagaagccagggcgccgaggagaaacgccagcaccccgggcggagagcugccugggugcgcgaaccucuggaggaauga

SEQ ID NO: 77245 - RNA, 1197 nt, Artificial Sequence
  derived and/or modified sequence opt5 from TRHR__Homo_sapiens__XP_011515565
auggagaacgaaaccgugagcgagcugaaucagacacaacuccagcccagagccgucguugcucuggaauaccagguggugacgauccuucugguccucauuaucugcggccuggggauugugggaaacaucaugguugugcuugucgugaugcggaccaagcacaugcgcacaccuaccaauuguuaucugguuucccucgccguggcggaccugaugguccugguggcugccggccucccgaacauuacagauucuaucuacgggagcuggguguauggauacgucggcugccuguguaucaccuaucuucaguaccuggggauuaaugccuccucuugcagcaucacagcuuucaccauugagagauauaucgccauuugucaucccaucaaagcucaauuucucugcacguucucccgggccaagaaaauuaucaucuuuguuugggcguucaccucucuguacuguaugcuuugguuuuuccugcucgaccugaacauuagcacauacaaggaugccaucgugauuuccugcggauauaaaaucagccgcaauuacuauucuccuauuuaccugauggacuuuggcguguucuaugucgugcccaugauccucgcuaccguucuguacggcuuuaucgcccggauucuuuuccugaacccuauccccuccgauccuaaggaaaauagcaagacauggaaaaacgacucuacccaccagaauacgaaccucaaugugaacacauccaauagauguuuuaacagcaccgucucuucccgcaaacaggugacaaagaugcuggcuguuguggucauucuuuucgcccugcucuggaugccguauagaacccugguggucgugaacagcuuucuguccucucccuuccaggagaauugguuccuccuguuuugccggaucuguauuuaccuuaacagcgcgaucaauccuguuaucuacaaccugaugucccaaaaguuccgcgccgcuuuuagaaaacucugcaauugcaagcagaagcccaccgagaaaccugccaacuauagcguggcucugaauuacucugucauuaaggaauccgaucauuucagcacagagcuugacgauaucacggugaccgacacauaucugucugccaccaaaguuagcuuugaugacacaugucucgccuccgaagugucuuucagccaguccuga

SEQ ID NO: 77246 - RNA, 231 nt, Artificial Sequence
  derived and/or modified sequence opt5 from TRIAP1__Homo_sapiens__NP_057483
augaacagcgugggcgaggccugcaccgacaugaagagagaauacgaucaguguuucaaucggugguuugcugagaaauuccugaagggggacuccucuggagaucccugcacagaccucuuuaaacgcuaucaacaguguguccagaaggccaucaaagaaaaggagauuccuaucgaaggccuggaguucauggggcacggaaaggagaaaccggaaaacagcuccuga

SEQ ID NO: 77247 - RNA, 1119 nt, Artificial Sequence
  derived and/or modified sequence opt5 from TRIB1__Homo_sapiens__NP_079471
augagagugggccccguccggagcgccauguccggggcuucucagccucgcggaccggcccuucucuuccccgcgaccagaggcguuccugcuaagcggcugcuugacgccgaugacgccgcugccguggcugccaaaugcccccgccugagcgaguguuccucuccucccgauuaccucagcccuccggggucccccugcucuccucaacccccucccgcggccccgggagcuggcgggggaagcggcuccgccccuggccccagcagaaucgcugacuaucugcuucugccucucgccgaacgggagcacgugucucgcgcgcuguguauucauacagggagagaacugcggugcaaggucuuucccaucaaacacuaccaggauaagauucgccccuauauccagcucccuucccauagcaacauuacgggaaucguggagguuauccugggcgaaaccaaagccuacguguucuuugagaaggacuucggggauaugcacucuuaugucagaucccggaagcgccuuagagaggaagaggcugcccggcuguuuaaacagauugugagcgcuguugcccauugucaccaaucugccaucgugcucggagaccugaagcugcgcaaauucgucuuuuccacagaagagagaacccagcugcggcucgagagccuggaagauacacacauuaugaagggcgaggacgaugcucuguccgacaaacaugggugcccggcguacgugucucccgaaauccucaauaccacaggaaccuauagcggcaaggccgcugauguguggucccugggcgucaugcuuuacacgcugcucguugggagauacccuuuccacgacagcgaccccucugcccuguuuuccaagauucgccggggacaguucuguaucccugagcauauuagccccaaagccagaugccuuauccgcucucugcuccggagagaaccgagcgagcgccugaccgcuccugagauccugcuccaccccugguuugaauccgugcuggagccuggcuauauugauucugaaaucgggacaagcgaccagauugugcccgaguaccaagaagauuccgacaucagcucuuucuuuuguuga

SEQ ID NO: 77248 - RNA, 1032 nt, Artificial Sequence
  derived and/or modified sequence opt5 from TRIB2__Homo_sapiens__NP_067675
augaacauccacagaagcaccccuauuacaaucgcccgguacggccgcuccagaaauaagacgcaggacuucgaggaacugucuagcauucgguccgcugagccuucucagagcuuuuccccgaaccucgggucucccagcccucccgaaaccccuaaucugucccauugcgugagcuguaucggaaaauaucuucugcucgagccccuggaaggcgaucacgucuuccgcgccguucaucuucacucuggggaggagcuggugugcaagguguuugacauuuccuguuaccaagaaagccucgcgccuugcuucugucugucugcucauuccaacaucaaucagaucacagagauuauccugggagaaaccaaagccuaugucuuuuucgagagaagcuacggcgauaugcacucuuuugugcggacaugcaagaaacuccgcgaggaagaggccgcuagacuguucuaucagauugccuccgcuguugcccacugucaugacgggggacuugugcugcgggaucucaagcugcgcaaguuuaucuucaaagacgaagagagaacccgggucaaacuugaaagccuggaggaugcguacauucuccgcggcgacgaugacucccugucugauaagcacggcugcccggccuaugugagccccgagauccugaacacauccgggagcuacucuggaaaggcugccgacguuuggucccucggcgugaugcuguacaccaugcuugucgggagauauccuuuucaugauauugaacccagcucucuguucagcaaaauccggcgcggacaauuuaauaucccugagacgcucucccccaaggcuaagugucugauuagaucuauccuucggagagaaccgagcgagcgccugaccucccaggaaauucucgaccacccuugguucagcacagacuucucuguguccaacagcgccuacggcgcgaaagaggugucugaucagcugguccccgacguuaauauggaggaaaaccuggaucccuuuuucaauuga

SEQ ID NO: 77249 - RNA, 1077 nt, Artificial Sequence
  derived and/or modified sequence opt5 from TRIB3__Homo_sapiens__NP_001288117
augagagccacaccccuggcugccccugcgggcagccucucccggaagaaacgccuggagcuugacgauaaccuggacaccgaaagaccggugcagaagcgggcucgcucugggccccaaccuagacugcccccuugccuccuuccccugagcccuccgacggcccccgaucgggccaccgcugucgccacagcuucccgccucggaccuuacguucugcuggagcccgaagagggcgggagagccuaucaggcgcuccacuguccuaccggaacagaauauaccugcaaaguguaccccgugcaggaggcccuggcuguccuugagccguacgcccggcugccuccccauaagcacguggcucgcccuacagaaguucucgccggcacccagcugcuuuaugcguucuuuacgagaacccauggggacaugcacucucuggugcggagccgccauagaauccccgagcccgaagccgcuguccucuuccggcaaauggccacagcucuggcccacugucaccagcauggacuggugcuccgcgaucugaaacuuugcagauuuguuuucgccgaccgggagagaaagaagcuggugcucgagaaucuggaagauuccuguguccuuaccggcccugacgauucucugugggacaaacacgcuugcccggcguacgugggccccgagauucucagcucccgcgccagcuauucugggaaggcugccgauguguggucccugggagucgcccuguuuacaaugcucgcuggccauuacccuuuccaggacagcgaacccguucugcuuuuugggaaaauccggagaggagccuacgcgcugccugcuggccucucugcccccgcccgcugucuggugcggugccuucugagacgcgagccggcugaacggcucaccgccacggggauucugcugcacccuuggcucagacaggaucccaugccucuggcucccacacgcucccaccuuugggaggccgcgcaaguggucccugacggacugggccucgacgaggcccgggaagaggaaggcgauagagaggugguucuguauggguga

SEQ ID NO: 77250 - RNA, 1446 nt, Artificial Sequence
  derived and/or modified sequence opt5 from TRIM10__Homo_sapiens__NP_006769
auggccagcgcugccuccgugaccucucuggcggacgaggucaacugcccuaucugucagggcacacucagagaaccuguuacgauugauugcgggcacaauuucugucgggcuugccugacccgcuacugugagaucccgggacccgaccuugaagagagcccuacaugcccccuguguaaggaaccuuuuagacccggcuccuuccggccuaacuggcaacucgccaaugugguggagaacauugagcgccugcagcuugucucuacccuggggcucggagaagaggaugugugccaggaacauggcgagaaaaucuauuucuucugugaggacgaugaaaugcagcugugcguuguguguagagaggccggggaacacgcuacacauaccaugcgguuucuggaggacgccgcugccccguaccgcgaacaaauucacaagugccucaaaugccugagaaaggagcgggaggaaauccaggagauccagagccgcgaaaauaaaagaaugcagguccuucugacacaaguguccaccaagcggcagcagguuauuucugaguucgcgcaucuccgcaaguuucuggaagaacagcaaagcauccuucuggcccagcucgagucccaggauggagacauucugagacaacgggaugaauuugaccugcucguggcuggcgagaucugucgcuuuagcgcccugauugaggagcuugaagagaaaaacgagagacccgcucgggaacugcucacggauaucagaucuacccugauucgcugcgagacacggaaguguagaaaaccugucgccgugucccccgaacuuggccagcgcauccgggacuucccucagcaggcgcugccccuccaaagagagaugaagauguuucuggagaaacugugcuucgaacucgauuaugagccggcccacaucagccuggacccucagaccucucaccccaaacuucugcucuccgaagaccaucagcgcgcucaguuuagcuacaaguggcaaaauucuccugauaacccccagcgguucgacagagccacaugugugcuggcucacaccgggauuacgggaggccgccauacaugggucguuuccaucgaucuugcccacgggggaagcugcaccgugggcguggucuccgaggacgugcagcggaagggggaacugagacuccgccccgaggagggaguuugggccgugcggcuggcuuggggcuucgucucugcgcugggcagcuuuccuacaagacucacccugaaggaacagccgcggcaagugcgcguuucccuugauuaugagguggggugggucaccuucacaaaugccgugacgagagaacccauuuacaccuuuacagcuagcuucacccggaaagucauccccuuuuucggacuguggggcagagggucuuccuuuagccucucuagcuga

SEQ ID NO: 77251 - RNA, 1407 nt, Artificial Sequence
  derived and/or modified sequence opt5 from TRIM11__Homo_sapiens__NP_660215
auggccgcucccgaccugagcaccaaccuccaggaggaagccacaugcgcgaucugucuggauuacuucacggacccugugaugaccgauugcggccacaauuuuuguagagagugcauucggcgcuguugggggcaaccggaaggacccuaugcuugcccugaguguagagaacuuucuccccagcggaaccugcgcccuaauagaccccucgccaagauggccgagauggcucggcgccugcauccuccgucccccgucccucagggcguuugccccgcccacagagagccucuugcugccuucuguggggacgaacugcggcuccugugcgcggccugugagcgcagcggagaacauugggcucacagagugcggccccugcaggaugccgcugaggaccucaaagccaagcuggagaaaucccuugaacaucugcgcaagcaaaugcaggaugcgcuccuguuucaggcccaggcugacgagacaugcgugcuuuggcagaaaauggucgaaucucaaagacagaacgugcugggcgaguucgaacggcuccgcagacugcuggccgaggaggaacagcaacuccugcagcggcuugaggaagaggaacuggagguucucccgagacugcgcgagggggcugcccaccuuggacagcaaagcgcccaccuggcugaacucaucgcggagcuggaaggccggugccagcugccugcccucggccugcuucaggauauuaaggacgcucugagacgcgugcaggaugucaagcuccaacccccugaggugguucccauggaacugcggaccguguguagaguccccgggcuuguggagacacugcgccgguuuagaggagacgugacccucgauccugacacagccaauccggagcugauccuguccgaagaccgccggucuguccagagaggcgaucuccgccaggcccugcccgacagcccugagcgguucgaucccgggccuugcguucuuggacaggaaagauuuaccuccggccggcauuacugggagguggaggugggggaccgcacgagcugggcucugggagucuguagagaaaacgugaaucggaaagagaagggcgaacucucugccggcaacggguucuggauucugguuuuucugggauccuauuacaauagcucugagagagcgcuugcuccccuccgcgauccgccucggagagugggcaucuuccuggacuaugaagccgggcaccuguccuuuuacagcgccaccgauggaucucuccuguucaucuuucccgagauuccuuucuccggcacacuucgcccccuguucagcccucucuccucuagccccaccccgaugacaaucugcagaccuaaagggggauccggcgacacccuggcuccccaauga

SEQ ID NO: 77252 - RNA, 1233 nt, Artificial Sequence
  derived and/or modified sequence opt5 from TRIM13__Homo_sapiens__NP_001007279
auggacgugauggaacugcucgaagaggaucugaccugccccaucuguugcagccuuuucgacgauccuagaguccugccguguucccacaacuuuugcaagaaaugucucgaaggcauucuggaggggucuguucggaauagccuuuggcgccccgccccuuucaagugccccacauguagaaaagaaacguccgcuaccggaaucaacucucuucaggugaauuacagccucaagggcauuguggagaaauauaacaagaucaagauuuccccuaaaaugcccgucugcaaggggcaucugggacaaccucugaauaucuuuugucucacagacaugcagcugaucugcggcauuugugccacccgcggggagcacacaaaacauguguucugcucuaucgaagaugcguacgcucaggagcgggacgccuuugaaagccuuuuccaguccuuugagaccuggagacggggagaugcccugagccgccucgacacacuggagaccucuaagagaaaaucccuucaacugcucacgaaggauagcgacaagguuaaagaguucuuugaaaagcugcagcacacccuggaucagaaaaagaacgaaauucucucugacuucgagacaaugaaacuggcugugaugcaggccuaugauccggaaaucaauaagcugaacaccauucugcaagagcagcggauggcuuuuaauaucgccgaggcguucaaagacgucuccgaacccauuguguuucuccagcagaugcaagaguuccgcgaaaagaucaagguuaucaaagagacaccucugcccccuagcaaccuucccgccucuccgcugaugaagaauuucgacaccucccagugggaagauauuaaacucguggacgucgauaagcugagccugccucaggacacgggcacauuuaucuccaaaauucccuggucuuucuacaagcucuuucugcuuauccugcuccugggccuugugauuguguucgggccuaccauguuucuggaguggagccucuucgaugaccuggcuacauggaagggaugccuguccaacuuuagcucuuaucucaccaaaaccgccgauuucaucgagcaauccgucuuuuacugggaacagguuacagacggcuucuuuaucuucaaugagagauuuaagaacuucacgcugguggugcuuaauaacgucgcugaguucguguguaaauauaagcugcucuga

SEQ ID NO: 77253 - RNA, 1398 nt, Artificial Sequence
  derived and/or modified sequence opt5 from TRIM15__Homo_sapiens__NP_150232
augcccgccaccccuagccugaaggugguccacgagcucccggcuugcacacugugugccggcccccuugaagacgcgguuacgaucccuugcgggcauaccuucuguagacugugccuccccgcucugucccagaugggagcccaaucuagcggcaaaauucuucuguguccucucugccaggaggaggaacaggccgaaacacccauggcuccugugccgcuggggccccugggagagaccuacugugaggaacacggcgagaagaucuacuuuuucugcgaaaacgaugccgaguuucucuguguguucugccgggaggggccuacacaucaggcucacaccgucggauuucuggacgaagccauucaacccuaucgcgauagacuucggucccgccuggaggcgcucucuacagaaagagacgagaucgaagaugugaaaugucaggaggaccagaagcugcagguucuucugacccaaauugagagcaaaaagcaucagguggaaacggccuucgagcggcuccagcaggaacuggagcaacagcgcugccugcuccuggcuagacuucgggaacuggagcagcaaaucuggaaggagcgcgaugaauauaucaccaaagucuccgaggaagugacaagacucggcgcccagguuaaggagcuggaagagaaaugccagcagccugcuucugagcuucugcaagacgugcgggucaaucagagccgcugugaaaugaagaccuuugugucccccgaggccauuagcccggaucucgugaaaaagaucagagacuuccaccggaagauucugacacugccugaaaugaugcgcauguuuucugagaaccucgcgcaccaucuggagaucgauuccggcgucauuacccuugacccccagacggccagcagaucucugguucucuccgaagaucggaaaagcgugagauacacacgccagaagaaaucucugccugacagcccccuucgguucgacgggcugcccgcugugcucggauuuccuggcuucuccuccgggagacaccgcuggcaagucgaucugcagcugggagacggcgggggaugcaccgugggcguugccggcgagggggugcggagaaagggagaaaugggccucucugcugaggauggggucugggccgugaucauuagccaucagcaguguugggccuccacaagcccgggaaccgaccugccccuuucugaaaucccucgcggcguucggguggcucuggauuaugaggcggggcaagucacccuccacaaugcccagacacaggagcccaucuuuacguucaccgcuuccuucagcggaaaaguguuuccuuucuuugccgucuggaagaaaggcucuugccugacacugaagggcuga

SEQ ID NO: 77254 - RNA, 1695 nt, Artificial Sequence
  derived and/or modified sequence opt5 from TRIM16__Homo_sapiens__NP_006461
auggccgagcuggaccucauggcucccggcccucugccgagagccaccgcgcagcccccugcuccccuuagcccugauuccgggucucccagcccugacuccggaucugccagcccgguggaagaggaagaugucggcuccucugagaagcuggggcgggaaacagaggagcaagacagcgauuccgccgaacagggagaccccgcuggcgaggggaaagaaguucucugcgauuucugucuggacgauacgcgcagagugaaggccgugaaaagcugccuuaccuguauggucaacuacugcgaggagcaucugcagccucaccaggugaauaucaagcuccaaucucaucugcugacagaacccguuaaagaccacaacuggcgguauuguccugcucaccauagcccccucuccgccuuuugcuguccggaucagcagugcauuugucaggacugcugucaagagcacucuggacacaccaucgugucccuggaugcggcccgcagagacaaggaagcugagcuucagugcacacagcuggaccucgaacggaagcugaaacuuaaugagaacgccauuagccgccugcaggcuaaucaaaagucuguccucguguccguuagcgaggugaaagccgucgcggaaaugcaguucggcgagcugcuggccgcugugagaaaggcccaggcuaacgugaugcucuuucuggaagagaaagaacaagccgcccuuucccaggcuaauggcaucaaggcgcaucuggaguaccggucugccgagauggaaaagagcaaacaggagcucgaacgcauggcugccauuuccaacaccguccaguuccuggaggaauauugcaaguuuaaaaauacagaggauaucaccuucccuagcguuuacguggggcuuaaggacaaacugucuggaaucagaaaggugauuacggaguccaccguccaccucauccaacugcuggaaaacuauaaaaagaagcuccaggaguuuagcaaagaagaggaguacgauauucggacacaggugucugccguugugcagcgcaaguauuggaccagcaaacccgaaccuuccacaagagagcaauuccugcaguacgcuuacgacaucaccuuugaucccgacacggcccauaaguaucuucggcugcaggaagagaaucgcaaagucacaaacaccacacccugggaacacccuuacccggaucuccccucuagauuccugcacuggagacaggugcuuagccaacagucccuguaucuccaucgguacuauuuugagguugagauuuucggcgcggggaccuacgugggacugaccuguaagggcaucgaccgcaagggggaagaacggaauagcugcauuucuggaaacaauuuuuccuggagccugcaguggaacggcaaagaguucacagcuugguauucugauauggagacgccucucaaggccggccccuucagacgccugggggucuacaucgacuuuccuggaggcauccuuuccuucuacgggguggaauaugauaccaugacacugguccacaaauuugccuguaaguucagcgagcccguguacgcugccuuuuggcucuccaaaaaggagaacgcuauucggaucguugaccugggagaggaaccggaaaagccugcccccucucuggugggcaccgcgccuuga

SEQ ID NO: 77255 - RNA, 1434 nt, Artificial Sequence
  derived and/or modified sequence opt5 from TRIM17__Homo_sapiens__NP_001020111
auggaggccguggaacuggcuagaaagcuccaggaggaagcgaccugcagcaucugucuggacuacuucacagaucccgucaugacgaccugcggccacaacuuuugucgggccugcauucaacuuuccugggagaaagcucgcgggaagaaaggaagacggaagcgcaaaggcucuuucccuuguccggaaugcagagagaugagcccccagcggaaucugcucccuaaccgccugcuuacaaagguugccgagauggcccagcagcaucccgggcugcaaaagcaggaccucugucaggaacaccaugagccucugaaacuguuuugccagaaggaucaaucccccaucuguguggugugcagagaaucucgggagcaccgccuccauagaguccugccugcugaggaagccgugcagggauauaaacuuaagcuggaggaagacauggaguaccuccgggaacagauuacccgcacaggcaaucugcaggcuagagaggagcaaagccuugccgaauggcaggggaaaguuaaggagcggcgcgaaagaaucgugcuggaguucgaaaagaugaaccucuaucuggucgaggaggaacagcggcugcuccaagcgcuggagaccgaagaggaagagacagccuccagacuucgcgagucuguggcuugucuggaucggcagggacacagccucgaacugcuucugcuccagcuggaggaaagauccacccagggcccgcugcaaaugcuccaggacaugaaagagccccugagccgcaagaauaacguuucugugcagugcccugaggucgcucccccuacgcggcccagaaccgugugccgcgugccgggccagauugaaguccuucggggguuucuggaggauguugugccugacgccacauccgccuaccccuaucuccugcuuuacgaaagcagacaacgccgguaucugggaucuuccccugagggcagcggguucuguucuaaagauagauuuguggcguaccccugcgccgucggacagaccgcuuucuccagcggccgccacuacugggaaguggggaugaauaucacaggagacgcccucugggcucugggcguuugucgggauaacguguccagaaaggaccggguccccaaaugcccugagaauggcuuuugggugguucagcugucuaaggggaccaaauaucucagcacguucuccgcccugacaccggugaugcuuauggagcccccuagccauaugggaaucuuucuggauuucgaagccggcgaggucucuuuuuacuccgugagcgacgggucucaccuccauaccuauagccaggcuacauuccccggaccucugcaacccuucuuuugucugggcgcgccgaaguccgggcagauggucauuucuaccgugaccauguggguuaagggauga

SEQ ID NO: 77256 - RNA, 1428 nt, Artificial Sequence
  derived and/or modified sequence opt5 from TRIM21__Homo_sapiens__NP_003132
auggccagcgcugccagacugaccaugaugugggaggaagugacaugccccaucugucucgacccuuucgucgagccgguuuccauugaaugcggccacucuuuuugucaggagugcaucagccaaguggggaagggaggcggguccgugugucccgucugccggcagcgcuuccugcuuaaaaaccugagaccuaaucggcagcucgcgaacauggugaauaaccugaaggaaauuucucaggaggcucgcgagggaacgcaaggcgaaagaugugccguucauggggagcggcuucaccuguuuugcgaaaaagauggaaaggcccucuguugggugugcgcucagagccgcaaacauagagaccacgccauggucccccuggaggaggcugcccaggaauaccaggagaagcugcaaguggcgcucggcgaacugcggcgcaagcaggagcuugccgaaaaacuggagguugagaucgcuauuaagagagccgauuggaaaaagaccguggaaacacagaaaucccggauccaugcugaguucguccagcaaaagaauuuucucguggaagaggaacagcgccagcugcaagagcuugagaaggacgaaagagagcagcugcggauccucggcgaaaaagaggccaagcuggcgcagcagucucaagcccugcaggaacucauuagcgagcuggaucgcagaugucacuccagcgcucuugagcugcuccaggaagugaucauuguccuggagcggucugaauccuggaaccuuaaagaccuggauaucaccagcccugagcucagaucuguuugccacgugcccgggcugaagaaaaugcugcgcacaugcgccgugcauauuacccucgacccugauacagcuaauccguggcugauccuuuccgaggaccggagacagguccgccugggagauacccaacagagcauucccggcaacgaggaacgguucgacucuuauccuauggugcucggggcccagcacuuucauuccggaaagcacuacugggaaguugaugugacgggcaaagaggccugggaccugggggucuguagagacagcgugcgccggaagggacacuuccuucuguccucuaagagcggcuuuuggaccaucuggcucuggaauaaacagaaguaugaagcuggcacauacccccaaaccccucugcaucugcagguucccccgugccagguggggaucuuccucgauuaugaggcgggaauggucuccuuuuacaacauuacagaccacggcagccugaucuauucuuucuccgagugugccuuuaccgggccucuuagacccuucuucagcccuggauuuaaugauggcgggaaaaacacggcuccccugacacucugcccccugaauauuggaucucagggcagcaccgacuacuga

SEQ ID NO: 77257 - RNA, 1485 nt, Artificial Sequence
  derived and/or modified sequence opt5 from TRIM22__Homo_sapiens__NP_001186502
auggacuucagcgugaaggucgauaucgagaaagaaguuaccugccccauuugucuggagcuccugacagaaccccuuucccuggacugcggccacucuuuuugucaggccugcaucacggcuaagauuaaagagagcgugaucauuuccagaggggaaucuagcuguccggugugccaaacccgguuccagcccggaaaccuccgcccuaauagacaucuggccaacaucgucgagcgggugaaggagguuaaaaugagcccccaggaaggccagaagcgcgaugugugugagcaccaugggaagaaacuucaaaucuuuugcaaggaagacggaaaagucauuuguugggugugcgagcugucucaggagcaccagggccaucagacauucagaaucaaugaaguugugaaggagugucaagaaaaacuccaggucgcgcugcagcggcugauuaaggaggaucaggaagcugagaagcucgaggacgauauccgccaagaaagaaccgccuggaaaauugagcggcagaagauccugaaaggguuuaacgaaaugcgcgugauucuugacaaugaggaacagagagagcugcaaaagcucgaggaaggagaggugaacguccuggauaaucuugccgcugccacagaccagcugguucagcagcggcaagaugcuagcacccucaucuccgaccugcagcgcagacugcggggcagcucuguggaaaugcuccaggaugugaucgacgucaugaaacgcuccgagagcuggacacugaagaaaccuaagucuguguccaagaaacuuaagagcguuuucagagugcccgaccugucuggcaugcuccagguccugaaagaacuuaccgaugugcaauacuauuggguugacgugaugcugaacccuggguccgccacgagcaaugucgcgauuuccguggaucagcggcaggucaagaccgugagaacaugcaccuuuaaaaacucuaauccgugcgacuucagcgccuuuggaguuuucggcugucaguacuuuuccagcgggaaguauuacugggagguggaugucucuggaaagaucgcuuggauucucggcgugcacuccaaaaucagcucucugaacaagcgcaaaagcuccggguucgccuuugaccccucuguuaauuauagcaagguguacucccgguauagaccucaauacggauacugggucauuggccugcagaacacaugcgaguauaaugcuuucgaagauuccucuuccagcgaccccaaagugcucacccuguucauggccgugccucccugucgcaucggcguuuuucuugauuacgaggcggggaucgucucuuucuuuaacgugacgaaccacggagcccugauuuauaaguucuccggcugccgguuuagcagaccggcuuacccuuauuucaaucccuggaacugucucgugccuaugacagucugcccucccuccucuuga

SEQ ID NO: 77258 - RNA, 1725 nt, Artificial Sequence
  derived and/or modified sequence opt5 from TRIM23__Homo_sapiens__NP_001647
auggccacccugguggucaacaagcucggcgcugggguugacagcggaagacagggcucccgggggacagccguggugaaaguccuggagugcggagugugugaagauguuuucucucuucaaggcgacaaggugccccgccugcuccugugcgggcacacggucugucaugauugccuuaccagacugccucuccacggacgggcgauccgcuguccguuugacagacaggugacagaucugggcgacagcggcguuugggggcugaaaaagaauuucgcucuccuggagcuucuggaacggcuccagaacggacccauuggccaguacggggccgccgaggaauccaucggaauuucuggcgagagcaucauucgcugcgaugaggacgaagcucaucuggccuccguguauuguaccgucugcgcuacacaccuuuguucugagugcagccaagugacccauuccacaaaaacccuggccaagcacagacgggugccucucgcggauaagccccacgagaaaacgauguguagccagcaucagguccacgccaucgaguuuguuugccuggaggaagggugccagaccucuccucugauguguugcguguguaaggaguacggaaaacaucaaggccacaagcacuccgugcucgaacccgaggcuaaucagauccgcgccagcauucuggacauggcucauugcaucagaacauucaccgaagagauuucugauuauucccggaaacuugucggcaucgugcagcacauugaagggggagaacagaucguugaggacggcauugggauggcccauacagaacacgugccuggaaccgcggagaacgcccgcagcuguaucagagcuuacuuuuaugaucugcaugaaacgcucugccggcaagaggagauggcccugucugucguggacgcucacguucgcgaaaaacuuaucuggcugagacagcagcaagaggacaugacaauucuccuguccgaagugagcgccgccugucugcacugcgagaagacccuccagcaggaugacugucgggucgugcuggcuaagcaggaaaucacaagacuucuggagacccuccaaaagcagcagcagcaauucaccgaggucgcggaucauauucagcuggacgccuccaucccggugacauuuacgaaagauaaucgcguucacauuggccccaagauggaaauccggguggucacccuugggcuggacggagcuggcaaaacaaccauccucuucaagcugaaacaggaugaguuuaugcagccuauucccacaaucggcuucaacguggaaaccguugaguacaagaaucugaaguuuacgauuugggacgucgggggaaaacauaagcucagaccucuguggaaacacuauuaccuuaacacacaagccgugguguucgugguugauucuagccaccgcgaccggaucuccgaggcccauagcgaacuggcuaagcuccugaccgagaaagaacugagagaugcccuucuccugauuuuugcgaauaagcaggacgucgcuggcgcccugucuguggaggaaaucaccgagcuccugucccuucacaagcugugcugugggcgcagcugguacauccagggaugcgacgcccggucuggcauggggcucuaugagggccuggauuggcugagcagacagcuuguggcugccggaguccucgacguggcuuga

SEQ ID NO: 77259 - RNA, 3051 nt, Artificial Sequence
  derived and/or modified sequence opt5 from TRIM24__Homo_sapiens__NP_003843
auggagguggccgucgaaaaggcuguugccgcggcugccgccgcuagcgccgcugccuccggcgggcccucugcggccccuagcggagagaacgaagcugaguccagacagggcccggacucugaacggggcggagaggccgcucgccugaaucuccuggauaccugcgccgugugucaccaaaacauccagagcagagcgcccaaacuucugccuugccuccauuccuucugucagcggugccugcccgccccucagcgcuaccuuaugcugcccgcuccuaugcucggcucugccgagacaccgcccccugugcccgcuccugggagccccgucuccggaagcucuccguuugccacgcaagugggcguuauuagauguccugugugcucccaggaaugugccgagcggcacaucauugacaauuucuuugucaaggauaccacagaagugcccagcucuaccguugagaaauccaaccaggugugcacaagcugugaggacaaugcugaagcgaacggcuucugcgucgaguguguggaauggcugugcaagaccugcauccgcgcccaucagagagugaaauuuacaaaggaucacaccguccggcaaaaggaggaaguuucuccugaggcugugggggugacgucccagcgccccgucuucugucccuuucauaaaaaggagcagcugaaacucuauugcgaaaccugugacaagcugacaugcagagauugucagcuucuggagcacaaagaacaccgguaccaauucauugaggaagccuuucagaaucagaaggugaucaucgacacccucauuacaaagcugauggagaaaaccaaguauaucaaauucacgggaaaccaaauucagaaucgcaucauugagguuaaccagaaucagaagcaaguggaacaggauaucaaagucgccauuuuuacacuuaugguggagaucaacaagaaaggcaaggcucugcuccaucagcuggaaagccuggccaaggaccacagaaugaaacucaugcagcaacagcaggagguugcggggcuguccaagcagcuugaacaugugaugcacuucucuaaaugggcugucagcuccggaagcucuaccgcccugcucuacuccaagcggcugaucacauaucgccuuagacaucugcuccgggccagaugcgaugcuagcccugugaccaauaacaccauucaauuucacugugacccgucuuucugggcccagaauaucauuaaccugggcagccuggucaucgaggauaaagagucccagccccagaugccuaagcaaaaccccgugguugaacaaaauucucagccucccagcgggcucuccagcaaccagcugucuaaguucccgacacagauuucccuugcucagcugcgccuccagcacaugcaacagcagcagccucccccucggcugaucaauuuucaaaaccauagccccaaaccuaauggacccgugcuuccgccucacccccagcagcugagauaucccccuaaccagaauaucccgcgccaagccauuaagcccaacccucuccagauggcguuccuggcccagcaagcuaucaaacaguggcagauuucuuccggccagggcacgcccagcaccacaaauuccaccucuagcacaccuuccucucccaccaucacgagcgccgcuggguacgacggaaaggccuuuggcuccccuaugauugaccugagcucucccgucgggggauccuacaaccucccgagccugccugauaucgacuguucuuccacaaucaugcuugauaauauugugcggaaagacaccaacaucgaucauggccaacccagaccucccagcaaucgcaccguucagucuccgaacagcuccgugccuagccccgggcuggcgggaccugucacaaugaccucugugcacccucccauucggucccccagcgccuccucugugggcagcagaggcuccucugggagcuccucuaagccggcuggagccgacagcacacacaagguucccgucgugaugcucgagccuauccgcauuaaacaggaaaauuccgggcccccugagaacuacgauuuccccguggucaucgugaagcaggagagcgacgaagagucucggccucaaaacgcuaauuauccgagauccauucugacgagccugcuucucaacucuucccagagcucuaccuccgaagagacaguucugcgcagcgaugcccccgacuccaccggggaucagccuggacugcaucaggacaauagcucuaacggcaaaagcgaauggcucgaccccucccaaaagucuccucugcacgugggggagacacggaaagaggaugaccccaaugaagauuggugcgccgucugccagaacggcggagagcuucuguguugcgaaaagugcccgaagguguuucaucucagcugucacguuccuacccugacgaauuuccccuccggcgaguggaucugcaccuuuuguagagaccugucuaaacccgaaguggaguacgauugcgacgcuccuagccacaacuccgagaagaaaaagacagaagggcuugucaaacucacccccaucgauaagcggaaaugugagcgccugcuucucuuccuguauugccaugaaaugucucuugcguuucaggacccugugccgcugacaguucccgauuacuauaagauuaucaagaauccuauggaccucagcaccauuaaaaagagacugcaggaggauuacuccauguauagcaaacccgaagacuucguggccgauuuucggcugaucuuccaaaacugugcugaguuuaaugagccugacucugaagucgccaacgccggaauuaagcuggagaauuacuucgaggaacuccugaaaaaccuguaccccgagaagagauucccgaagccugaauuucgcaaugaguccgaagacaacaaauucagcgaugacucugaugacgauuuugugcagccccggaagaaaagacucaaguccaucgaggaacgccagcugcuuaaauga

SEQ ID NO: 77260 - RNA, 1893 nt, Artificial Sequence
  derived and/or modified sequence opt5 from TRIM25__Homo_sapiens__NP_005073
auggccgagcugugcccccucgcugaagaacugagcuguuccaucugccuugaaccuuucaaggagccggugaccacacccuguggccacaacuuuugcgggucuugucugaaugaaacgugggccguccagggaagcccuuaccucugcccccaauguagagcgguuuaucaggcucggccucagcugcauaaaaacaccgugcuuugcaauguggucgagcaguuccugcaagccgaccucgcccgcgagcccccugcugauguguggacaccgcccgccagagcuuccgccccuucucccaacgcgcagguugccugugaccacugccugaaggaagcugccgugaaaaccugucuggucugcauggcuagcuuuugccaggagcaucuccagccucacuucgauucccccgccuuucaagaccauccgcugcagccucccgugcgggaucuucugcgcagaaaguguucucagcacaaucggcuccgcgaguucuuuugcccugagcacagcgaguguauuugccauaucugucugguugaacacaaaacaugcucccccgcgagccuuucucaggccuccgcugaccuggaggccacccucagacauaagcugacagugauguacagccaaauuaacggcgcuucucgggcccuggaugacguccgcaauagacagcaggaugugcggaugaccgccaaccgcaagguggaacaacuccagcaggaguauacggaaaugaaagcucugcuugacgcguccgagaccacaagcaccagaaagaucaaagaggaagagaagcgggucaauucuaaauucgauacaauuuaccagauccugcucaagaagaaauccgaaauccaaacccugaaggaggaaauugagcagagccuuacgaaacgcgacgaguuugaguuccuggaaaaggccuccaaacucagagggaucucuacaaagcccguuuauauuccugaaguggagcugaaccacaaacugaucaagggcauucaccagagcaccaucgaucucaagaaugaacugaaacaguguauuggacggcuucaagagccgacacccuccagcggggacccuggagagcaugaccccgcuucuacccacaaguccaccagaccugugaaaaaggucagcaaagaagagaagaagucuaaaaagcccccgccugugcccgcccugccuagcaaacuccccacauuuggcgccccugaacagcugguugaucuuaagcaggcuggccuggaggccgcggcuaaagccacguccucucaucccaacagcaccucccucaaggccaaggugcuggagacauuccuggcuaaaagccgcccggaacuccuggaguacuauaucaaggucauccuugacuacaauaccgcccacaacaaaguggcucugucugaaugcuacacaguugccuccguggcggagaugccucagaauuaucggccccauccccaaagauuuaccuacuguagccagguccucgggcugcacugcuauaagaaaggcauucacuacugggaaguggagcugcagaagaacaacuucuguggagucgggaucugcuauggaucuaugaaucgccagggcccugagucccggcuugggagaaacagcgccuccuggugcguggaaugguucaauacgaagauuucugcuuggcauaacaauguugagaaaacacucccgagcaccaaggccacccgcgugggaguccugcugaacugugaucacggcuuugugaucuucuuugcuguugccgacaaagugcaucucauguacaaguuccgggucgauuuuacagaagcgcuguaucccgccuucuggguguuuuccgcuggcgccacccuuucuauuugcagcccuaaauga

SEQ ID NO: 77261 - RNA, 1620 nt, Artificial Sequence
  derived and/or modified sequence opt5 from TRIM26__Homo_sapiens__XP_005249435
auggccaccagcgcuccccugagaucccucgaggaagaggugacaugcucuaucugucuggacuaccuucgggauccugucacgauugacugcggccacguuuucugucgcagcugcaccacagaugugagaccgaucuccgggucucggcccguguguccucugugcaagaaacccuuuaagaaagaaaacauucgcccugucuggcagcucgccagccugguggagaauaucgaaagacuuaagguugacaaaggacggcaacccggcgaggugacccgcgagcagcaggaugcgaagcugugugaaagacaucgggagaagcuccacuauuacugcgaagacgaugggaaacugcugugugucaugugccgcgaguccagagagcaucggccucacacagcugugcucauggaaaaggccgcccagccgcaucgcgagaaaauucugaaccaccuuucuacccugagacgggaccgcgauaagauccaaggauuccaggcuaaaggcgaagccgacauccucgcugcccugaagaaacuucaggaucagagacaauauauuguugcggaguuugaacaggggcaccaguuccugcgggagagagaggaacaucuccuggagcagcuggccaaacucgaacaagagcugacagaaggacgcgagaaguuuaaaagccggggcgugggcgagcuugcuagacuggcccucgucaucuccgaacuggaggggaaggcucagcagcccgccgcggaacuuaugcaagacacccgcgauuuccugaaucgguacccuagaaagaaguuuugggugggaaaacccauugcccgcguggucaagaagaaaacgggcgaguucagcgacaagcuccugucucugcagcgggggcucagagaauuucagggaaaacugcuucgcgaccuggaguauaagaccguuuccgugacacucgauccucagagcgcuucuggcuaccugcaacuuuccgaggacuggaaaugugugaccuauacaagccuguacaagucugccuaccuccacccccagcaguucgauugcgaaccggggguccugggauccaagggcuuuaccuggggcaaaguguauugggagguugaaguggagcgggagggguggagcgaagacgaggaagagggagaugaagaggaggaaggcgaggaagaggaagaggaggaagaggcuggguacggagacggcuaugaugacugggaaacggaugaggacgaagagucccugggggaugaggaagaggaagaggaggaagaggaagaggaaguccucgagucuugcauggugggaguugccagagacagcgugaagcgcaaaggcgaccugucccuucggccugaggauggcgucugggcccugagacucucuagcuccgggaucugggcuaacacaagccccgaagcggagcuguucccugcccugcggccccgcagagugggaauugcucuugacuacgaaggcgggaccgucacauuuaccaaugccgagucucaggaacucaucuauaccuucacagccacguucacccggagacuggugcccuuucuguggcucaaguggccuggaacacgccugcuucugcggccguga

SEQ ID NO: 77262 - RNA, 1542 nt, Artificial Sequence
  derived and/or modified sequence opt5 from TRIM27__Homo_sapiens__NP_006501
auggccagcggcuccguggccgagugccugcagcaagaaaccacaugucccgucugccuccaguacuucgccgagccuaugaugcuggacugugggcacaacaucugcugugcgugccuugcuagauguuggggaacggccgaaaccaauguuucuugcccgcagugucgggagacauuuccccagcgccauaugagaccuaaccggcaccuggccaaugugacccaacucgugaagcagcugcgcacagaaagacccagcggcccugggggagagaugggcgucugcgagaaacaucgggaaccccuuaagcuguauugugaggaagaucagaugccuauuugcgugguuugcgaccgcuccagagagcaccgggggcauucugugcucccgcuggaggaagcugucgagggauucaaagaacagauccaaaaccagcuggaucaccucaagcgcgugaaagaccugaagaagagacggcgcgcccagggcgagcaggcuagagccgaacuucugagccucacccaaauggagcgggagaaaauuguuugggaauuugagcagcuguaccacucccuuaaggaacaugaguaucgccugcucgcgagacuggaagaacuggaucucgccaucuacaauucuauuaacggcgcuaucacacaguucagcuguaauaucucccaccugagcucucuuauugcccaacuggaggaaaaacagcagcagcccacccgggagcuccugcaagacaucggggauacgcuuuccagagcugaacgcauucggaucccugagcccuggauuaccccucccgaccugcaggaaaagauccauauuuuugcccagaaaugccucuuccugacagagagccugaagcaguuuaccgagaagaugcaaucugauauggagaaaauccaggagcucagagaagcgcagcuguauuccguggacgucacacuugauccggacaccgccuacccuagccugauccucucugauaaccugcgccaggugcgguauuccuaccuucaacaggaccugcccgacaauccugagagauucaaccucuuucccugugugcugggaagccccugcuucauugcuggccgccacuacugggaggucgaaguuggggauaaggccaaauggacgaucggagugugugaggacuccgugugccggaagggcggggucacaucugcuccucagaauggauuuugggccgugagccugugguauggcaaagaauacugggcccucaccuccccgaugacagcucugccccuuagaaccccucugcagcgcguuggcauuuuccucgauuaugacgcgggggaggugagcuuuuacaacgucaccgaacggugucacacauucacguucucucaugccaccuuuugcggacccgugagaccuuauuucucccugagcuacucuggcggaaagagcgcugcuccccugaucauuuguccgauguccgggaucgauggcuuuucugggcacguuggaaaucauggccacagcauggagacauccccuuga

SEQ ID NO: 77263 - RNA, 2508 nt, Artificial Sequence
  derived and/or modified sequence opt5 from TRIM28__Homo_sapiens__NP_005753
auggccgcuagcgccgcggcugccuccgccgcugccgcuucugccgcgagcggcucccccgggccuggagagggcucugccgggggagaaaagagaagcaccgcuccguccgccgcugccucugcgagcgccuccgcugccgcuagcucucccgccggcgggggagccgaggcucuggaacuccuggagcacugcggcgugugucgggaacgccuuagaccugagcgggagccccgccugcucccuugccugcauuccgcguguagcgccugccuuggccccgcugccccugccgcugccaacucuuccggggacggaggcgcggcuggggauggaacagucguugacuguccggugugcaaacagcaauguuucagcaaggauaucguggaaaauuacuuuaugagagacucuggcuccaaagccgccacggaugcucaggacgccaaccagugcuguaccagcugcgaggauaaugcucccgccacauccuauugugucgaaugcucugagccucugugcgagaccuguguggaagcgcaccagcggguuaaguacacaaaagaccauaccgugcgcagcacagggcccgccaaguccagagauggagagcggaccgucuauugcaacgugcacaagcaugaaccucucguucuguucugugagagcugcgacacgcugaccugucgcgauugccaacucaaugcucacaaagaccaccaguaccaguuucuggaagaugccgugagaaaccagcggaaacuucuggcuucucucgucaagcgccugggcgacaagcaugccacacuucaaaaauccaccaaggaggugagaagcucuauucgccaggugagcgacguccagaagcggguucagguggaugugaaaauggcgauccugcaaauuaugaaggagcucaauaaaagaggccggguccuggugaacgacgcccagaagguuacagaagggcagcaagagagacuggaacgccagcacuggaccaugacgaaaauccagaagcaucaggagcacauucuccgguucgcuuccugggcccuggaaucugauaauaacacagcccuucugcucagcaaaaagcugaucuauuuucaacuucacagagcucugaagaugaucguggaccccgucgagccgcauggagagaugaaauuccagugggaucucaaugccuggaccaaguccgcugaagcguuuggcaaaauuguggccgagcgcccugggacaaacagcaccggacccgcuccuauggccccuccccgggcccccggcccgcugucuaagcagggguccggaagcucucagcccauggaaguucaagagggcuacggcuucggguccggagacgauccuuauagcuccgcugaaccccacgugucuggcgucaaaagaagccgcuccggggagggagaggugucuggccugaugcggaaggucccuagagugagccucgaacgccuggaccuugaucugaccgccgacucccagcccccgguuuuuaagguguucccugggagcacaacggaggauuacaaucucaucgucauugaacggggcgcggcugccgccgcuaccggacagcccggcacagccccugcggggacccccggagcuccuccccuggccggcauggccaucgugaaagaggaggaaacagaggcugccauuggggcuccgccuaccgccacggaaggacccgagacaaagcccguucuuauggcgcuggccgaaggcccuggggcugagggcccgagacucgccucucccuccggaagcaccucuuccggccuggagguggucgcuccugaagggaccagcgcccccggaggcgggccuggaacacuggacgacucugccaccaucugucgcgugugccagaaacccggcgaucucgugauguguaaccaaugcgaguuuuguuuccaucuggacugccaccuuccugcucugcaggauguucccggggaagaguggagcugcucccucugucauguccugccggaccugaaggaagaggauggcagccuuucucucgacggagcggauuccacaggcgugguggccaaacugagcccugcuaaucagcggaagugcgagagaguccugcucgcccuguuuugucacgaacccugccggccucuucaccagcuggccacggacuccaccuucucucucgaucaacccgggggaacacuggaccugacccuuauucgcgcuagacuccaggagaagcugagcccgccuuacuccucuccccaggaguucgcccaagaugugggccggauguuuaaacaguucaacaagcugacagaagacaaagcggauguucagagcaucaucgggcuccagagauuuuucgaaacccgcaugaacgaggcuuuuggagacacgaaguucuccgccgugcuggucgagccuccucccaugucucuucccggcgccgggcugagcucccaagaacucagcggcggaccgggcgacgggcccuga

SEQ ID NO: 77264 - RNA, 1767 nt, Artificial Sequence
  derived and/or modified sequence opt5 from TRIM29__Homo_sapiens__NP_036233
auggaggccgcugacgccagcagauccaacggcucuagccccgaagcgcgggaugcucgcuccccuucugggccgagcggaucccuggagaauggcaccaaggccgacgggaaagaugccaagacaacgaacggacacggcggggaagcugccgagggaaaaucucucggcagcgcucugaagcccggcgaagggagauccgcccuuuucgcgggaaaugaguggcggcgcccuaucauucaguuuguggagagcggcgacgauaaaaacucuaauuacuucuccauggacagcauggaagggaagagaucucccuaugccggacugcaacucggcgcugccaagaaaccucccgucaccuuugcugagaagggggaacugcggaaauccaucuucagcgagucucgcaagccuacaguuuccauuauggagccgggagaaaccagacggaacagcuacccccgcgccgauacaggccucuuuuccagaucuaaaagcggcuccgaggaagugcugugcgacagcuguaucgggaauaagcagaaggcggugaaaucuugccucgucugucaggccuccuucugcgagcugcaucugaagccucaccucgaaggagcugccuuucgggaucaucagcugcuugagcccauucgcgacuucgaggcuagaaaauguccugugcacggcaagaccauggaacuguuuugccaaacagaucagaccuguaucugcuaucucuguauguuccaggagcauaaaaaccacagcacgguuaccguggaagaggccaaggccgaaaaagagacagagcugucucuucagaaggaacaacugcagcucaagaucauugagaucgaagacgaggcugaaaaauggcagaaggagaaagaucggauuaagagcuuuaccacaaaugagaaagcgauccuggaacagaacuuccgcgaccuggucagagaccucgagaagcaaaaggaagaggugcgggccgcucuggagcagagagaacaggaugccguugaccaagugaaagucauuauggaugcccuugacgagcgcgcuaaggugcugcacgaagauaaacagacccgggagcagcuccauuccaucucugacagcgugcuguuucuucaggaguucggggcccugauguccaauuacagccuucccccgccucugcccacguaucacguccugcucgaaggagagggccuggggcaaucucuuggaaacuucaaggaugaccugcucaauguuugcaugagacauguggagaaaauguguaaggcggaucugucccgcaacuuuauugaacggaaucacauggaaaacggcggcgaccacagauacgugaacaauuauacaaacagcuucgggggagaguggucugcuccugauaccaugaagcgcuacuccauguaccuuacacccaaaggcgggguccggaccagcuaucagcccuccucuccuggaagauuuaccaaggaaacaacgcagaaaaauuucaacaaucuguacggcaccaaggggaacuauacaagccgcgugugggaguacuccucuagcauccagaauagcgacaacgaccucccgguugugcaaggcuccucuuccuuuagccugaaaggauaucccucucugaugcggucccagagcccuaaggcccagccccagaccuggaagucuggcaaacaaacaaugcucagccauuacagaccuuucuaugucaauaaggggaacggaaucggcuccaaugaggcccccuga

SEQ ID NO: 77265 - RNA, 2235 nt, Artificial Sequence
  derived and/or modified sequence opt5 from TRIM2__Homo_sapiens__NP_001123539
auggccagcgagggcaccaacauccccuccccuguggucagacagauugacaagcaauuccugaucugcucuauuugucucgaacgguacaaaaauccgaagguucugcccugccuucacacauuuugugagcgcugccugcagaacuauaucccugcucauagccucacgcuguccugucccgugugcagacagaccucuauucuuccugaaaaagggguggccgcgcugcagaauaacuucuuuaucacaaaucucauggauguccugcaacggacccccggaagcaacgcugaggaauccucuauccuggagacagugaccgccguugccgcuggcaagccucucagcuguccgaaucacgacgggaacgugauggaguucuacugccaguccugugaaacagccaugugccgcgaguguaccgaaggagagcaugcugagcaccccacggucccucugaaagaugugguugaacagcauaaggccagccuucaggugcaacuggacgcggucaauaagagacuccccgagauugauucugcccugcaguuuaucuccgaaauuauccaccagcuuaccaaccagaaagcuagcauuguggacgauauccacucuacauucgacgagcugcaaaagacccucaaugugcggaaauccguccugcugauggaacucgagguuaacuauggccugaagcauaaagugcuucagagccagcuggauacacuccugcaagggcaggagucuauuaaguccugcagcaauuuuaccgcccaggcucuuaaccacggaacggaaacagaggugcugcucgucaagaaacagauguccgaaaagcugaaugagcuggccgaccaagauuucccucuccauccccgcgaaaacgaccagcuggauuuuaucguggagaccgagggccuuaaaaagucuauccacaaccugggcacaauucucaccaccaaugcgguugccagcgaaacaguggcuacgggggagggacugagacagaccaucauuggccagccgauguccgucacaaucaccacaaaagacaaggacggggaacuuugcaaaaccggaaacgccuaccugacggcugagcucagcacaccugauggcucuguggccgacggggaaauucuggauaauaagaacggaaccuaugaguuccuguacaccguucaaaaggagggcgacuuuacacucucccugcggcuuuaugaucagcacauccgcggcagccccuucaaacugaaggugaucagaucugccgacgucagcccuaccacagaaggggugaaacggcgcgucaagucccccggaucuggccaugugaaacagaaggcuguuaagagacccgcgagcauguacuccacggggaaacggaaggagaauccuauugaagaugaccucaucuuucgcgugggaaccaaaggcagaaacaagggggaguucacaaaucugcagggagucgccgcuagcaccaacggcaaaauucugaucgccgauucuaauaaccaaugugugcagauuuucuccaaugacggccaguuuaagagccgguucgggaucagaggacgcucuccgggccagcuucaacggcccacagggguugccgugcacccuuccggagauaucauuaucgcugacuacgacaacaagugggucagcaucuuuuccucugauggcaaauucaagaccaaaauugggagcggcaagcucaugggacccaaaggcguguccguggacagaaaugggcauauuaucguugucgauaacaaggccugcuguguguuuauuuuccagccuaauggaaagaucgugacgcgcuuuggcucucgggggaacggagacagacaguucgcgggcccccacuuugcugccgucaacagcaauaacgagaucauuaucaccgauuuccauaaucacuccgugaaaguuuuuaaccaagaaggggaguucaugcugaaguuuggcagcaauggagaaggcaacgggcaguucaaugccccgacaggaguggcugucgacucuaacggcaauauuaucguggccgauugggggaacucccgcauucagguuuucgacggaagcggcucuuuucuguccuauaucaauaccagcgcugauccucucuacgggccccagggccuggcccuuacaucugacggacacguggucguggcggauagcggcaaccauugcuucaaaguuuaucgguaccugcaauga

SEQ ID NO: 77266 - RNA, 1278 nt, Artificial Sequence
  derived and/or modified sequence opt5 from TRIM31__Homo_sapiens__NP_008959
auggccagcggccaguucgugaacaagcugcaagaggaagucaucugccccauuugucucgacauccugcagaaaccuguuaccauugauugcgggcacaauuuuugucuuaagugcaucacacagauuggagagacguccuguggcuucuuuaaaugcccgcuguguaagaccucugugcggaaaaacgcuaucagauucaauagccuccugcgcaaccuuguggaaaagauccaggcccugcaagcguccgagguccagucuaagagaaaagaagcuacaugcccccggcaucaggagauguuucacuacuucugugaggacgaugggaaguuucucugcuucgugugucgcgaaagcaaagaccauaagucccacaauguuucucugauugaggaagccgcccagaacuaucaaggacagauccaggagcagauucaagugcugcagcagaaagagaaggaaaccguccaagugaaggcucagggcguucauagaguggaugucuuuacagaccagguggagcacgaaaaacagcggauccucaccgaguucgaacugcuucaccaagugcuggaggaggaaaagaauuuucuccugagccgcauuuacuggcuugggcaugagggaacagaagccggcaaacacuaugucgcuuccaccgagccucagcugaacgaucucaagaaacugguugacagccugaagacgaaacagaauaugcccccuagacagcuccuggaagauaucaagguggugcuuugccggucugaggaguuccaauuucugaaccccaccccugucccgcucgaacuggagaagaaacuuuccgaagccaagagccgccaugacucuauuacaggcucccugaaaaaguucaaagaucagcuccaggcggacagaaagaaggaugagaaucgguucuuuaaaagcaugaacaagaaugacaugaaaucuugggggcugcugcagaagaacaaucacaaaaugaacaagaccuccgaacccggaagcuccucugccggcgggcgcacaaccagcggaccucccaaccaccauuccagcgcuccuucucacucccucuucagagccagcucugcuggcaaggugacguuucccguuugccugcuugccagcuacgacgagaucuccgggcaaggagcgucuagccaggauacaaaaaccuucgacguggcccuguccgaggaacuccaugcugcccugagcgaguggcuuacagcuauccgggccugguuuugugaagucccgucuuccuga

SEQ ID NO: 77267 - RNA, 1962 nt, Artificial Sequence
  derived and/or modified sequence opt5 from TRIM32__Homo_sapiens__XP_011516700
auggccgcugccgcggcuagccaccugaaccucgacgcccugagagaggugcuugaaugccccaucuguauggaguccuucaccgaagaacagcugcggccuaagcuccugcauugcggccacacaauuugucgccaaugccuugaaaaacugcucgccucuagcaucaauggggucagauguccguuuugcuccaagauuacgcggaucaccucucugacacagcugaccgauaaccucacaguucugaaaauuaucgacaccgcuggacuuagcgaggccgugggccugcucaugugucgcuccugcgggagacggcugccccgccaguucuguagaucuugcggacuugugcugugugagccuugccgggaagcugaucaucagcccccuggccacugcacacuccccgucaaggaggccgcggaagaacgcagacgggacuuuggggagaaacugacccgccugagagaacucaugggagagcugcaacggcgcaaggccgcucuugaaggcgugagcaaggaucugcaggccagauacaaagcuguucuccaggaguauggccaugaggagcggagagugcaggacgagcuggcccgcucccggaaguucuuuacggggagccuugcggaagucgagaaaucuaauucccaagugguugaggagcagagcuaccugcucaacaucgccgaagugcaggcugucucuagaugugauuauuuccuggccaagauuaaacaggcugacguggcccugcucgaggagaccgccgaugaagaggaaccugagcugacagcuucccuuccgcgcgaacugacccuccaagacguggagcugcuuaaggucggacacguuggcccccugcagaucgggcaggcggugaagaaaccucggacagugaaugucgaggauagcugggccauggaagcuaccgccucugccgcuuccacgagcgugacauuuagagagauggacaugucccccgaagagguuguggccucuccucgcgcgagccccgcuaagcaacggggaccggaggccgccuccaacauucagcagugccucuuccugaaaaagaugggcgcuaaagggagcaccccuggaauguuuaaucugcccgucucucucuacgugacaucccagggcgaaguucugguggccgauagaggcaacuaucgcauccaagucuucacccggaagggguuucuuaaagagauuagacgcagcccuucuggaaucgacagcuucgugcuguccuuucucggcgcugaccugcccaaucugacaccccuuucugucgccaugaacugucaggggcucauuggagugaccgauagcuacgacaauucccugaagguuuauacgcuggauggccacugcguggcgugucaucggagccagcucucuaagccuugggggaucaccgcccugccguccggacaguucgucgugacagacguugaaggcggcaaacuuuggugcuucaccguggauagagggagcggagucgugaaguacucuugucugugcuccgcugugcggcccaaauuuguuacaugugacgccgagggcaccgucuacuucacgcaagggcucggacugaaccuggaaaaucgccagaacgagcaccaucuugagggcggguuuagcaucggcuccgugggaccugauggccagcucgggagacagauuucucacuucuuuagcgaaaaugaggacuuccggugcaucgcuggaauguguguggaugccagaggcgaccugauugucgcggauuccucucgcaaggaaauccugcacuuucccaaagggggaggcuauagcgugcucauucgggaggggcugacaugcccuguuggcaucgcccuuacccccaagggacaacugcucgugcuggacugcugggaccauuguaucaagauuuacuccuaucaccugagacgcuacagcaccccguga

SEQ ID NO: 77268 - RNA, 1467 nt, Artificial Sequence
  derived and/or modified sequence opt5 from TRIM34__Homo_sapiens__NP_067629
auggccagcaagauccugcucaacgugcaggaggaaguuaccugccccauuugucuggagcuucugacagaaccucucucccuggacugcggccacucucuuuguagagcuugcaucacggucagcaauaaagaggccgugaccuccaugggagggaagucuagcuguccggugugcggcauuuccuacucuuucgaacaucugcaagcgaaccagcaccucgcuaauaucgucgagcggcugaaagaggugaagcugagccccgauaacgggaaaaagcgcgaccucugugaucaucacggagaaaagcugcuucuguuuugcaaagaggacagaaagguuauuuguuggcucugcgaacggucccaggagcaucgcggccaccacacagugcugaccgaggaagucuucaaagagugucaggaaaaacuucaagccgugcugaagagacucaagaaggaggaagaggaggccgaaaaacuggaggcugauauccgggaagagaagacaagcuggaaauaucagguucagaccgaacgccagagaauccaaacagaguuugaccagcugcggucuauucucaauaacgaggaacagcgcgagcugcagagacuugaagaggaagagaagaaaacccuggauaaguucgccgaggcugaagacgagcucgugcaacagaaacagcugguccgggaacuuaucuccgauguggagugccgcagccaauggucuacgauggagcugcuccaggacauguccgggauuaugaaguggagcgaaaucuggagacugaagaaaccuaagauggugucuaaaaagcugaaaaccgucuuucaugcccccgaucucucccggaugcugcagauguuccgcgagcuuacagcgguuagaugcuacuggguggacgugacccugaauagcgucaaccucaaucugaaccuugugcuguccgaagaucagcggcaaguuauuucugugccuaucuggcccuuucaguguuauaauuacggaguccucggcagccaguauuucuccagcggcaagcacuacugggagguggacguuucuaagaaaacagccuggauucuggggguguauugcagaaccuacucccgccauaugaaguacgucgugcggagaugugcuaaccgccagaaucuguauacgaaauaccggccucucuuuggauauugggucaucggccugcaaaacaagugcaaauacgggguguucgaagagagccuuucuagcgacccggagguucugacacucuccauggccgugcccccuuguagagucggaguguuucuggauuaugaagcuggcaucguuucuuucuuuaaugugaccagccacgggucccugauuuacaaguucagcaagugcuguuucucucagcccgucuauccuuacuuuaaccccuggaacugcccggccccuaugacacuuugucccccuuccagcuga

SEQ ID NO: 77269 - RNA, 1482 nt, Artificial Sequence
  derived and/or modified sequence opt5 from TRIM35__Homo_sapiens__NP_741983
auggagagaagccccgacguguccccuggcccgucucggagcuucaaggaagaacugcucugcgccgucuguuacgaucccuuucgcgacgcuguuacccugagaugcgggcacaacuucugucggggaugcgugucccgcuguugggaagugcaggucucuccuacaugccccguguguaaagauagagccagcccugcggaccuucggacgaaucauacccugaacaaucucguugagaagcugcuucgcgaagaggcugagggcgccagauggacauccuaucgguuuucucgcgugugcagacugcaccgggggcaacucagccuguucugucuggaagauaaagagcuccugugcuguuccugccaggccgacccccgccaucagggacacagaguccagccugugaaggauaccgcucaugacuuucgggccaaaugccgcaacauggaacacgcucuuagagagaaggccaaggcguucugggccaugcggagaagcuacgaggcuaucgccaaacacaaucaaguugaagcugccuggcuggagggccgcauucggcaggaauuugauaagcucagagaguuccugcgcguggaggagcaggcgauccuugacgccauggcugaggaaacacggcagaaacaacugcucgccgaugagaagaugaaacagcugaccgaagagacagaaguccuggcucaugagauugagagacuccagauggaaaugaaggaggacgaugugucuuuucugaugaagcacaaaucccgcaagcggagacuuuucuguaccauggaaccggagcccgugcagccugggaugcugaucgacgucugcaaauaucucggaagccugcaauaccgcguuuggaagaaaaugcuugccucuguggaauccgugcccuuuagcuucgacccuaacacggccgcuggcuggcugucugucuccgaugaccucaccagcgugacaaaucauggcuaucggguucagguggagaaccccgagagauuuuccucugcgccgugucugcuggggagccgcgucuucucccagggaagccacgccugggaaguggcucucggcgggcugcaaucuuggcggguuggaguggucagagugcggcaggauuccggcgccgaggggcacagccauucuugcuaccacgacacccgcagcggauucugguaugucuguagaacacagggcguggaaggcgaucauugcguuaccuccgacccugccacgucuccccuugugcuggcuauuccucggagacuccgcgucgagcuggagugugaagagggggaacuuagcuuuuacgaugccgagcggcacugccaucuguacacauuccacgcgagauuuggagaagugcgccccuauuucuaccucggcggggcuagaggagccgggcccccugagccgcugcggaucuguccccugcacaucuccguuaaggaggaacucgacggcuga

SEQ ID NO: 77270 - RNA, 183 nt, Artificial Sequence
  derived and/or modified sequence opt5 from TRIM36__Homo_sapiens__NP_001017397
augagcgaguccggcgaaaugucugaguucggguacaucauggaacugauugccaagggaaaaaugcccgacuggagacggggcuaucgcugcagacagggguguggaaagaccacagagcucgcuacggccaccgauuuuagccaaacaggcaacaaauccgggaagcacuucaaaaccuga

SEQ ID NO: 77271 - RNA, 2895 nt, Artificial Sequence
  derived and/or modified sequence opt5 from TRIM37__Homo_sapiens__NP_056109
auggacgagcagagcguggaauccaucgccgaggucuucagaugcuuuauuuguauggaaaagcugcgggaugcucgccucugcccccacuguucuaaacugugcuguuucagcugcaucagacgguggcuuaccgagcaacgcgcccaguguccucauugcagagcgccgcugcagcuccgggaacugguuaacugucgcugggcugaggaggugacacagcaacuugacacgcugcagcucugcucccugaccaagcacgaagagaaugaaaaagauaagugugagaaccaucacgagaaacugucuguguuuugcuggacaugcaagaaguguauuugccaucagugugcccucuggggcgggaugcacggaggccacaccuucaaaccccuggccgaaaucuacgagcagcaugucacaaaggugaaugaagagguugcuaaacuuagacggcgccugauggaacucauuagccuggugcaagaggucgagagaaacguggaagccguucggaaugcuaaggacgagcgcgugagagaaauccggaacgccgucgagaugaugaucgcgcgccuugauacccagcugaaaaauaagcucauuacacugauggggcagaagaccucccugacgcaggaaaccgagcuccuggagucucuucugcaagaaguggagcaccagcucagaagcugcuccaaaagcgaacugaucucuaaguccagcgagauucuuaugauguuucagcaagugcaucggaaaccuauggccucuuucgucacaacccccguuccucccgacuuuacauccgaacuggugccuagcuaugauucugcuaccuucgugcucgagaacuuuuccacgcugagacagcgcgccgacccggucuacagcccuccccuccagguguccggacuguguuggcggcugaagguuuaucccgauggcaaugggguggucagaggauacuaucuuucuguguuccuggagcucagcgcuggccugccugaaacauccaaauacgaguaucgcguugaaauggugcaccagagcugcaacgaccccaccaagaauaucauucgggaguuugccucugauuucgaggucggcgaauguuggggguacaacagauuuuuccgccuugaccugcucgcgaaugagggauaccugaacccgcaaaaugauacagugauccugcgguuccaggucagauccccuaccuuuuuccagaaaagccgcgaccagcacugguauauuacccaacucgaagccgcucagacaucuuacauccagcagaucaacaaccugaaggagcggcuuacgauugaacugagcagaacccaaaagucccgcgaccucucucccccugauaaucaucugagcccccagaacgacgaugcccuggagacacgggcuaaaaaguccgccugcagcgacaugcuucucgagggcgggcccaccacagccucugugagagaagcuaaagaggaugaagaggacgaagagaagauccagaaugaggauuaucaccaugaacuguccgacggagaucuggaccucgaucugguuuacgaggacgaagugaaccagcuugacggcuccucuuccagcgcguccucuaccgccacgagcaauacagaggaaaacgauauugacgaggagaccauguccggggaaaaugaugucgaguauaacaauauggaacuggaggagggagaacucauggaggacgcugccgccgcuggcccugccggcucuagccacggguacgugggauccagcucucggaucucccgcagaacccaucuguguagcgcggcuacaucuucccugcuugauauugacccgcucauccugauccaucugcucgaucugaaagaccggagcucuauugaaaaccuuuggggccugcaacccagaccucccgccagccuccugcagccuaccgccuccuauagccgcaaggauaaggaccagcggaaacaacaggcuauguggagaguucccucugaucugaagaugcuuaaacgccucaagacacagauggccgaggugagaugcaugaaaacggacgucaagaauacccuguccgaaaucaagagcuccucugcugccagcggggauaugcagacaucccuguuuucugcggaccaagccgcucucgccgcuuguggaaccgagaacagcggccggcugcaggaccuugggauggagcugcucgccaaauccucuguggcgaauugcuacauucgcaacagcacaaauaagaaauccaacagcccgaagccugccagaucuuccguggcuggaagccugucucugcggcgcgccguugaucccggcgaaaacuccagaagcaaaggcgacugccagacccuuucugagggguccccuggaagcucccagagcggcucucggcacagcagcccccgcgcucucauccacgggucuauuggagauauccugccuaagacggaagacagacaauguaaggcccuggauagcgacgccgucgugguggcugucuucuccggccuccccgcgguggagaaacggcgcaagaugguuacccugggggccaaugcuaaaggcggacaccuugaaggccugcagaugacagaucucgagaacaauucugagaccggggaacugcagccggugcugccugagggagccagcgccgcucccgaagagggcauguccucugacagcgauaucgaaugcgacacagagaacgaggaacaggaggaacauaccuccgucgggggauuucacgauagcuucauggugaugacgcaacccccugacgaggauacacacucuuccuuuccggacggcgagcagauugggcccgaagaccuuagcuucaauaccgaugagaacucuggcagauga

SEQ ID NO: 77272 - RNA, 1398 nt, Artificial Sequence
  derived and/or modified sequence opt5 from TRIM38__Homo_sapiens__XP_005248857
auggccagcaccacauccacgaagaaaaugauggaggaagcuaccugcucuaucugucugagccucaugacaaaccccguguccauuaauugcggccacucuuacugucaucugugcaucaccgacuucuuuaagaacccuagccagaaacaacuuagacaggagacauucuguugcccgcagugucgggcccccuuucacauggauucccugcgcccuaauaagcagcucgggucucugauugaagcgcuuaaagagaccgaccaagaaaugagcugcgaggagcauggagaacaguuccaccuguuuugugaggaugaaggccagcucaucugcuggagaugugagcgggcuccccagcauaaggggcacacaaccgcccuggucgaggacguuugccaaggauauaaggaaaaacugcagaaggccgugacgaaacucaagcagcuggaggaucgcugcaccgaacagaaacuuuccacagcuaugagaauuaccaaguggaaggagaaagugcaaauccagcggcagaagauccgcagcgacuucaaaaaccugcaauguuuucuccacgaagaggagaagucuuaccuguggagacuugaaaaagaggaacagcagacacugucccggcuccgcgauuaugaggccggccuggggcugaaguccaaugaacucaaaucucauauucuggagcuugaggaaaagugccagggauccgcucaaaagcugcuccagaacgucaaugacacccugagcagaucuugggccgugaaacuugagacguccgaagcgguuagccuggagcuccacacaauguguaacguguccaagcuguacuucgaugucaaaaagaugcugcggucucaucaggugagcguuacccucgacccugauacagcccaccacgaacugauccuuuccgaggaccgcagacaggugacccggggcuauacccaagagaaucaggauacaagcucucgcagauuuacggcuuuccccugcguccugggcugugaaggguuuaccuccggacggagauacuucgagguggacgugggcgaagggacaggaugggaccucggcgucugcauggagaacguucagcgcgggaccggaaugaaacaggagccucaaagcggcuuuuggacacugcggcuuuguaagaagaaaggcuauguggcccugaccucuccgcccacgagccuccaucugcacgaacagccucugcucguggggauuuuccuggauuacgaggcuggagucguguccuucuacaauggcaacacagggugccauaucuuuaccuuccccaaggccucuuuuagcgacacccuuagaccuuauuuccagguuuaccaguauagcccccuguuucucccgccucccggagauuga

SEQ ID NO: 77273 - RNA, 1557 nt, Artificial Sequence
  derived and/or modified sequence opt5 from TRIM39__Homo_sapiens__NP_067076
auggccgagaccagccugcucgaagcuggcgccuccgcggcuucuacagccgccgcucuggagaaccuucagguggaagccagcugcuccgucugucuggaguaccucaaggaacccguuaucauugagugcgggcacaauuucuguaaggcuugcaucacgagauggugggaggaccuggaacgggauuuuccuuguccggugugccgcaagaccucuagauaucggagccuucgccccaacagacaacugggauccaugguggagauugccaaacagcuccaggcggucaagcggaaaauccgcgacgaaucucuguguccucagcaucacgaggcccugagccucuucugcuacgaggaucaagaagcugugugucugauuugcgccaucucccauacacacagagcucauaccguugugccccuugacgaugccacacaggaguauaaggaaaagcugcagaaaugucucgagccucuggaacagaaacuucaagagaucacccggugcaaaagcucugaggaaaagaaacccggcgagcugaagcgccucgucgaauccagacggcagcagauucugcgcgaguuugaagaacugcacagacggcucgacgaggaacagcaagugcugcuuagccgccuggaggaagaggaacaggauauccuccagagacugcgggagaaugcggcccaccuuggggacaagagacgcgaucuggcucaucucgccgcugagguugaaggaaaaugccugcaaucuggcuucgagaugcugaaggacgugaaauccacacucgaaaagaacauuccucggaaauuugggggaagccugucuaccaucuguccgagagaucacaaggcccuucugggccucgucaaagagauuaaucgcugcgagaaggugaagacgauggaagugaccuccgucagcaucgagcuggagaaaaacuucuccaauuuuccccggcaguacuucgcccuuagaaagauucugaaacagcucaucgcugacguuacacuggauccugagaccgcgcaucccaaccuggugcucucugaagaccgcaagagcgugaaauuugucgagacacggcugagagaccuuccugauacgccccgccgguucaccuuuuauccgugugugcuggccacagagggcuucaccuccgggagacacuacugggaaguugaggugggagacaagacacacugggcugucggcgugugccgcgauagcguuucucggaagggggaacucaccccucugcccgagaccggauauuggagagugcggcuguggaauggcgacaaauacgccgccacaacgaccccuuuuacaccccuucauaucaaggucaaacccaagcgcguggggauuuuccucgauuacgaagcuggaacccuguccuucuauaacgucacagacagaagccacaucuacaccuuuacggauacauucaccgagaaacuguggccucucuuuuauccgggcauucgggccggcagaaagaaugcggcuccccugaccauccgcccucccacagacugggaguga

SEQ ID NO: 77274 - RNA, 2235 nt, Artificial Sequence
  derived and/or modified sequence opt5 from TRIM3__Homo_sapiens__XP_011518146
auggccaagagagaggacagccccggcccugaagugcagccgauggauaaacaauuccuggucugcuccaucugucucgaccgguaccagugccccaagguucugccuugucuucacaccuuuugcgagcgcugucugcagaacuauauucccgcucagucucucacacugagcugcccuguguguagacaaacguccauccuucccgaacagggggugucugcccugcagaauaacuucuuuauuagcucccucauggaggcgaugcagcaagcuccugauggagcccaugacccggaagauccccacccucugucugucguggccggccggccccugagcugcccuaaucaugaggggaaaaccauggaguucuacugugaggcuugcgaaacagccauguguggagaaugccgcgcuggcgagcacagagagcaugggaccguucuccugcgggacguggucgaacagcacaaggccgcgcuucagcgccagcuggaggccgugagaggacggcucccccaacuguccgcugccaucgcucuuguuggcggcauuagccagcagcugcaagaacgcaaagccgaggcgcucgcccagaucucugcugccuuugaagaucuggagcaggcucugcagcaaagaaagcaggcccucguguccgaccuggagacaaucugcggggccaagcagaaaguccuucagagccaacuggauacccuccggcagggacaggaacacauugggucuuccuguagcuucgcugagcaggcgcugcgccuuggcucugccccggaagugcugcucgugagaaagcauaugcgggagcgccuggcugcccuggccgcucaagccuuuccugaaagaccccacgagaacgcgcagcucgagcugguccuugaaguugacggacugcggagauccgugcucaaucugggcgcccuucugacaaccagcgcuacggcccaugagaccguggcuacaggggaaggacuccgccaggcccuggucggccagccugcuucccugaccgugacaaccaaagauaaggacggccggcucguuagaacggggucugccgagcugcgcgcggaaaucacaggacccgauggcacccggcuucccgugccugucguggaccacaaaaacgggacauaugagcugguuuacaccgccagaaccgagggagaacuccugcugagcgugcuucucuauggccaaccgguccgcgggucccccuuccgggugagagcucugcgcccuggagaccugcccccuagccccgaugacgucaagcggagagugaagucuccgggcggcccugggucccacguucgccagaaagccgugcggagacccagcucuauguacagcacaggaggcaagcggaaagauaauccuauugaggacgaacucgucuuucgcgugggguccagaggacgggagaagggcgaguucacgaaccugcaggggguuucugcugccagcuccggcagaaucguggucgcggauagcaauaaccaaugcauucagguguuuucuaaugaaggacaguucaaauuucgcuucggcgugcgggggagaucccccggacagcuucaacgcccuaccggcguugccgucgacacaaacggggauaucauuguggcugacuaugauaauagaugggugagcaucuucucucccgagggaaaguuuaaaaccaagaucggcgccgggcggcugaugggcccgaagggagucgcuguggaccgcaacggccauauuaucguuguggauaauaaauccuguugcgucuucacauuucagccuaacgggaagcucgugggaagauucggcgggcggggagccaccgaccgccacuuugccggcccccauuucguugcugugaacaauaaaaacgaaauugucgugacggacuuucacaaucauagcguuaagguguacuccgcggauggggaguuccuguuuaaauucggcucucacggagaaggcaacgggcaguuuaaugcccccacaggagucgcuguggacagcaacggcaauaucauuguggccgauugggggaacuccagaauccaggucuucgacucuagcggauccuuucugagcuacaucaauaccucugccgagccucuuuauggcccgcaagggcucgcucugaccuccgauggccacguugugguggccgacgcgggaaaccauuguuucaaggcuuaccgguaucugcaguga

SEQ ID NO: 77275 - RNA, 777 nt, Artificial Sequence
  derived and/or modified sequence opt5 from TRIM40__Homo_sapiens__NP_001273562
augaucccccugcagaaggacaaccaagaggaaggcgugugcccuauuugucaggagagccucaaagaagccgucuccaccaauugcgggcaccuguucuguagaguuugccuuacacagcauguggagaaggcuucugccagcggaguguuuuguugcccgcugugucggaaacccugcuccgaagagguccucggcacgggguacaucuguccuaaccaccagaagcgcgugugcagauucugugaggaaucucggcugcuucugugcguugagugccucgugagccccgaacauaugucccaccaugagcugaccauugagaaugcgcugucucacuauaaagaacgccucaacagacggagccgcaagcugagaaaggauaucgcugagcuucaacggcugaaagcccagcaggaaaagaaacuccaggcccugcaauuucaggucgaccacggaaaucaucgccuugaggcuggcccugaaucccagcaccagacaagagagcaacugggggcccucccccagcaguggcugggacaacuggagcauaugccugcugaagccgcgcggauucucgauaucagccgcgccgugacccagcugagaucucuuguuaucgaccuggagcggacagcuaaggaacucgauaccaacacacugaaaaaugccggcgaccuucugaaccgcuccgcuccgcagaagcucgaggugauuuacccccagcuggaaaagggcgucagcgagcugcuccugcaaccuccccagaaacuuuga

SEQ ID NO: 77276 - RNA, 2172 nt, Artificial Sequence
  derived and/or modified sequence opt5 from TRIM42__Homo_sapiens__NP_689829
auggagaccgccaugugcguguguugccccuguugcacauggcagagauguugcccucaacuguguagcugccucuguugcaaguucaucuuuacguccgaacggaacuguaccugcuucccgugccccuacaaagacgagcgcaauugucaguuuugccacuguacaugcucugaaagcccuaacugucauuggugcuguugcuccugggcuaaugaucccaacuguaagugcuguugcaccgccucuagcaaucugaacugcuauuacuaugaguccagauguugccggaauacaauuaucaccuuccacaaaggccgccuuagaucuauucauacaagcuccaagaccgcgcugcggacggggagcucugacacccaggucgaugaaguuaaauccaucccugcuaacagccaccucgugaaucaucugaacugucccaugugcucucgccuuagacugcacuccuuuaugcucccuuguaaucacagccugugcgagaagugucugcggcagcuccaaaagcaugccgaggugacagaaaacuucuuuauucugaucugcccggucugugaccgcucucacugcaugcccuacuccaauaaaaugcagcuuccugagaacuaucugcauggaagacucaccaagcgguacaugcaggaacacggcuaucugaaauggcgcuucgauagaagcuccgggcccauccuuugucaggugugccggaauaagcgcauugccuacaaaagaugcaucacaugucggcugaaccucugcaacgacugucugaaggcuuuucacucugauguugccaugcaagaccauguguucgucgauaccagcgcugaggagcaggacgaaaagauuugcauccaccauccuuccagcagaauuaucgaguacugucgcaaugauaacaaacugcucugcacguuuuguaaguucucuuuucacaauggacaugacacaauuucccugaucgaugccugcagcgaacgggcggccucucuuuucagcgcuaucgccaaauucaaggcugugagauaugagauugacaacgaccugauggaauuuaauauccucaaaaacuccuucaaggccgauaaagaggcgaagcgcaaggagauucggaauggcuuucugaaacuuagaucuauccugcaggaaaaggagaaaauuaucauggaacagaucgagaaccucgaaguuagccgccaaaaggagauugagaaauacguguaugucaccacaaugaaggugaaugaaauggacgggcugaucgccuacuccaaggaggcucugaaagaaaccggacagguggccuuccuccagagcgcuaagauucuggucgaucaaaucgaggacggcauucagaccacauaucggcccgauccgcagcuuagacugcacucuaucaacuacguuccucucgacuuuguggaacuguccagcgccauccacgagcuuuuccccacgggcccuaaaaaggugcggucuuccggggauagccugcccucccccuauccuguccauucugagaccaugauugcccgcaaagugacauuuagcacccacucccucggaaaucagcauaucuaccaaagaucuagcuccaugcugagcuucucuaacacagacaagaaggcuaaaguuggccuggaagcgugugggcgcgcccaguccgcuaccccggccaagcccacggauggacucuacacauauuggagcgccggcgcugacucucaguccgugcagaauagcucuagcuuucacaacugguacuccuucaaugaugggagcgucaaaaccccuggacccauugugaucuaucaaacccugguuuacccucgggccgcgaagguguauuggacaugccccgcugaggacgucgacucuuuugaaauggaguucuacgaggugauuaccuccccgccuaacaacguccagauggaacuuuguggccagaucagagauauuaugcagcaaaaucuggagcuccacaaccugacacccaauacggaauauguguuuaaaguucgggccaucaacgacaauggcccugggcaguggagcgauaucugcaagguggucacccccgacggacauggcaagaaccgcgccaaaugggggcugcuuaagaauauucaguccgcucuccagaaacacuucuga

SEQ ID NO: 77277 - RNA, 1035 nt, Artificial Sequence
  derived and/or modified sequence opt5 from TRIM44__Homo_sapiens__NP_060053
auggccagcggcgugggggcugccuucgaggaacugccccacgacggaaccugcgaugagugugaaccugacgaggcgccgggcgcugaagaggucugcagagaguguggguuuugcuacugucggcgccaugccgaagcccacagacagaaguuccucucccaucaccuggcugaguauguucauggaucucaagccuggacacccccugcugauggcgaaggggccggaaaagaggaggcggaagugaagguggagcaggaacgggagaucgaaagcgaggccggcgaggaauccgagucugaagaggaaagcgaguccgaggaagagucugaaacggaggaagagagcgaggacgaauccgaugaggaaagcgaggaggacucugaagaggaaauggaggaugaacaggaguccgaggcugaagaggacaaccaggaagagggcgaaagcgaggccgagggggaaaccgaggcugaaucugaguuugaucccgaaauugagauggaggccgaacgcgucgcgaaaagaaagugcccugaccacggacuugaucuguccacauacugucaagaggaccggcagcucaucugcgugcugugucccguuauuggcgcccaccaggggcaucagcuuagcacccuggaugaagccuucgaggagcuccgcucuaaagacuccggaggccugaaggcugcuaugaucgaacugguggagagacucaaguuuaaaagcuccgacccuaaggucacacgggaucaaaugaaaauguucauucagcaggaauuuaagaaagugcagaagguuaucgccgacgaggaacaaaaggcccugcaccuuguggauauccaggaggcuauggcgaccgcccaugucacagagauucuggcugacauccagucucacauggaucgccucaugacccaaauggcccaggccaaagaacagcuggacacgagcaaugaguccgcugaaccgaaggccgagggggaugaagagggacccagcggcgcgucugaggaagaggacaccuga

SEQ ID NO: 77278 - RNA, 1464 nt, Artificial Sequence
  derived and/or modified sequence opt5 from TRIM50__Homo_sapiens__NP_835226
auggccuggcaagugagccugcccgagcucgaagacagacugcagugcccuaucugucuugaggucuucaaggaaccgcugaugcuccagugcggccacuccuacuguaaagggugccugguuucucuuagcugucaucuggaugcugagcuccggugccccgugugucgccaggccguggacggauccucuagccugccuaacgucucccuggcgagagugauugaagcucuccggcugcccggcgauccugagcccaagguuugcgugcaccaucgcaauccucuuucucuguuuugugagaaagaccaggaacucaucugcgggcuguguggacuucugggcagccaccaacaucacccggucacccccguguccacaguuuauagcagaaugaaggaggaacucgccgcccugauuucugagcugaaacaggagcagaagaagguggaugaacucaucgcuaaacuggucaacaaucggacgcgcauugugaacgaguccgacguguucagcugggucaucagacgggaauuucaggagcuucaccaucugguugaugaagagaaggcccgcugccucgaggggaucggaggccacaccagaggccugguggcuucucuugacaugcaacuggaacaggcccaggggacacgggagcgccucgcgcaggccgaaugcgugcuggagcaauucggaaaugaagaucaucacaaauuuauuagaaaguuccacuccauggcuagccgggccgagaugccucaggcucgcccccuggagggcgccuuuucuccuaucuccuucaaacccgggcuccaucaggcggacauuaagcugaccgucuggaagagacuuuuucggaaagugcugccggccccugaaccccucaagcuggauccugcuacagcccacccccuucuggagcucagcaaaggaaacaccguugugcaauguggccugcuggcucagagacgcgccucccagcccgaacgguucgacuacucuacaugcguccucgccagcagaggguuuuccuguggacgccauuauugggaggugguugugggcagcaagucugauuggcggcugggcgucaucaaagggaccgcuuccagaaagggaaaacuuaaucgcagcccugaacacggcguguggcugauugggcucaaggagggacgggucuacgaggcguucgccugcccgagagugccccugccuguugcuggccauccccaccgcaucgggcuguaucuucacuacgaacagggagagcucacguuuuucgacgccgaccggccugaugaccugagaccccuguauaccuuccaagccgauuuucagggcaagcucuacccgauucuggacacauguuggcaugaacgcggcucuaacagccuuccuauggugcugcccccucccuccgggccuggaccccucucuccggagcagccuaccaaacuguga

SEQ ID NO: 77279 - RNA, 2268 nt, Artificial Sequence
  derived and/or modified sequence opt5 from TRIM56__Homo_sapiens__NP_112223
auggugagccacggcuccucucccagccugcucgaggcccuguccucugacuuccuugcuugcaagaucugucuggaacagcucagagccccuaaaacccugccgugccuucauacauacugucaagauugccuggcgcagcucgcugacgggggacggguccgcugucccgagugcagagaaacgguuccugugcccccugagggcguggccagcuuuaagaccaacuucuuugucaaugggcugcuggaucucgugaaagcccgggcuuguggagaccugcgcgccggcaagcccgcuugcgcccuuuguccucugguugggggaacauccaccggcggcccggcgacagccagaugccucgauugugcugacgaucugugccaggccugcgcugacgggcaccgguguacccgccagacacauacccacagaguggucgaucuugugggauaucgggccggcugguacgacgaagaggcgcgcgagagacaagccgcucagugcccccagcauccuggggaagcccugcgguuccucugucagcccugcucucaacugcugugucgcgagugcagacucgauccucaccuggaccaccccugucuuccgcuggcugaagccguucgggcccgcagaccuggacucgagggccugcuugcugggguggauaacaaucuggucgagcucgaagcggcccggagaguggagaaagaagcucuggcccgccugcgggagcaggccgcuagagugggaacgcaggucgaagaggccgcggagggcguucuccgcgcucugcuugcccagaagcaagaagugcugggccagcuccgggcccauguggaggcugccgaagaggcugccagagaacgccuggcggagcuugaggggcgggaacaggucgccagagcugccgcugccuuugcgcgccgggugcugagccucggaagagaggccgaaauucugucccuggagggcgcuaucgcccaacgccuccggcagcugcaggggugccccugggcuccuggacccgcccccugucuucugccucagcucgaacugcacccgggccugcuugacaagaacugccaucuccugagacugagcuucgaggagcaacagccccagaaagacgggggaaaggauggcgccggcacccaagggggagaagagucucagucccggcgcgaagacgagccuaaaacagagagacagggcgggguucagccccaggcuggagauggcgcgcaaaccccuaaggaagagaaagcccagacaacccgggaagagggggcucagacgcucgaagaggacagagcccagacaccccacgaggauggcggaccgcaaccucaccgcggcgggcggcccaauaagaagaaaaaguuuaaaggaagacuuaagagcauuucucgcgaaccuucccccgcccugggcccuaaccuggacgggagcggacuccugcccagaccgaucuucuauuguucuuuuccuacccggaugcccggcgauaaacgcucccccagaauuacagggcugugcccuuucggcccgcgggagauccuuguggcugacgaacagaaucgcgcccucaagagauuuagccugaacggagauuacaaaggcaccguccccgugccugaggggugcucccccuguucuguugcggcucugcagagcgccguggccuucuccgcuagcgcccggcucuaucugaucaauccuaacggagaaguccaauggcgcagagcgcuuucucugucccaggcuagccaugccguggccgcucuccccucuggcgaccgggucgccgugagcguugcugggcacguggaggucuacaauauggagggaucccuggccacccgcuuuauuccuggcgggaaggcgucuagaggccugcgggcccuuguguuccucacaacgagcccccagggacauuucguuggcuccgauuggcagcaaaacagcguggucaucugcgacgggcugggacagguggugggcgaauauaaggggccgggacugcacggcugucagccugggucuguuuccgucgacaaaaagggcuacauuuuucucacccugagagaggugaauaaaguggucauccuugaucccaagggaagccugcucggcgacuuccugacagcuuaccaugggcuggaaaaaccucgcgugaccacaaugguugauggacgguaucuuguggucucucucuccaacggcaccauucacaucuuuagagugcgcagccccgacuccuga

SEQ ID NO: 77280 - RNA, 1461 nt, Artificial Sequence
  derived and/or modified sequence opt5 from TRIM58__Homo_sapiens__NP_056246
auggccugggcucccccuggcgagagacugcgggaagacgcccgcugcccggugugucucgauuuccugcaggagcccgucagcguugacugcgggcacuccuuuugucuuagaugcaucucugaguucugugagaaaagcgauggagcgcaaggcgggguguacgcuugcccucagugucggggacccuuucgcccuuccggcuucagacccaaccggcagcuggccgggcucguggaaucuguccgcagacugggacuuggcgccggcccuggggcucggcgcugcgccagacauggagaggaccugagccgguuuugugaggaagaugaggcugcccucugcugggugugugacgcgggcccggaacaccgcacccauagaacagcuccccugcaggaggccgccggguccuaucaaguuaaacugcagauggcucucgagcugaugcggaaggaacuugaggaugcccugacgcaggaagcgaaugugggaaagaagaccgucauuuggaaagagaagguggaaaugcagcgccaaagauuccggcucgaguuugagaagcacagaggcuuccuggcccaggaagaacagcgccagcuucggagacuggaagcugaggaacgcgccacacuccaacggcugagagagucuaaaagccgccugguucagcaguccaaggcucucaaagagcuggccgacgaacuucaagagcggugccagagaccugcccuggggcuccuggaaggagugcgcggcguccuuagccggucuaaggcugugaccagacuggaggcggaaaacauccccauggagcucaaaacagccugcuguauuccuggccgccgggagcugcugagaaaguuucagguggaugucaagcucgaccccgcuaccgcccauccgucccugcuucugacagccgaucuccggagcguucaggacggggaaccuuggcgcgaugugcccaauaacccugagagauucgacaccuggcccugcauccugggacuucaaucuuuuuccagcggccggcacuacugggaagugcuggucggggagggagcugaguggggccucggggugugucaggacacgcugcccagaaaaggagaaaccacaccuucuccggagaauggcguuugggcccuguggcuccugaagggcaacgaauauauggugcuugcgucccccagcgucccucugcuccagcuggagucuccccgcugcauugggaucuuccuggauuacgaagcuggagagaucuccuuuuauaaugugaccgacggcagcuacauuuauacauucaaccagcuuuucuccgggcuccugcggccuuacuuuuucaucugugaugccacgccccugauucucccgccuaccacaaucgccggaagcggcaauugggcuucuagagaccaccuggaucccgccuccgacguucgcgaugaccaucuuuga

SEQ ID NO: 77281 - RNA, 1212 nt, Artificial Sequence
  derived and/or modified sequence opt5 from TRIM59__Homo_sapiens__NP_775107
augcacaacuucgaggaagaacugaccugccccaucuguuacagcauuuuugaagacccuagagugcucccgugcucccauacauucugucggaauugccuggagaacauccuucaggccucuggcaauuuuuauauuuggcgcccccugagaaucccucucaagugucccaacugccggagcauuacggaaaucgcuccuaccgggaucgagucccugcccgucaauuucgcccuucgcgcgauuaucgagaaauaccaacaggaagaucacccugacauuguuacauguccggagcauuauagacagccccugaacguguacugccuccuggauaagaaacugguguguggacacugccucaccaucggccagcaucacgggcacccuauugacgaucugcaaucugcuuaucuuaaggaaaaagacacaccccagaagcugcucgagcagcugaccgauacacauuggaccgaccuuacgcaccugaucgagaagcucaaagaacagaagucccauuccgagaaaaugauucaaggagauaaggaagccguccugcaguacuuuaaagagcugaaugacacccucgaacagaagaagaaaucuuuccugacagcccuuugugaugugggcaaccugaucaaucaggaguauaccccucaaaucgagcggaugaaggaaauucgcgagcagcagcucgaacugauggcucuuacaaucagccugcaagaggaaagcccccucaaauuucuggagaagguugacgaugugagacagcacguccagauucugaaacagcggccgcucccugaggugcaacccguugaaaucuacccucgcgugagcaagauucugaaagaggaauggucuagaaccgagaucgggcagaucaagaacguccuuauucccaagaugaaaaucucccccaagcggaugagcugcucuuggccuggaaaagacgaaaaggagguggaguuccugaaaauucucaauaucguggucguuacgcugauuuccgugauccuuaugagcauccuguuuuucaaccagcacauuaucacauuucucucugaaauuacccugaucugguucuccgaggccagccuguccguguaccagucucucagcaauucccugcauaaggucaagaacauucuuugccacaucuuuuaucugcucaaagaguucguguggaagauuguuagccauuga

SEQ ID NO: 77282 - RNA, 1482 nt, Artificial Sequence
  derived and/or modified sequence opt5 from TRIM5__Homo_sapiens__NP_149023
auggccagcggcauccuggugaacgucaaggaggaaguuaccugccccauuugucucgagcugcuuacacagccucugucccucgacugcgggcacucuuucugucaggcuugccugacggccaaucauaaaaagagcaugcuugauaaaggagaauccucuuguccggugugcagaaucagcuaccaacccgagaacauucggccuaaucgccacguggcgaacaucgucgaaaagcugagagaggugaaacucucccccgagggccagaagguugaccauugugcucggcacggggaaaagcugcugcucuuuugccaggaggauggaaaagugauuuguuggcugugcgaacgcucucaagagcauagaggccaccacaccuuccuuacagaggaagucgcccgggaguaucaggugaagcugcaggccgcucucgaaaugcugcgccagaaacaacaggaggccgaagaacuugaggcugacaucagagaagagaaggccagcuggaaaacccagauccaguacgauaagacaaauguucuggcggacuuugaacaacuccgggauauucuggacugggaggaauccaacgagcugcagaaucucgagaaggaagaggaagauauccugaaaagccuuaccaacucugagacagaaauggugcagcaaacccagucccugcgcgagcucauuagcgaccuggagcauagacuucaggggucugucauggaacugcuccagggaguggauggcgugaucaagcggacggagaaugucacccugaaaaagccugaaacauuccccaaaaaccaacgcagaguuuuucgggccccugaccugaagggcaugcucgagguguuccgcgagcugaccgaugugagacgguauugggucgacgugacaguugcuccgaauaacauuuccugugccgugaucagcgaagacaaaagacaggucucuucccccaagccucagauuaucuacggggcucgcggaacccgguaucagacguuugugaauuucaacuacugcacaggcauccuugggagccaauccauuaccucuggaaagcacuauugggagguugaugugagcaaaaagacagccuggauccugggcgucugcgcgggguuucagcccgacgccauguguaauauugagaaaaacgagaacuaccagccuaaguacggauauugggugaucggccucgaagagggcgucaaaugcuccgcuuuccaggauagcucuuuucauacccccuccgugccguucauuguuccucugagcgugaucaucugucccgacagagucgggguguuucuugauuacgaggccugcaccguuucuuucuucaauauuacaaaccacggauuucugaucuauaaguucagccacuguuccuuuucucaaccuguguuccccuaccucaauccccgcaagugcggcgucccuaugacgcuguguagcccguccagcuga

SEQ ID NO: 77283 - RNA, 1065 nt, Artificial Sequence
  derived and/or modified sequence opt5 from TRIM62__Homo_sapiens__XP_011540007
augcccgagaagaccgccguggaccagccuuggacacaagcucugagagaacucaaagaucagcugcaggcccuucaggacagcgagcgggaacacacggaggcgcugcaacuccugaagcgccagcuugcugaaaccaaauccucuacaaagagccugagaaccacaaucggcgaggccuucgagcggcuccaucgccugcugagagaacggcagaaagccaugcucgaggaacuggaggcugauaccgcccgcacacuuaccgacauugagcagaagguccaaagauacucccagcagcugcggaagguucaggaaggggcucaaauccuccaggagcgccuggccgaaacggauagacacaccuuucuugcgggaguggccucucugagcgagcggcucaaaggcaagauucaugaaacaaaccugaccuaugaggacuucccgacauccaaauacaccgggccccugcaguauacgaucuggaagucucucuuucaagauauucacccugugcccgcugcccugacacuugacccuggaaccgcucaucagcgccugauccucagcgaugacugcacaaucgucgccuacggcaaucugcacccccagccucuucaggauuccccgaaaagauucgacguggagguuagcgugcuggggucugaagcguuuuccagcggaguccacuauugggaggugguuguggccgaaaagacccaaugggucauuggccucgcucaugaggccgcuucucggaagggcuccauccagauucagcccagccgcggguucuacuguaucgugaugcacgauggaaaccaguauucugccugcaccgaaccuuggacaagacugaaugugcgggacaaacuggacaaggucggcguuuuucucgauuacgaccaagggcugcuuauuuucuacaacgccgaugacauguccuggcuguauacguuuagagagaaauuccccggaaagcucuguagcuacuuuuccccuggccagucucaugcuaaugggaaaaacgugcagccccugcgcaucaauaccgugcggauuuga

SEQ ID NO: 77284 - RNA, 3651 nt, Artificial Sequence
  derived and/or modified sequence opt5 from TRIM66__Homo_sapiens__NP_055633
auggccagaaacugcagcgaguguaaggaaaaacgggcugcccacauccugugcaccuacuguaaucgcuggcucugcuccucuuguacagaggaacauagacacagccccgugccuggcgggccguucuuuccccgggcgcagaagggauccccuggcgucaacgggggacccggcgacuucacgcuguauugcccucuucauacccaagagguucugaaacucuuuugugaaacaugcgauaugcugaccugucacucuugccuugugguggagcauaaggagcaccgcuguagacacgucgaagaggugcugcagaaucagcggaugcuccuggaagggguuacaacccagguggcucauaaaaagagcucccugcaaacaucugccaagcagauugaggaccgcaucuucgaggucaaacaccagcauagaaagguggaaaaccagauuaaaauggccaagaugguucucaugaaugagcugaacaaacaagcuaauggacuuaucgaggaacuggaaggcauuaccaacgagcggaagcgcaagcucgagcagcagcugcagagcaucauggugcuuaauagacaauuugaacacguccagaacuucaucaauugggccgugugcuccaaaacgagcgugcccuuucuguucucuaaggagcucauugucuuucagaugcaacggcugcuggaaaccuccugcaacacagauccuggcagcccguggucuauccgcuucaccugggagcccaauuuuuggacaaaacagcucgcuucccugggguguauuaccacggaaggaggccagaugagcagagccgacgcgccugccuacgggggacuucaggggucuucccccuucuaucaaagccaccaguccccuguugcucagcaggaggcccugucucaucccagccacaaguuucaauccccggcugugugcuccucuuccguguguugcagccauuguucuccugucagccccucccucaaaggccaggugccuccucccucuauccaccccgcccauagcuuccggcagccgcccgagaugguuccucagcaacugggaucccuucagugcagcgcgcugcucccccgcgaaaaggagcuggccuguucuccucaucccccgaaacugcuccagccuuggcuggaaacacagcccccuguggagcaagaauccaccagccagagacuuggccagcaacugacaucucagcccgucugcauugugccuccccaggauguucagcaaggcgcucacgcccagccgacccuccagaccccuuccauccaggugcaauucgggcaccaccagaagcugaaacuuagccauuuucagcagcaaccccagcagcaacugcccccuccgcccccuccccucccucaucccccucccccgcugccucccccuccccagcagccgcacccuccccugccucccucccagcaccucgcuucuagccaacacgaguccccucccggaccggccuguucucagaacauggacauuaugcaucacaaguucgagcuggaagagaugcagaaggaucuugaacugcuccugcaggcccaacagcccagccugcagcuuucccagacaaaaagcccucaacaucuccagcagacgaucgucggccagaucaauuacauugugcggcaacccgcuccuguccagucucagucccaagaggagacccugcaggcgacagacgaacccccugccagccaggggucuaagccggcucugccccucgauaaaaacaccgccgccgcucugccucaggccuccggagaggaaacaccccuuagcgugccucccguugacucuaccauccaacacagcuccccgaacguggucagaaagcacagcacgucucuguccauuaugggcuuuagcaauacacucgagauggaacuguccucuacccgccuggagcggccucuugagccccagauccagagcguguccaaccucaccgcgggggcuccccaggccguuccuucucugcugagcgcucccccuaagaugguguccucucucacaagcguccaaaaucaggccaugccgucccugaccacaagccaucuucagacggugcccucucuggugcacuccaccuuccagagcaugccuaaccucauuucugauagcccccaagccauggcuagccuggccucugaccauccucaggcgggacccucccugaugagcggccacacacaggccguuccgucccuugcuaccugcccucuccaaagcauucccccugucucugauaugcagcccgaaacaggcagcuccucuagcuccgggagaaccucuggaagccuguguccucgcgacggcgccgaccccucccuggagaaugcucucugcaaagugaagcuggaggaaccgaucaaccuuucugugaaaaagccuccccuggcccccgucgugagcacguccaccgcgcuccagcaguaucaaaauccuaaagaaugcgagaacuuugagcagggggcccuggaacuggaugcuaaggagaaucagagcauccgggccuucaacucugaacauaagaucccguacguuagacuugagcgccucaaaauuugugcugccuccagcggagaaaugcccguguuuaagcugaaaccucagaagaaugaccaagauggcucuuuccugcucaucauugagugcgggacagaguccagcuccaugucuaucaaagucagccaggaccggcuguccgaagccacccaggcucccggccuugagggaagaaaggugacaguuaccagccuggcgggccagcgcccucccgaaguggaggggacgucuccugaggaacaccggcucaucccgagaacacccggagccaagaaaggcccucccgcuccuauugagaacgaagauuuuugugccgucugccugaaugggggagagcugcuuuguugcgaccgcugucccaagguguuccaccuguccugccauguuccggcccuccugagcuuuccuggcggggaauggguguguacccucugccggucucugacacaacccgagauggaguaugauugugaaaacgcuugcuacaaucagcccggcaugagagccagcccuggacuuuccauguacgaccagaaaaagugcgagaaacugguccucucucuguguugcaacaaccugagccuucccuuccacgaaccuguguccccgcuggcgcggcauuauuaccagaucauuaagcgccccauggaucucucuaucauuagacggaaacugcaaaagaaggacccugcucacuauaccacccccgaggaaguggucagcgauguuagacucauguuuuggaauugugccaaauucaacuacccugacuccgagguggccgaggcuggccgcugccuggaaguguucuuugagggguggcuuaaggaaaucuaucccgagaaacgguucgcccagccgagacaggaagacagcgauucugaggaggucuccagcgaauccggauguucuacaccucaaggcuuucccuggccucccuacaugcaggaggggauucagccuaagcgcagacggcgccacauggaaaaugagagagcgaaacggaugagcuuccgccuggcuaacuccaucucucagguguga

SEQ ID NO: 77285 - RNA, 789 nt, Artificial Sequence
  derived and/or modified sequence opt5 from TRIM68__Homo_sapiens__NP_001291425
augcagaagcuggagcucaaccacagcgaacugauccaacagucccaggugcuuuggagaaugauugccgagcugaaagaacggucucagcgccccgucagauggaugcuccaagacauccaggagguucugaaucggagcaaguccuggucucuucagcagccugaaccgauuagccuggagcucaaaaccgauugccgcgugcugggccugagagagauccucaagacauacgcugccgacgugcggcuggaucccgacacggcguauucccgccuuauugucucugaagauagaaaacgggugcauuacggggacaccaaccaaaagcugccugauaaucccgagcgcuucuauagauacaacaucguucucggaagccaguguaucuccagcggccggcacuauugggaaguggaggucggggaccgcucugaguggggacugggcgugugcaagcagaauguugauagaaaagaaguggucuaccuuuccccucauuauggguuuugggugauucggcugcgcaagggaaacgaguacagagcuggcacagacgaauaccccauccucagccugccugugccgccccggagagucggcauuuucguugauuaugaggcccacgacaucucuuuuuacaaugugaccgauugugggucccauauuuucacauuuccucgcuaucccuucccuggacggcugcuccccuacuuuagcccgugcuauucuaucggcaccaacaauacagccccucuggcuauuuguucccuugacggggaagacuga

SEQ ID NO: 77286 - RNA, 891 nt, Artificial Sequence
  derived and/or modified sequence opt5 from TRIM69__Homo_sapiens__NP_001288073
auggaguuccugaagcuccaccaguuucugcauagcaaagaaaaggacauccuuaccgagcugagagaagagggcaaagcccucaacgaagagauggagcugaaucuuucccaacugcaggaacagugccuccuggcuaaggauaugcuggugucuauucaggccaaaacagagcaacagaacagcuucgacuuucucaaggauaucacgacccugcuucacucccuggaacaggggaugaagguccucgcgacacgggagcugauuucucgcaaacuuaaucugggacaguacaagggccccauccaauauaugguuuggagagagaugcaggacacccucuguccugggcugagcccgcugacacucgaucccaaaaccgcucauccuaaccuggugcuuuccaagucucagacaagcguguggcacggagacauuaaaaagaucaugcccgaugacccugaacgguucgauuccagcgucgccgugcugggcucucgcggguuuaccuccggaaagugguacugggagguugaaguggccaaaaagacgaaauggaccgucggcgugguuagagagagcaucauucggaagggcucuugcccccucacaccugaacagggguucuggcugcuucgccugagaaaucaaaccgaccucaaagcucuggaucugccguccuuuagccucacacugaccaacaaucuugacaaggugggaaucuaucuggauuacgagggcgggcagcucucuuucuauaacgccaaaacgaugacacauauuuacaccuuuuccaauacauucauggagaagcuguaucccuacuuuuguccuugccuuaacgacggaggcgaaaauaaggagccccugcacauccuccacccucaguga

SEQ ID NO: 77287 - RNA, 2529 nt, Artificial Sequence
  derived and/or modified sequence opt5 from TRIM6-TRIM34__Homo_sapiens__NP_001003819
augugcggcagcgagagaauccugcaggccgggaacauucucgaaauccgggugggacaagcuggcgcccgcagagucgcgaccaugacaucccccguucugguggacauucgggaggaagugacguguccuaucugccuugagcugcucaccgaaccgcugucuauugauugugggcacagcuucugccaggcuuguaucacacccaauggacgcgaguccgucaucggccaggagggggaaagaucuugcccugugugucagaccagcuaccaacccggaaaccuucggccuaaucgccaucuggccaacauuguuagacggcuccgcgaggugguccugggccccggcaagcagcugaaagccgugcucugcgcugaccacggggaaaagcugcagcuuuucugucaggaggauggaaaaguuaucugcuggcugugugagagaucccaagaacaucggggccaccauacauuccucguggaggaagucgcccaggaguaucaggaaaaguuucaggagucucugaaaaagcugaagaaugaggaacaagaggcugaaaaacuuaccgccuucauucgcgagaagaaaacaagcuggaagaaccagauggaaccugagagaugccggauccagaccgaguuuaaucaacuccgcaacauucuggacagaguggaacagcgggagcugaaaaagcucgaacaggaggaaaagaaagggcugagaaucauugaggaggcggaaaaugaucuugugcaccagacgcaaucccugcgcgagcucaucagcgaccuggaacggagaugccagggaucuaccauggagcuucugcaggaugucuccgacguuacagagcgcagcgaauuuuggacccuccggaagccggaggcccugcccacaaaacugagaucuauguuucgcgcuccugaucucaagcggaugcugagagugugucgcgaacuuaccgacgugcaguccuacugggccauccaaggcagccugacgcggagagagcgccgggcuucuggggucagaacacggcgcucccagggaagcuccgccauggcgucuaaaauucuccugaacgugcaggaagagguuaccugccccaucugucuugagcugcucacagaaccucugagccuggauugcggccacucccucuguagagccugcauuaccgugagcaauaaggaggcugucaccucuaugggcgggaaauccagcugucccgugugcggaaucucuuauagcuucgaacaucugcaggccaaccaacaccuugcuaauauuguugagcggcugaaggaagugaagcucuccccggacaacggcaaaaagagagaucugugugaccaucacggggagaaacugcuucucuuuugcaaggaggaccgcaaagucaucuguuggcugugcgaacggucucaggagcacagaggacaucacacagugcugacggaagaggucuucaaggaaugccaggagaagcuccaggccgugcugaaacgccuuaagaaagaggaagaggaagccgagaagcuggaggcugauaucagagaagagaaaaccagcuggaaguaccaaguucagacagaacggcagcgcauucaaaccgaguuugaccagcucagauccauccugaauaacgaggaacagcgggagcugcagcgccuugaagaggaagagaagaaaacacucgauaaguucgcggaagccgaggacgagcuggugcaacagaaacagcuggucagagaacucauuagcgauguggagugucggucucagugguccaccauggaacugcuucaagacaugagcggcaucaugaaguggucugagauuuggcgccugaaaaagccuaagaugguuuccaaaaagcucaaaacgguguuucaugcucccgaucugagcagaaugcugcagauguuccgggaacuuacagccguccgcugcuauuggguggacgugacccucaacuccguuaaucugaaccugaaucucguccugucugaggaucagagacaggugaucagcgugccuaucuggcccuuccaauguuacaacuaugggguccuuggaucccaguacuuuucuagcggcaagcacuacugggagguggacguuuccaaaaagaccgccuggauucugggcguguauugccggacauacagcagacauaugaaauaugucgugcgccggugugcuaauagacagaaccucuacaccaaguaucgcccccuguucggguacuggguuaucggacugcaaaauaagugcaaauauggcguguuugaagagucucuuuccagcgauccugaaguccucacacugucuauggccgugccgcccugucggguugggguguuccuggacuacgaggcgggaauugucuccuuuuucaacgugacgagccacggcucucucaucuacaaguuuagcaaaugcuguuucucccagccuguguaucccuacuuuaauccuuggaacugccccgcuccgaugacccuguguccucccagcucuuga

SEQ ID NO: 77288 - RNA, 2607 nt, Artificial Sequence
  derived and/or modified sequence opt5 from TRIM71__Homo_sapiens__NP_001034200
auggccagcuuccccgagaccgacuuucagaucugccugcucuguaaggaaaugugcggcuccccugcuccgcugucuagcaacuccucugccagcuccucuagcucccaaacaagcacgucuuccgggggaggcgggggaggccccggggcggcugccagacggcuucacgugcugccuugucuccaugccuucugccgccccugucuggaggcucacagacuuccugccgcuggaggcggcgccgcgggggaaccccugaaacuccggugcccugucugugaucagaagguugugcuggccgaggcugccggaauggacgcucugccgagcucugccuuucuccuguccaaucuucuggaugcgguggucgccaccgcugacgaacccccucccaaaaacggccgcgccggggcuccugccggagccggcgggcauagcaaucacagacaucacgcucaccaugcgcacccccgggccucugcuuccgccccgccucucccccaggccccucagccucccgcucccagccgcuccgccccgggaggccccgcggcuucuccuagcgcccugcuucugagacggccccauggcugcuccagcugugaugaggggaacgccgcuucuucccgcugccucgacugucaagagcaccugugcgauaauugcgugagagcccaccagcggguucgccugacaaaggaccauuacauugaaagaggaccucccggcccgggggcugccgcggccgcucagcagcucggacugggcccucccuucccugggcccccuuuuagcauccuuucuguguuccccgagcggcugggauuuugucaacaccaugaugacgaaguccuccaccuguauugcgauaccuguagcgugccgauuugccgcgaguguacaaugggcagacauggcgggcacuccuucaucuaccuucaggaggcccugcaggacucucgggcucucaccauucagcugcuggccgaugcgcaacagggaagacaggccauccaacucagcaucgaacaggcucagacaguugccgaacagguggaaaugaaagcuaaggucgugcaauccgaggugaaggccgucaccgcccgccacaaaaaggcucuggaggagcgggagugcgaacuucuguggaaaguugagaagauuagacaggugaaagccaagagccucuaucuucagguggaaaagcugcgccagaaccugaauaaacucgagucuacgaucuccgcgguccaacaggugcuggaagagggccgggcucuggacauucuccuggccagagaccgcaugcuugcccagguucaggagcugaagaccgugcggagccuccugcaaccucaggaagaugacagagucauguuuacaccucccgaucaggcucuguaccuugccaucaaaucuuucggguuuguguccagcggagcguucgcuccccucaccaaggccacaggcgacgggcugaaacgcgcccugcagggcaagguugcuuccuuuaccgugauuggauaugaucaugacggcgagccgcggcucucugggggagaucugaugagcgccgucgugcuuggccccgacgggaaccuguucggagcggaagucuccgaucaacagaauggcacguacgugguuucuuauagaccucagcucgagggggaacaccuggugagcgucacacuguguaaccaacauaucgagaauagccccuucaaagugguuguuaagagcggccgcucuuacgucggaauuggccuuccugggcucuccuuuggaagcgagggcgacucugaugggaagcugugccggcccuggggaguguccguggacaaagaaggcuacaucaucguugcugacagaagcaacaaucggauucaggucuucaagccuuguggggccuuucaccacaaauucggcacccugggaucucgccccggccaguuugauagaccggccgggguggcuugcgacgccagccggagaaucguggucgcugauaaggacaaccaucgcauucagaucuucacauuugagggacaauuccuccugaaauuuggcgaaaaggggaccaagaauggacaguucaacuauccuugggauguggccguuaacuccgagggcaaaauucuugugagcgacacccggaaucacagaauccagcuguuugggcccgauggcgucuuccucaacaaguacggauuugagggcgcgcuguggaaacauuucgacucuccucgcgggguggccuucaaucacgaaggacaucugguugugacagauuuuaacaaucacagacuucucgucauccaccccgacugucaguccgcucgguuccugggcagcgaggggacgggaaacggccaauuucugcgcccgcagggcguggccguugaucaggaagggagaauuaucguggcugacucccggaaucaucgcguccagauguucgagucuaacggauccuuucucugcaaguucggcgcccaaggguccggauuuggccagauggauagaccuucugggauugccaucacccccgacggaaugauugugguggucgacuucggcaauaaccggauccugguguuuuga

SEQ ID NO: 77289 - RNA, 1434 nt, Artificial Sequence
  derived and/or modified sequence opt5 from TRIM72__Homo_sapiens__NP_001008275
augagcgccgcucccggccugcuccaccaggagcuguccugcccucuuugucugcaacucuucgacgccccggugaccgcggaaugcgggcauucuuuuuguagagcuugccugggacgggucgccggcgagcccgccgcugaugggacaguucuuuguccuugcugucaggcccccacgcgcccucaggcucugagcaccaaccuccagcuggccagacugguggaaggacucgcgcaagugccccagggccacugcgaggaacaucuggacccucuuuccaucuacugugagcaggaucgggcccuggucugcggggugugugcuucucucggaagccaccgcggccauagacugcuuccggccgcugaggcccacgcgcggcugaagacacagcucccccaacagaaacugcagcugcaggaagccugcaugcgcaaggagaaauccguugcugugcucgaacaccaacuggucgagguggaggaaaccguuagacaguuccggggcgccgugggggagcagcuuggaaagaugcgcgucuuucuggcugcccucgaaggcucucuggacagagaggccgaacgggugcgcggggaggcuggaguggcgcuuagacgggagcugggcagccucaauuccuaucuggaacaacugcgccagauggagaaaguccucgaagagguugccgauaagccucagacagaguuccugaugaaguacugccuugugaccagcagacugcagaaaauucucgcugaaucucccccucccgcccggcuggacauccaacuuccgauuaucuccgaugacuuuaaguuccagguguggagaaaaauguuucgcgcccugaugccugcucucgaggaacugacauucgaucccagcucugcccauccuucccuggucgugucuagcuccgggcggagaguugaguguagcgaacagaaggcgccucccgcuggagaggacccccgccaguuugauaaagccguggccgucguggcucaccaacagcucuccgaaggcgagcauuauugggagguugacgugggcgauaagccgcggugggcccugggggucauugcugccgaagcgcccagacgcggacggcuucacgccgugccuucucagggccuguggcuccuggggcugagagagggaaagauccuugaagcucacgucgaggccaaagagccccgcgcucuccggagcccugaaagacgccccacccggaucggccuguaccuguccuucggggacggagugcucagcuuuuaugacgccucugaugcggacgcccugguuccgcuuuucgcuuuucaugagagacugccucggcccguguacccuuucuucgaugucugcuggcacgacaagggcaaaaacgcccagccccuccugcuggugggcccugaaggggcugaggccuga

SEQ ID NO: 77290 - RNA, 753 nt, Artificial Sequence
  derived and/or modified sequence opt5 from TRIM73__Homo_sapiens__NP_944606
auggccuggcaagugagccugcucgagcuggaagacagacuucagugccccaucugucuggaggucuucaaggaaucccucaugcugcagugcggccacucuuacuguaaagggugccuuguuagccuguccuaucaucucgauaccaaggugcgguguccuaugugcuggcaaguggucgacggaucuagcucccugccgaacgugucucuggcuuggguuauugaggcccuccgccugcccggcgauccugaacccaaaguguguguccaccauagaaauccucuuagccuguuuugcgagaaggaccaggagcucaucugugggcugugcggacuucugggcucccaccagcaucaccccgugacaccuguuagcacgguguguucucggaugaaagaagaacucgcggcucuguucuccgaacugaagcaggagcagaagaaagucgaugagcucauugccaagcuggugaaaaaccgcaccagaaucgugaaugaaagcgacgucuuuucuuggguuauucggcgcgaguuccaggaacuuagacacccgguggaugaggaaaaggcccggugccuggaggggaucggaggccauacacgcggccucguggcuucccuggacaugcaacuugagcaggcccaggggaccagagaacggcuggcucaggccgagugcguccucgaacaauuuggaaacgaggaucaccaugaguucaucuggaaauuucacagcauggcgucucgcuga

SEQ ID NO: 77291 - RNA, 750 nt, Artificial Sequence
  derived and/or modified sequence opt5 from TRIM74__Homo_sapiens__XP_011514491
auggccuggcaagugagccugcucgagcuggaagacuggcuucagugccccaucugucuggaggucuucaaggaaucccucaugcugcagugcggccacucuuacuguaaagggugccuuguuagccuguccuaucaucucgauaccaaggugagauguccuaugugcuggcaaguggucgacggaucuagcucccugccgaacgugucucuggcuuggguuauugaggcccuccggcugcccggcgauccugaacccaaaguguguguccaccaucgcaauccucuuagccuguuuugcgagaaggaccaggagcucaucugugggcugugcggacuucugggcucccaccagcaucaccccgugacaccuguuagcacgguguguucuagaaugaaagaagaacucgcggcucuguucuccgaacugaagcaggagcagaagaaagucgaugagcucauugccaagcuggugaaaaaccggacccgcaucgugaaugaaagcgacgucuuuucuuggguuauuagacgggaguuccaggaacuucgccacccgguggaugaggaaaaggccagaugccuggaggggaucggaggccauacacggggccucguggcuucccuggacaugcaacuugagcaggcccaggggacccgcgaaagacuggcucaggccgagugcguccucgaacaauuuggaaacgaggaucaccaugaguucaucugguuucacagcauggcgucucgguga

SEQ ID NO: 77292 - RNA, 1656 nt, Artificial Sequence
  derived and/or modified sequence opt5 from TRIM8__Homo_sapiens__NP_112174
auggccgagaacuggaagaauugcuucgaagaggaacugaucugucccauuugccuccacguguuugucgagccuguucagcugccguguaaacauaacuucugcagaggcuguaucggggaggcuugggccaaggacagcggacuugugcggugccccgaauguaaucaagcguacaaccagaaaccuggccuggagaagaaucucaaacugaccaacauuguggaaaaguuuaaugcccuucacgucgagaagcccccugcugcccugcauugcguguucugucgcagagggcccccucucccggcucagaaaguuugccugcggugugaagcccccugcugccagucccacgugcaaacacaucugcagcagccuucuacggcucgcggacaccuccuggucgaggccgaugacgugagagcguggagcuguccccagcacaacgccuaucggcuuuaccauugcgaggcugaacaaguugccgugugucaguauugcuguuacuauuccggcgcucaccaggggcauucugucugcgauguggagauccgcagaaaugaaauucggaagaugcugaugaaacagcaagaccgccucgaggaaagagagcaggauaucgaggaccagcuguacaaacuugaaagcgauaagcggcugguggaggaaaaggucaaccaacucaaggaggaaguucgccugcaguaugagaaacugcaccagcuccuggacgaggaucuuagacagaccguggaagugcuggacaaggcccaagcgaaauuuuguuccgagaaugccgcucaggcccuccaccugggagaacggaugcaggaggcuaagaaacuucugggcucucuccagcugcuguucgauaagacagaagacgucagcuuuaugaaaaacaccaaguccgugaagauccucauggaucgcacacaaaccugcacaucuagcucccugagcccuaccaaaauuggccaucuuaauucuaagcuguuccucaacgagguugccaaaaaggagaaacagcugagaaagaugcuugaagggcccuuuuccacgccggugccuuuccugcagagcgucccccucuacccuuguggagugucuuccagcggcgccgagaagcggaaacacuccaccgcuuuucccgaagcgucuuuccuggagacaagcuccgggcccguuggaggccaguacggggccgcuggaaccgccagcggcgagggccaaucugggcagccucugggaccgugcuccagcacacagcaucucguggcccugcccggcggggcucagccuguccacucuagccccguguuuccucccucccaauauccgaauggaucugccgcgcagcagccuaugcuuccccaauacggcgggagaaagauccuggucuguagcguggacaacugcuauugcuccagcguugcuaaccauggaggccaccagccuuacccccgcucuggccacuucccuuggaccgugcccucccaggaauauagccauccgcucccucccacgcccucugucccucagucccugccgagccuggccgugcgggacuggcuugaugccucccaacagcccgggcaccaggacuucuacagaguuuauggacagccuucuacaaaacauuacgugaccagcuga

SEQ ID NO: 77293 - RNA, 2133 nt, Artificial Sequence
  derived and/or modified sequence opt5 from TRIM9__Homo_sapiens__NP_055978
auggaggaaauggaggaggaacugaagugccccguguguggcagcuucuacagagaaccuaucauucucccgugcucccacaaccugugucaggccugcgcucggaauauccuuguccaaacccccgagucugagagcccucagucccaucgcgccgcggggucuggaguuagcgacuaugauuaccuggaccucgauaaaaugucccuguauucugaagcugacagcggcuacggguccuauggaggcuuugccagcgcccccacaacgccuugucagaagucucccaacggggugagaguguucccuccggcuaugcccccucccgccacccaccuuuccccugcucuggcccccgucccgcggaauagcugcauuacauguccucagugccaucgcucucucauccuggaugacagaggacugcggggcuuucccaaaaaccgcgugcucgagggcguuauugauagauaccaacaguccaaggcggccgcucugaaaugucagcuuugcgaaaaggccccuaaggaggcuaccgugaugugugagcagugcgacgucuucuauugcgaucccugucggcugcgcugccaucccccuagagggccgcucgccaaacaccggcuggugcccccugcgcaaggacgcguuagcagacggcuuucuccccgcaagguguccacauguaccgaccacgaacuggagaaucacagcauguacugcguccaguguaaaaugccugugugcuaccagugucucgaagagggcaagcauuccucucacgaagugaaagcccugggggcuauguggaagcugcauaagagccagcucucccaagcccugaacggacuuagcgauagagcuaaagaggccaaggaguuucugguccagcuccggaauaugguucagcaaauccaggaaaacucuguggaguucgaagccugccugguggcucagugugacgcgcuuaucgaugcccugaauagacgcaaagcucagcuccuggcccgggucaacaaggagcacgaacacaaacugaaggugguuagagaccaaauuucccauugcacagugaaacuccgccagaccacgggccugauggaguauugucuugaggucaucaaggaaaaugaccccagcggguuucugcagauuucugaugcccucauccggagagugcaccugaccgaggaccaguggggaaagggcacacuuaccccgcgcaugacaaccgauuucgaccugagccucgauaacuccccucugcugcaaucuauucaucagcucgacuuuguucaggugaaagcuagcucccccgucccugccacgcccauccugcagcuugaagagugcugcacacacaauaacagcgcgacccugucuuggaagcaaccuccccucuccacagugccggcugauggcuacauucuggaacuggacgaugggaauggaggccaguuccgggaggucuauguggggaaagagaccauguguaccguugacggacuucauuuuaacagcacauacaacgccagagugaaggccuucaauaaaacgggcgucucuccuuauuccaagacccucgugcugcagacaagcgaaguugcuugguuugccuucgaucccggguccgcucacucugacaucauccugagcaacgacaaucucaccgugacaugcuccucuuacgaugaccgcgucgugcugggaaagaccggcuucagcaaaggcauucacuauugggagcuuacgguggaucgguacgacaaccaucccgauccugccuuugggguugcgagaauggacgucaugaaggaugugaugcugggaaaagacgauaaggccugggcuauguacguggacaauaaccgcuccugguucaugcacaauaacagccauacaaaucggaccgaaggcgggaucaccaaaggagccacaauuggcguccuccuggaucugaacagaaagaaucuuaccuuuuucaucaacgacgagcagcaagggccgauugcuuuugauaauguggagggccucuucuuucccgccguuucucugaaccggaaugugcaggucacacugcacacgggacucccugugcccgacuucuauuccagccgcgcgucuaucgccuga

SEQ ID NO: 77294 - RNA, 7098 nt, Artificial Sequence
  derived and/or modified sequence opt5 from TRIOBP__Homo_sapiens__NP_001034230
auggaggaagugcccggcgacgcccugugcgagcacuucgaagcuaacauccucacccagaaucggugccagaacugcuuucauccugaggaagcccacggggcccgguaccaggagcugcgcuccccguccggagcugagguccccuauugugaucuuccuagaugucccccugcccccgaagacccucugucugccagcaccuccggcugucagucuguuguggauccggggcuccggcccggaccuaagcgcggccccuccccuuccgcugggcugcccgaggaaggaccgacggccgcuccuagaucucggucccgcgagcuugaggccgugcccuaccuggaaggccucaccacaucccugugcggcagcuguaaugaggacccugggucugaucccaccuccagccccgacucugcgacaccugaugacaccuccaacuccucuuccgucgauugggacacaguggaaagacaggaggaagaggccccgagcugggaugagcuggcuguuaugauuccccggcgcccuagagaaggaccccgggccgacuccucucaacgcgcuccuagccuccugaccagaucccccgugggcggggaugccgcgggacagaaaaaggaggacacgggcgggggaggccggagcgccggccagcauugggcucgccuuagaggggaaucuggacugucccucgagcggcacagaagcacccugacacaggccucuagcaugaccccgcauuccggcccucgcucuacaaccagccaggcuucccccgcccagcgggacacggcccaggcugcgagcacaagagaaaucccucgcgccucuagcccccaccggauuacccagagagauacaagccgcgcuucuuccacccaacaggagaucagccgggccuccucuacccagcaagagacaagcagagccuccucuacgcaggaagacaccccucgcgcuagcuccacacaggaggauacaccccgggccagcucuacacaguggaauaccccgagagcguccagcccuucucgcuccacgcaacuugacaacccccggacaagcucuacccagcaggauaauccccagaccagcuucccuacaugcaccccgcaaagagaaaacccccggacaccuuguguccagcaggacgauccccgcgcuuccagcccuaauagaacgacccagcgggagaacucuagaacauccugcgcccaacgcgacaaucccaaagccagccggaccuccucuccuaacagagcuacacgcgauaaucccagaaccagcugugcccagcgggacaacccgcgcgcuuccucuccuagcagagccacgcgggauaaucccaccacauccugcgcgcagcgcgacaacccuagagccucucggaccagcucccccaaccgcgcuacaagagacaauccgcggaccagcugcgcccagcgcgauaacccuagagcuucuucccccagccgggccacgagagacaauccuacaaccucuugugcgcaacgcgauaacccccgggccuccagaacaagcucucccaaucgcgcuacccgggacaacccuagaaccuccugcgcccagcgcgauaauccgcgggcuagcucccccaacagagccgcccgcgacaauccuacaacgagcugugcucagcgggauaaccccagagcgucucggaccagcuccccuaaucgcgccacaagagacaacccccggaccucuugcgcucaacgcgauaauccuagagccagcuccccgaaccgggccacaagagacaaucccaccacgucuugugcucagcgcgauaacccucgggccagcagaacauccucucccaaccgcgcgacccgggacaauccuagaaccagcugcgcucagcgcgauaacccccgggccuccagcccgaauagaacaacccagcaagacucuccucgcacauccugugccagacgggacgauccccgcgcuagcucucccaacagaacgauucagcaggaaaauccucggaccuccugcgcccugcgcgacaaccccagagcgagcuccccuucucggacaauccagcaagagaauccgagaaccagcugugcucagcgcgaugacccccgggccuccagcccuaacagaacaacccagcaggagaauccccgcacgucuugcgcccggagagauaacccucgggcuuccagccgcaauagaaccauccaacgggacaacccccgcacaucuugugcccagagagauaauccgcgggcuagcuccccuaaccgcaccauucagcaagaaaaucucagaacaucuugcacccggcaggacaacccccgcacaagcuccccuaacagagccacccgggauaaucccagaacgucuugcgcgcagcgcgacaaccugcgggccagcuccccuaucagagcuacacagcaagauaauccccgcaccuguauucagcagaacaucccgcgguccucuuccacccagcaagacaauccuaagacaagcugcaccaaaagagauaaccugcgccccacguguacacagcgggacagaacccaguccuuuucuuuccagcgcgacaaucccgggacaagcuccucucaaugcuguacccagaaggagaaccuccggccuagcuccccgcacagaagcacacaguggaauaacccccgcaauucuuccccucaucggaccaacaaggauauucccugggccagcuuuccucugagacccacgcagucugacggaccucgcaccuccagcccgucuagaagcaaacaauccgaagugcccugggcuucuaucgcccuucggccuacacagggcgaucgcccccagaccagcuccccuagcagacccgcccaacacgacccgccucaguccucuuucgggcccacacaguauaaucugcccagccgggcuaccuccucuagccauaacccuggacaccaguccacgucuagaacaagcucccccguuuacccugcggccuauggcgcuccgcucaccagccccgagccuucucaacccccuugcgccguguguauuggccaccgggaugcgccccgcgcuuccagcccgccuagauaccugcagcaugaccccuuuccuuucuuucccgagccucgggcccccgaaucugagccgccucaccaugaaccgcccuauaucccuccggcggucugcaucgggcaccgcgaugcucccagagccuccagcccuccccggcauacacaguucgacccuuuucccuuccuuccugauaccucugacgccgagcaccagugucaaagcccccaacacgaaccgcugcagcucccugcucccgugugcauuggauaccgcgaugccccuagagcgagcagcccuccccggcaggcucccgagcccagccugcuguuucaagaccucccccgcgccucuaccgagagccuggugccuuccauggacucucuucaugaauguccccacaucccuacaccggucugcauuggccauagagaugcccccagcuucuccucuccuccccggcaggcuccugagcccagccuguucuuucaggacccuccggggacguccauggaaucucucgcccccagcaccgauucccugcacggaagcccuguucuuaucccccaagugugcauuggccaccgcgacgcuccuagagccucuagcccuccccggcauccucccagcgaucuggcguuccucgcccccucucccucccccgggagcuccggcggaucucgcggcagcgcuccuccgggggagacaagacacaaucuggaacgggaggaguacaccgugcuggccgaccugcccccucccagacgccuggcucagcggcagccuggaccccaggcccaauguuccagcggcgggagaacacauucuccgggacgcgccgaagucgagcggcuuuuuggccaggaaagacgcaaguccgaggcugcgggggccuuccaggcucaggaugaaggccggagccaacagccuucucagggacagagccaacugcucagacgccaguccucucccgccccuagcagacaggugaccaugcugcccgccaaacaggcugagcugacgagacgcucccaagccgagccgccucaccccuggucucccgaaaagcggccugagggcgacagacagcuucaggggagcccccucccuccgcggacauccgcgagaacccccgaacgcgagcugcggacccaaagaccucuggagagcggacaggcuggcccccgccagccucucgggguuuggcagucucaagaggaacccccuggaucccagggcccgcauagacaccuggaacggagcugguccucucaggaagggggccuuggacccggcgggugguggggaugcggcgaaccuagccugggggccgccaaagcucccgagggagccuggggcgggacaucccgcgaguauaaggaaucuuggggccagccugaggcgugggaagagaagcccacccacgaacucccgagagagcugggaaaacggagcccucugacaagcccgcccgagaacuggggcgggccugccgaaagcucucaauccuggcauagcggaacgcccaccgcugugggcuggggagccgagggagcuuguccuuacccgcgcggcucugaaagacggcccgagcuugauuggcgcgaccuccugggccugcucagagccccuggggaaggagucugggcucgggugcccucccuggauugggagggccuucuggagcuccugcaggcccgccugccuagaaaggaccccgcggggcaccgggaugaccuugcccgcgcucucggaccggaacugggcccucccgggacaaacgacguuccugagcaggaaagccauucucagcccgagggaugggccgaggcuaccccugugaauggccacucccccgcccugcaaagccagucuccgguccagcuccccagcccugccugcacauccacccaauggcccaaaaucaaggugacgagaggcccugcuaccgcgacacuggccgggcuugaacagaccggaccgcugggcagccgguccacagcuaaagggcccucucucccugagcugcaguuucagcccgaggaaccugaagagagcgagcccuccagaggacaagauccucugaccgaccagaagcaggccgauucugccgacaaacgccccgcugaaggcaaggccgggagcccgcuuaagggacggcucgucacauccuggagaaugccuggcgaucgccccacgcuguucaacccuuuucugcucucucugggcgugcuucgguggagacgccccgaccugcucaauuucaaaaagggguggaugagcauccuggaugagccgggagaaccucccucccccagccugaccacaaccucuaccucccaguggaaaaagcauugguuuguucuuacagacagcucucugaaauauuaccgggauuccacggcggaggaagccgacgagcucgauggcgagauugaccugagaagcuguaccgaugugacagaauaugcuguccaacgcaacuacggguuccagauccacaccaaggacgccguguauacacucucugcuaugaccuccgggauccggagaaauuggaucgaggcccugcggaagacgguucgcccuacaagcgcgcccgacgugaccaaacuuucugauuccaacaaggaaaaugcccugcacagcuacagcacccagaaaggcccucucaaggcuggggagcagagagccggauccgaagucauuucucggggcggcccgcgcaaagcugacgggcaaagacaggcccuggauuacguggagcugagcccccuuacacaggcuuccccucaacgggccagaacccccgcgcgcacaccugaccggcuggccaagcaggaggaacucgagagagaucuggcucagcgcucugaggaacggagaaagugguuugaggccaccgacagccgcacgcccgaagugccggcuggagagggcccuagacgggggcucggagcgccccucacagaagaucagcaaaaccgccuuuccgaggaaaucgagaaaaaguggcaggagcuggaaaaacucccucugagagagaauaagcggguuccccugaccgcccuucugaaccagucucgcggcgaaagacgggggccucccagcgacggacaugaggcccucgaaaaagagguccaggcucugcgcgcccaacucgaggcuuggagacugcagggcgaagccccgcaguccgcccuucggagccaggaggauggccacauucccccuggguauauuucucaagaggcuugcgagagaucccuggccgaaauggagagcucucaucaacaggugauggaggaacugcagcgccaccacgagcgggaacuccaaagacugcagcaggagaaggaguggcuucuggcggaagagacagccgcuaccgccuccgcuaucgaagccaugaagaaagcguaccaagaggaacucagccgcgagcuguccaagacgcggucucuccagcagggacccgacggccugagaaaacagcaucaaagcgauguggaggcccuuaagcgcgaacugcagguccuguccgagcaguauucucagaaaugucucgaaauuggggcucugaugcggcaagccgaggaaagagagcacacccuucggcgcugccagcaggagggacaggaacugcucagacauaaucaagagcugcacggccggcucagcgaagagaucgaccagcugcgcggguucauugcuucccagggaaugggcaacggcugugggagaagcaaugaacggucuuccugcgagcuugaggugcugcugcgcguuaaggaaaacgagcuccaauaccugaaaaaggaagugcagugucuuagagacgagcugcagaugaugcagaaggauaaacgguuuacaagcggaaaguaucaagacgucuacguggagcucucucauaucaaaaccagaagcgaacgcgagauugaacagcugaaggagcaccuccggcuggccauggcugcccuucaggaaaaagaguccaugagaaauucucuggcggaguga

SEQ ID NO: 77295 - RNA, 9294 nt, Artificial Sequence
  derived and/or modified sequence opt5 from TRIO__Homo_sapiens__NP_009049
augagcggauccucugggggagcugcugcccccgcggcuagcuccggcccugccgccgcugccucugcugccgggagcggaugcggcgggggagcgggcgaaggcgccgaagaagcugccaaggaccuggcugauaucgccgcguucuuuagauccggguuccggaagaacgacgaaaugaaggccauggaugugcugccgauucugaaggaaaaggucgcuuaccuuucuggaggcagagacaaaagagggggacccauccugaccuuuccugcccggagcaaucacgaucgcauuagacaggaagaccuccggcgccugaucuccuaccuugcuuguauucccagcgaggagguuugcaagagaggcuucaccgugaucguggauaugcgggggucuaagugggacuccaucaaaccucugcucaagauucugcaggagagcuuccccuguugcauccacgucgcccugauuaucaaaccugauaacuucuggcagaagcagcgcacgaauuuuggaucuuccaaauucgaguuugaaaccaacauggugagccucgagggccugacaaagguuguggacccgucucagcuuacccccgaguucgauggcugucuggaauacaaucacgaggaauggauugagaucagagucgccuuugaagacuauauuuccaacgcuacacauaugcucagccggcuggaggagcuucaagauauccuggcgaagaaagaacucccucaggaccuggagggggcccgcaauaugaucgaagaacacucccagcugaagaaaaaggugauuaaagcucccaucgaagaccucgaucuggagggacagaaacuucugcaacgcauucagucuagcgaguccuucccuaaaaagaacagcggcucugggaaugccgaccuccagaaccugcuucccaagguuuccaccaugcuggaucggcuccauagcacacgccagcaucugcaccaaauguggcaugugagaaaacugaagcucgaccagugcuuucagcugcggcuuuucgaacaagaugccgagaaaauguucgacuggaucacccacaauaagggacuguuucucaacucuuacacggaaauuggcaccagccauccgcacgcuauggagcugcagacacagcacaaucauuucgccaugaacuguaugaaugucuaugugaacaucaacagaaucauguccguggcgaaucgccuugucgaaucugggcacuacgcuagccagcaaauucggcagaucgccucccagcuggagcaggaguggaaagccuuugcugccgcucucgaugaaagaagcacccugcuggacaugucuuccauuuuccaucaaaaggccgagaaguauaugagcaacguugauucuuggugcaaagcguguggagaaguggaccucccuuccgagcugcaggaucuugaggacgccauccaccaucaccagggcauuuacgaacacaucacacuggcuuacagcgaggugucccaggacggcaagucucuccuggauaaacugcaacgcccccuuaccccugggagcuccgacucucucacggccagcgcuaauuauuccaaggccguccaucacgugcuggauguuauccaugaagugcugcaccaccagcggcagcucgagaacauuuggcagcauagaaaaguccgccugcaccaacggcuucagcugugcguguuucagcaagacguucaacaggugcucgauuggaucgaaaaucauggagaggcguuccugagcaagcacacaggcgucgggaagucucugcauagagcccgcgcccuucagaaacggcacgaggacuuugaagagguggcccaaaacaccuacacaaaugcugauaagcuccuggaagccgccgagcagcuggcucagaccggagaaugugaccccgaggagauuuaucaggcggcccaccaacucgaagauagaauccaggacuucguccgccggguggagcagagaaaaauucugcuugauauguccguuagcuuucauacccacgugaaggaacuguggacauggcucgaggaacugcagaaagagcugcuugacgaugucuacgcugagucuguggaagccguucaagaccucaucaagcgguucggccagcagcaacagacgacccuccaggugacagucaacgugauuaaggagggggaagaccugauccagcaacuccgcgauuccgccaucagcucuaauaaaacaccccacaacagcuccauuaaucacaucgagacagugcugcagcagcuugacgaggcucagagccaaauggaagaacuguuucaggaaagaaagauuaaacucgagcuguuccugcagcuucggaucuuugaaagagaugccauugacaucaucucugaucucgaguccuggaacgacgagcugagccagcaaaugaaugauuucgacaccgaagaucugacgauugcggagcagcgccuccagcaucacgcugacaaggcccugacaaugaacaaucuuaccuucgauguuauccaccagggccaagaccugcuccaguaugucaacgaagugcaggccuccggaguggagcugcugugcgaucgggacgucgacauggcuaccagagugcaagaucuucuggaauuucuccaugagaaacagcaggagcuggaccucgccgcggaacagcaccgcaagcaucuggagcaaugcguucagcuuagacaucugcaggcugaagugaaacagguccucggcuggauucggaacggggagucuaugcugaaugccggacugaucacagccagcucccuucaagaagcugagcagcugcagcgcgagcacgaacaguuccaacaugccauugagaagacccaccagucugcucuccaggugcaacagaaggccgaagcgaugcugcaggccaaccauuacgauauggacaugaucagagauugugcugagaaaguugccagccacuggcagcaacucaugcugaagauggaggaccggcuuaaacuggugaaugcuuccgucgccuuuuauaagacaucugaacaggugugcagcguucucgagucccuggaacaggaguacaaacgcgaagaggauugguguggcggggccgacaagcugggaccuaacagcgagacggaucaugugaccccgaugaucucuaagcaccuugaacagaaagaggcuuuccugaaggcgugcacacucgccagacggaaugcugacgucuuucugaaauaccuccaccgcaacuccgugaauaugcccggcauggugacccauauuaaggccccugaacaacaggucaaaaacauccugaaugagcuuuuccagagagaaaaccggguucugcacuauuggacaaugcgcaagagacggcuggaucagugucaacaguacgugguguuugagagaagcgccaagcaggcucucgaguggauucaugacaauggggaguucuaucugucuacccacacguccaccggcagcucuauccagcacacacaagagcuucugaaagaacaugaggaauuucagauuaccgccaagcagacaaaagagcgcgucaagcuccugauccaacucgcggacggauucugcgagaaaggccacgcucaugccgccgaaaucaagaagugugugaccgcuguugauaaacgguacagagacuuuucccugcgcauggagaaguaucggacgagccuugaaaaagcccuggggauuuccagcgauucuaacaagagcuccaaaucucugcagcucgacaucauucccgcgagcaucccuggauccgaggugaagcugagagaugcugcccacgagcuuaaugaagagaaacgcaagucugcccggagaaaggaguucauuauggcugagcugauccagacagaaaaagccuacguccgcgaccuccgggagugcauggauaccuaucugugggagaugacaagcggcguggaagagauucccccggggaucguuaacaaggaacucaucauuuuuggaaauaugcaggagaucuacgaguuccauaacaacauuuuccugaaagagcuugagaaguacgaacaacugccugaggacgugggccacuguuuugucaccugggcugauaaauuccagauguaugugaccuacugcaagaauaagcccgacuccacacagcugauccucgaacacgccgggucuuauuuugaugagauucagcaaagacauggccuggcgaacagcaucuccagcuaccuuaucaaaccuguucagcggauuacgaaguaucagcugcuccugaaagaacuccugaccuguugcgaggagggaaagggcgaaaucaaagacgggcuugaggugaugcugucuguccccaagcgcgccaaugaugcuaugcaccuguccaugcucgaaggauucgacgagaacauugagagccagggcgaacugauccuucaagagucuuuucaggugugggacccuaagacacugauuagaaaagggcgggaacgccaucucuuccuguuugagaugucccugguguucagcaaggaagucaaagauuccucuggaagaagcaaguaccucuauaaauccaaacuuuuuaccagcgagcugggcguuacagagcacguggaaggggaccccugcaaguucgcccugugggugggccggaccccgacgucugauaauaaaaucguccucaaggcuuccagcaucgagaacaaacaggacuggauuaagcacaucagagaagugauucaagagcgcacaauccaucugaaaggagcccuuaaggaaccuauucacauccccaagaccgcccccgcuacccggcagaaaggcagacgcgauggggaggaccuggauucucagggagacggcagcucccagccugauacaauuucuaucgcgagccggaccucccaaaauacacucgacucugauaagcugagcgggggaugugagcugacgguugugauccaugacuuuaccgccugcaacuccaaugaacucacaauuagacgcggccagaccgucgaggugcuugaacggccgcacgauaaacccgacuggugucugguuagaacaaccgaccgcagcccugcugccgagggccuggugcccugcgggucucucuguaucgcccauuccagaagcuccauggaaauggagggaauuuucaaccacaaggauucucugagcgucuccucuaaugacgcuagcccucccgccuccguggcgagccuucagccucacaugaucggcgcucagucuucccccgggccgaaacggccuggaaacacgcugcgcaaguggcucaccagccccgucagacggcugucuuccggcaaagccgaugggcaugugaagaagcuggcccacaaacauaagaaaagccgcgagguuagaaagucugcugacgccggaagccaaaaagauuccgacgauucugcggccacaccucaggacgaaaccguggaggaacggggcagaaaugagggccucagcuccgggacacuuagcaaguccucuagcuccggaaugcagucuugcggcgaggaagagggggaagagggagcugaugccgucccccugccgccucccauggcuauucagcaacacagccugcuccagccugacucccaggaugacaaggccucuagccgccugcuugugcggcccaccuccagcgaaacacccucugcugccgagcugguuuccgcgaucgaggaacucgugaaaagcaagauggcccuggaggacagaccuucuucccugcucgucgaucaaggcgacuccucuagcccgagcuucaaccccuccgauaauagccuucugucuagcuccucuccuaucgacgaaauggaggaacgcaaaagcuccucucugaagcggagacauuacgugcuccaggagcugguggagaccgaacgggauuacguucgcgaccuuggguaugucguggagggauacauggcucugaugaaagaagauggcgugcccgacgauaugaagggcaaggacaaaauugucuuugggaacauccaccagauuuaugauuggcacagagacuucuuucucggagagcuggaaaagugucuggaggauccugagaaacucggcagccuuuucgugaagcaugaacggcgccugcacauguacaucgccuauugccagaacaaacccaaguccgagcauauuguuucugaauacaucgacacguuuuucgaggaccugaagcaaagacucgggcaccggcugcagcuuacagaucugcucaucaaaccugugcagcgcauuaugaaguaucagcugcugcucaaagacuuucuuaaguacagcaaaaaggcuucccuggauaccagcgagcuggaaagagccgucgaggugauguguaucguuccgcggcgcugcaaugacaugaugaacgugggaagacuccaaggcuucgaugggaaaauugucgcccagggaaagcugcuucugcaggacaccuuucucgugacagaucaggacgcuggccugcugccccgguguagagaacgccggaucuuccucuuugagcaaauuguuaucuucucugaaccucuugauaagaaaaagggcuuuuccaugcccggguuccuguucaaaaauagcauuaaggugucuugccugugccucgaggagaacgucgaaaaugacccuuguaaauuugcgcugaccuccagaacgggagaugugguggagacauucauccuucacagcuccucucccagcguccgccagaccuggauccaugaaauuaaccagauccuggagaaucagcggaacuuucucaaugcccugacauccccgauugaauaccaaagaaaccacagcggcgggggaggcgggggaggcucuggcggguccggaggcgggggaggcagcgggggaggcggcgcuccuucugggggaagcggccauuccgggggacccucuagcugcggcggggcccccuccaccucucgcagccggccuuccagaaucccccagccuguucgccaccauccgcccgugcuggugagcucugccgcuuccagccaggccgaggcggacaagauguccggaacaucuaccccuggccccagccucccucccccgggcgccgcuccugaggccgggcccuccgcuccuucucggagacccccuggagccgacgcggaaggcagcgagcgcgaagccgagcccauuccgaagaugaaaguccuugaauccccucggaagggggcugccaaugcuagcggaucuucccccgaugcccccgcuaaagacgccagagcgagccugggcacgcugccucucgggaagccgcgcgccggcgcugccucuccccugaacuccccucuuagcucugcugugcccucccugggaaaagagccuuuucccccuagcucuccgcuccaaaagggcgggagcuuuugguccagcauccccgccuccccugccucuagacccggcagcuucaccuuuccuggcgauuccgacucucugcagcggcagacaccccgccacgcggcuccggggaaggauaccgacagaaugagcacauguuccucugccagcgagcaguccguucaaagcacccagucuaauggauccgaauccucuagcagcucuaacaucuccacgaugcuggugacacacgauuauaccgcugucaaagaggacgaaauuaauguguaccagggcgagguugugcagauccucgccagcaaccaacagaauauguuccuugucuuucgggccgcuacagaucagugcccugccgcggagggguggauucccggcuucgugcugggacauaccucugccgucaucguggaaaaccccgacggcacccugaagaaauccacaagcuggcacacggcucucagacugcggaagaaaagcgagaagaaggauaaagacgggaagcgcgaaggaaaacuugagaacggcuauagaaagucccgggaagggcugucuaauaaaguuagcgugaagcuccugaacccuaauuacauuuaugaugugcccccugaguuugucaucccgcuguccgagguuaccugugaaacaggagagaccguggugcuccgcugcagagucuguggccggcccaaagccucuaucacauggaaggggccugaacauaacacccugaauaacgacggccacuacagcauuuccuauucugaccuuggagaggcuacgcugaagaucgugggcguuacaaccgaagaugacgggauuuauaccugcaucgccgugaaugauaugggaagcgcguccagcucugccucccuccgcguccugggccccgggauggacggaauuauggugacauggaaagauaacuucgacagcuuuuacucugaggucgcugagcuuggcagaggccgguucuccgugguuaagaaaugugaucagaaggggaccaaacgcgccguggcuacaaaguucgucaauaagaaacugaugaagagagaccaagugacgcacgaacucggaauccugcagagccugcagcauccucuccugguuggccuucuggauaccuuugagacacccaccuccuauauucucgugcuggaaauggccgaccaagggcggcuucuggauugcgucgugcgcuggggaucucucacagagggcaaaaucagagcucaccugggggaagugcuggaggccguucgguaccuccauaacugucgcaucgcgcaccuggaccuuaagccggagaauauucuggucgaugaaagccucgccaaaccuaccaucaagcuggcugacuucggagacgccgugcagcuuaacacgaccuauuacauucaucagcugcucggcaaucccgaguuugcugccccugaaaucauucugggcaaccccgugucccugacaucugauaccuggagcgucgggguucucacauaugugcugcuuuccggagugagcccuuuccuggacgauucugucgaggagaccugccucaauaucugcagacuggacuuuuccuuccccgaugacuacuuuaagggcgugagccagaaagccaaggaguucguuuguuuucuucugcaagaggauccggcgaaacggccuucugcugcccucgcccugcaggaacaguggcugcaggcugggaacggaagaagcacaggcgugcucgacacgucccgccugaccucuuucaucgagcggagaaagcaccaaaacgauguccgccccauucggagcaucaaaaauuuucuucaguccagacugcucccccgcguguga

SEQ ID NO: 77296 - RNA, 1806 nt, Artificial Sequence
  derived and/or modified sequence opt5 from TRIP10__Homo_sapiens__NP_001275891
auggacuggggcaccgagcugugggaucaguucgaagugcucgagagacacacacaaugggggcuggaccuucuggaucgguacgucaaguuuguuaaagaacgcacggagguggaacaggccuaugcuaagcagcucagaagccuggugaaaaaguaccuucccaaacggccugccaaggacgauccggaguccaaguucucucagcaacagagcuuuguccagauccugcaggaggugaacgacuucgcgggacaacgcgaacucguugcugagaaucuguccgugagagucugccuggaacucaccaaauauucucaggagaugaagcaggagcggaaaaugcauuuucaggaaggccgcagagcccaacagcagcuggagaacggguucaagcaacuugaaaauagcaaacggaaguuugagcgcgauuguagagaagccgagaaggcugcccagacagcugagcggcuggaccaggauauuaacgccaccaaagcggacguggaaaaggccaaacagcaagcucaccuccgcucccauauggccgaggaaucuaagaaugaguacgcugcccagcugcagagauucaaccgggaucaggcgcacuuuuauuucagccaaaugccccagaucuuugacaaacuucaggauauggacgaacgcagagccacacggcugggagcuggcuacgggcuccuguccgaggccgagcuggaaguugugccuauuaucgcuaagugccucgagggaaugaaagucgccgccaaugcuguggaccccaagaacgauagccaugugcugauugaacuucacaagucuggcuucgcgagaccuggcgacgucgaguuugaagauuucucccagcccaugaaucgcgccccuagcgacucuucccuggggaccccgagcgauggacggcccgagcucagaggcccugggcgcucucggacaaaaagauggcccuucggaaagaaaaacaagccucggcccccgccucugagcccccuuggcgggccuguucccagcgcucugcccaauggaccuccgucuccccgcuccggcagagacccucucgccauccugagcgagaucuccaaaagcgugaagccccgccuggccucuuuucggucccucagaggcagccgcgggaccguggucacggaagauuucucucaucugccucccgagcaacagcggaagagacuucagcagcaacuggaggaacggagccgcgagcuccagaaagaaguggaccagagagaggcucugaagaaaaugaaggauguuuaugagaaaaccccgcaaaugggagacccugccucccuugaaccccagauugcggaaacacugucuaacaucgagcggcucaagcuggaggugcagaaguacgaggcuuggcuggccgaagccgaaagcagaguccucuccaaucgcggcgauagccugucucggcacgcuagaccucccgacccucccgccuccgcuccgccugacuccucuuccaacagcgccucccaggauaccaaagagucuagcgaggaaccucccuccgaggaaucucaagacacacccauuuacaccgaguuugaugaagacuucgaggaggaaccgacgagccccaucgggcacuguguggcgauuuaucauuuugagggauccagcgaaggcacaaucucuauggccgagggggaagaucuuucccugauggaggaggacaagggagauggcuggacccgcguuagacggaaagaaggcggggagggauacgugccuacaagcuaucuccgcgucacccugaauuga

SEQ ID NO: 77297 - RNA, 5940 nt, Artificial Sequence
  derived and/or modified sequence opt5 from TRIP11__Homo_sapiens__NP_004230
augagcuccuggcugggcgggcucggaucuggccuggggcagagccuuggacaagugggcgggucccuggccucucucaccggacagaucagcaacuucacaaaggacaugcugauggagggcacggaagaggucgaagcugagcuucccgauuccagaaccaaggaaauugaggccauccacgcgauucugcggucugagaaugaacgccucaagaagcugugcacagaccuggaggaaaagcaugaggcuagcgagauccagauuaaacagcaauccaccagcuacagaaaccagcuccagcagaaggaaguugagaucucucaccugaaggcccggcaaaucgcccuucaggaucagcugcucaaacugcaguccgcugcccaaagcgugccuucuggcgcuggggugccggccacaaccgcguccagcucuuuugccuauggaauuucccaucaccccagcgcuuuccaugacgaugacauggauuuuggcgacaucauuuccucucagcaggaaaucaaucgccuuagcaacgaggucuccagacuggaaagcgagguggggcacuggcggcacauugcccaaacaucuaaggcucagggaaccgauaauuccgaccagagcgagaucuguaaacuccagaacauuaucaaggaacugaaacaaaaucgcucucaggagaucgaugaccaucagcacgaaaugagcguucugcagaacgcccaucaacagaagcucacggagauuuccagacggcaccgcgaggaacugucugauuacgaggaaagaaucgaggaacuugagaaucugcuccagcagggcgggagcggagugauugaaaccgaccuguccaagaucuaugagaugcagaagacaauucagguccuucagaucgagaagguggaaagcaccaaaaagauggagcagcuggaagacaaaaucaaggauauuaacaaaaagcucucuuccgcggagaaugaccgggauauccugcgcagagagcaagaacagcugaacguugagaagcggcagauuauggaagagugcgaaaaucucaaacuggaguguagcaaacuucaaccuucugccgugaaacaguccgacacaaugaccgagaaggaacgcauccuggcucagagcgccuccgucgaggaaguguucagacuccagcaagcucugucugaugccgagaacgaaauuaugcggcuuagcucccugaaucaggacaacucucucgccgaggauaaccugaaacugaagaugagaaucgaggugcucgaaaaggagaaaagccugcuuucccaggaaaaggaggaacugcagaugagccuccugaaacugaauaacgaguacgaggucaucaagucuacggcuacacgcgacauuucccuugauagcgaacuccacgaccugcggcugaaucucgaggcgaaagaacaagagcugaaccagucuaucuccgagaaggaaacccuuauugccgagaucgaagaacuggauagacagaaucaggaagcuacaaagcauaugauucucaucaaagaccaacugagcaagcagcagaacgagggcgacucuauuaucagcaaacugaagcaagaucuuaaugacgagaaaaagcgcguucaccagcucgaagaugacaagauggauaucaccaaagagcuggacgugcagaaggaaaaacugauucaguccgagguggcccucaacgaucugcaucuuaccaagcaaaaacuggaagacaaggucgagaaucucguggaucagcugaacaaaagccaggagucuaauguuuccauccagaaggaaaaccuggagcuuaaggaacacauucggcaaaaugaggaggaacugagcagaauccgcaacgagcugaugcagucccugaaucaggacucuaacagcaacuuuaaagauacacuccugaaggaacgggaggccgaagugagaaaucuuaaacagaaccuguccgagcucgagcaacugaaugaaaaccugaagaaagucgcuuucgacgugaagauggagaaugaaaaacuuguucucgccugcgaggaugugcgccaucagcuggaagagugucuggcgggcaacaaucagcucucucuggagaaaaacacgauugucgaaacccuuaagauggagaaaggggaaaucgaggcugaacugugcugggccaagaaacggcuccuggaggaggccaauaaguaugaaaagacaaucgaggaacugagcaacgcuagaaaucuuaacaccuccgcccugcagcucgagcacgaacaccugauuaaacucaaucaaaagaaagacauggagaucgcugagcugaagaaaaacauugaacagauggacacagaucauaaggagaccaaggacgugcuuucuagcucccuggaagaacaaaaacaacucacgcagcugaucaauaagaaagagauuuuuaucgaaaagcugaaagagcgcagcucuaaacuucaggaggaacuggauaaauacucccaggcccuccggaagaacgaaauccugagacaaacaauugaggagaaggaccggagccucggaucuaugaaagaagagaacaaucaucugcaggaggaacuugaacgccugagagaggagcagucccggaccgcgcccgucgccgauccuaagacccucgacagcgugacagaacuggcuucugagguuucccagcugaacaccaucaaagaacaccuugaggaagagauuaagcaccaccagaagaucauugaggaucagaaucagagcaagaugcagcugcuccaaucccugcaggaacagaagaaagagauggacgaguucagauaucaacaugagcagaugaacgccacacacacgcagcucuuucuggagaaggaugaagagaucaaaagccuucagaagaccaucgaacaaauuaaaacacagcugcaugaggaacgccaggacauccagaccgauaauucugacauuuuccaagagacaaaggugcagagccugaacaucgagaauggcuccgaaaagcacgaucucucuaaagcugagaccgaacggcuggucaaggggauuaaagagagagaacuugagaucaagcugcucaacgagaaaaauauuagccugacgaagcagaucgaccagcucuccaaggacgaagugggaaaacugacccaaaucauucagcagaaggaucuugagauccaggcccugcaugcgcgcauuucuagcacaucccacacccaagacguuguguaccugcagcagcaacuccaggccuacgcuauggaaagagagaaagucuuugccgugcugaacgaaaagacacgggaaaauucucaccuuaaaaccgaguaucauaagaugauggauaucguggcugccaaggaagccgcucugauuaaacuccaggacgagaacaagaaacugagcacgcgcuucgaauccagcggccaggauauguuuagagagacaauccaaaaucucucucggaucauucgcgagaaggacaucgaaauugaugcgcugucccagaaaugucagacccuucuggccguucugcagacaagcucuaccgggaacgaggcuggaggcgucaauuccaaccaauucgaggaacuccugcaggaaagagacaaacuuaaacaacaggugaagaagauggaggaguggaaacaacaggugaugaccacaguccagaacaugcaacacgaaagcgcccagcugcaggaggaacuccaucagcugcaagcccaggugcucguugauuccgacaauaacucuaagcuccagguggauuacacgggccuuauccagagcuaugagcaaaaugaaaccaaacugaagaacuucgggcaggagcuggcucagguccagcacuccauuggacaacucugcaauacaaaagaccugcuucugggcaagcucgacaucaucagcccccagcugucuuccgccagccugcucaccccucagucugcggagugucuucgggcuagcaaguccgaagugcugucugagagcuccgaacugcuccaacaggagcuggaggaacuucgcaaaucucugcaggagaaggaugccacaauuagaacccuccaggaaaacaaucaucggcugagcgacuccaucgccgcuacgagcgagcuggaacgcaaagagcacgagcaaacagauucugaaauuaagcagcucaaagagaagcaggacguucuucagaagcugcugaaagaaaaggaucuccugaucaaagccaaguccgaccaacuucugagcuccaacgagaauuuuaccaacaaagugaaugaaaacgagcuccugagacaggcggucaccaaucugaaggagcggauucucauccuugaaauggauauugggaagcugaaaggagagaacgaaaagaucguggagacauacagaggcaaagaaaccgaguaucaggcucugcaggagacaaauaugaaguucucuaugaugcuccgcgaaaaagaguuugaaugccacagcaugaaggagaaagcccuggccuucgaacaacuucugaaggagaaggagcaggggaaaacgggcgaacucaaccagcugcugaaugcuguuaaguccaugcaggagaaaaccguggucuuucaacaggaacgggaccaggugaugcucgcccuuaagcaaaaacagauggagaacacagcucugcagaacgaggugcagagacugcgcgauaaggaguuccggucuaaucaagagcucgaaagacugcgcaaccaucuucuggagagcgaagacuccuacacccgggaggcccucgcggccgaggauagagaagcuaagcugcgcaaaaaggucacaguucuggaggaaaaacucguguccucuagcaaugccauggagaacgcuagccaccaggccucugugcaggucgaaucccuucaggagcaacugaaugugguuagcaagcagcgggacgagaccgcccugcagcucucugugagccaggaacaagucaaacaguaugcucugucccuugcgaaccugcagauggugcucgagcauuuucaacaggaagagaaggccauguacucugcugaacuggagaagcagaaacagcugaucgccgaguggaagaaaaaugccgaaaaccucgagggaaagguuauuagccuucaagaaugucuggaugaggcuaaugccgcgcuggacuccgcuagcagacucacggagcagcuggacgugaaagaggaacagaucgaggagcuuaagcggcagaacgaacugcgccaagagaugcucgaugacguccagaagaaacugaugucccuggccaauucuagcgagggcaagguggauaaaguucucaugagaaaccuuuucauugggcacuuucacaccccgaagaaucagcggcaugaagugcugcgccugaugggauccauccucggcgucagacgggaggaaauggagcagcuguuccacgacgaucaagggggagugacaagauggaugaccggcuggcuugggggcggaucuaaaagcgugcccaacacaccucugcgccccaaucagcaguccgucguuaacucuagcuuuuccgaacucuucgugaaguuucuggagaccgagagccauccuucuauucccccgccuaaacuguccgugcacgacaugaagccccucgauagcccuggccggagaaagcgcgacacaaacgcccccgaaucuuucaaagauaccgcugagucccggagcgggagacgcacggacgucaaucccuuccuugccccucggucugcggcugugccgcugaucaaccccgccggacugggcccugggggacccggccaucuccugcuuaagccuaucuccgauguucugcccacauuuaccccgcucccugcccugcccgacaauagcgcuggggugguccugaaagaucuccuuaagcaguga

SEQ ID NO: 77298 - RNA, 870 nt, Artificial Sequence
  derived and/or modified sequence opt5 from TRIP13__Homo_sapiens__NP_001159732
auggacgaggccgugggcgaucugaagcaggcucuccccugcgucgccgaaagcccuaccguucacguggaggugcaucaaagaggguccucuacagcgaaaaaggaagacaucaaccugagcguccggaaacuucugaaucgccacaacauuguguucggagauuacacguggaccgaguuugacgaaccguuccucacaagaaauguucaguccgugucuaucauugauaccgagcugaaggucaaagacagccagcccaucgaucuuuccgcuuguacaguggcccugcauauuuuucagcucaacgaggacggcccuucuagcgaaaaucuggaggaagagaccgagaacaucaucgccgcuaaucacuggguucugcccgccgcugaguuccaugggcucugggauucccugguguaugacgucgaagugaaaagccaccuucuggauuacgugaugacaacccuccuguuuucugacaagaacgucaauuccaaccuuauuacguggaaucggguugugcugcuccacggaccucccggcaccgggaagacaagccugugcaaggcccuggcgcaaaaacucaccauccgccugucuuccagauaucgguacggacagcuuauugaaaucaacagccauucucuguucuccaagugguuuagcgaguccggcaaacucgugacaaagauguuccagaagauucaggaucugaucgacgacaaagaugcccuugucuuugugcugauugacgaaguugagucucucaccgcugcccgcaaugcuuguagagccggcacggagccuagcgaugcgauccggguggucaacgccgugcugacacaaaucgaccagauuaagcgcuga

SEQ ID NO: 77299 - RNA, 1746 nt, Artificial Sequence
  derived and/or modified sequence opt5 from TRIP4__Homo_sapiens__NP_057297
auggccguggcuggcgccgucagcggggagccccugguucacuggugcacccagcaacucagaaagacauucggacuggacguguccgaagagaucauucaguacgugcuuucuaucgaaagcgcggaggaaauucgggaguaugucacggaucugcuccagggcaacgaggggaaaaagggacaguuuaucgaagaacugauuaccaaauggcaaaagaaugaccaggaacuuaucuccgauccucugcagcaguguuucaaaaaggacgagauccucgauggccaaaagucuggggaccaucugaaacgcggaagaaagaaaggccggaaccgccaggaggugccggcuuuuacagaacccgauaccacagccgagguuaagaccccuuucgaccuggccaaagcucaggaaaauagcaacuccgugaagaagaaaacaaaguuugucaaucucuacaccagagagggccaggaucggcuggccgugcuucugcccgggcgccacccuugcgacugucucggacaaaaacauaagcugauuaacaauugccuuaucuguggcagaauuguuugcgaacaggaggggucuggacccugucuguucugcggcacgcucguguguacccacgaggaacaggauauccugcaacgggacagcaacaaaucccagaagcugcucaaaaagcugaugagcggggucgaaaauucuggaaagguggauauuuccacaaaagaccuucugccucaucaggaacuccgcaucaagagcggccuggagaaagcuauuaagcacaaagacaaacuucuggaauuugauagaaccucuauccggcgcacacaggugaucgacgaugaguccgacuauuucgccagcgauucuaaccaauggcucuccaagcuggagagagaaacccugcagaagcgggaggaggagcuccgcgaacugagacacgcgagccggcuuuccaagaaagucacgauugacuuugccggcagaaagauccuggaggaggaaaauucucucgcugaguaccauagccgccuggaugaaacaauucaggccaucgcuaacgggacccuuaaucagccgcugacaaaacucgaccgguccagcgaggagccccugggaguucuggugaacccuaauauguaucaaucucccccucaguggguggaucacaccggcgccgcgucccagaagaaggccuucagaagcucuggguuuggacucgaguucaacagcuuucagcaucaacugcgcauucaggaccaggaguuccaggaaggcuucgaugggggauggugccuuuccguccaccaacccugggcuucucugcucgugcggggcaucaaaagaguugagggccgcagcugguacaccccgcaccgggggagacuguggaucgccgcuacagccaagaaaccuagcccccaggaaguguccgagcugcaggccacguaucgccuucuccggggaaaggacgucgaguuuccuaacgacuaccccucuggcugucugcuggggugcguggaucucauugacugccugucccaaaaacaguucaaggaacaguuucccgauaucagccaggagucugacuccccuuucguuuuuauuuguaagaauccgcaagaaaugguggucaaauuccccaucaagggaaacccuaaaauuuggaaacuugauagcaagauccaucagggcgcuaagaaagggcugaugaagcagaauaaggcgguguga

SEQ ID NO: 77300 - RNA, 1431 nt, Artificial Sequence
  derived and/or modified sequence opt5 from TRIP6__Homo_sapiens__XP_011514847
augagcggccccaccuggcugccuccgaagcagcccgagccugccagagcuccccaagggcgggccaucccucgcggaacacccggcccuccgcccgcgcacggggcugcccuccagccucaucccagagugaacuucugcccucugcccuccgaacaguguuaccaggccccgggaggcccugaggaccgggggcccgcuugggucggaucucacggcguucuucaacauacgcagggccugccugccgaucgcgggggacucagacccggcagccuggacgcugaaauugaucuucuguccucuacccucgccgagcugaaugggggacggggccacgcgagccgcagacccgaccggcaggccuaugaaccuccgcccccucccgcuuaccgcacagggucccugaaaccuaaccccgccucuccgcucccugcuagccccuauggaggcccuacccccgccuccuacacaaccgcgagcacacccgccggccccgcuuuuccgguccaggugaagguggcccaaccugugagagggugcggaccuccccggcgcggcgcuucucaggccuccgggccucugccgggaccccauuucccucuucccggcagaggggagguuuggggaccuggcuaucggagccagcgcgagcccggcccuggggccaaagaagaggcugcgggagugucuggccccgccgggagaggacggggcggggaacacggcccgcaggucccucugucccaacccccugaggaugagcucgacagacugaccaagaaacuugugcacgauaugaaucaucccccgagcggagaauacuuuggccagugugggggaugcggcgaggacguugugggggauggagcuggcgucguggcccuggaccgcguguuccacgucggguguuuuguuugcucuacgugucgggcccagcucagaggccaacauuucuaugcuguggaacgccgggccuacugcgagggauguuacguggcgacccuggaaaagugcgcuacauguucccagccuauccuggaucgcauucuccgcgccaugggcaaggccuaucaccccgggugcuuuaccugcgucgugugucaccggggacuggacggcaucccuuucacaguugaugcuaccagccagauucauugcaucgaggacuuucacagaaaauucgcccccagauguuccgugugcgggggagcuaucaugcccgagccuggccaggaagagacgguccggauuguggcccuugacagaucuuuucauaucggguguuacaagugcgaagaguguggccugcuccugagcuccgaaggagagugccaaggcuguuauccgcuugaugggcacauucugugcaaagcguguagcgccuggcgcauccaggagcucucugcuacaguuaccacagacugcuga

SEQ ID NO: 77301 - RNA, 261 nt, Artificial Sequence
  derived and/or modified sequence opt5 from TRIQK__Homo_sapiens__XP_011515284
augggcagaaaggacgccgcuaccaucaaacugcccguggaucaguaccggaagcaaauugggaaacaggacuauaagaaaacaaagccuauccuccgcgccacgaagcugaaagcggaggcuaagaaaaccgccauuggaaucaaggaagucggccuuguucuggccgcuauucucgcccugcuucuggcuuucuacgccuuuuucuaucucagacugacaaccgauguggacccggaucuggaccaggaugaggacuga

SEQ ID NO: 77302 - RNA, 1020 nt, Artificial Sequence
  derived and/or modified sequence opt5 from TRMT10A__Homo_sapiens__NP_001128137
augagcuccgagaugcugcccgccuucaucgaaaccucuaacguggacaagaaacagggcauuaaugaggaucaagaagagagccagaagccuagacucggggaaggaugcgagccgaucuccaaacggcagaugaagaaacugauuaagcagaagcaaugggaggaacagcgcgagcuuagaaaacagaagcggaaagaaaagcgcaaaagaaagaagcuggagcggcagugucaaauggagcccaacucugacggccacgaucgcaaaagaguccggcgcgacguugugcauagcacacucagacugaucauugauugcuccuuugaccaccuuauggugcugaaggauaucaaaaagcuccauaaacagauccagcgguguuacgcugaaaaucgcagagcccugcacccuguccaguucuaucugacgucucaugggggacaacucaagaaaaacauggacgagaaugauaagggcugggugaacuggaaggacauucacaucaaacccgaacacuacagcgagcugauuaagaaagaagaucuuaucuaucugaccuccgacagcccuaauauucucaaggagcuggaugagucuaaagcguacguuaucgggggacuuguggaccauaaccaccauaagggccugacauauaagcaggcuuccgacuacggcauuaaucacgcccagcucccccuggggaacuuugucaaaaugaauagccggaaggugcuggccguuaaccacguguucgaaaucauccucgaguaucuggaaacccgcgauuggcaagaggccuuuuucacaauucuuccucagagaaaaggagcugucccgaccgacaaggcuugcgaaucugccucccaugauaaucagagcgugcggauggaggagggcgggucugacuccgauagcuccgaagaggaauacucuagaaacgagcuggacagcccccacgaagagaaacaggauaaggagaaucauacagaauccaccgugaacagccucccucacuga

SEQ ID NO: 77303 - RNA, 1347 nt, Artificial Sequence
  derived and/or modified sequence opt5 from TRMT12__Homo_sapiens__NP_060426
augagagagaacguggucguuagcaauauggaacgggaguccggcaagcccguggccguggucgcugugguuaccgaaccuugguucacacagcgcuacagagaguaucugcaacggcagaaacucuuugacacgcagcaccgcguggaaaagaugccggaugggucugucgcccugcccgugcuuggagagacccugccugagcagcaucuccaagaacugagaaaccggguugcgcccggcagcccuugcaugcuuacacagcugcccgacccugugccguccaaacgcgcucagggguguucucccgcccagaagcucugccuggaggucagcagauggguggaaggacggggcgugaaaugguccgccgagcuggaggcugaucucccucgcucuuggcaaagacacgggaaucugcuucugcucagcgaagacuguuuccaggccaagcaguggaagaaccugggacccgagcuuugggaaaccgucgcucuggcccucggcguucagcggcuggcgaaacgcggcagaguguccccugaugggacacggacccccgccgugacacugcuccugggagaccauggcugggucgagcacguggauaaugggauccgcuacaaguuugacguuacccaaugcauguucagcuuuggaaacauuacggaaaaacuuagaguggcuucucuguccugugccggcgagguccucguggaucuguaugcugggaucggauacuucacccuuccguuucugguucaugccggcgcggccuucgugcacgcuugcgaguggaauccucacgccgucguggcucuccggaacaaucuggaaauuaacggcgucgccgacagaugucagauccauuuuggggauaaucgcaagcugaaacucagcaacauugccgaccgggugauccugggacuuauccccucuuccgaggaaggcuggccuauugcuugccagguucugagacaagaugccgggggaauccuccacauucaucagaauguggagagcuuccccggcaagaaccugcaggcgcuuggggucucuaagguggaaaaagagcacuggcuguauccccagcaaaucacaaccaaucaguggaagaacggagcuacacgcgacucccggggcaaaaugcucagcccugccaccaagccggaguggcagagaugggccgaauccgcugagacgcgcauugccacacugcugcagcaaguucacggcaaacccuggaagacccagauccuccauauucagccugugaaaucuuacgcgccccacgucgaccauaucgugcuggaucuugaauguugcccuugucccagcgugggguga

SEQ ID NO: 77304 - RNA, 1893 nt, Artificial Sequence
  derived and/or modified sequence opt5 from TRMT1__Homo_sapiens__NP_001136026
augcagggcagcucccuguggcucucucugaccuucagaagcgcccgggugcuuucccgcgcuagauuuuucgaguggcaaucucccgggcugccuaacacagccgcgauggaaaauggaacgggcccguacggggaggaacggccccgcgagguccaggaaaccacaguuaccgagggagcugccaagaucgccuuuccuagcgcuaacgagguguucuauaaucccgugcaggaauuuaacagagaccucacaugcgccgucauuaccgaguucgcucggauccagcugggcgccaaagggauucaaaucaaggugccuggagaaaaagauacacagaagguuguggucgaccuuuccgagcaggaggaagagaaaguggaacugaaggagucugaaaaucucgcgagcggcgaucagccccgcaccgccgcuguuggcgagauuugugaggaagggcugcacgugcuggagggacucgccgcuuccggccugagaagcauccgguuugcccuugaagucccugggcugcgcucugugguggcgaacgacgccuccacgagagcugucgaucucauccggcgcaauguucaacugaacgacguggcccaucuugugcagccgagccaggcugaugccagaaugcugauguaccagcaccaacgggucucugagcgcuucgacgugauugaucucgaccccuauggauccccugccaccuuucuggaugcugcgguucaggccgugagcgaaggcgggcugcucugcgucacauguaccgacauggcugugcuggccggaaauucuggcgagacaugcuacuccaaguauggcgccauggcucuuaaaagcagagccugucaugagauggcgcugcggaucguucuccacucccuggaucuuagagcuaacugcuaccagcgcuucguggucccccugcucucuauuagcgccgacuuuuaugugcgggucuucgugagaguuuuuaccgggcaagccaaggugaaggcuuccgcccgcgcuaaauucagcgccgcguguggaccucccgucacgccggaaugcgagcauuguggccagcggcaccagcugggcggaccuaugugggccgaacccauccacgaccuggauuucgugggcagaguucucgaggcugugucugccaauccugggcgcuuucauacauccgaacggauuagaggaguccugagcgugaucaccgaggagcuucccgacgugccccuguacuacacacucgaucagcugucuagcaccauucacugcaacaccccuucccuucugcaacuccgcucugcucugcugcaugccgacuuccggguuagccucucccacgcguguaaaaaugccgucaagacagaugcuccggccagcgcucugugggacaucaugagaugcugggaaaaggagugccccgugaaacgcgaacggcuuucugagacguccccugccuuuagaauccugagcguggagccccggcuccaggccaacuucaccauucgcgaagaugcuaauccuucuuccagacagcggggccugaagagauuucaggcgaaccccgaggccaacuggggcccgcgcccucgggcuagacccgggggaaaagccgccgacgaagcuauggaggaacgcagacggcugcuucaaaauaagcgcaaagagccucccgaggaugucgcccagagagcggcucggcucaagacauucccuuguaaacgcuuuaaggaagggaccugccagagaggggaccaguguugcuauagccacucucccccgacaccucggguguccgccgaugccgcucccgacugucccgagaccagcaaccaaacgccuccgggacccggcgccgcggcugggccuggcaucgacuga

SEQ ID NO: 77305 - RNA, 2274 nt, Artificial Sequence
  derived and/or modified sequence opt5 from TRMT44__Homo_sapiens__NP_689757
auggccgaggugggcagaaccgggaucagcuaccccggagcucugcucccucagggcuucugggccgcggucgaaguuuggcuggagcggccgcaaguggcuaacaagcgccuuugcggggccagacuggaagcccggugguccgcugcccuccccugugcugaggcccgcggaccuggcacaucugcggggagcgaacagaaagagagaggacccggcccuggccaggggucccccggaggcgggccuggaccgcggucucugagcggccccgagcaggggacggccugcugugaacuugaggaagcucaaggacagugccagcaggaggaggcccaacgcgaagcugccuccgugccucugagagacucuggccaccccggccaugcggaggggcgggaaggagauuuuccugccgcugaccucgauagccugugggaggacuucucccagagccuggcccgcggcaauucugaacuccuggcuuuucuuaccuccagcggggccggaucucagcccgaggcccagagagagcuggaugucgugcuccggacaguuauuccgaagaccuccccucacuguccccugacaaccccucgcagagaaaucgugguccaagacgugcuuaacggcacaauuaccuuccugccccucgaggaagaugacgaggggaaucugaaaguuaagaugagcaacguguaucagauccagcugucucauuccaaagaagagugguuuauuagcguccucaucuucugccccgagcgguggcacuccgauggaaucguguacccuaagccgacguggcugggcgaagaacuucuggcuaagcucgcgaaauggucuguggaaaauaagaaaagcgacuuuaaguccacccugagccuuauuucuaucaugaaauauuccaaggccuaccaagagcugaaggaaaaauauaaggagauggucaaaguuuggcccgaggugacagauccugaaaaguucguguacgaggacgucgcuauugccgccuaucuccugauccugugggaagaggagcgcgcugaaagacggcucaccgccagacagagcuuuguggaucugggcugugggaacggacuucugguucauauucucucuagcgagggccaccccgggcgcggaaucgacgugcggagacgcaaaauuugggacauguacggcccucagacacagcuggaagaggaugcgaucacccccaaugacaagacgcuuuucccggaugucgacuggcugaucgggaaccacuccgaugaacucacaccuuggauucccgugaucgcugcccggucuagcuacaauugcagauuuuucguucugccuuguugcuuuuucgacuucauuggccgcuauucccggagacaaagcaaaaagacccaguaccgcgaguaucuggauuuuaucaaggaggugggauucacauguggcuuucaugucgacgaagauugccuccggauucccucuaccaaaagagugugccuggucgggaagucccgcaccuacccuagcucucgggaggccuccguggacgaaaaacggacacaguauaucaagagccggcgcggaugucccguuuccccgccuggcugggagcuuucucccagccccagauggguggcugccggguccgcuggacacugcgauggccagcaagcccuggacgcgcgggucgggugugugacgagagccugggcugccgaacauggcgcuggaccucaggccgagggcccguggcuccccggguuccacccucgcgagaaagcggaacggguuagaaacugcgccgcucugccccgcgacuuuaucgaucaggugguccuucagguggccaaucugcuccugggaggcaagcaacugaacaccagaucuagccggaaugggucccucaagacauggaacggaggcgagagccugucucuugcugaaguggccaaugagcuggacaccgaaacacuccgcagacugaaacgggagugugggggccugcagacccuucuccgcaacucccaccagguuuuccaggucgugaacggaagagugcauauucgggauuggcgcgaggaaacgcuguggaagacaaaacaaccugaggccaagcagagacugcucagcgaggcuugcaaaacccggcuguguugguuuuucaugcaccaucccgacggcugcgcgcuuucuaccgauuguugcccuuuugcccacgggcccgcugagcugcgcccgccuagaacaacccccagaaagaagaucuccuga

SEQ ID NO: 77306 - RNA, 1530 nt, Artificial Sequence
  derived and/or modified sequence opt5 from TRMT5__Homo_sapiens__NP_065861
auggugcuguggauccucuggagacccuucggcuuuagcgggcgguuccugaaacuugagucccacucuauuaccgaaagcaagucccugaucccugucgccuggacaucucucacgcagaugcugcuugaggcuccgggaauuuuucugcucggccaacgcaagagauucagcaccaugcccgaaacagagacccaugaacgggagacagagcuguuuuccccucccucugacguucgcgggaugaccaaacuggauagaacagccuucaagaaaaccgugaacaucccugugcucaagguccggaaggaaauugugagcaaacugaugcgcucccuuaagagagcggcucugcagcggcccggaauccgcagaguuaucgaggacccugaagauaaagagagccggcucauuaugcuggacccguacaagaucuuuacgcacgauucuuucgagaaagccgaacuuuccgugcuggagcagcucaaugucagcccccagauuucuaaguauaaccuggaacugaccuacgagcauuuuaaguccgaagagauccuccgcgccgugcugccugagggccaagacguuacaagcggguucucuagaauuggacacaucgcucaucuuaaucugcgggaucaccagcuccccuuuaaacaccugauuggccaggugaugaucgacaagaacccuggcaucaccuccgccgucaauaaaauuaacaauaucgauaacauguaucgcaauuuccagauggaagugcuuagcggggagcaaaacaugaugacaaaggugagagaaaauaacuacaccuaugaguuugacuucuccaaagucuacuggaauccccggcugucuacggaacauagcagaauuacagagcuccugaagccgggagauguucuguucgacguguuugcuggcguggggccuuucgccauccccgucgcgaaaaagaacugcaccguguuugccaaugaucucaacccugagucccacaaguggcugcuuuauaacuguaaacugaauaagguugaccagaaagugaaggucuucaaccucgacggaaaagauuuucugcagggccccgugaaggaagaacuuaugcagcugcucgggcugagcaaggaacgcaaacccucuguucauguggucaugaaucugccugcuaaggccauugaguuccucuccgcuuuuaaauggcugcuugacggacaaccgugcagcucugaguuccugcccaucgugcacuguuacagcuuuuccaaggaugccaacccugcggaggacguccggcagagagccggcgcugugcucggcaucucucuggaggccugcagcuccguucaccuggugcgcaaugucgcucccaacaaagaaaugcuuuguauuacauuccagaucccugccagcgugcucuacaagaaucaaacccggaaccccgagaaucaugaagauccgccucugaagagacagcgcaccgccgaggcuuuuucugacgagaaaacacagauuguuuccaacacguga

SEQ ID NO: 77307 - RNA, 924 nt, Artificial Sequence
  derived and/or modified sequence opt5 from TRMU__Homo_sapiens__NP_001269711
augaugugcagcggcgccgacgcuaucgccaccgggcacuacgcgagaacaucccuggaggaugaagagguguucgaacagaagcaugucaaaaagcccgagggacucuuucggaaccgcuucgaaguuagaaaugcugugaaacugcuucaagccgccgacucuuuuaaggaucagacguucuuucugagccaggugucccaggacgcucuccggcgcaccauuuucccucugggcgggcuuacaaaagaguuugucaagaagaucgccgcugagaacagacugcaccaugugcuccagaaaaaggaaucuaugggaauguguuucauuggcaaacggaauuuugagcacuuccugcugcaauaucuccagccgcgccccgggcauuuuaucagcauugaagauaacaagguucugggaacccacaaaggcugguuccuuuacacacugggccagagagccaauaucgggggacuccgggagccuugguauguggucgagaaggacuccgugaagggcgauguuuuuguggcgccccgcaccgaccacccugcccuguacagagaucuucugcggacaucucgcguccauuggaucgcugaggaacccccugccgcucucgugagagacaaaaugauggaaugccacuuccgguuccgccaucaaauggcccuggugccguguguccugacccucaaccaggaugggacgguuugggugaccgcggugcaggccgucagagcucuggccacaggacaguuugcuguguucuauaagggcgacgagugccuugggagcggaaaaauucugcggcucggccccuccgccuacacccugcaaaagggccagagacgcgccgggauggcuacagaaagcccuucugauucccccgaggacggaccuggccuuagcccccugcucuga

SEQ ID NO: 77308 - RNA, 4296 nt, Artificial Sequence
  derived and/or modified sequence opt5 from TRO__Homo_sapiens__NP_001034794
auggacagacggaacgauuacggcuaucgcgugccccuguuccaggggccucucccgcccccuggaagccugggccuucccuuuccucccgacauccaaaccgagacaacggaagaggauuccguccugcucaugcacacccugcuugccgcuacaaaggacucucuggccauggauccuccgguugugaauagacccaaaaagagcaaaaccaagaaagcgccuauuaagacaaucaccaaggcugcccccgccgcuccucccgugccggccgcuaacgaaauugccacaaauaaaccuaagaucaccuggcaggcgcucaaccugcccgucauuacgcagaucucccaggcccugccuaccacagaggugaccaauacacaagccucuagcguuaccgcccagcccaaaaaggcuaacaaaaugaagcgggugacggccaaggcggcccaggggucccagucucccacaggacaugaaggcgggaccauccaacucaaaagcccucugcagguccuuaagcugccggugauuucccagaauauccacgcucccauugccaacgagagcgcuucuucccaggcccucaucacaagcauuaaaccuaagaaagccucuaaggcuaaaaaggcggccaauaaggcuaucgccuccgccaccgagguuagccuggcugccaccgcgacacauacggcuaccacacaaggacagauuaccaacgaaacagccucuauccacaccacggccgcuuccauccgcacaaagaaggccagcaaagcuagaaagaccauugccaaagugaucaauaccgacacagagcauauugaagcgcuuaacgucaccgaugccgcuacacggcagaucgaggccuccgugguggcuauucgccccaagaagucuaaaggcaagaaagccgcgagcagaggcccuaauuccgucagcgagaucucugaagcuccccuggcuacgcaaaucguuaccaaccaggcccucgcugccacacugcgggugaagcgcggguccagagcccggaaagcugcgaccaaggcccgcgcuacagagagccagaccccgaaugccgaccagggagcccaagcuaagauugccucugcgcagacgaacgugagcgcucuggaaacccaggucgccgccgcugugcaggcccucgcggaugacuaccuggcucaacuuucccuggagccuacaaccagaacacggggcaaacgcaacagaaagucuaaacaccucaauggggaugaacggagcggauccaacuauagacgcauccccuggggccggagaccugcucccccucgcgacguugccauucugcaggagcgggccaauaaacuugugaaauaccugcucgucaaggaucagaccaagauccccauuaaaagaagcgacaugcugcgcgacgugauccaggaguaugaugaauacuucccggagaucauugaacgggccucuuauacgcuggagaagauguuuagaguuaaccucaaagaaaucgacaagcaauccagccuguacauucuuaucucuacacaggaguccagcgcugggauucugggaaccacaaaagauaccccuaagcucggccugcuuauggugauccuguccgucauuuucaugaauggcaacaaagccucugaggcggugaucugggaaguccuccgcaagcuggggcugcggcccggagugagacacagccucuuuggcgagguucgcaagcugaucaccgacgaguucgugaaacagaaguaccuugaauauaaacggguccccaauuccagaccuccggaauacgaguuuuucugggggcugcggucuuaucaugagacaagcaagaugaaagugcucaaguuugccugccgcguucagaagaaagaucccaaggacugggcugugcaauacagagaagccgucgagauggaagugcaggcugccgccguggcuguugcggaggccgaggcucgggccgaagccagagcucagaugggaauuggcgaggaagccgucgcggggccuuggaacugggaugacauggauaucgacugucugacgcgcgaggaacugggagaugacgcucaagccuggucccgguucagcuuugagauugaggccagagcucaggaaaaugccgacgcgucuaccaacgugaauuucucccgcggcgcuagcacaagagccggcuuuucugauggggccuccaucagcuucaacggagcucccucuagcuccggcggguucagcggaggcccugggauuaccuuuggcguggcccccucuacauccgcuagcuucuccaauaccgccucuaucagcuuuggaggcacgcuuuccacaucuagcuccuucucuagcgcggccuccaucagcuuugggugcgcucacucuaccuccaccagcuucucuuccgaggccagcauuucuuuuggaggcaugccuuguacauccgcuagcuucuccgggggagucagcucuagcuuuuccggcccccucucuaccagcgccacauucuccgggggcgccucuagcggauuuggcgggacgcuguccaccacagcuggauucucuggcgugcugagcaccuccaccagcuuugggucugcgccgacaacguccaccguuuucagcucugcccucuccacaagcaccggauucggcgggauccuguccacaucugugugcuuuggcggaagcccuuccagcucuggcuccuucgggggaacccuuagcacaucuauuuguuuuggcgggagccccugcaccuccacgggauucggcgggacacugucuaccagcgucuccuuuggcggaucuagcuccaccagcgcuaacuucggcgggacacucucuaccuccaucuguuuugacggaagcccuuccacgggcgccggguucggaggcgcccugaauacaucugcuagcuuuggcuccgugcugaacaccucuacaggguucggaggcgccaugagcaccuccgcggauuuugggggaacacuuagcaccucuguuugcuucggcgggucccccggaacgagcgugucuuuuggcuccgcucucaacaccaaugccggcuaugggggagccgucagcacaaacaccgacuucggcgggacacugucuaccagcguguguuucggaggcuccccgucuacgagcgcuggguuuggaggcgcccugaauacaaacgcguccuucggcugcgccguuagcaccuccgcuucuuuuagcggggccguguccacaucugcuuguuucagcggagccccuauuaccaaucccggcuuugggggagcuuucuccaccucugccggcuuugggggagcgcucagcacagccgcugauuucggcggcacgccuuccaacagcaucggguuuggagccgcucccucuaccuccgucagcuucggcggggcccauggaacaucucugugcuuuggcggggcccccuccaccagccuuugcuucggaucugcuuccaauacaaaccuguguuucggcggcccuccgagcaccuccgcgugcuuuagcggggccacgucucccagcuucugugacggaccuuccacaucuaccggcuuuagcuucgggaauggacucuccaccaacgcuggcuuugggggaggccugaauacaucugccggcuucgggggaggccuggggaccagcgccggauuuuccggcgggcuuucuacaagcuccggauucgauggcggccucgggacgagcgcuggauuuggcgggggacccggcaccucuacaggguucggcggaggccuggggaccuccgccggauuuagcggcgggcugggaacaucugcgggcuucgggggcggacucgugaccuccgacggcuuugggggaggccuggggacgaacgccagcuucggauccacccuuggcacaucugcuggguucagcggcggacuguccaccagcgauggcuuugggucucggccuaaugccuccuucgaccgcggacucagcacaaucauuggcuuugggucuggaagcaacaccuccacaggcuucacgggcgaacccucuaccagcacaggguuuuccucuggaccuagcuccaucgugggcuucagcgggggaccgucuaccggcgucggguuuugcuccggacccagcaccuccggcuucucuggcgggccuagcacaggagcuggcuuugggggaggccccaauacgggggccggauucggcggcgggccuuccaccucugcgggauuuggcagcggggccgcuucccugggagccuguggcuucagcuacggguga

SEQ ID NO: 77309 - RNA, 1578 nt, Artificial Sequence
  derived and/or modified sequence opt5 from TROVE2__Homo_sapiens__NP_001035828
auggaggaaagcgugaaccagaugcaaccccugaaugagaagcagaucgccaacucccaggacggcuacgucuggcagguuaccgauaugaauagacuccaccgguuccugugcuuugggucugaaggaggcacauauuacauuaaagagcaaaaacuugggcuggaaaacgcugaggcccucauccgccugauugaggacggaagaggcugugaagugauccaggagauuaagagcuucucccaggaagggcggacgaccaagcaggagccuaugcuuuuugcgcuggcuaucugcucucaauguagcgauaucuccacaaaacaggccgccuucaaggcugugucugaggucugccgcauuccgacccaucucuuuacauucauccaguuuaagaaagaccugaaggaaagcaugaaauguggaauguggggcagagcccugcggaaggcuauugccgauugguauaaugagaaaggcgggauggcgcucgcccuggcugugaccaaguacaagcagcgcaacggauggucccacaaagaccuucugagacucagccaucugaagcccucuuccgaaggccuugccaucguuacaaaauauauuaccaagggguggaaagaggugcacgaacuguacaaggagaaagcucucagcgucgagacggaaaagcugcugaaguaucucgaggccguggaaaaaguuaagcggacccgcgaugagcuggaagugauccaucuuauugaggagcacagacugguccgggaacaccuccugacaaaucaucuuaaaucuaaggagguguggaaagcgcugcuccaagaaaugccucugaccgcccugcuccgcaaccugggaaagaugacagcuaauuccgugcuugagcccggcaacagcgaagucucucugguuugcgagaagcucuguaaugagaaacugcuuaagaaagccagaauccacccuuuccauauccugauugcucucgaaaccuacaagacggggcacggacugcggggcaaacugaaguggcgccccgacgaggaaauccucaaggcccuggaugccgcuuuuuacaaaacauucaagaccguggagccuacaggcaaaagauuucuucuggcgguggacgucuccgccagcaugaaccagcgggugcucggguccauucugaaugcuucuaccguugccgccgcuaugugcaugguggucaccagaacagagaaggauagcuaugugguugccuucuccgacgaaauggugccgugucccgucacgaccgauaugacacugcagcaagugcuuauggcgaugagccagaucccugcuggaggcaccgacugcucucuccccaugauuugggcccagaaaacaaacaccccugccgacgucuuuaucguguucacggauaaugagacauucgcugggggaguucaccccgccaucgcucugcgcgaauaccggaagaagauggacauuccggccaaacugaucguguguggcaugaccuccaacggguuuaccauugcggauccugacgauagagcccuccagaacacacugcuuaauaagagcuucuga

SEQ ID NO: 77310 - RNA, 3435 nt, Artificial Sequence
  derived and/or modified sequence opt5 from TRPA1__Homo_sapiens__XP_011515926
augagcaucuccaugaagaaaggcgccagagcuagaggggagcagcugcaccaaguggccucuggagucggcagcaugaagcgcucccucagaaaaauguggcggcccggggaaaagaaagagccucagggaguuguguacgaagacgugccggaugacaccgaggauuucaaggaaucucugaaggucguguuugagggcagcgcguaugggcuucagaacuucaauaaacagaagaaacugaagcgcugcgacgauauggacacauuuuuccuccauuacgcugccgccgagggacaaauugaacugauggagaaaaucacgagagauuccucucuugaaguucugcacgagauggacgauuauggcaacacaccccuccauugugcuguggagaagaaucagauugaaagcgucaaguuucugcugucccggggcgccaacccuaaucuccgcaacuucaauaugauggcuccccugcacaucgccgugcaggggaugaacaaugagguuaugaaagugcuucuggaacauagaacaauugacgucaaccucgagggagaaaauggcaacaccgcggugaucaucgccugcacaaccaauaacagcgaggcucugcagauucuucugaagaaaggggccaagccuuguaaaucuaauaaguggggaugcuuucccauccaccaagcugccuucuccggcagcaaagaguguauggaaauuauccuccgguuuggggaggaacacggauacucucgccagcugcauauuaacuucaugaacaauggcaaggcgacaccucugcaccucgccgugcagaacggcgaucuggagaugaucaagaugugccuugacaauggggcucagauugauccggucgaaaaaggaagauguaccgccauccauuuugcugccacgcaaggcgccaccgagaucguuaagcugaugauuuccagcuauucuggguccguggacaucgugaacacaaccgacggaugccacgagacaaugcuccaccgggcuagccuguucgaucaucacgaacuugcggacuaccugauuuccgucggcgccgauaucaauaaaauugacucugaggggcgcagcccccucauccuggcuaccgccuccgccagcuggaacaucgugaaucugcuccugucuaagggagcucagguugauauuaaagacaacuuuggcagaaauuuccuucaucugacggugcagcaaccuuauggccucaagaaccugcggcccgaguucaugcagaugcagcagaucaaggaacuugucauggaugaagacaaugauggguguacaccucugcacuacgccugccgccaaggaggccccggguccgugaacaaucuccugggauuuaacguuagcauucauucuaaaagcaaggacaaaaaguccccgcugcacuucgcggcuucuuacggcagaaucaauaccugucagcggcuccugcaggauauuagcgacacaagacuucugaacgagggggaccuccacggcaugaccccucugcaucuggccgccaaaaacggacacgauaaggugguccagcuucuccugaagaaaggcgcucuguuucucuccgaccauaauggguggaccgcccugcaccacgcuagcaugggaggcuauacacaaacgaugaaggugauccuugauaccaaccugaaaugcacagaccgccucgaugaggacgggaauaccgcccugcauuucgcggcccgggaaggacacgcuaaggccgucgcucugcuucucucucauaacgccgauaucgugcugaauaaacagcaggcguccuuucugcaccucgcccugcauaacaagagaaaggagguugugcuuacaauuauccgcagcaaacggugggacgaaugccugaagauuuucucucacaauucccccggcaacaaauguccuaucaccgagaugauugaguaccuccccgaaugcaugaagguccugcuggauuuuuguaugcuucacagcacggaggacaaauccugcagagauuauuacaucgaauauaauuucaaguaccuccaguguccccuggaguuuaccaaaaagaccccuacccaagacgugauuuaugaaccgcugacagcucucaacgccaugguucagaauaaccgcaucgagcugcuuaaucaucccgugugcaaggaguaccugcucaugaaauggcuggcuuacggguuccgggcccacaugaugaaccugggcucuuauugucuuggacucaucccuaugaccauucuggucgugaauaucaagcccggcauggccuuuaacagcacagggauuaucaacgaaacguccgaucauucugagauucuggacaccacaaauagcuaccucaucaaaaccugcaugauccugguguuccuuuccagcauuuuuggauauuguaaggaagcuggccagaucuuccagcaaaaacggaacuacuucauggacauuucuaauguucuggaguggaucauuuauacaaccgggaucaucuuuguccucccucuguucguggaaauucccgcgcaucugcaguggcagugcggagccaucgcuguguacuuuuauuggaugaacuuccuucuguaccuccaacgcuuugagaauuguggcauuuucaucgucaugcuggaggugauucucaagacgcugcuucgguccaccguuguguuuaucuuccugcuccuggccuuugggcugagcuucuacauccuucugaaccuccaggauccguuuucuuccccucugcucagcauuauccagacauucucuaugaugcugggcgacauuaauuauagagagagcuuucuugaacccuaccugcgcaacgaacucgcccacccuguccuguccuucgcucagcuggugagcuucaccaucuuuguucccauugugcuuaugaaucugcucaucggacuggccgucggcgauauugcggaggugcaaaagcacgcuucucucaaacggaucgccaugcagguugaacugcacacaucccuugagaagaaacugccucugugguuccucagaaagguggaccagaaaagcaccaucgucuaucccaacaagccgcgguccgggggaaugcuguuucauauuuucugcuuucuuuucugcacgggcgagauccgccaggaaauuccuaaugccgauaagucucuggagauggaaauccucaaacaaaaguacagacugaaagaccucacauuucugcuugagaagcagcacgagcugauuaaacugaucauccagaagauggaaauuaucagcgagaccgaagaugacgauucccauuguucuuuccaggaccgguuuaagaaagagcaaauggaacagagaaacagccgcuggaauacagugcuccgggcugugaaggccaaaacccaccaccuggagcccuga

SEQ ID NO: 77311 - RNA, 2382 nt, Artificial Sequence
  derived and/or modified sequence opt5 from TRPC1__Homo_sapiens__NP_001238774
augauggccgcucuguaccccagcaccgaccucuccggcgccucuagcuccucucugccuagcuccccgucuagcuccagccccaacgaggugauggcgcuuaaggaugucagagaaguuaaagaggaaaauacacugaacgagaagcucuuucugcuugcuugcgacaaaggggauuauuacauggugaagaaaauccuggaagaaaauucuuccggagaccucaacauuaauuguguggauguccugggccggaacgccgugacgaucaccauugagaaugaaaaccuggacauccuccagcugcuucuggauuaugggugccaaagcgccgacgcucuccugguugccauugauucugagguggucggagcuguggacauccuucugaaucaccgcccuaagagauccagccggcccacaaucguuaagcucauggaacgcauucagaacccugaguacucuaccacaauggauguggcccccgucauccuggcggcccauagaaauaacuaugagauucugaccaugcuccugaaacaggacgugucccuuccuaagccgcacgcugugggcugugaaugcacacuguguagcgccaaaaauaagaaagauucccuccggcauucucgcuuuagacuggacaucuaccggugccuugcuagccccgcccugauuaugcucaccgaggaagacccuauccugcgcgcguucgagcuguccgccgaucucaaggaacugagccuugucgagguugaguuuagaaacgacuaugaggagcuggcucggcaguguaagauguucgccaaagaucuccuggcucaagcccgcaauucuagagaacuugaggugauucugaaccacacguccagcgacgaaccccucgauaagcgggggcugcuggaggagcgcaugaaccucucuagacugaaacuugccaucaaguacaaucagaaagaauuugugagccaguccaacugccagcaauuccugaauaccgucugguuuggacagaugucuggcuaccggagaaagccuacauguaaaaagaucaugaccgugcucacaguuggcauuuucuggcccgugcugagccugugcuaucuuaucgcuccgaagucccaguuugggcgcauuauccauaccccuuucaugaaauuuauuauccacggagcgagcuacuucacguuucuccugcugcucaaccuguauucucuugucuacaaugaggacaagaaaaacacaaugggccccgcccuggaacggaucgauuaucuccugauucuguggaucauugggaugaucugguccgacauuaagagacuuugguacgagggacucgaagauuuccuggaggagagccgcaaucagcugucuuucgugaugaacucccucuaucuggcuaccuuugcccuuaaaguuguggcccacaauaaguuccaugacuuugcugaucggaaggacugggacgccuuccacccuacacuggucgcggaaggccucuuugcuuucgccaacgugcugagcuaccugagacuuuucuucauguacaccaccuccucuauccucgggccccugcaaaucagcaugggacagaugcugcaggauuuuggcaaauuccucggcauguuucugcuuguccuguucuccuuuacaauugggcucacgcaacuguaugacaagggauacaccucuaaagagcagaaggauugugugggcaucuucugcgaacagcagagcaaugacacauuccauuccuuuauugggaccugcuucgcccuguuuugguauaucuucagccuugcucacguugccauuuuugugacacgcuucucuuacggagaggagcuccaauccuuugucggcgcugugaucguugggaccuauaacguggucguggugauuguucugacgaaacugcucgucgccaugcugcacaagagcuuccagcuuaucgcgaaucaugaagauaaggaguggaaauuugcccgggcuaagcuguggcucucuuacuucgacgauaaauguacacugcccccuccguuuaacaucauucccuccccuaagaccaucugcuauaugauuagcucucugagcaaauggaucuguucccacaccagcaagggaaaggugaaaagacaaaauucucuuaaggaauggcgcaaccugaaacagaagcgggacgagaacuaccagaaagugaugugcugucucguccauagauaccugacauccaugcgccagaagaugcagagcaccgaucaggccacaguggaaaaucucaacgagcugcggcaagaccuuuccaaauucagaaaugagauucgggaucugcucggcuuucgcacgucuaaguaugcuauguucuaccccagaaacuga

SEQ ID NO: 77312 - RNA, 2766 nt, Artificial Sequence
  derived and/or modified sequence opt5 from TRPC3__Homo_sapiens__NP_001124170
augagcaccaaggugagaaaaugcaaggagcaggcccgggucacauuccccgcuccugaagaggaagaggacgaaggcgaggaugagggggccgaaccgcaacgcagacggcgcggauggagaggcguuaacgggggacuggagccccgguccgcgccuucucagcgcgaaccccacggcuacuguccucccccuuuuagccaugggccggaccucuccauggagggaucucccagccugagacggaugacggugaugcgcgagaaaggcagacggcaggcugugcgcggcccugccuucauguuuaaugauagagggaccucccuuacagccgaagaggaacgguuccuggacgcugccgaguauggaaacauccccgucgugcgcaagaugcucgaagagucuaaaacccugaauguuaacugcguggauuacaugggccagaaugcccuucaacuggcugucgggaacgagcaccucgaagugacagagcugcugcucaagaaggaaaaucuggcgagaauuggagacgcccuucugcucgcuaucagcaaaggcuauguucggauuguggaggccauccugaaccauccuggguuugcugccuccaagagacuuacccugagccccugugaacaggagcuccaggaugacgauuucuacgcguaugacgaggauggaacacgcuuuucuccggacauuaccccuaucauccuggccgcucacugccagaaauacgaagucgugcauaugcugcucaugaagggcgcccggauugagagaccccacgauuauuucuguaaaugcggcgacuguauggaaaagcaacgccacgacuccuuuagccauucucgguccagaaucaaugcuuacaaggggcuggccagcccugccuaccuuucucuguccagcgaggaucccgugcucacggcucuggaacuuuccaacgagcuggcgaaacucgccaauauugagaaggaguucaaaaacgacuaucgcaagcugucuaugcagugcaaagauuuugucguuggagugcuggaccucugucgggauagcgaagaaguggaggcuauccugaauggcgaccuugaguccgccgaaccccuggagguccacagacauaaggccagccucucucgcgugaaacuggcuauuaaguacgaaguuaagaaauucguggcccacccuaacugccagcagcaacuucugaccaucugguaugagaaucucuccgggcugcgggaacagacaauugcgaucaagugucuggucgugcucguuguggcucugggacuuccguuucuggccaucggcuacuggauugcccccugcagcagacucgggaaaauccugcgcucuccuuucaugaaguucgucgcucacgccgcuagcuuuauuaucuuccugggacuucucguguuuaacgccuccgaucgguucgagggcauuaccacacugcccaacaucaccgucacggacuauccuaaacagaucuuuagagugaagacaacccaauucacauggaccgagaugcugauuaugguuugggugcucggcaugauguggucugaaugcaaggagcuguggcuugaagggccccgggaguacauccugcagcucuggaauguccuggauuuuggaaugcugagcauuuucaucgcggccuuuaccgcucgcuuccuugccuuucuccaggcuacaaaagcccagcaauauguggacuccuacguucaggaaagcgaucugucugaggugacgcugccgccugagauucaguacuucaccuaugcgagagacaaguggcuccccuccgacccucagaucaucagcgaaggccuguacgccauugcugucgugcuuucuuuuucccggaucgccuauauucugcccgcuaacgagagcuucgggccucuccaaaucucccugggaagaacagugaaagauauuuucaaguuuaugguucuguucaucauggucuuuuucgccuuuaugauuggcauguucauccuuuacucuuauuaccucggggccaaagugaaugcugcguuuaccacaguggaagagagcuucaagacccuguuuugguccaucuucggccugucugaagucacgagcgugguucucaaguaugaccauaaauuuauugagaacaucggauacgugcuguacggcauuuauaaugucacaauggugguugugcuucugaacaugcucaucgccaugauuaauuccagcuaccaggagaucgaagaugacucugaugucgaguggaaguucgcucgcuccaaacuguggcugagcuauuuugacgaugggaagacccuucccccgccuuucucucucgugcccucccccaagagcuucguuuacuuuaucaugcggauugugaacuucccuaaauguagacgcagacggcugcagaaggacaucgaaaugggaaugggcaauucuaaaagccgccugaaccucuuuacccaguccaauagcagagucuucgagucucacuccuuuaacagcauucugaaucaaccgacacgguaucagcagaucaugaagcgccuuauuaaaagauacgugcugaaggcccagguggauaaagagaacgacgaagucaaugagggggaacucaaggagaucaaacaagauaucuccucucugcgguaugaacugcuugaggacaagagccaggccaccgaggaacuggcuauucucauccauaagcuguccgagaaacucaaccccucuaugcugcgcugcgaauga

SEQ ID NO: 77313 - RNA, 2370 nt, Artificial Sequence
  derived and/or modified sequence opt5 from TRPC4AP__Homo_sapiens__NP_955400
auggccgcugcccccguggcggcuggcagcggggccggaagaggccggcgcuccgccgcuaccgucgccgcuuggggaggauggggcgggagaccucggccgggaaacauccugcuccagcugcgccaaggccagcuuacaggcagagggcugguucgggccgugcaguucacggagaccuuucucacagaacgcgacaagcagucuaaauggagcgggauuccccaacugcuucugaagcuccacaccacaucccaucugcacucugauuucguggagugccagaauauccugaaagaaauuagcccucuccuguccauggaggcgauggccuuugucaccgaagagagaaaacuuacacaggagaccacguaccccaacaccuauaucuucgaccuguuuggcgggguggaucuccugguugaaauucuuaugcggccuacaaucucuauccgcggacagaagcugaagauuagcgacgagauguccaaggauugucucagcauccuguacaauaccugcguguguacagaaggcgucaccaaaagacuggcugagaagaacgacuucgugauuuuucucuucacgcugaugacaucuaaaaagaccuuucuucaaacagccacccugaucgaggauauucucgggguuaaaaaggaaaugauccggcuggacgaggugcccaaucuuuccagccuggucucuaacuucgaucagcagcagcucgcuaauuuuugccgcauucuggccgugaccaucuccgaaauggacacaggaaacgaugacaagcauacgcugcucgcgaaaaaugcccaacagaagaaaagccugucucuuggcccuuccgcugccgagaucaaccaggcugcccugcucagcauuccgggcuucguggaaagacuguguaaacuugccacccggaaggucuccgagucuacagggaccgcuagcuuucugcaagagcucgaagagugguauacauggcuggauaaugcgcugguucucgacgcccugaugcgcguggcuaacgaagaguccgaacacaaucagggagccagcgaggagaacggccuuccccauaccucugccagaacgcagcugccucaguccaugaagaucaugcacgaaauuauguacaaacucgaggugcuguauguccugugcgugcuucucauggggcggcaaagaaaucagguucaccgcaugaucgcugaguucaagcugauucccggacugaacaaccucuucgacaagcugaucuggcggaaacauagcgccucugcgcuugugcugcacggccauaaucagaacugugauugcagcccugacaucacacucaagauucaguuucugagacugcuucaauccuucucugaucaccacgaaaauaaauaccuccugcugaacaaucaggaacucaacgagcugagcgcuaucucccuuaaggccaauauucccgaggucgaagccgugcugaacaccgaccgcagccucguuugugaugggaaacggggacugcugaccagacuucuccaggugaugaagaaggagccggcugaaucuuccuuucgcuucuggcaggcccgggcugucgagagcuuucugagaggcacaaccucuuaugccgaccaaauguuccugcucaaacgcggccugcuugagcauauccuguacugcauuguggauuccgaauguaagagccgggacguccuccaguccuacuuugaucugcugggggagcuuaugaaauucaauguggacgcguuuaagagauucaacaaauauaucaauacagaugccaaguuucagguuuuccucaagcagaucaacucuagccugguggacuccaauaugcugguccgcugcgugacgcucucucuggaccgguuugaaaaccaaguugauaugaaaguggcugagguccuuagcgaaugcagacugcucgccuacauuucccaggugccuacccagaugagcuuccuguuccggcugaucaauauuauccacgugcaaacacuuacccaggagaacguuucuugucugaacacaucccucgucauucugaugcucgcucgcagaaaggagcggcugccccuuuaucugagacuccugcagcgcauggaacauagcaaaaaguacccuggauuucugcuuaauaacuuccacaaucugcuccgguuuuggcagcaacauuaucugcacaaagacaaggauucuaccugccucgagaacuccagcuguaucucuuucagcuacuggaaggaaacgguguccauucugcuuaaucccgacagacagagccccucugcccugguguccuauaucgaggaaccuuacauggauaucgaccgcgauuuuaccgaggaguga

SEQ ID NO: 77314 - RNA, 2682 nt, Artificial Sequence
  derived and/or modified sequence opt5 from TRPC4__Homo_sapiens__NP_001129427
auggcccaguucuacuauaagagaaacgugaaugcucccuaccgggaccgcaucccucugagaauuguccgggccgagagcgaacucuccccgucugagaaagcguaucugaacgcuguugaaaagggcgauuacgccagcgugaaaaagucccuugaggaagccgagaucuauuuuaaaauuaauaucaacugcauugacccccuggggcgcaccgcucuccugaucgccaucgagaaugaaaaccuugagcugauugaacuccugcugucuuucaauguguacgucggagaugcucuccugcacgccaucagaaaggaggugguuggcgcgguggagcuucugcucaaccauaagaaaccuagcggggaaaagcaagugcccccuauucugcuugacaaacaguuuuccgaguucacacccgauaucacgccuauuauccuggccgcucacaccaauaacuaugaaauuaucaagcuccugguccagaaaggaguuucugugccgcggccccaugagguccgcuguaauugcguggaaugugugagcuccagcgacgucgauucucugagacacucccggagccgccucaacaucuacaaggcccuggcuucuccuucccuuauugcccugagcucugaggaccccuuucucacagcguuccagcuguccugggagcuucaagaacugagcaagguugagaaugaauuuaaauccgaguacgaagaacucucuagacagugcaagcaguucgccaaagaucugcuggaccagacccggagcucccgcgagcucgaaaucauucugaacuauagagaugacaauagccuuaucgaggaacaaucuggcaacgaucuggcucggcucaagcuggccauuaaauaccgccagaaggaguuuguggcucagccuaacugucagcaacuucuggccuccagaugguaugacgaguuccccggguggcggagacgccauugggccgugaaaauggucacaugcuuuaucaucggacuccuguucccgguguuuagcguuuguuaccugauugcuccuaagucuccccucggccuguucauccggaagccuuucauuaaauuuaucugccacaccgcgagcuaucuuacauuccuguuucuccugcugcuugccucccagcacauugacagaucugaucucaaucgccagggcccuccgcccaccaucguggaguggaugauccugcccuggguccugggguucauuuggggagagaucaagcaaaugugggacggcgggcuccaggauuacauucaugacugguggaaccugauggauuuugugaugaauagccuuuaucuggcuacgaucucccucaaaauuguugccuucgugaaguacagcgcccugaacccccgggaaucuugggacauguggcacccuacccuggucgcugaggcccuuuuugcgaucgcuaauauuuucuccagccucagacugaucucucuguuuacagccaacucccaucucggaccccugcagaucagccuuggccgcaugcugcucgauauucugaaauuccuguuuaucuacugucuugugcuccuggccuucgcuaaugggcugaaccagcucuauuuuuacuaugaagagaccaagggacugacaugcaagggcauucggugugagaaacaaaauaacgccuucuccacccuuuucgaaacgcugcagucucucuuuuggagcaucuucggccugauuaaucuguacgucacaaacgugaaggcucagcacgaguuuaccgaguucguuggggccacaauguuuggaaccuauaaugugaucucccuugucgugcuccugaacaugcugaucgcgaugaugaauaacucuuaccagcucauugccgaccacgcugauaucgaauggaaauucgccagaaccaagcuguggaugagcuauuuugaagagggcgggacacuuccuacgcccuucaacguuauuccguccccuaaaagccugugguaccucaucaaguggauuuggacccaucugugcaagaaaaagaugcgccggaaacccgagucuuuuggaacaaucggcagacgcgcugccgacaaucugcggagacaccaucaauaccaggaagugaugcggaaccuugucaagcgcuauguggcggccaugaucagagaugcuaaaaccgaggaagggcugacagaggaaaauuucaaggagcucaagcaggacauuuccagcuuucgguucgaggugcugggacuccugagaggcucuaaacuuuccaccauccagagcgccaacgcuucuaaggaaagcuccaauagcgccgacucugaugagaaauccgacagcgaagaggaaguugcccgccaacaggcugcgggcccucuggagcggaacauucagcucgaguccagagggcuggccucucgcggagaucugagcauccccggccuuuccgaacagugcguccugguggaccacagagagcggaauacggauacacucgggcugcaagugggaaagcgcgucuguccuuuuaaaucugaaaaggugguuguggaggacaccguccccauuaucccgaaagagaagcaugcuaaggaagaggauagcuccaucgacuacgaucucaaccugccugacaccgugacacacgaagauuauguuaccacaagacuuuga

SEQ ID NO: 77315 - RNA, 2922 nt, Artificial Sequence
  derived and/or modified sequence opt5 from TRPC5__Homo_sapiens__NP_036603
auggcccagcuguacuauaagaaagugaacuacagccccuauagagaccggaucccucuccaaauuguccgcgcugagaccgaacuguccgccgaggaaaaggcguuccuuaaugcuguugagaaaggcgauuacgccacagugaagcaggcccugcaggaagcugagaucuauuacaacgugaauauuaacugcauggacccgcucgggagaucugcccugcuuaucgcuauugagaaugaaaaccuggagaucauggaacuccugcugaaucacagcgucuaugugggagaugcccuccuguacgcgauccggaaagagguugugggcgccgucgagcuucugcucuccuaccgcagacccucuggggaaaaacaggugccuacgcugaugauggacacccaauuuagcgaguucacacccgauauuaccccuaucaugcuugcugcccauacaaacaauuaugaaauuaucaagcugcucguucagaagcgggugaccauuccccgcccucaccagaucagauguaacugcgucgaguguguguccucuagcgaaguggacucccugcggcauagccgcucuagacugaauauuuacaaggcucucgccuccccgagccugaucgcgcuuucuuccgaggaucccauccugacagccuuucggcucggaugggagcugaaagaacuuagcaaggucgagaacgaguucaaagcugaguaugaagaacugucucagcaaugcaagcucuuugccaaggaccugcuggaucaggcucgcuccagcagagagcucgaaauuauccugaaucaccgggacgaucauuccgaggaacuugacccucagaaauaccacgaucuggccaagcucaaaguugccauuaaguaucaccagaaagaguucguggcucaacccaacugucagcagcugcuugcgacccugugguacgacggcuuuccuggguggcgcagaaagcauuggguggucaaacuccugacgugcaugaccaucggauuccuguuucccaugcucucuauugccuaucugaucagcccgcgguccaaucuuggccuguucaucaagaagccuuuuauuaaauucaucugucacacagcuagcuaccucaccuuucuguucaugcugcuucucgccucucaacauauugugagaacagaccugcacguucaggggcccccucccaccguggucgaauggaugauccugcccugggugcucggguucauuuggggagagaucaaggagaugugggauggcggguuuacggaauacauccacgacugguggaaccugauggauuucgccaugaacucccuuuaucuggcuacaauuagccucaaaaucguugccuacgugaaguauaauggaucucgcccucgggaggaaugggagauguggcauccgacccugauugcggaggcucuguuugccaucagcaacauucuuuccucucucagacugaucagccuguucacagccaauucccaccucggcccccugcagauuagccuugggcgcaugcugcucgacauccugaaauuucuguucaucuacugccuuguccuccuggcuuuugccaacggacugaaucagcucuauuucuacuaugaaacccgggcuauugaugagccuaacaauuguaagggcaucagaugcgaaaagcaaaacaaugccuuuucuacccuguucgagacacuucagucccuguuuuggagcguguucggccuccugaaccuguacgucacgaaugugaaagcgcgccaugaauuuaccgaguucguuggggccacaauguucggaaccuacaacgugauuucucuugucgugcuccugaauaugcugaucgcuaugaugaacaauuccuaucagcucauugccgaccacgcugauaucgaguggaaguuugcccggacaaaacuguggaugagcuacuucgacgaaggcgggacccuucccccucccuuuaacaucauuccguccccuaagucuuuccuguaucucggaaacugguuuaauaacacguucugucccaaaagagauccugacggccgccggagacgccggaaucugcggagcuuuacagagcggaacgcggauucccugauccagaaucaacauuaccaggaaguuauucgcaaccuugugaagagauaugucgccgcuaugaucagaaauucuaagacccacgaggggcugaccgaagagaacuucaaagagcucaagcaggacauuagcuccuuuagauacgaagugcuggaccuccugggaaaucgcaaacacccccggagcuucucuacauccagcaccgagcuuucucagagagaugacaacaaugauggcuccggcggggcccgcgcuaagagcaaaucugugagcuuuaaccugggaugcaagaagaaaacaugccauggcccuccccucaucagaacgaugccgcgguccagcggggcccaaggaaagucuaaagccgaauccagcuccaagcgcucuuucaugggcccuagccugaaaaagcuggggcuucuguuuuccaaauucaauggccacaugucugagcccagcuccgaacccauguauaccaucucugacggaauuguucagcagcauuguauguggcaggauaucagauacagccaaauggagaagggcaaggcugaggcgugcucccagagcgaaauuaaccucucugaggucgaacugggggaggugcagggagccgcucaauccagcgaguguccucucgccuguucuuccagccugcacugcgccucuuccaucugcagcuccaauagcaaacuucuggacucuagcgaagauguguucgagacauggggcgaggcuugugaccuccugaugcacaaguggggcgauggacaggaagaacaggucaccacacggcuguga

SEQ ID NO: 77316 - RNA, 2796 nt, Artificial Sequence
  derived and/or modified sequence opt5 from TRPC6__Homo_sapiens__NP_004612
augagccagucccccgccuucggcccuagacgggggucuagcccgcgcggagcugccggcgcggcugccagacggaacgagucccaagacuaccugcucauggauucugaacugggggaggacggaugcccccaggccccucuucccuguuauggcuacuauccuugcuuucgcgggagcgauaauagacuggcucaccggcgccagaccgugcucagagaaaagggacggcgccuggccaacagaggccccgcuuacauguucuccgaccggucuacaagccuuuccaucgaggaagaacgcuuucuggaugccgcggaguauggcaauauuccugucguuagaaaaaugcucgaagagugucauagccugaacgugaauugcguggacuacauggggcagaacgcccugcaacucgcugucgccaaugaacaccuggagaucacggagcuucugcucaagaaagaaaaccugucucgggugggagaugcccuucugcucgcuauuuccaagggcuauguucgcaucguggaggcgauucugagccauccggccuucgcugaagggaaaagacuggccaccucucccucccagagcgagcuccagcaggacgauuuuuacgcuuacgacgaagauggaacacgguucucucacgacgucaccccuaucauccuggccgcccauugucaagaguaugagauugugcacacacuucugagaaagggcgcucgcaucgaacggccccacgauuacuuuugcaaguguaaugacugcaaccagaaacagaagcaugacuccuucagccacuccagaucucgcauuaaugcguauaaagggcucgccagcccugcuuaccugucccuuagcucugaggaucccguuaugaccgcccuggaacucuccaacgagcuggccgugcuggcuaauaucgaaaaggaguuuaaaaacgacuauaagaagcucagcaugcaguguaaagauuucgucgugggacugcuugaccugugccggaauacagaggaaguggaggccauucucaacggcgaugucgaaacccugcaaucuggcgaccaugggagaccgaaccuuagccgccugaagcucgcgaucaaauacgagguuaagaaauuuguggcucacccuaauugucagcagcaacugcuguccauuugguaugaaaaccucucuggacugcggcagcagacgauggccgugaaguuccuugucgugcuggccguugcuaucggccuccccuuucuggcccugaucuacugguucgcuccuugcagcaaaauggggaagauuaugagaggacccuucaugaaguuuguggcccacgcggccuccuucaccaucuuucuuggccuccuggucaugaaugcugccgaucgcuucgaggggacaaaacugcuccccaacgagaccagcacagacaaugcuaagcagcuguuucggaugaaaaccucuugcuucuccuggauggaaaugcuuauuaucagcugggugauuggaaugaucugggccgaguguaaggaaaucuggacgcaaggcccuaaagaguaccuguuugagcucuggaacaugcuggauuucggcaugcuggcgauuuuugccgcuucuuucaucgccagauuuauggcuuucuggcaugccuccaaggcccagagcauuaucgacgcuaaugauacacuuaaggaccucaccaaaguuacacugggggacaacgugaaguauuacaaucuggcgcgcauuaaaugggauccguccgacccccagaucaucucugaaggacucuaugccauugcugucgugcugagcuuuucccggaucgccuacauucuuccugccaacgagucuuucggcccccugcagaucagccucgggagaaccgucaaggauauuuucaaauuuauggugaucuucauuaugguuuuuguggcuuucaugaucggaauguuuaaucuguauuccuacuauaucggcgccaagcaaaacgaagcguucaccacagucgaggagagcuuuaagacgcuguucugggcuauuuuugggcuuucugaggugaaauccguugugaucaauuacaaccacaaguucauugagaauaucggcuacguccucuauggaguguacaacgugaccaugguuauuguccugcugaacaugcucaucgccaugaucaauagcucuuuucaggaaauugaggacgaugccgacguggaauggaaauucgcucgggccaagcugugguuuuccuauuucgaggaaggccgcacacuuccugugcccuucaaccuggucccgagcccuaaaucucucuuuuaccugcugcuuaagcucaagaaauggaucagcgagcuguuccaggggcauaagaaaggauuucaggaggaugcggaaaugaauaagauuaacgaggagaaaaagcugggcauccucgggucccacgaagaccugagcaaacuuucucuggauaagaagcaagugggacauaauaaacagcccuccauuagaagcuccgaagacuuccaccucaacucuuuuaauaacccuccccggcaguaucagaagaucaugaaaagacugaucaagcgcuacguucugcaagcucagauugauaaagagagcgacgaggugaaugaaggcgagcuuaaggaaaucaagcaggauauuuccucucugcgguaugagcuccuggaggagaaaagccaaaacaccgaagaccucgccgaacugaucagagagcuuggggaaaagcuguccauggagccuaaucaggaggaaacaaaccgcuga

SEQ ID NO: 77317 - RNA, 2241 nt, Artificial Sequence
  derived and/or modified sequence opt5 from TRPC7__Homo_sapiens__NP_001161048
augcugagaaacagcaccuucaagaauaugcagcggcgccacacaacgcucagagagaaaggccggcgccaagccaucagagggcccgcuuacauguuuaacgaaaagggaaccucccugacaccugaggaggaacgguuccuugacucugccgaauauggcaauauuccggugguccgcaaaaugcuggaggagagcaagacccucaacuuuaauugcguugauuacauggggcagaacgcgcugcagcuugcugugggaaaugaacaucuggaggugacagaacuccugcugaaaaaggagaaccucgccagagucggcgacgcccugcuucuggcuaucuccaagggguaugugcggauuguugaggccauccucaaucaccccgcuuucgcccagggacaacgccugacccuuucuccucuggaacaggagcucagagaugacgauuuuuacgcguaugacgaagauggcacacgguucagccaugacauuacccccaucauccuggccgcucacugucaggaguacgaaauugugcauauccugcuccugaaaggcgcccgcauugagagaccucacgauuauuuuugcaaguguaacgagugcacggaaaaacagcggaaggacuccuucucucacagccgcuccagaaugaaugcuuacaaagggcuugccagcgcggccuaccugucucucuccagcgaggaucccguccugaccgcucuugaacugucuaacgagcucgcccggcuggcuaauaucgaaacagaguuuaagcugggaagaacccuccgcuccccuuucaugaaguuuguggcccaugccguuagcuucacaauuuuucugggccuucugguggucaacgcuucugaccgguucgagggggugaaaacccucccgaaugaaacguucacagauuaucccaagcaaaucuuuagagugaaaaccacacaguucuccuggaccgagaugcugauuaugaaguggguccuuggaaugaucuggagcgaauguaaagagaucugggaagagggcccucgcgaguacguucugcaccucuggaaccugcuggacuuugggaugcucuccauuuucguggcgucuuuuaccgcccgguucauggcuuuucugaaggccacagaagcccagcuuuauguggaccagcauguccaagaugacacgcugcacaacgugagccucccgccugagguugcuuacuucaccuaugccagagauaaaugguggcccuccgacccgcagaucauuagcgaaggacuguacgcgaucgcugugguccugucuuuuucccgcauugccuauauccuuccugccaaugagagcuucggcccccuccagaucucucugggccggacagugaaggauauuuuuaaguucaugguuaucuuuauuaugguguucgucgcuuucaugaucgggauguuuaaccuguacagcuacuauagaggagccaaauacaauccugcuuucaccacaguggaggaauccuuuaagacccucuucuggucuauuuuuggccugagcgaggucaucuccgugguucuuaaauaugaccacaaguucaucgaaaacauuggguacgugcuguauggagucuacaaugugacgaugguugugguccuccugaacaugcugaucgccaugauuaauaacagcuaucaagagaucgaagaggaugcggacguggaguggaaauuugcccgcgcuaaacuuuggcucucuuacuucgaugaaggccggacacugcccgcccccuuuaaucuggugccuucccccaagagcuucuacuaucucauuaugagaaucaagaugugccugauuaaacuuuguaagucuaaggcuaaauccugcgagaacgaccuggaaauggggaugcucaauagcaaguuuaagaaaacccgcuaccaggccggaaugcggaacuccgagaaucugaccgcgaacaauacacugucuaagcccaccagauaucagaaaaucaugaagcggcuuaucaaacgcuacguucucaaggcccaggucgauagagaaaacgacgaggugaacgagggcgaacugaaggagauuaaacaagacaucagcucccugcgguaugaacuccuggaggaaaagucucaggcuacaggcgagcuugccgaucugauucagcagcucagcgagaaauucgggaagaaucugaacaaagaccaucugagagugaauaagggaaaagauaucuga

SEQ ID NO: 77318 - RNA, 4929 nt, Artificial Sequence
  derived and/or modified sequence opt5 from TRPM1__Homo_sapiens__NP_001238949
augagcuccuucaagagaggcucucugaaaagcuccaccucugggagccagaagggacaaaaauccuggaucgagaagacauuuugcaaacgggaauguauuuucgugauccccucuaugaaggacagcaaccgcugcuguugcggccaguuuacgaaucagcacauuccuccgcuccccuccgccaccccuagcaagaacgaggaagagucuaaacaggucgaaacacaacccgagaagugguccguugcuaaacauacccagagcuacccuacagauucuuauggggugcuggaguuccagggaggcggguacuccaauaaggccauguauaucagagugagcuacgacaccaaacccgauucucuucugcaccucauggucaaggacuggcagcuggaacuuccuaagcugcucauuuccgugcauggaggccugcaaaacuuugagaugcagccgaaacugaagcagguuuucggcaaagggcucaucaaggcggcuaugacaaccggagccuggaucuuuacgggcggggugagcaccggagucauuucccacgugggcgaugcccugaaagaccauucuagcaagucccgggggcgcguuugugcuaucggaauugcccccuggggcaucguggaaaauaaagaggaucuugucggcaaggacgugacaagaguguaucagaccaugagcaacccucugucuaagcucuccguccugaauaacagccacacacacuucauucuugcugauaaugggacccugggaaaauacggcgccgagguuaagcuccggcgccugcuggaaaaacauaucucucuccaaaagauuaacacgagacuggggcagggagugccccuugugggccuggucguggaagggggaccuaauguugugagcaucguccucgaauaucugcaggaggaacccccgaucccugugguuauuugcgacggcuccggccgggcgucugauauccuuagcuuugcccacaaauacugugaggaagggggaauuaucaacgaaucccugcgcgagcaacuccuggugacaauucagaagaccuucaauuacaacaaggcucagagccaucagcuguuugccaucaucauggaaugcaugaaaaagaaagagcucgucacaguguucagaaugggcucugaagggcaacaggacauugagauggcuauccugaccgcccuucugaagggaaccaaugucuccgcgcccgaucagcucagccuggcccuugcuuggaaccggguggacauugcccgcucucagaucuuuguuuucggcccucacuggccuccccuggggucccucgcucccccgacagacagcaaagccacggagaaggaaaagaaacccccuauggccaccacaaagggcggaagaggcaaagggaaggggaaaaagaagggcaaagugaaggaggaagucgaggaagagaccgauccccggaaaauugagcugcugaacugggugaaugcucucgaacaagcgaugcuggacgcccuuguucuggaucgcguggacuucgucaagcuccugaucgagaacggggugaauaugcagcacuuucugacaaucccuagacuugaggagcucuauaacacccggcugggacccccgaauacgcugcaucuccuggugagagauguuaaaaaguccaaccuuccucccgacuaccacauuucucugaucgauauuggccucguccuggaguaucugaugggaggcgcuuaccgcuguaauuauacacggaaaaacuucagaacccuuuacaauaaccucuuuggaccuaagcgccccaaggcccugaaacugcucggcauggaagacgaugagccucccgccaaggggaaaaagaaaaagaagaaaaagaaagaagaggaaaucgacauugauguggacgacccggcugugagccgguuccaguauccuuuucaugagcugauggucugggccgugcuuaugaagagacagaaaauggcgguuuuccuguggcaacgcggagaggaauccauggcuaaggcccucguggccugcaagcuguacaaagcuauggcccacgagucuagcgaauccgaucuggucgacgauaucagccaggaccuugauaauaacucuaaggacuuuggccagcucgcucuggagcugcucgaucaguccuacaaacaugacgaacaaauugccaugaagcugcuuaccuaugagcugaaaaauuggagcaacucuacaugucucaagcuggcgguggccgcuaagcaccgggauuucaucgcccauaccugcucccagaugcugcuuacagacauguggauggggagacuccgcaugcggaaaaaucccggacugaagguuaucaugggcauucugcugcccccuacgauccucuuucuugaguucagaaccuacgaugacuuuagcuaucagacaucuaaagaaaacgaggaugggaaggaaaaagaggaagagaacaccgacgcuaaugccgacgcgggcagccgcaagggagaugaggaaaacgagcacaaaaagcaacgguccauuccgaucggcacaaagauuugcgaguucuacaaugcccccaucgugaaauuuugguucuauaccaucagcuaccugggguaucuccugcuguucaacuacgucauucuugugagaauggacggauggccuucucugcaggaguggaucguuauuuccuacaucgugagccucgcucuggagaagauucgggaaauccucauguccgagcccggcaaacugucucagaagaucaaagucuggcuucaggaauauuggaauauuacggaucugguggccaucagcaccuuuaugauuggggcuauccuccgccugcaaaaccagccuuacaugggauauggcagagugauuuacugugucgacaucaucuucugguauauucggguucuggauaucuuuggggugaauaaguaccuuggccccuaugugaugaugauuggaaagaugaugaucgacaugcuguacuucgucgugauuaugcucguugugcugauguccuuuggcgucgccagacaggccauccuccacccugaggaaaaacccucuuggaagcuggcucgcaacauuuucuacaugccguauuggaugaucuacggggagguguuugcggaucagaucgaccuuuaugccauggagauuaauccucccugcggagaaaaccuguacgaugaggaaggcaaacggcucccucccuguaucccgggggcuuggcugaccccugcccugauggccugcuaucuucugguugcuaauauucuccuggugaaccuccugaucgccgucuucaauaacacauuuuucgagguuaagagcauuuccaaucaaguguggaaauuucagagauaccagcuuaucaugacauuccaugaccgccccgugcugccuccucccaugaucauucugucucacaucuauauuaucauuaugagacucagcggacggugucgcaagaagagagaaggcgaucaggaggagcgggaccgcggccugaaacuuuuucuguccgaugaggaacucaagagacugcacgaguucgaagaacaaugcguccaggagcauuuccgggagaaagaagacgagcagcaaucuagcuccgacgaacgcaucagagugaccagcgagcggguggagaacaugucuaugcgccucgaagagaucaacgaaagagagacguuuaugaagacaucccugcagaccgucgaucuucggcuggcgcagcuggaggaacucagcaauagaaugguuaacgcucuggagaaucuugccgggauugaccgcucugaucugauccaggcccgguccagagcuagcuccgaaugugaggccacauaccuccugcgccaaagcucuauuaacagcgcggacggauacucccucuaucgguaccacuucaauggcgaggaacugcuuuuugaagauaccucucugagcaccucccccgggacaggagugcgcaaaaagacgugcucuuucagaaucaaggaggagaaagacgugaagacccaucuggucccggaaugucagaacagccuccaccugucccuuggcacaucuaccagcgcuacacccgaugggucccaucuggccguggacgaucucaaaaaugccgaggaaagcaagcugggaccugacauuggcaucucuaaagaggaugacgaacggcagaccgacuccaagaaggaggagacgauuagccccucucucaacaaaacagauguuauccacggccaggacaaguccgaugugcaaaauacccagcugaccgucgaaacaaccaacaucgaggggacaauuagcuauccucuugaagagacgaaaaucaccagauacuuucccgacgagacaauuaaugcuugcaagaccaugaaaucccgcucuuucguguauagccggggaagaaagcugguuggcggggugaaccaggaugucgaauacuccagcaucacagaccagcaacugaccacggaguggcagugucaggugcagaaaauuacccggucucacuccacagauaucccuuauaucgucagcgaagccgcugugcaagccgagcauaaggaacaguuugcggacaugcaggaugagcaccauguugccgaggcuauuccgcgcauccccagacucucucugaccauuacagaccggaauggaauggaaaaccuucugagcgugaagccugaucaaacccucggcuuccccucccugcgcucuaaaagccugcacgggcauccuagaaaugucaaguccauccagggaaaacucgaccggucuggccacgccagcuccgugagcucucuuguuauuguguccggcaugacagcugaggaaaagaaagucaagaaggagaaagccagcaccgaaacggagugcuga

SEQ ID NO: 77319 - RNA, 4512 nt, Artificial Sequence
  derived and/or modified sequence opt5 from TRPM2__Homo_sapiens__XP_005261228
auggagcccagcgcccugagaaaggcuggcuccgaacaggaggaaggguucgagggacucccucggcgcgugaccgaccugggcauggucucuaaccuuagacggagcaauuccucucuguuuaaaagcuggcgccuccagugcccguucgggaacaaugauaagcaggaaucccugucuagcuggauccccgagaacauuaaaaagaaagaguguguuuacuuuguggaauccagcaagcucucugacgccggaaagguggucugccaguguggcuauacacacgagcagcaucuggaagaggcgacgaaaccucacaccuuccaagggacacagugggaucccaagaaacaugugcaggagaugccuaccgacgcuuuuggagauaucguuuucacaggccucucccagaaggugaaaaaguacgucagagugagccaagacacccccucuuccguuauuuaucaccugaugacacagcauuggggccuggaugugccuaaucuccugaucagcgucaccgggggagccaagaacuuuaauaugaaaccgcggcuuaagucuauuuuccgcagaggccuggugaaaguggcccagacgaccggggcuuggaucaucacaggaggcucccacaccggggucaugaagcagguuggagaagccgugcgggacuuuagccucuccucuagcuacaaagagggcgaacugauuacaaucggcguggcuaccugggggacgguccaccgcagagagggacuuauucaucccacaggcuccuucccugccgaauauauccuggaugaggacgggcaaggaaaccuuaccugccuggauagcaaucacucucauuuuauucugguggacgauggcacacacgggcaguacggaguugagaucccccuccggacccgccuggaaaaguucauuuccgagcagaccaaagaaagaggcggcguggcgaucaagaucccuauugucugugugguucuugaagggggacccggcacacugcacacgaucgacaacgccaccacaaaugggaccccgugcguggucguggaaggaagcggccgggucgcugacgugauugcccaaguugcuaaccucccugugucugauaucacaauuagccugauccagcagaagcucuccgucuuuuuccaggagauguucgagaccuuuacggaaucucgcaucguggaguggacaaagaagauucaagacaucguuagacggagacagcugcucaccguguuccgcgaagggaaagauggccagcaggacgucgauguggccauucugcaagcgcugcucaaggccagccggucccaggaccauuuuggacacgagaauugggaucaucagcugaaacuugcuguggccuggaacagaguugacaucgcucgcagcgaaauuuucauggaugaguggcaguggaagcccucugaccugcacccuaccaugacagccgcccucaucuccaauaagcccgaguuugucaaacuguuccuugaaaacggcgugcaacugaaggaguuugugaccugggauacacuccuguaucuguacgaaaaccucgaccccagcugucuguuccauucuaaacuucagaagguccugguggaggacccugagcggccggcuugcgcgcccgccgcuccuagacuccagaugcaccacguugcccaggugcugcgcgaacugcuuggggauuuuacgcaaccccucuacccucggcccagacauaaugaccgccugcggcugcuccugccggucccucacgugaaacuuaacguucagggagugucccugagaagccucuauaagcgcuccucuggccaugucaccuucacaauggaucccauccgggaccugcugauuugggccaucgugcagaauagacgggagcuugcugggauuaucugggcccaaagccaggauuguauugcggcugcccucgccugcuccaagauccugaaagaacugucuaaggaggaagaggacaccgauagcuccgaggaaaugcucgcucuggccgaggaauacgagcaccgcgcuauuggaguuuuuacagaauguuauagaaaagacgaggagcgggcccagaaacuucugaccagagugagcgaagcguggggcaaaacgaccugccuccagcuggcccuggaggcuaaggauaugaaguucgucucucacgggggcauccaagccuuucuuacaaaagugugguggggacagcucuccguggacaacggccuguggcgcgucacccugugcaugcucgcuuucccucugcuucugacagggcucaucagcuuccgggaaaagagacugcaggauguuggaacccccgccgcgcgcgccagagcuuucuucacggccccugugguggucuuucaucugaauauucuuucuuacuucgcuuuucucugucuguucgccuaugugcugaugguugacuuucagcccgugccguccuggugcgagugugccaucuaccucuggcuguucagccuugucugcgaagagaugcggcaacuguuuuaugauccugacgaguguggccucaugaaaaaggcugcgcuguacuucucugacuuuuggaacaaacuggaugugggggccauucuucuguucguugcuggacucacaugccgccugauccccgccacccucuaccccggcagagugauucugagccuugacuuuauccuguucugucuccggcugaugcacaucuucacaauuuccaagacccuggggccuaaaaucauuaucgucaagcgcaugaugaaggauguguuuuucuuucuuuuccugcucgccguuuggguggucagcuuuggcguggcuaaacaggccauucugauccauaaugaaagacggguggacuggcuuuuccgcggagcggucuaucacucuuaccugaccaucuuuggccagauuccgggguauaucgauggaguuaacuucaaucccgagcauugcuccccuaacggcacagaccccuacaagccuaaaugucccgaaagcgaugcuacgcagcaaagaccugccuuucccgaguggcuuaccgugcugcuccugugccuguaucuucuguucacaaauauucuccugcucaaccugcuuaucgccauguuuaauuacaccuuccaacaggugcaggagcacacagaccagauuuggaaguuccagcggcacgaucugaucgaagaguaucaugggcgcccggcugccccucccccuuuuauccugcucucccaucugcagcuuuucauuaaaagagucgugcugaagacccccgcgaagcggcacaaacaacucaagaacaaacuggaaaagaaugaggaagcugcccuccugucuugggagaucuaccuuaaagagaacuaccugcagaacagacaguuucagcaaaagcagcgcccggaacagaagauugaggacaucagcaauaaaguugaugccaugguggaccugcucgaucuggacccucuuaagcgguccggaucuauggaacagagacuggcuagccucgaggaacaagucgcccagacggcucaggcccugcacuggauugugcgcacacuccgggcguccggcuucucuagcgaggccgacguucccacccuggcuucccagaaagccgcugaggaaccugaugccgagcccgggggcagaaagaaaaccgaggagcccggagacagcuaucaugugaacgcccgccaccuucuguacccuaauuguccggucacacgguuucccgugccuaacgaaaagguccccugggagaccgaguuccugaucuaugauccucccuuuuacacagcugaaagaaaggacgcggccgcuauggauccuaugggcgacacgcucgagccgcugucuaccauucaauauaaugugguugaugggcuucgcgaccggagauccuuccacggacccuacacagugcaggccggccugccucucaaccccauggggcggaccggacugcgcggcagaggcagccucucuugcuuugggccuaaucauacacuguaucccauggucacccgguggcgcagaaacgaagauggagccaucugccggaaauccaucaagaaaaugcuugaggugcugguugugaagcugccgcucagcgagcacugggcucugccuggcgggucuagagaacccggagagaugcuuccccgcaaacugaagcggauucucagacaggaacauuggccuuccuucgagaaucugcugaaauguggcauggaagucuacaagggguacauggacgauccccgcaacacggacaaugccuggaucgagaccguggcggugagcguucacuuucaagaccagaacgaugucgagcucaaucggcuuaacuccaaucugcacgcuugcgacagcggagccucuauuagauggcaagugguggaucgccggaucccucuguaugccaaccauaagacacuccugcagaaagcugccgcggaauuuggcgcucacuacuga

SEQ ID NO: 77320 - RNA, 5124 nt, Artificial Sequence
  derived and/or modified sequence opt5 from TRPM3__Homo_sapiens__NP_001007472
augcccgagccuuggggcacaguguacuuccuggggaucgcccaggucuuuagcuuccuguuuuccugguggaaccuugaaggaguuaugaaucaggcugacgccccgagaccccuuaacuggacaauucggaagcugugccacgcggcuuuccucccuucugugcgccugcuuaaggcccagaaaagcuggaucgagagagccuuuuauaaacgggaaugugugcauauuauccccuccacgaaggacccucaccgcugcuguugcggcagacugauugggcagcaugucggacucacccccucuaucagcgugcugcagaaugagaaaaacgaaucccggcugucucgcaaugacauccaaagcgagaagugguccauuagcaagcacacacagcucucuccuaccgaugcuuucggcacaaucgaguuucaagggggcgggcauuccaacaaagccauguacguuagagugagcuucgacaccaagccggaucugcuucugcaccucaugacaaaagaauggcagcuggagcuucccaagcugcucauuucuguccacggcgggcugcaaaauuuugaacugcagccuaaacucaaacagguguucggaaagggccugaucaaagcugccaugaccacgggggcguggauuuuuaccggaggcguuaacacaggggugauccggcaugucggagacgcccuuaaggaucacgcuuccaaaagccgcggcaagauuuguaccaucggcaucgcccccugggggauuguggagaaucaggaggaccugaucggaagagaugugguccggccuuaucaaacaaugucuaaccccauguccaaacucaccguucugaauagcaugcauucccacuucauucuugcugacaacggcacgacagggaaguacggagccgaagugaaacugcgcagacagcucgagaagcacaucucucugcagaagauuaauacccggaucggccaaggggugccggucguggcgcugaucguugaaggaggcccuaacgugauuagcaucguccucgaguaucugcgcgauacacccccugugcccguuguggucugcgacggcuccgggagagccagcgauauucuugcuuuuggacauaaauacucugaagagggcgggcugaucaaugagucccuccgggaccagcugcuugugaccauucagaagaccuucacauauacgagaacccaggcccaacaccuguucaucauccucauggaauguaugaaaaagaaagagcugauuacagucuuucgcaugggaagcgaaggccaucaggacaucgaucuggcuauucucaccgcccugcuuaagggggccaacgcuucugcgcccgaccagcugagccucgcccuggcuuggaaccggguggauaucgccagaucccagauuuucaucuacggccaacaguggccuguuggaucucuggagcaggccaugcuugacgcucucgugcuggaucgcgucgacuuugugaagcugcucauugaaaauggcguuagcaugcaccgguuccugacaaucuccagacuugaggagcuguacaacacccgccaugggccgagcaauacgcucuaucaccuggugcgggaugucaaaaagggaaaccugcccccugacuacagaaucucucuuauugauaucggccucgugauugaauaucugaugggaggagccuaccgcugcaauuauacacggaaaagauuucgcacccuguaccacaaccucuucggccccaagcggccuaaagcgcugaaacuucuggggauggaggacgauaucccccucagacggggccgcaagaccaccaagaagagagaagaggaaguggacauugaccuggaugacccggagaucaaucauuuuccuuuccccuuucacgagcugaugguuugggcuguccuuaugaagcggcagaagauggcccucuucuuuuggcaacauggagaagaggccauggcuaaagcccugguggcuuguaagcugugcaaggccauggcgcacgaagccuccgagaacgauaugguggacgauaucagccaggagcucaaucacaacucuagagacuucggccagcuggcugucgaacuucuggaucaguccuauaaacaagacgagcagcucgccaugaagcugcugaccuacgaacuuaaaaauuggagcaacgcuacaugucuccagcuggccguggcggccaagcaucgcgauuuuauugcucacacgugcucccaaaugcugcucaccgacauguggauggggcggcugagaaugcgcaaaaauucuggacuuaagguuauccugggcauucuccugccucccagcauccugucccuugaguucaaaaacaaggaugacaugccuuacaugucucaggcccaggaaauucaucugcaggagaaggaggcugaggaacccgaaaaaccgacaaaggagaaagaagaggaggauauggaacucaccgccaugcuggggagaaauaacggagagagcucccggaagaaagacgaagaggaagugcaaagcaagcaccgccucaucccucugggcagaaagaucuaugaguucuacaacgcccccauugucaaauuuugguucuauacacuugcuuacaucggguaucugaugcucuuuaauuacauugugcugguuaagauggagcgguggcccucuacccaggaauggaucgugauuuccuauaucuucacgcugggcaucgagaaaaugcgcgaaauucuuaugagcgagccuggaaagcugcuccagaaagucaagguguggcugcaggaguacuggaacguuaccgaccucaucgcgauucugcucuuuucugugggcaugauccugagacuccaagaucagccguuccgguccgacgggcgcgucauuuacugcgugaauaucauuuauugguacaucagacugcuggauaucuuuggagugaacaaguaucuuggccccuacgucaugaugauugggaaaaugaugaucgacaugauguauuucguuauuaucaugcugguggugcucaugagcuuuggagucgcccggcaggcuauucuguucccuaaugaggaacccucuuggaagcucgccaaaaacaucuuuuacaugccuuauuggaugaucuacggcgaaguguucgccgaucagauugaucccccuugugggcaaaaugagacacgcgaagauggcaagaucauucagcugcccccgugcaaaaccggagcuuggaucguuccugccauuauggcguguuaccuucugguggcuaacauccugcucgucaaucugcuuaucgccguguuuaacaauacauucuucgagguuaagagcauuuccaaccagguguggaaguuucaaagauaucagcugaucaugaccuuccaugagcggcccguccucccucccccgcugauuaucuuuagccacaugacgaugauuuuccagcaccucugcuguagauggcgcaaacaugaaucugacccugaugagcgggacuacggccugaaacuuuuuaucacagaugacgaacugaaaaaggugcacgauuucgaggaacagugcauugaggaguauuuuagagaaaaagacgaccgcuucaauuccagcaacgaugagcggaucagaguuaccuccgaacgcguggagaauaugucuaugcggcuggaagaggucaacgagagagaacauagcaugaaggccucccuccaaacaguggacauccgccuggcucagcuugaggaucugauugggcggauggccaccgcgcucgaaagacugaccggacucgagcgggcugagucuaacaaaauccgcagcagaacauccucugacuguacggaugccgccuacauugugcggcagagcuccuuuaauagccaggaaggcaacaccuucaagcugcaagagucuaucgaccccgcuggggaagagacaauguccccuaccagccccacacuuaugccccgcaugagaucucacuccuuuuauagcgucaauaugaaggauaaaggaggcauugaaaagcuggagucuaucuucaaagagcggucccugagccuccauagagccaccuccagccacucuguugcuaaggaaccuaaagccccggcggcccccgcuaacacgcuggccaucgugccugacagccgccggcccuccucuugcauugauaucuacgugagcgcuauggacgagcuucacugugauauugacccucuggacaauuccgucaacauccucggccugggggaacccucuuucagcacaccugugccguccaccgcccccucuagcuccgccuaugcuacccucgcgccuacagauagacccccuagccgcucuauugacuuugaggauaucaccuccauggacacacggagcuucucuuccgauuacacgcaucugcccgaaugccagaauccgugggacagcgagccucccauguaccacaccaucgagagauccaagucuagccgcuaucuugccacaacccccuuucugcuggaagaggcuccuauuguuaagucccauagcuucauguuuucucccucccggagcuacuaugccaacuucggagugccugucaaaacagccgaauacaccucuaucacggauuguauugacaccagaugcgugaaugcuccgcaggccaucgcggaucgcgcugccuuucccggcgggcucggagacaagguugaggaucugacaugcugucacccugaaagagaggccgagcuuagccaccccuccucugacagcgaagagaacgaagcuaaaggccggcgcgccaccauugcgaucuccucucaggagggggauaauagcgagagaacacuguccaacaauauuaccgugccuaagaucgaacgggcuaacagcuauucugccgaggaacccuccgccccguacgcucauacacgcaagagcuucuccaucucugacaagcucgacagacaacggaauaccgccagccugagaaacccuuuucagcgcuccaagucuagcaaacccgagggacggggcgauucccugagcaugagacgccucucucggacguccgcuuuccagagcuuugaaucuaagcacaacuga

SEQ ID NO: 77321 - RNA, 3210 nt, Artificial Sequence
  derived and/or modified sequence opt5 from TRPM4__Homo_sapiens__NP_001182156
auggugguccccgagaaggaacagagcuggaucccuaaaauuuucaagaaaaagaccugcacaacguuuaucguugacuccaccgauccgggcgggacacugugucaaugcggaagaccccggaccgcccacccugcuguggccauggaggacgcguucggcgcugccguggucacagugugggauucugacgcccauaccacagaaaaacccaccgaugcuuacggggagcucgacuuuacgggagccggccgcaagcacagcaacuuccugagacuuuccgaucggaccgacccugcugccguuuauucucuggugacacgcaccuggggguuuagagcgcccaaucucgucgugagcguucugggaggcuccggcgggccugugcuucagacauggcugcaggaucuccugcggcgcggacuggucagagccgcucagucuaccggcgccuggauugugacagggggacuccauacgggcaucgggcggcacgugggagucgcuguucgcgaccaucaaauggccagcaccggcggcacaaaggugguggcgaugggggucgccccguggggagugguuagaaaccgggauacccugauuaaucccaaaggcuccuucccugcucgcuacagauggcgcggggaccccgaagauggagugcaguuuccucuugacuauaacuacagcgccuucuuucuggucgacgauggcacccacgggugucucggaggcgagaaucgguucagacugcggcuugagucuuauaucucccagcagaagacaggcguugggggaacgggcaucgacauucccgugcugcuccugcugaucgauggggacgagaaaaugcucaccagaauugaaaacgcuacacaagcccagcugccgugccuucugguggccggaagcggcggggcugcggauugucucgccgaaacccuggaggacacacuugcuccuggcucuggaggcgcccgccagggggaggcccgggauagaauccgccgguuuuuccccaagggagaccuggaaguccuccaggcucaaguggagagaauuaugacccgcaaagaacugcugacggucuacuccagcgaggauggcucugaagaguuugagacaaucgugcucaaggcccugguuaaggcgugcggguccagcgaggcuuccgccuaucuugacgaacugcggcucgccguggcuuggaauagagucgauauugcccagucugaacuguuccgcggagacauccaguggcggagcuuccaccuugaggcuucccugauggacgcccuccugaacgauagaccugaauuugugcgccugcucaucagccauggccugucucuugggcacuuccugacccccaugcggcucgcgcaacuguacuccgccgcucccagcaauucucugauuagaaaccuucucgaccaggccagccauuccgcuggcaccaaagccccugcgcugaagggaggcgccgcugagcugcggccgcccgauguugggcacgugcuccgcaugcugcuuggaaaaaugugugccccuagauaccccucuggcggggcuugggacccucaccccggacagggcuuuggggagagcauguaucugcucuccgauaaggccacaagcccgcugucucuggacgccggccuuggacaggcuccuugguccgaucuccugcugugggcgcuccugcuuaaucgggcccaaauggcuauguacuucugggaaaugggcagcaacgccgucucuuccgcccugggggcuugccuccugcugagagugauggcccgccuugagcccgacgcggaagaggcugcccggagaaaagaucucgccuuuaaguucgaaggaaugggcguggaccuguuuggggaguguuaucgcagcuccgagguuagagcugcccggcugcuccugcgcagaugcccucuuuggggagaugcgaccugucugcagcucgcuaugcaggccgacgcccgggcuuucuuugcccaggauggcguccaaucucugcugacacagaaaugguggggcgacauggcuagcacgacccccaucugggcccuugugcucgcguucuuuugcccuccccugauuuacacacgccugaucaccuucagaaaguccgaagaggaaccgacacgggaggagcucgaauuugacauggauucugugauuaauggcgagggaccugucggccugacccccgggcuuuaucaucugggacgcacggugcucugcaucgacuucaugguuuucaccgugagacugcugcacaucuuuacagucaacaagcagcuuggccccaaaauugugaucguuagcaagaugaugaaagauguguucuuuuuccuguuuuuccucggggucuggcugguggccuacggaguugcuaccgaaggccuccugcggccucgcgacuccgauuuuccgagcauucuuagacggguguucuauagacccuaccugcagaucuuuggccaaauuccucaggaggacauggaugucgcccucauggaacauucuaauuguuccagcgagcccggguucugggcucacccucccggagcccaggccggcacaugcgugucucaguacgcuaacuggcuggugguccugcuucugguuaucuuucuccugguggcgaacauccuccuggugaaucuucugauugccauguucuccuauaccuuugggaagguccaaggaaacagcgaccucuacuggaaagcucagcgcuaucggcugaucagagaguuccauucucgcccugcccuggcucccccguucauugugaucagccaccuucggcugcuccugagacagcucugucgccggccuagaagcccccaaccuuccucucccgcccuggaacacuuucgcguuuaccuuuccaaggaggccgaacggaagcugcugacgugggagagcgugcauaaagaaaauuuccuccuggcgagagcucgggauaagcgcgaguccgacucugagagacuuaaacggacaagccagaaggucgaucuggcccucaaacagcugggccacauucgcgaauaugagcagagacucaaggugcuggaacgggagguucaacagugcuccagagugcuugggugggucgccgaagcucugucucgcagcgcccugcucccgccuggagggcccccuccucccgaccugcccggcuccaaggauuga

SEQ ID NO: 77322 - RNA, 3498 nt, Artificial Sequence
  derived and/or modified sequence opt5 from TRPM5__Homo_sapiens__NP_055370
augcaggacgugcaaggccccagacccgggagcccgggagaugccgaggaccggcgcgaacugggccuccacagaggggaggucaacuucggaggcuccgggaagaaacggggaaaguuuguucgcgugcccucuggcguggcuccuagcguccuguucgaucuucugcucgccgaauggcaucugcccgcgccuaaucuugugguuucccuggugggcgaggaacagcccuuugcuaugaaaucuuggcucagagacguccugcggaaggggcuggugaaagccgcccagagcaccggagcuuggauccucacauccgcccugcgcguuggccuugcuagacacguggggcaggccguccgggaucauucucuggcgagcacguccaccaaggugcgcguggucgccguuggaauggcuagccucggcagagugcugcaccggcgcauucuugaggaggcccaagaagacuucccugugcauuacccggaggaugacgggggaucucagggcccccugugcucccucgauagcaaccugucucacuuuauccuggucgaaccugggcccccugggaagggagacggccucacagagcugagacuucggcuggagaaacacauuuccgaacagcgcgcuggguauggaggcaccgggagcaucgagauucccgugcucugucugcuuguuaauggagauccgaacacacuggaaagaaucucucgggccguggagcaggcggccccuuggcucauccuggucggcuccggcgggauugcugacgugcuggccgcucucguuaaucaaccccaucugcuugugccuaaggucgccgaaaaacaguucaaggagaaauuucccagcaagcacuucuccugggaggauaucgugagauggaccaagcugcuccagaacauuacaucucaucagcaucugcuuaccgucuacgacuuugaacaagagggaagcgaggaacuggacacggugauccucaaagcccugguuaaggcuugcaaaucccacagccaggaaccccaggauuaucuggacgagcucaagcuggcgguggccugggaucgcgucgacauugcuaaaucugagaucuucaauggcgauguggaauggaaguccugugaccuugaggaaguuaugguggaugcccuggucagcaacaaaccugaguuugugagacucuucguggacaauggggccgauguugcugacuuucugaccuacggaagacugcaagaacuuuaucgcucugucagccggaagucccuccuguucgaucugcuccagagaaagcaggaggaggcccgccugacacuugcgggccuggggacccagcaagcucgggaaccgcccgccggcccucccgccuucucucuccacgaggugagcagagugcugaaagacuuucugcaggacgcuugccgcggauucuaccaggauggccggccuggggacagacgccgggccgaaaagggacccgcuaaaagaccgacaggccagaaguggcuucucgaucugaaccaaaaauccgagaauccuuggcgggaccuguuucucugggccguccugcagaaccgccacgagauggcgaccuauuucugggccauggggcaggaaggaguggcugccgcucuugccgcguguaagauucugaaggagaugagccaucucgaaacggaggccgaagcugccagagcuacacgggaggccaaauacgagagacuggcccuggaucucuuuucugaaugcuacuccaauagcgaggcucgcgcguucgcccuucugguucggagaaaccgcuguuggucuaagaccacaugccugcaccucgcuaccgaagccgacgccaaagccuuuuucgcccaugauggcgugcaggcguuucugaccagaaucugguggggcgacauggcugccggcacacccauccuucggcugcucggagccuuccuguguccugcucuggucuauacgaaucuuauuaccuuuuccgaggaagcuccccuccgcacaggccuggaggaucugcaagaccucgauagccuggacaccgagaaguccccucuuuacgggcugcagucuagaguggaggaacucguugaagcgccccgggcucagggagaucgcggcccgagagccguguuccugcugacacgguggcgcaaauuuuggggagccccugucaccguguuccuugggaacguugugauguauuucgcuuuucuguuccucuuuacguacguccugcucguggacuucagacccccuccccagggcccgagcgggcccgaggugacacuguauuuuugggucuucacccuuguucuggaagagauccggcaaggcuuuuucaccgacgaggauacacaccucgugaagaaguuuacccuguacgugggagacaacuggaauaaaugcgauauggucgccauuuuccuguuuaucgugggcguuacaugucgcaugcuuccuuccgcuuucgaagccgggagaacggugcuggcgauggacuuuauggucuucacccuccggcugauucacaucuucgccauccauaagcagcucggacccaaaauuaucgugguugagagaaugaugaaggauguguuuuucuuucuguucuuucuuucugucuggcugguggcuuauggcguuacaacccaggcccuccugcacccucaugacgggcgccuggaauggauuuuccggagagugcuuuaccgccccuaccugcaaaucuuuggacagauuccucucgaugagaucgacgaggcucgggucaacugcagcacacacccccugcuccuggaagauuccccgagcugcccuucucuuuaugccaauuggcuggugauccugcuccuggugaccuuccuucuggucacgaacguucuccugaugaaucuccugauugccauguuuuccuacaccuuccagguggugcagggcaacgcugacauguuuuggaaauuccaaagauauaaucuuaucgucgaguaccacgaacgccccgcgcuggccccucccuucauucugcucagccaucugucucuuacacugcggagaguguuuaagaaggaggcugaacacaaacgcgagcaucucgagcgggaucugccggacccucucgaucagaagguugugaccugggaaacaguccagaaagagaacuuccuguccaagauggaaaaacggcggcgcgacagcgagggggaagugcuuagaaagaccgcccaccggguugacuuuaucgccaaauaucugggcggacugcgcgagcaggagaagagaauuaagugucucgaaucucaaaucaauuacugcagcgugcuggucuccagcguggcugauguccuugcccagggcgggggaccccggucuucccagcauuguggcgaggggagccagcugguggcggcugaccacagaggaggccucgauggcugggaacaaccuggggccggacagccucccuccgacacguga

SEQ ID NO: 77323 - RNA, 6054 nt, Artificial Sequence
  derived and/or modified sequence opt5 from TRPM6__Homo_sapiens__NP_001170781
augauuauucugagcaaaucccagaaaucuuggaucaagggaguguucgauaaacgggagugcagcaccauuauccccuccucuaagaacccucaccgguguacaccggucugccaaguuugucagaaucucauucgcugcuacugugggagacugaucggagaucacgccggcaucgacuauagcuggacgauuuccgcugccaaagggaaggaaucugagcaguggagcguggaaaagcacaccacaaaaucccccaccgauacauuuggaaccaucaacuuccaggacggcgagcauacacaccaugccaaguacauucggaccagcuaugauacgaaacuugaccaccuccuccaccugaugcuuaaggaauggaaaauggagcugccuaagcucgugaucucuguccaugggggcauucagaauuuuaccaugcccuccaaguucaaagagaucuuuagccagggccuggugaaggcugccgaaacaaccggcgccuggauuaucacagaggggaucaacaccggaguuucuaaacacgugggcgaugcucugaagucccauagcucucacucccuccgcaaaauuuggacggucgggaucccucccuggggagugauugaaaaucagagagaccugaucggcaaggauguugugugccuuuaccagacacuggacaacccucucagcaaacugaccacacuuaauuccaugcacucucauuucauucugagcgaugacgggaccgucggaaaguauggcaacgagaugaagcuccggcgcaaucuggagaaauaccugucccuccaaaagauccacuguagaagccggcagggcgugccgguggucgggcugguuguggaaggaggccccaacgugauccuuucugucugggagaccgugaaagauaaggacccuguuguggucugcgaagggacaggacgcgccgcugaccugcucgccuuuacgcauaaacaccuggcggaugagggcaugcuuagaccccaggugaaggaagagauuaucuguaugauucagaauaccuucaacuuuucccugaagcaaagcaaacaucucuuccagauccugauggagugcaugguucaccgggacuguauuacaaucuuugaugccgacucugaagaacagcaagaucuggaccucgcuauccugaccgcccuucugaaggggacaaaucucagcgcuuccgaacagcugaaccuugccauggcgugggaucgcguggacauugccaaaaagcacauccugauuuaugagcagcauuggaaaccugaugcucucgaacaggccaugucugacgcucuggucauggauagaguggacuucgucaagcugcucaucgaguacggagugaaucugcaccgguuucuuaccauuccccgccuggaggaacucuacaacacgaagcaaggcccgacaaacacccugcugcaucaccuuguucaggacgugaaacagcacacccuccugagcggcuauagaaucacacugauugauaucgggcucgucguggaguaccugaucggacgggccuauagauccaauuacacccgcaagcauuuccgggcccuuuauaacaaucuguacagaaaauauaagcaccagcgccauagcucuggcaaccggaaugaauccgcugagagcacacuccacucucaauucauuagaacggcgcagccuuacaaauuuaaggaaaaguccaucguucugcauaaaagccgcaagaaauccaaggagcagaacgugucugacgaucccgagagcaccggguuccuguacccuuauaaugaccuucucgucugggccgugcugaugaaacggcagaagauggcuauguuuuucuggcaacacggagaagaggccacagugaaagccguuauugcuugcauccuguacagagccauggcgcacgaagcuaaggagucccauauggucgaugacgccucugaggaacucaagaacuauagcaaacaguuuggccagcuggcccuugaucugcucgagaaggcuuucaaacagaaugaacgcauggccaugacccugcugacauacgagcuucggaacugguccaauucuaccugccucaagcuggcuguguccgggggccugagacccuuugugucccacacguguacccaaaugcuccugacagacauguggaugggacgccuuaaaaugcggaagaacagcuggcugaagauuaucaucucuauuauccugcccccuaccauucugacacuggaguucaaauccaaggccgagaugagccaugucccgcagucucaggauuuucaauucaugugguauuacagcgaccagaaugcguccagcucuaaagaguccgccagcgugaaggaauaugaucuugagagaggccacgacgaaaaacucgaugagaaccagcauuuugggcuggaauccggacaccagcaucugcccuggacccggaagguuuacgaguucuacucugcuccuaucgugaaguuuugguucuauacgauggccuaccucgcuuuccugaugcuuuuuacauauaccguccugguggagaugcaaccccagccuagcguucaggaauggcucguguccauuuacaucuucacaaaugccaucgaggucgugcgcgaaauuugcaucucugagcccggcaaauuuacccagaagguuaaaguguggauuagcgaauauuggaaccugaccgagacagucgcgaucgggcuguucuccgccggauuugugcuuagauggggcgacccgccuuuccauacggcugggcggcugauuuacuguaucgacaucaucuuuugguucucuagacuccuggacuuuuucgccgugaaccaacacgcuggccccuaugucaccaugaucgccaagaugacagccaauauguuuuacauuguuaucauuauggcuaucgugcuccugagcuucggaguggcgcgcaaagccauucuuuccccuaaggagcccccuagcuggucucuggcucgggacaucgucuuugaacccuacuggaugaucuauggcgagguguacgccggggaaauugauguuugcuccagccagccgucuuguccucccggauccuuccucacccccuuccugcaggccguguaucuguuuguccaguacaucauuauggugaaccuucugaucgcuuucuuuaauaacguuuaucucgacauggagagcauuucuaauaaccuguggaaguacaauagauaucgcuacaucaugacauaccaugagaaaccuuggcucccgcccccucugauccuucugucccacgugggccuccugcugagacggcuuugcugucaccgcgcgccccacgaucaagaagagggggacgucggacugaagcucuaucugagcaaagaagaucucaagaaacugcacgacuucgaggaacagugcguggagaaguacuuucaugagaaaauggaagauguuaacuguuccugcgaggaacggauucgggugaccagcgagcgcgucacggaaauguauuuccagcuuaaggagaugaaugagaaggugucuuuuaucaaagacagccugcugucccucgauucucaagugggccaucugcaggaccuuagcgcgcugacagucgauacccucaagguucuguccgcuguggacacccuccaggaagacgaggcccugcuugccaaaagaaagcauucuacauguaaaaagcugccucacagcugguccaacgugauuugcgcugaaguccuggggucuauggagaucgccggcgaaaagaaauaccaguauuacagcaugcccuccagccuccugcggucucuugcgggaggccgccacccucccagagugcaaagaggggcucugcucgagauuaccaauuccaagcgcgaggccacaaacguuagaaaugaucaggaacggcaggagacgcagagcucuaucguggucuccggagugagcccgaacagacaagcccauuccaaauauggccaguuccugcucguuccuucuaaucugaagcgcgugcccuuuagcgcugaaaccguccuuccucugucccggcccagcgugccggacguccuggccacagagcaggauauccagaccgaggugcucguucaccugacagggcaaaccccuguggucucugacugggcuuccguggaugaacccaaagagaagcaugaaccuauugcccaccuucuggacggacaggauaaggcggagcagguucuccccacgcugagcugcacccccgaaccuaugacaaugucuagcccgcucucccaggccaaaaucaugcaaaccggcgggggcuacgugaacugggcuuucucugagggagacgagacaggcgucuuuagcauuaagaaaaaguggcagaccugucugcccuccacaugcgauucugacagcuccagaagcgaacagcaccaaaaacaggcccaggauucuucccuuagcgacaacuccacccgcucugcucagagcuccgaguguucugaaguggggccuuggcugcaacccaauacgagcuucuggaucaacccucugcggagauaccgccccuucgcccggucccauagcuuuagauuccacaaggaggaaaagcucaugaaaauuugcaagaucaaaaaucugucuggauccagcgagauuggccagggggccugggugaaggcuaaaaugcuuacaaaggaccgccggcugucuaagaaaaagaaaaacacccagggacuccagguuccuaucaucaccgucaaugcguguucccaaagcgaucagcugaacccggagcccggcgaaaauucuauuagcgaggaagaguauuccaagaacugguuuacagugucuaaauucagccauaccggcguggaaccuuacauccaccagaagaugaaaacgaaggagauugggcagugcgccauccaaauuuccgacuaucugaagcagagccaggaggaucucuccaaaaauucucuuuggaacagcagauccacaaaucugaacagaaauucucugcucaagagcuccaucggagucgacaaaaucucugcuagccuuaagagcccccaagaaccucaucaccacuacagcgccauugagcgcaacaaucugaugagacugucucagaccauccccuuuacaccggugcaacucuucgccggcgaagagauuaccguuuaucggcuggaggaauccagcccucugaaccucgauaaaucuauguccagcuggucucagcgcgggagagcugccaugauccaagugcuuucccgggaggaaauggacggaggccugagaaaggcgaugcgcgucgugagcacaugguccgaggaugacauucugaagcccgggcagguuuuuaucgucaagagcuuccuccccgaaguggugcggaccuggcauaagaucuuucaggagucuacgguucugcaccuuugucugagagagauucagcaacagcgcgcugcccagaaacucaucuacaccuucaaccaggugaagccucaaacaauucccuauaccccucgguuucuggaagucuuccugaucuacugccauagcgccaaucaguggcucacaauugagaaauacaugaccggagaauuuagaaaguauaacaauaacaauggcgaugagaucacgccgacaaacacccuugaggaacugaugcuggcuuucucccacuggacauacgaguauacccgcggcgaacuccuggugcuugaccugcagggggugggagagaaucucaccgaucccucugucauuaagccugaaguuaaacagagccggggcaugguguucgggcccgccaaccugggagaggacgcgaucagaaauuuuaucgcuaagcaccauuguaacuccugcugucgcaaacugaagcucccugaucuuaaaagaaaugacuacucucccgaacggauuaacagcacauucggccuggagaucaagauugaguccgccgaggaaccgccugcccgcgaaacggggagaaauucucccgaggacgauaugcaacuguga

SEQ ID NO: 77324 - RNA, 5598 nt, Artificial Sequence
  derived and/or modified sequence opt5 from TRPM7__Homo_sapiens__NP_060142
augagccagaaguccuggaucgaaucuacccugacaaaaagagaaugcguguacauuauccccagcuccaaggacccucaccggugucucccgggaugccagauuugucagcagcugguccgcugcuucugugggagacuuguuaaacagcacgccugcuuuacggcuucucuggccaugaaguauagcgaugugaaacucggagaccacuucaaccaagcgaucgaggaaugguccguggagaagcauaccgaacagucucccacagaugcuuacggagucauuaauuuucaagggggaagccacuccuaucgggccaaguacgugcgccugagcuaugacaccaaaccugagguuauccuucagcugcuccugaaggaguggcaaauggaacugcccaaacucgugaucucuguccauggcgggaugcagaaguucgagcugcacccuagaauuaaacagcuucugggaaagggccucaucaaggccgcugugacaaccggcgccuggauucugacagggggaguuaacaccggcguggcuaaacacgucggggaugcccuuaaggaacaugcgucccggagcucucgcaaaaucuguacgauuggaaucgcccccuggggcgugauugagaauagaaacgaccugguggggcgggaugucguugcuccuuaccagacccuccugaauccgcuguccaagcucaacgugcugaauaaccuucacagccauuuuauccugguggacgauggaacagucggcaaauauggcgccgaggugcgccucagacgggaacuggagaagaccaucaaucaacagcgcauucacgcuagaaucgggcagggaguucccguggucgcccuuauuuucgaaggcgggccuaacgugauccugacaguucucgaguaccugcaagaaucucccccugugcccgucguggucugcgagggaaccggccgggcggccgaccugcucgcuuacauucacaaacagacggaggaagggggaaaucugccggaugccgcugagccugacaucaucuccacaauuaagaagaccuuuaacuucggccagaaugaagcccuucaucuguuucagacacucauggaguguaugaaacgcaaggaacugaucaccguguuccacauuggcagcgaugagcaucaagacaucgacguugccauucuuaccgcucugcucaaagggacaaacgcguccgccuuugaucagcugauccugacgcucgcuugggacagaguggauaucgccaagaaucacgucuucguguauggacagcaguggcugguuggcucucuugagcaagccaugcuggacgcucucgugauggaucgggucgccuuugugaaacugcugauugaaaacggggugagcaugcauaaguuccuuaccauccccagacucgaggaacuguacaacacaaagcagggaccuaccaaucccaugcuguuccaccucguucgcgacgucaaacagggcaaccugcccccuggguauaagauuacacuuaucgauauuggccuggugaucgaguaccucaugggaggcaccuaucggugcacguacacaagaaaacgcuuucggcugauuuauaauucccucgggggaaacaauagacgcagcggccggaacaccucuuccagcaccccgcagcuuagaaagucucacgagagcuucgggaaucgcgcggacaaaaaggagaagaugcggcauaaccacuuuaucaaaacagcucaacccuacagaccuaagaucgauaccgugauggaggaaggcaaaaagaaacgcacaaaggacgagauugucgauaucgacgaccccgaaacgaagcgguucccuuacccccucaaugagcugcugauuugggccugucucaugaaaagacaggugauggcccgguuucuguggcagcauggcgaggaauccauggcuaaggcccuuguugcuugcaaaaucuaucgcucuauggccuacgaggcgaagcagagcgaucugguggacgauaccuccgaagaacugaaacaauauagcaacgacuucgggcagcuggccgucgaacugcuugagcagucuuuuagacaagaugagacaauggcuaugaagcuccugaccuacgaacugaaaaauugguccaacagcacaugccucaagcuggccgugucuucccggcuuagaccguucguugcucacaccuguacgcagaugcugcucagcgacauguggaugggccgccugaauaugcggaagaacuccugguauaaagugauucugucuauccuugucccucccgccauccuccugcuggaguacaagaccaaagcggaaaugagccacauuccucagucccaggaugcccaucaaaugacaauggacgauucugagaauaacuuucagaacaucaccgaagagauucccauggagguguucaaggaaguuagaauccucgacagcaaugagggcaaaaacgaaauggagauucagaugaaguccaagaaacugccuaucacacgcaaguuuuaugcuuucuaccacgcccccaucgugaaauuuugguucaauacccuugcuuaccugggcuuccucaugcuguauacguuugucgugcuggugcagauggaacaacuuccgagcguccaggaguggauuguuaucgccuacauuuucacauaugccaucgagaaggugagagaaauuuuuaugucugaggcugggaaagugaaccagaagaucaaggucugguucuccgauuacuuuaauaucagcgacaccauugcgaucauuucuuucuuuaucggauucggccugcgguuuggggccaaauggaacuucgcuaaugccuaugauaaccauguguuuguugccggacgccucauuuacugccugaauaucauuuucugguaugugagacuccuggacuuucuugcugucaaccagcaagccggcccuuacgugaugaugaucgggaagaugguugcgaauauguucuacaucguggucauuauggcucuggugcuccuguccuucggcguuccccggaaagccauccuguauccccacgaagccccuagcuggacacuugcuaaggacauuguguuucauccguacuggaugaucuucggagaggucuaugccuacgagauugaugugugugcgaacgacucugugaucccccagaucugcggcccugggaccuggcugacccccuuucuccaggcugucuaucuguucguucaauacauuaucauggugaaucuccugauugccuuuuucaacaauguguaucuucaggucaaagccaucagcaacauuguguggaaguaccagcgcuaccacuuuaucauggcuuaucacgaaaagccuguucugcccccuccccucaucauucugucccauaucgugagccuguucuguugcauuuguaaaagacggaagaaagauaagacaucugacggaccgaaacuuuuucugacggaggaagaucagaagaaacuccacgacuucgaggaacaaugcgucgagauguacuuuaacgagaaggaugacaaguuccauuccggcagcgaagaacgcaucagagugaccuucgaacggguugagcagauguguauucagaucaaagaagugggggaucgcgucaauuauauuaagagaucccugcagucucucgacagccaaaucggacaucugcaggaucuuuccgcccugacaguggacacccugaaaacacucaccgcucagaaggccucugaggcgagcaaaguccauaacgagaucacgcgggaacuguccauuucuaagcaccuugcccagaaucugaucgaugacggcccugugagacccagcguuuggaagaaacacgggguggucaacacacucuccagcucucugccucaaggcgaccucgaguccaauaaccccuuucauugcaauauucugaugaaggaugacaaagauccgcaguguaacaucuucggacaggaccuuccugcugugccccagcgcaaggaauuuaauuucccugaggccggcagcucuagcggggcucuguuucccagcgccguuucucccccugaacugcggcaaagacuccacggaguggagcugcuuaaaauuuucaacaagaaucagaagcugggcuccagcuccaccagcaucccgcaucucucuucucccccuaccaaauuuuucgucuccacacccucccagccuagcugcaagucccaccuggagaccgggacaaaagaucaagaaacggugugcucuaaggccaccgagggagacaacacagaauuuggcgcuuucgugggccaccgcgauagcauggaccuccagcgguuuaaagagaccuccaauaagaucaagauucugucuaacaauaacacaagcgagaacacccuuaaaagaguuuccagccuggcgggguucacggauugucaucgcaccucuauccccguccacuccaagcaggccgagaaaauuagccggagaccuucuacagaggacacccaugaaguggauuccaaggcugcccugaucccggacuggcuccaggaccgccccagcaaucgggagaugccuuccgaagagggaacacugaacggccuuaccucucccuuuaaaccugccauggauacaaauuacuauuacagcgcuguggagagaaacaaucugaugcggcucucccaaagcauucccuucaccccggucccuccccgcggggaacccgugacgguuuauagacuggaggaaucuuccccuaacauccucaauaacagcaugucuagcuggucccagcugggacuuugcgccaagaucgaguuccugucuaaggaagagaugggcgggggacugcggcgcgcggugaaaguccaguguacauggagcgagcacgacauucucaaguccggccaucuguacaucauuaaaucuuuucuucccgaagugguuaauaccuggagcuccaucuacaaggaggauaccgugcugcaccucugccugagagaaauucagcaacagcgggcugcccagaaacugacauucgccuuuaaccagaugaagccuaaaagcaucccguauucucccagauuccucgaggucuuucuucuguacugucacuccgcuggccaaugguucgccguggaagagugcaugaccggggaguuucgcaaguauaauaacaauaacggagacgaaauuaucccuacgaauacacuggaggaaaucaugcucgcguucagccauuggaccuacgaguauacacggggcgagcugcuuguucuggaucuccagggggugggagaaaaccugaccgaccccuccgucauuaaggcugaggagaaaagaucuugugauaugguguuuggcccugccaaucugggggaggacgccaucaagaacuuccgcgcuaaacaccauugcaacagcuguugccggaagcucaaacuucccgaucugaagagaaaugacuacacaccggauaagauuaucuuuccucaggacgaacccuccgaucugaaccuccaaccuggaaauucuaccaaagagagcgaguccacgaacagcgugcgccugaugcuuuga

SEQ ID NO: 77325 - RNA, 3315 nt, Artificial Sequence
  derived and/or modified sequence opt5 from TRPM8__Homo_sapiens__NP_076985
augagcuucagagccgcucggcuguccaugcgcaacagacggaaugacacccucgauucuacacgcacgcuguacagcuccgccucuagaagcaccgaccuuuccuauucugagagcgaucuggugaacuuuauccaggcgaauuucaagaaacgggaaugcgucuuuuucacaaaggacuccaaagcuaccgagaacguuuguaagugcggcuacgcccaaagccagcacauggaagggacacagauuaaucagucugagaaauggaacuauaagaagcauaccaaagaauuucccacagaugccuucggagacauccaauuugagacccucggcaagaaagggaaguacauucgccuguccugugauacggacgcugagauccuuuaugaacugcucacccagcacuggcaucugaaaacaccuaaucuggugauuagcgugaccggaggcgccaagaacuucgcucucaagccgagaaugcggaaaaucuuuucucgccugaucuacauugcccaguccaagggggcguggauccuuacaggaggcacccacuauggccugaugaaauacauuggggaggucgugagagauaauacgaucagccggucuuccgaagagaacauuguugccaucggaauugcugccuggggcauggugagcaaucgcgacacacucaucagaaacugcgaugcugagggguacuuccuggcccaguaucuuauggacgauuuuacccgggacccccuguacauccucgacaauaaccauacacaccuucugcucgucgauaauggaugucacggccauccuaccguggaagcgaagcugcgcaaccaacuugagaaauauauuuccgaaagaaccauccaggacucuaacuacgggggaaagauucccaucguuugcuucgcccagggcggcgggaaagagacacugaaggcuauuaauacgagcaucaagaacaaaaucccuuguguggucguggaaggauccggccagauugccgaugugaucgcuagccucgucgagguugaggacgcccugaccucuuccgccgugaaggaaaaacuugugcgguuucugcccagaacagucagccgccucccugaggaagagaccgaaucuuggauuaaguggcugaaagagauccuggagugcagccaccuccugacagugauuaagauggaagaggcuggggaugaaaucguuuccaaugcgaucucuuaugcccuuuacaaggcuuucagcaccuccgagcaagacaaagauaacuggaauggacagcugaagcuccugcuugaauggaaccagcuggaccucgccaaugaugagauuuucacgaacgaccggagaugggagagcgccgaucugcaagaagugauguuuacagcucugaucaaagaccgcccgaaguucguccggcucuuucuggagaauggccuuaaccugagaaaauuccucacccaugacgugcugaccgaacuguuuucuaaucacuucuccacacuuguuuaucgcaaccuccagauugccaagaauagcuacaacgaugcgcugcugaccuuuguguggaagcucgucgcuaauuuccggagaggguuucgcaaagaggaccggaacggaagagaugagauggacaucgaacugcacgaugugucucccauuacacgccauccucuucaggcccuguucaucugggccauucuccagaacaagaaagagcuguccaaggucaucugggaacaaacgcggggcuguacccuggcugcccuuggcgcuagcaaacuccugaagacacuggccaaggugaaaaaugacaucaacgcggccggggaguccgaggaacucgcuaaugaguacgaaaccagagccguugagcuguuuacagaaugcuauucuagcgaugaggaccuugcugaacagcugcucguguacuccugugaggccuggggaggcucuaacugccuggagcuggcggucgaagccaccgaucagcacuucauugcucagcccggggugcaaaauuuucuuagcaagcagugguauggagagaucucccgggacacgaaaaacuggaagauuauccucugccuguucauuaucccucugguuggcuguggguucgugagcuuucgcaaaaagcccgucgauaaacauaagaagcuccugugguacuauguggccuucuuuaccucuccguucguggucuuuuccuggaauguuguguucuacaucgcuuuucuucuucucuucgccuaugugcugcugauggacuuucacagcgucccucaucccccugaacuugugcucuacucucugguuuucgugcuguuuugcgaugaggucagacagugguacgugaacggcguuaauuauuucacagaccucuggaacgugauggacacccugggacuguuuuacuucauugccggcaucgucuuccggcugcacuccagcaauaaaucuagccucuauuccgggagagugaucuuuugucuggauuacauuauuuucacacugcgccuuauccacaucuuuaccguuagccggaaccugggacccaagauuaucaugcuccagagaaugcugauugacguguucuuuuuccucuuucuguucgcugucuggaugguggcguuuggcguggcccgccaagggauccuuagacagaaugaacagcgguggcgcuggauuuucagaucugucaucuaugagcccuaccuggcuauguuuggacagguuccuuccgauguggacggcacgacauaugauuucgcccauugcaccuucacagggaacgagagcaaaccgcucuguguggaacuggacgagcacaaucugccccgguuuccugaauggaucaccauuccccuugucugcaucuacaugcuguccaccaacauucuccuggugaaccuccugguugccauguucggcuacacagugggaacgguccaagagaauaacgaucagguguggaaguuucagcgcuauuuccuuguucaagaguacuguucuagacugaauaucccuuuucccuucauuguguuugcuuauuucuacauggucgugaaaaagugcuuuaaguguugcuguaaagaaaagaacauggagagcuccguuugcugcuucaaaaaugaagacaacgagacccucgccugggaaggcgugaugaaggagaauuaucuggucaaaaucaacacaaaggcgaaugauaccucugaggaaaugcggcaucgcuuuagacagcuggacacaaagcugaacgaucugaaagggcuccugaaggagauugcuaauaaaaucaaguga

SEQ ID NO: 77326 - RNA, 3858 nt, Artificial Sequence
  derived and/or modified sequence opt5 from TRPS1__Homo_sapiens__NP_001269831
augcagagcaacauggugagaaagaaaaaucccccucugcggaacgucgccuccgagggcgaagggcaaauccucgagccgauuggaaccgaaucuaagguuagcggcaaaaauaaggaguucuccgcugaccagaugucugaaaacacagaucagagcgacgccgcggagcugaaucacaaagaggaacauucccuucacgugcaggaucccucuagcuccagcaagaaggaccugaaaucugcugugcucuccgagaaggccggguuuaacuacgaaagcccuucuaaaggaggcaauuuccccuccuuuccucaugaugaggucacggaccgcaacaugcuggccuucagcucucccgcugccgggggagugugcgagccucuuaaguccccgcaaagagcugaagccgaugacccccaggauauggcguguaccccuagcggcgacucccuggagacaaaagaagaucagaagaugucucccaaggccaccgaggaaacaggccaggcucaaagcgggcaggccaauugccagggacucuccccuguuagcguggcuucuaaaaacccccaggucccguccgacggcggggugcggcugaauaagagcaaaaccgaucugcucguuaacgacaauccugaccccgccccucugucucccgagcuucaagauuuuaaguguaacaucugcggauauggcuacuaugggaaugaccccacagaucugauuaaacacuuccgcaaguaccaucucggacugcacaacagaacccggcaggacgcggagcuugauagcaaaauccuggcccuccacaacauggugcaguuuucccauucuaaggacuuccaaaaggucaaucgcagcguguuuuccggcgugcugcaggauauuaacagcucuagaccuguccugcucaauggcacguaugacguucaggugaccuccgggggaacauucaucggcaucgggcggaaaaccccggauugucagggaaacacaaaguacuuucgcugcaaauucuguaauuuuaccuauaugggcaacagcucuacggaacuggagcaacacuuccuucagacacaucccaauaagauuaaggcuucccugccuagcuccgaaguggccaaacccucugagaagaacagcaauaaauccaucccugcucuccagucuagcgacuccggggaucugggaaaguggcaggacaaaauuaccgucaaggccggcgacgauacacccgugggcuacagcguuccgaucaaaccucuugacucuuccagacaaaacgggaccgaagccaccagcuacuauuggugcaaguucuguucuuuuuccugcgagagcucuagcucccugaagcuccuggagcacuacggaaaacagcacggcgcugugcagagcgggggacugaaucccgaacucaacgauaagcugucucggggcuccgucauuaaucagaacgaccuugcgaaaagcuccgagggggaaacaaugacgaagaccgauaaaucuagcuccggcgccaagaagaaagacuucucuagcaagggagcugaggauaauauggugacauccuauaacugucaauuuugcgacuuccgcuacucuaaaagccauggcccugauguuaucguggucgggccccugcucagacacuaucagcagcugcauaacauucacaagugcaccaucaaacauuguccuuuuugcccccggggacuuuguuccccggaaaagcaccugggcgagaucacauacccuuucgccugccgcaaaagcaauuguucucacugcgcccuccugcugcuccaucugucccccggggcugccggaagcucuagagugaagcaccagugucaucaaugcuccuuuaccacgcccgacgucgaugugcuucuguuccacuaugagagcguucacgaaucucaggcguccgacgugaagcaggaggcuaaccaucuccaaggcagcgaugggcagcaguccgucaaagaaagcaaggagcacucuuguacaaaaugcgacuuuauuacccagguggaggaagagaucagccggcauuacagacgcgcccacuccuguuacaagugccggcaaugcucuuucaccgccgcugacacacagagccugcuggaacauuuuaauaccguucacugucaggagcaggauauuacaacggccaacggcgaagaggacggacacgcuaucuccaccauuaaagaggaaccuaagaucgauuucagaguguauaaucuucucacaccggacucuaagaugggcgagcccgucagcgaauccguggugaaacgcgagaagcuggaagagaaagaugggcugaaggagaaaguuuggaccgaaucuagcuccgacgaucuccggaacgucacauggagaggagccgacauccugcgcggcagcccuucuuacacccaagcgucccuugggcugcucacgcccgugagcggaacccaggagcagacaaagacccugcgggauucuccuaauguggaagccgcucaucuggccagacccauuuauggccuugcugucgagacaaagggguuucuccagggcgccccugcgggaggcgaaaaauccggggcccugccccaacaguacccggcuagcggagagaacaaguccaaagacgagucucagagccugcuccgccggagacgcggcuccgggguguucugcgccaauugucugaccacgaagacaagccuuuggcggaaaaacgcuaauggaggcuauguuugcaacgccugugggcuguaccaaaagcuccacucuaccccuagaccccugaauaucauuaagcagaacaauggcgaacagaucauucggcgcagaacacggaaaagacugaacccugaggcccuucaggcugaacaacucaacaagcagcagcgcggauccaaugaggaacaggugaacggcagcccccuggagcggagaucugaggaucaucugaccgaaagccaccaacgcgagaucccgcucccuucccugucuaaauaugaagcgcaggggagccuuaccaagucccauucugcccagcagcccguccuggugagccaaacacucgacauccacaaaagaaugcagccucugcacauucagaucaagagcccccaggaguccacgggagaucccggcaauucuuccagcguuuccgaggggaaaggaucuagcgaacggggcuccccuauugagaaguacaugcgcccggcuaagcaucccaacuacucuccucccggcagcccuaucgaaaaauaucaauacccccuguucgggcuuccuuuugugcacaaugacuuccaguccgaggccgacuggcucagauuuuggagcaaguauaaacugucugucccgggaaacccccauuaccugucccacgugccuggccuccccaauccuugccagaacuauguucccuacccgaccuucaaucugccuccccacuuuagcgccguggggucugauaacgacauuccccuugaucuggcuaucaagcauucccggccuggacccacagccaauggcgcgagcaaagaaaagaccaaggcuccuccgaacgucaaaaaugaggggccccucaacguggugaagacagagaaagucgaccgcucuacccaagaugaacugagcacgaaguguguucacugcggaauuguguuccuggacgaggugauguaugcccuucauauguccugucacggcgauucuggcccuuuucagugcagcaucugucagcaucugugcacagacaaauacgauuucaccacccacauccagagagggcuccaccggaauaacgcccaagucgaaaagaacggaaagcccaaagaguga

SEQ ID NO: 77327 - RNA, 2520 nt, Artificial Sequence
  derived and/or modified sequence opt5 from TRPV1__Homo_sapiens__NP_542437
augaagaaauggagcuccaccgaccugggcgccgcugccgauccccuccagaaggacacaugcccugauccgcuggacggggaucccaacucuagaccucccccugcgaaaccccaacuuagcacggcuaagucccggacccgccuguucggaaaaggcgacucugaggaagccuuuccuguggauuguccgcacgaggaaggggagcucgacagcugccccacaaucaccgucuccccuguuauuacaauccagagacccggagauggcccuaccggggcccggcugcuuucucaggacagcguggcugccuccacagaaaagacccugcgccucuacgauagacggagcauuuucgaggcuguggcccagaauaacugucaagaccuggagucucugcuccuguuucuucagaaguccaaaaagcaucugacggauaaugaauuuaaagaccccgagaccggaaagacaugccuccugaaagcgaugcuuaaccugcacgacggccagaauaccacaaucccgcuccugcuggaaauugcccgccagaccgauagccucaaggagcuggucaacgcuucuuauacggacuccuacuauaagggccaaacagcccuucauaucgcuaucgagagacggaauauggcccuggugacccuccugguugaaaacggggcggaugugcaggccgcugcccacggagacuuuuucaaaaagacaaaaggccgcccuggguuuuacuucggagagcuuccccugagccucgcugccuguaccaaucagcugggcauugucaaguuucugcuccagaacucuuggcaaaccgccgauaucuccgcuagagacagcguggggaauacaguucugcaugcgcuuguggaagucgccgauaacacggcugacaauaccaaauucgugacauccauguauaacgagauucugaugcucggagccaagcugcacccuacccuuaaacuggaagaacucacaaauaagaagggcaugacgccccuggcccuggcugccggcaccgggaaaaucggagugcucgcguacauucugcagcgggagauccaggaacccgagugccgccaccuuucuagaaaguuuacagaaugggcuuauggcccuguccauagcucccuguacgaucucagcuguauugauaccugcgagaaaaacucuguucuggaagugaucgccuacuccagcucugagaccccgaaccggcacgacaugcugcuuguggagccccucaaucgccugcugcaagacaagugggacagauucgucaaacggaucuuuuauuucaacuuccucguguacugucuguauaugauuaucuuuacaauggccgcuuacuauagaccuguugaugggcuucccccuuucaagauggaaaagaccggagacuacuuucgcgugacaggcgagauucugagcguccucgggggaguguauuucuuuuuccggggcauccaguacuuucugcagagacgccccuccaugaaaacgcuguucguugauucuuacagcgaaaugcuuuucuuccuccagucccuguuuaugcuggccaccgugguccucuauuucagccaucugaaggaguacguggcuucuauggucuuuucccuugcccugggcuggacaaauaugcucuauuacacccggggguuccaacagaugggaauuuaugcggugaugaucgagaaaaugauccugagagaccugugccgcuucauguuuguuuacauuguguuccuuuuuggcuucagcacagccgucgugacccucaucgaggaugggaagaacgacucucugccguccgagagcacgucccaccgguggagaggaccugcuugucggcccccugauucuagcuauaauucccuguacucuaccugccucgaacuguuuaaauucacaauuggcaugggggaccuugaguuuaccgaaaacuacgauuucaaggccguuuuuaucauucugcuccuggcuuaugugauccugacauacauccuucuccugaauaugcugauugcccucaugggcgagaccgucaacaagaucgcgcaggagagcaaaaauauuuggaagcugcagcgcgccaucacgauucuugacacagaaaaauccuuccugaagugcaugagaaaggcuuuucgcagcggaaaacuccugcaagugggcuauacccccgaugggaaggacgauuaccggugguguuucagaguggacgagguuaacuggacaaccuggaauaccaacgucggaaucauuaaugaagacccuggcaacugcgagggggugaaacggacacugucuuuuucccuucgcagcucuagaguguccggacggcacuggaagaauuucgcccuggucccccuccugagagaagcuagcgcccgcgaucggcagucugcccagccggaggagguguaucucagacaguucagcggcucccugaaaccugaagacgcugagguuuuuaagagccccgcggccucuggggaaaaauga

SEQ ID NO: 77328 - RNA, 2295 nt, Artificial Sequence
  derived and/or modified sequence opt5 from TRPV2__Homo_sapiens__NP_057197
augaccagccccuccucuagcccuguguucagacuggagacacucgacggcgggcaggaagauggauccgaggccgaccggggcaagcuggauuuugggucuggacuuccgcccauggaaagccaauuccagggcgaggaccgcaaauuugcuccucagaucagagucaaccugaauuaccggaaggggacgggagccucccagcccgauccuaaccgcuucgacagagaucggcucuuuaaugcgguuucucgcggcgugcccgaagaccuggcuggccuuccugaguaucugagcaaaaccuccaaguaccucacagauagcgaguauaccgaagggucuacaggaaaaaccugccugaugaaggccgugcugaaccucaaggacggcgucaaugccuguauucugccgcuucugcaaaucgauagagacuccgggaacccccagccucucgugaaugcucagugcacagaugacuacuaucggggacacagcgcccugcauauugcuaucgagaaacgcucucuucaguguguuaagcugcucguggaaaacggcgccaauguccacgcgagagccugcgggcgguucuuucaaaaaggacagggcaccuguuucuacuuuggcgagcugccccugucccucgcugccugcacgaagcagugggacgugguuagcuaucugcuugagaacccucaucagcccgcuucucugcaagccaccgauucccaggggaauacagugcuccacgcgcuggucaugauuagcgacaacuccgccgaaaauaucgcucuugugaccucuauguacgauggacugcuccaggccggcgcucgccuguguccgacagugcaacuggaggacaucagaaaccuccaggaucugaccccucuuaaacuggccgccaaggaagggaagauugagaucuuccggcauauucuccagcgcgaauuuagcggacugucccaccuuagcagaaaauucacggaguggugcuacggccccguccggguuucucuguaugaccucgcuuccguggauagcugugaggaaaauucugugcuggagaucauugcguuucacugcaagagcccucauagacaccgcauggucgugcuggaaccccucaacaaacugcuucaggccaagugggaccugcucauccccaaauucuuccugaacuuucuguguaaucuuauuuacauguucaucuuuacagcuguugccuaucaucaaccuacccucaagaaacaggccgcuccgcaccugaaggccgagguggggaacuccaugcugcucacaggacacauccugauucuucugggcggcaucuaccuccuggucgggcagcugugguauuucuggcggagacauguguuuauuuggaucucuuucauugauagcuacuuugaaauccuuuuccucuuucaggcgcugcugaccguugugucccaaguccucugcuuccuggcuaucgagugguaucuuccccugcucgugagcgcccugguccugggauggcuuaaucuccuguacuacacccgcggcuuucagcacacagggauuuauucugugaugauccagaagguuauucugcgggaccuccugagauuccuucugaucuaccucguguuucuguucggauucgccgucgcucuggugucccuuagccaggaggccuggcgcccugaagcucccacgggcccuaacgccaccgagucuguucaacccauggaagggcaggaggaugaaggcaauggagcgcaguaucggggcauucucgaggccucccuggagcuguuuaaauucacaaucgggaugggagaacucgcuuuucaggagcaacugcauuucagaggcauggugcuucugcuccugcuggccuacguccuucugaccuauauccuccugcucaacaugcugauugcucuuaugagcgaaacaguuaauuccguggccaccgacucuuggagcaucuggaagcugcagaaagcgauuuccgugcucgagauggagaacggguacugguggugccgcaagaaacagcgggccggagucaugcugacggugggcacaaagccggacgggucuccugaugaaagaugguguuuucgcguggaggaagucaauugggcuagcugggagcaaacccugcccacccuuugcgaagacccuuccggcgccggagugccccggacacuggagaacccuguucucgcuucucccccgaaggaggaugaagacggcgccagcgaggaaaauuaugugccuguccagcugcuccaguccaacuga

SEQ ID NO: 77329 - RNA, 2376 nt, Artificial Sequence
  derived and/or modified sequence opt5 from TRPV3__Homo_sapiens__NP_001245134
augaaggcccaccccaaagagauggugccucugaugggcaagagagucgcugccccgagcgggaaccccgcgauccucccugaaaaacggcccgcugagauuaccccuacaaagaaauccgcccauuucuuucuggaaaucgagggauucgaacccaauccuacgguugccaagaccucuccgcccguguuuagcaagccuauggacuccaacauucgccagugcaucucuggcaauugugaugacauggauagcccccaauccccucaggacgaugugacagagacccccucuaacccgaauagcccuuccgcucagcuugccaaagaggaacagagacggaagaaacgcagacugaagaaacggauuuucgcugccgucagcgaggggugcguggaggagcucguugagcugcuuguggaacugcaagagcucugucgcagacggcacgacgaagauguccccgacuuucugaugcauaagcugacagcgucugauaccggaaagacaugccucaugaaagcccugcuuaacaucaauccuaacaccaaggagaucgugcgcauucugcucgcuuucgccgaagagaaugacauccugggcagauuuauuaacgcugaguacacggaagaggccuaugaagggcagaccgcgcuuaauaucgccauugagcggcgccagggagauaucgcugcccugcucauugcugccggcgccgacguuaacgcucacgcgaaaggcgccuucuuuaaucccaaguaccagcaugaaggguucuauuuuggagagacaccccuggcucuggccgccuguaccaaccaaccugagaucgugcagcuccugauggaacacgagcagacagauaucaccuccagagacagccggggcaauaacauucuucacgcucuggucacgguggccgaagacuucaaaacacagaacgauuuugugaagcgcauguacgacaugauccuccugagaucugggaauugggagcuugaaaccacacggaacaaugauggacugaccccgcuccaacuggcggcuaaaaugggcaaggccgagauucugaaguauauccucuccagagagauuaaagaaaagcgccugcggagccuuucuagaaaauucaccgacugggccuacgggcccgucuccagcucccuguaugaucucacaaacguugacacgaccacagauaauucugugcuggagaucaccguguacaacacaaauaucgacaaccgccaugaaaugcuuacccuggagccucuccacacgcugcugcauaugaaguggaaaaaguucgcuaagcacauguuuuuccucagcuuuugcuucuacuuuuucuauaauauuacacugacccuugucuccuacuaucggcccagagaggaagaggccaucccucacccccuggcucucacccauaaaaugggauggcugcagcugcuuggccgcauguuugugcucauuugggccauguguaucagcguuaaggaaggcauugcgaucuuccugcugcggccgucugaucuccaguccauccugagcgacgccugguuucacuucguguuuuucauucaagcuguccuugugauccugucuguuuuucucuaccuguucgccuauaaagaguaccuggcuugccuugugcucgccauggcgcuggggugggccaacaugcuguauuacacaagaggauuccagagcaugggcauguacuccgucaugauucagaaggugauccuccaugauguccugaaauuucuuuucguguauauuguuuuucugcucggguucggaguggcucuggccucucugaucgaaaaguguccuaaggacaauaaagacugcagcuccuacggcagcuuuucugaugcuguccuugaacucuucaagcugaccauugggcugggagaccucaacauccagcaaaauuccaaauaucccauccuguuucuuuuccugcucauuacauacgugauccugacguuuguucugcuucucaacaugcugauugcccugaugggcgagaccguggaaaaugucagcaaggagucugaacgcaucuggcggcuccagagagcccgcacaauucuggaguucgagaaaaugcuuccugaauggcugcgguccagauuucggaugggcgagcucuguaagguggcugaagaugacuuccgccugugccugagaaucaacgaggugaaguggaccgaauggaaaacacacguuagcuuucuuaacgaggaucccgggccuguccggagaaccgcggacuucaauaagauccaggauuccucucgcaacaauagcaaaacgacccugaacgccuucgaagagguggaggaauuucccgagacauccguguga

SEQ ID NO: 77330 - RNA, 2514 nt, Artificial Sequence
  derived and/or modified sequence opt5 from TRPV4__Homo_sapiens__NP_001170902
auggccgacagcuccgagggccccagagcugggccuggagaaguggccgagcugccgggcgaugaaucugggacccccggagacggccggccuaaccuccgcaugaaguuccagggggcguuuagaaaaggaguccccaauccuaucgaucugcuugagagcacacuguacgaauccucuguugugcccggcccuaagaaagcuccgauggacagccucuucgauuauggcacguaccggcaccauuccucugacaacaagcgcuggagaaagaagauuaucgagaagcaaccccagagcccuaaagcccccgccccucagcccccgccuauucugaagguguuuaaucggcccauccuuuucgauauugucucccgcgggagcaccgcugaccuggauggacuccugccuuuucugcucacacacaaaaagagacugaccgacgaggaguuccgggaacccucuacaggcaaaaccugccuucccaaggcccugcucaaccuguccaaugggcgcaacgauacaaucccugugcuucuggacaucgcugaaagaaccggaaauaugcgggaguuuauuaacagcccguuccgcgauaucuauuacagaggccagacggcccuccauauugcgaucgagcggcgcuguaagcacuauguugaacugcugguggcccaaggggcugacguccaugcccaggcuagaggacgguuuuuccagcccaaagacgagggcggcuacuuuuauuucggggaacucccucugucucuugccgcgugcaccaaucagccccacauugugaacuaccugacagagaauccucacaagaaagccgauaugagacgccaagacucccggggaaacaccguucuccaugcucugguggccaucgcugauaauacaagagaaaacaccaaguuugucacgaaaauguacgaccuucugcuccugaagugugcccgccuguuccccgauagcaaucucgaggccgugcugaacaacgacggccuuucuccgcugaugauggcugcgaaaacagggaagauuggaaucuuccagcacaucauucggagagaggugaccgaugaagacacacgccaucucucccggaaguuuaaagauugggccuauggcccugucuacagcucccuguaugaccuuucuagccuggauaccugcggggaggaggcuuccguucucgaaauccugguguacaauagcaagauugaaaacagacacgagaugcuggccguggagcccaucaaugaacuccugcgcgacaaauggcggaaguucggagccgucucuuuuuauauuaacgugguuuccuaccuuugugcuauggugaucuucacccugacagccuauuaccagccucucgagggcacgcccccuuaccccuauagaaccacagucgacuaccugcgccuggcgggcgaagugaucacccuuuuuacagggguucucuucuuuuucaccaauauuaaagaucuguuuaugaagaagugcccgggagugaacagccuguucaucgacggcucuuuucagcuccuguauuucauuuacagcguccuugugaucgucuccgcugcccuguaucucgccgggauugaggcuuaccuggccgugaugguuuuugcucuggugcuuggauggaugaaugcccucuauuucacgcggggccugaaacugacagggaccuacucuaucaugauccaaaagauucucuucaaagaucuguuuagauuccuucuggucuaccuccuguuuaugaucggcuaugcgagcgcccuggugucccuucucaacccuugugcuaauaugaagguuugcaacgaagaccagaccaauuguacagugcccaccuaccccagcugccgggauucugagacauucuccacguuucugcuggaccucuucaaacugaccauuggaaugggcgaucuugagaugcugagcucuacaaaguauccugucguguuuaucauucuccuggugaccuacaucauucugacauucguucuucuccugaacaugcugaucgcccucaugggggaaaccgucggacagguguccaaggagagcaaacacaucuggaagcugcaaugggcuacgaccauucuugacaucgaacgcuccuuuccgguguuccugagaaaagccuuucggucuggcgagauggucacaguggggaaaagcuccgauggaacccccgacagacgcugguguuuccggguugaugaggugaauuggucucauuggaaccagaaucucggcauuaucaacgaagacccugggaaaaacgagacauaucaguacuauggcuuuagccacaccgucggaagacugcgcagagaucggugguccagcgugguuccccgcguggucgaacugaauaagaacucuaauccugacgaggugguugugccccuugacuccaugggcaacccuagaugcgaugggcaucagcaaggauacccccggaaguggcgcacggacgaugcgccgcuguga

SEQ ID NO: 77331 - RNA, 2190 nt, Artificial Sequence
  derived and/or modified sequence opt5 from TRPV5__Homo_sapiens__NP_062815
augggcggguuccugcccaaggccgagggaccuggcagccagcuccaaaaacugcuuccguccuuucuggugagagaacaggacugggaucagcaccucgacaagcugcauaugcuucagcaaaaacggauccuggagucuccccuccugcgcgcuagcaaggaaaacgaucuguccguccucagacagcugcuucuggacugcaccugugauguucggcagcgcggggcccucggagagacagcgcugcacauugcugcccuuuacgacaaucuggaagccgcucucgugcugauggaggccgcuccugagcugguguucgaacccacgaccugcgaggccuuugcgggccagacagcccuccauaucgcugucgugaaccaaaauguuaaccuggugagagcccuucugacccggcgcgcuucugucagcgccagagcgacagggaccgccuuccggcacuccccucgcaaucucauuuauuuuggagaacauccccugucuuucgcugccugugugaacagcgaggagaucguuagacuucugauugaacacggcgcugauauccgggcccaggacucccucggcaauacagugcugcacauccugauucuccagccuaacaaaaccuuugccugccagauguacaaucugcuucugagcuaugaugggcauggagaccaccuccaaccgcuggaucuuguccccaaccaucagggccugacgccuuucaagcucgcugggguggagggaaauaccgugauguuucagcaccugaugcaaaagcgcagacacauccaguggacauacggcccccugaccucuauucucuaugaccugacagaaaucgauuccuggggagaggaacuuagcuuccuggagcucgucguuucuuccgacaaacgggaggcgcgccagauucuggaacagaccccugugaaggagcuggugagcuuuaaauggaacaaguacgggagacccuauuucuguauccuugccgcucucuaccugcuguacaugauuugcuuuacgacauguugcgucuaucggccgcucaaauucagaggcggcaaucgcacccauucucgggacaucacaauccugcaacagaaacuucugcaggaagccuacgagaccagagaagauauuauccgccucgugggggagcugguuuccauugugggagccgucaucauucugcuucucgagaucccugacaucuuccgggugggcgcuagcagauauuuugggaagaccauucugggaggccccuuccacguuaucauuaucacauacgccucccuggugcucgucacgauggugaugcgccugaccaacacaaauggggaagucgugccuaugucuuuugcgcuuguucugggaugguguagcgugauguauuucacccggggcuuucagaugcucggccccuucacaauuaugauccaaaagaugaucuuuggggaucugaugagauucugcuggcugauggcugucgugauucuuggauuugccuccgccuucuacaucauuuuucagaccgaggaccccacgagccucggccaguucuaugauuacccuauggcucuguuuacaaccuucgaacuguuccucaccguuaucgacgccccggcuaacuacgauguggaccugcccuuuauguucucuauugucaacuuugccuucacaaucauugcgacccuucugaugcucaaucuguuuaucgccaugaugggggauacacauuggcgcguggcucaggagcgggacgaacuguggagagcccaagugguugcuacgaccgucaugcuugagcgcaagcucccucggugucuguggcccagauccggaaucugcggcugcgaguucgggcugggcgaucggugguuucuccgcguggaaaaccacaaugaccagaacccucugagagugcuucgguaugucgagguguucaaaaauagcgacaaggaagaugaccaggagcaucccucugagaaacagccgagcggagccgaauccggcacacuggcgagagccucucucgcucugccuaccagcucccugagccgcacagccucucaauccagcucucaccgggggugggagauucuuagacagaacacccugggacaccucaaucugggccucaaccuguccgaaggggauggagaggaaguuuaccauuuuuga

SEQ ID NO: 77332 - RNA, 2298 nt, Artificial Sequence
  derived and/or modified sequence opt5 from TRPV6__Homo_sapiens__NP_061116
augggcccccugcagggggacggaggcccugcccucgggggagcugauguggccccgagacugagccccguccggguuuggccucgcccccaagcgccuaaggagcccgcucugcacccuaugggccugucccucccgaaagaaaaggggcugauccuuugccuguggucuaaauucuguagaugguuucagcggcgcgagagcugggcccaguccagagacgaacagaaccuccugcaacagaagcggauuugggagucuccccugcuccuggccgcuaaagauaaugacgugcaggcccuuaacaagcugcucaaguacgaagauugcaaagugcaucagcgcggagcuaugggcgagaccgcccugcacaucgcggcccuuuaugacaaucuggaggcugccaugguccucauggaagcugccccugagcugguguucgaacccaugacaagcgagcuguacgagggccaaacggcgcuccauauugccguugugaaccagaauaugaaccuggucagagcccuucuggcucggcgcgcuuccgugucugccagagccaccgggacagcuuuucggcgcagcccuuguaaucucaucuauuucggagaacacccccuguccuuugcggccugcguuaacagcgaggaaauugugagacuucugaucgagcauggcgcugauauccgggcccaggacucucucgggaauaccguccugcacauucugauccuccagccgaacaagacauucgccugucaaauguacaaucugcuucuguccuaugaucgccacggagaccaucuccagccucuggaucuugugcccaaccaccagggccugaccccuuuuaaacucgcugggguggaaggaaauacagucauguuccaacaucugaugcagaagagaaaacacacccaguggacguacggcccccugaccagcacacucuaugaccugaccgagauugauucuuccggcgacgagcagagccuucuggaacucaucauuacaaccaagaagcgggaggccagacaaauccuggaccagacgcccguuaaagaacuggugucucuuaaguggaaacgcuacgggcggccuuacuuuugcaugcucggagcgauuuaucugcuguacaucaucuguuucacaaugugcuguauuuauagaccgcucaagccccgcaccaacaaucggacauccccuagagauaacacccugcuucagcagaaacugcuccaagaggcuuacaugacccccaaggacgauauccgccuggugggcgaacuggucacagugauuggggccaucauuauccuucucguugaggugccugacaucuuucggaugggagucacgagauucuuuggccagaccauucuugggggacccuuccacgugcugaucauuacauaugccuucaugguucucgugaccauggucaugcgccugaucagcgcuuccggcgagguggucccgaugucuuuugcccuugugcugggcuggugcaacguuauguacuucgcucggggguuucagaugcucggaccuuucacaauuaugauccagaaaaugaucuuuggcgaucugaugagauucuguuggcugauggccguggucauucuuggguuugcgagcgccuucuauaucauuuuucaaaccgaagaccccgaggaacucggacauuucuacgauuacccuauggcucuguuuuccacguucgagcuguuucucacaaucauugacggccccgccaauuauaacguggaucugccuuucauguacagcaucaccuaugcugccuucgcgauuaucgccacccuucugaugcucaaucugcugaucgcuaugaugggggacacacacuggcgcguugcccaugaacgggaugagcuuuggagagcucagauuguggccaccacagucaugcucgagcggaagcugccccgcugccuguggccgagaucuggcaucugcggacgggaauacggccucggggacagaugguuucugcgcguggaggaccggcaggaucuuaacagacagcgcauucaaagauaugcccaggcuuuccacacgcggggauccgaagaccuggauaaggacagcguggagaaacucgagcugggcuguccuuuuucuccccaucugagccuucccaugccuuccguuucucgcagcaccuccagaagcucugcgaauugggaacggcugcgccaggggacacucagacgggaucugcgcggaaucauuaacagaggccucgaggacggggaauccugggaguaccaaaucuga

SEQ ID NO: 77333 - RNA, 11580 nt, Artificial Sequence
  derived and/or modified sequence opt5 from TRRAP__Homo_sapiens__NP_001231509
auggccuucguggcuacccagggcgccacaguuguugaccaaacgacccugaugaagaaguaccuccaguuuguggccgcucugacagaugugaacacccccgacgaaacaaaacuuaagaugaugcaggaagucagcgagaauuucgaaaacgugaccuccucuccucaguauagcacauuucuggagcacaucauucccagauuccucaccuuucugcaagauggggaaguucaguuccuucaggagaagcccgcccagcaacugcggaagcucgugcuggagaucauucaccgcaucccuacgaaugaacaccugagaccccauaccaagaacguccucuccgugauguuucgguuccuggagacagaaaaugaggagaacguucuuauuugccugcgcaucaucauugaacuccacaagcaguuuagaccucccaucacccaggagauucaccacuuccuggacuuugugaaacagaucuacaaggaacuuccuaaagucgugaaucgguauuucgagaacccgcaagugauucccgaaaauacagucccucccccugagaugguuggaaugaucaccacgauugccgugaaggugaaccccgagcgcgaagauucugagacaagaacccacagcaucaucccgcggggcucccugucucucaaaguccuggcugaacugccuauuaucgugguucucauguaccagcuguauaaacuuaauauucacaacguggucgccgaguuugugccccugaucaugaauacaauugcuauccagguuagcgcccaagcgcgccagcacaagcucuacaacaaagaacuguaugccgacuucaucgcugcccagauuaagacccuuuccuuccuggcuuacaucauuagaaucuaccaggagcucgugaccaaauauagccaacagauggucaaggggaugcugcagcugcucucuaauuguccugccgagacagcgcaucugcggaaagaacuucugauugccgcuaagcacauccucacgaccgagcugcgcaaccaguuuauccccugcauggauaaacuuuucgacgaauccauucugaucggaagcggcuacacagccagagagacccuccggccccuggcuuauucuacacuggccgaucucgugcaccauguccgccaacaucugccucuuuccgaccugagccucgccgugcagcuguuugcuaagaacauugaugacgaaucucugccguccagcauccagaccauguccuguaaacuucuccugaaucugguugauugcauuagaucuaaaagcgagcaggaguccgggaacggacgggacgugcucaugagaaugcuggaagucuucgugcuuaaguuucauacgaucgcgcgcuaccaacugagcgccauuuucaaaaaguguaaaccccagucugagcucggcgcuguugaagccgcccugccuggcgugcccacagcuccugccgcgcccgggccggcuccuucccccgccccuguccccgccccucccccgccuccgcccccuccgcccccugcuacccccgugaccccugcccccgugccucccuuugagaagcagggagagaaggacaaagaagauaagcagacauuccaaguuaccgacugccggagccuggucaaaacacuuguguguggcgugaagacgaucaccugggggaucacaucuugcaaagcuccgggagaggcccaguuuauuccuaauaagcagcuccaacccaaggaaacccagaucuauauuaaacuggucaaguacgcgaugcaggcccuggauaucuaucaggugcaaauugcuggcaacgggcagacauacaucagaguugccaauugucagaccgugcgcaugaaagaggaaaaggagguccucgagcacuucgcuggaguguuuacgaugaugaacccucugaccuucaaagaaaucuuucagacaaccguucccuacaugguggagcggauuagcaagaauuaugcccuucaaaucgucgcgaacuccuuccuggccaauccgacaaccucugcucucuucgccacgauucugguggaauaccugcuugacagacucccugagaugggcagcaacguugaacuguccaaucuguaucucaagcuguuuaaacuuguguucggcagcgucucucuguuugcugccgagaacgagcagaugcucaagccccaucugcacaaaaucgucaauuccagcauggaacuggcccagacagcuaaggagccuuacaacuauuuccuucuccugcgcgcgcuguuucggucuauugggggaggcucccacgaucuccuguaccaggaguuccuuccccugcuccccaaucugcugcaagggcuuaacaugcugcagagcggacuccauaaacagcacaugaaggaccuguuuguggagcucugccugaccgucccuguuagacuuuccucucugcucccguaucugcccaugcugauggauccucuugugagcgcccugaacggcucccaaacacucgugucucaggggcugcgcacccucgaacugugugucgacaaucuucagcccgauuuccuguacgaccauauccagccugugcgggcugagcucaugcaagcccuguggagaacccugcgcaaccccgccgauagcaucucccacguugcuuaccgggugcuuggaaaauuuggcggcagcaauagaaagaugcugaaggagucucagaaacuccacuaugucgugacagaaguucaggggccuuccauuacgguggaguucagcgacugcaaggccucucugcagcucccgauggaaaaagcgaucgagaccgcucuggacugccuuaaguccgccaacacagagcccuacuaucggcgccaagccugggaagucauuaaauguuuucugguggcuaugaugagccuggaggauaauaagcaugcccucuaccagcugcuugcgcacccuaacuucaccgaaaagacaauccccaauguuauuaucucucauagauauaaagcucaggacaccccugcccggaagacguuugagcaggcccugacaggagcuuucaugagcgccgugaucaaagaucucagacccuccgcucugccguucgucgccagccucauucgccacuacaccaugguggcgguggcccaacagugcggcccuuuucugcuucccuguuaucaggucgggucucagcccuccaccgcuauguuccauagcgaagagaacggauccaagggcauggacccucugguucugaucgaugccauugcuaucugcauggccuacgaggaaaaagagcucuguaagauuggggaaguggcccuggcugugaucuuugacgucgcgucuauuauccuuggcagcaaggagcgggccugccaacugccccucuucuccuacaucguggaaagacugugugcuugcuguuaugagcaggccugguacgccaaacucggaggcguugugucuauuaaguuucugauggagcgccuuccucugacauggguccugcagaaucaacagaccuuccucaaagcucugcuuuuugugaugauggaucugacaggggaaguuagcaacggagccguggcgauggcuaagacgacccucgagcagcugcucaugagaugcgccacaccgcugaaagacgaagaacgggccgaagagaucgucgcugcccaggagaaguccuuccaccacgugacccaugaucuuguccgcgaagugacaucucccaauagcaccguuagaaagcaagcgaugcacucccuccaggugcuggcucaggucacgggcaaaagcgugaccguuauuauggagccucauaaggaagugcugcaggacauggugcccccuaaaaagcaucugcuucggcaucaacccgccaacgcccagaucgggcugauggagggaaauacauuuuguaccacacuccagccgcgccuguucaccauggaucugaacgugguggagcacaaagucuuuuauacagaacuccuuaaucugugcgaggcugaagacucugcccugaccaagcucccuugcuacaaaucccugcccagccuugucccucugagaauugcugcccucaacgcgcuggccgcuuguaacuaucugccccagucucgggagaagaucaucgccgcucucuucaaggcccuuaauuccacgaacagcgaacugcaagaggccggcgaggcuugcaugcgcaaauuccuggaaggggcgacaauugagguggaucagauccacacccauaugagaccucuccugaugaugcuuggcgacuaccggucucugacccucaauguggucaaccgccugacauccgugaccagacuguuucccaauagcuucaacgacaaguuuugugaucagaugaugcaacaccuccggaaauggauggaaguuguggucauuacgcauaagggaggccagagauccgacgggaaugagagcaucucugaaugcggacgcuguccgcuuagcccuuucugccaguuugaggagaugaaaauuuguuccgccaucaucaaccuguuccaccugauucccgcugcuccccagacacucgugaagccucugcuugaaguugugaugaagaccgagcgggccaugcugaucgaagccggcucuccguuuagagagccccucauuaaauuccugacacgccacccuagccaaaccgucgaacuguuuaugauggaggccacacucaaugauccccaguggucccggauguucaugucuuuucuuaagcauaaagacgcgagaccucugcgcgaugugcuggcugccaaccccaaucgguucaucacccuccugcuuccugggggagcccagacggcuguuagaccgggcagccccuccaccucuacaaugcgccuggaccuccaguuucaagccauuaagaucauuagcaucaucgugaaaaacgaugacuccuggcuggcgagccagcacucucuggucucccagcuccggagagugugggugagcgagaauuuccaggaacggcaucgcaaggagaacauggccgcuaccaauuggaaggaaccuaaacuucuggccuauugccugcucaacuacuguaagagaaacuacggggauauugagcugcuuuuccaacugcuccgggcuuuuacaggccgcuuccugugcaauaugaccuuucugaaagaguauauggaagaggaaauccccaagaacuacucuauugcccagaaaagagcucucuucuuucgguucgucgacuuuaaugauccuaacuucggagacgagcuuaaggccaagguucugcagcacauccugaaucccgcguuucucuauuccuucgaaaaaggcgagggggagcagcugcuuggaccgccuaaccccgaaggcgauaaucccgagagcauuacguccguguuuaucacaaaggugcuggacccugaaaaacaagccgacaugcucgauucucugagaaucuaccugcuccaguaugcuacccuucuggucgagcaugcgccccaccacauucaugacaacaauaagaaccgcaauagcaaacugcggagacucaugacauucgcuuggccuugucugcuuuccaaggccugcguggauccggccugcaaguacagcgggcaucugcuccuggcucauaucauugcgaaauuugccauccacaagaaaauuguucugcaaguguuccacucucuccuuaaggcucaugccauggaagcccgcgcuaucguccggcaagccauggcgauccugacccccgccgugccugcuagaauggaggacggacaccagaugcugacccauuggacacgcaaaauuaucguugaggaaggccacacggugccccagcucguccauauucugcaccuuaucgugcagcacuucaaggucuauuacccugugcggcaucaccugguucaacauaugguguccgccaugcagagacucggguuuacccccagcgugacaauugagcagcgcagacuggcugucgaucugucugaaguugugaucaaaugggagcuccagcggauuaaggaccaacagccggauagcgacauggauccuaacuccucuggcgaaggagugaauagcgucuccucuagcaucaagcgcggccuuuccguggacagcgcccaggagguuaaaagauuccggaccgcgacaggggccaucucugcuguguuuggacgcucccagagccugcccggcgccgauucccugcucgcuaagccuauugacaaacaacacaccgacacggucgugaacuuccugaucagagucgccugucaggugaaugauaacacaaauaccgcugggucucccggagagguucuuagccggagaugcgugaaccugcucaagaccgcccugcgcccugacauguggcccaaauccgaacugaagcuccagugguuugauaagcugcuuaugacagucgagcaaccgaaccaggugaauuacggcaacauuuguaccggccuggaaguucucucuuuccugcuuacagugcugcagagcccugcgauccucuccagcuuuaaaccccugcagcgggggauugccgcuugcaugacguguggaaauaccaagguccugagagccgugcacucucuccugucccgccuuaugagcaucuuccccacagagccuucuaccuccagcguggcuucuaaauaugaggaacuggagugccucuacgccgccguuggcaaggucaucuaugaagggcugacaaacuacgagaaagcgaccaaugcuaacccgagccaacuuuuuggaacgcugaugauucucaaguccgccuguucuaauaaccccagcuauaucgaccggcugauuuccguguucaugagaagccugcagaagauggugcgggaacaucucaauccucaggcugccuccggcucuaccgaggccacaagcgggaccuccgagcuggucaugcuuucucuggaacucguuaaaacacgccuggcugugaugagcauggagaugagaaagaacuuuauccaggccauucuuaccucccugaucgaaaaaucucccgaugcgaagauccuccgggccguggucaaaauuguggaggaauggguuaagaauaacagcccuauggcugccaaucaaacacccacgcugcgcgagaaguccauccugcucgugaaaaugaugaccuacauugagaagagauucccugaagaccuggagcuuaacgcucaguuucuggaucucgucaauuauguguaccgggacgaaacacugagcggaucugagcuuaccgccaaacuggaacccgcguuccucuccggccugcgcugcgcccagccgcugaucagagcuaaguucuuugagguuuucgauaacagcaugaaacggcgcguguacgagagacuccuguaugucaccuguucucagaacugggaagccaugggcaaucacuuuuggauuaagcaaugcaucgagcuucugcucgcugugugugaaaaauccacaccuauugggacgagcugccagggagccaugcugcccucuaucaccaacgugaucaaucuugcugacucccaugaucgggccgcguucgccauggucacacacguuaagcaggagccuagagagcgcgaaaacagcgaguccaaggaagaggacguggaaauugauaucgagcuggcucccggcgaccaaaccagcacaccgaaaaccaaggagcucucugaaaaagacauugggaaucagcugcauaugcugacgaaccggcacgauaaguuucucgacacacugagagaggugaaaaccggagcccuucugagcgcuuucguccagcucugccacaucuccaccacacuggccgaaaagaccugggugcagcuuuuuccucgccuguggaagauucucucugaucggcaacagcaugcccuggcgggcgagaucagccccuuccuguguuccgggucucaccagguucagagagacugccaacccagcgcucucaauuguuuuguggaagccaugucccagugcgucccucccaucccuauucgcccgugugugcugaaauaccuuggaaagacacauaaccugugguuccggucuacccucaugcuggagcaccaggccuuugagaaaggccuuagccugcagaucaagcccaaacaaacgacagaguucuaugagcaggaauccauuaccccuccccagcaggagauccucgauagccuggcugaacuguacucucuucugcaagaggaggacaugugggccggccucuggcagaagagaugcaaguauuccgaaacagcuaccgccauugcguacgagcagcauggguuuuucgaacaagcccaggagagcuaugagaaagcuauggauaaggccaaaaaggaacacgagcgcucuaaugcuuccccugccaucuuccccgaauaccagcugugggaggaccacuggauccgguguagcaaagaacucaaccagugggaggcgcugacggaguacggacaauccaagggccauauuaauccuuaucuuguucuggaaugcgccuggagagugucuaacuggaccgcuaugaaggaggcccugguccagguggaaguuagcuguccgaaagagauggcuuggaaggugaauauguaccgcggguaucucgccaucugccaccccgaagaacagcagcuguccuuuauugagcggcuugucgaaauggcuagcucucuggccaucagagaguggcgcagacucccucauguggucucccacgugcacacaccccugcuccaagcggcccagcagauuaucgaacugcaggaggcugcccaaauuaacgccggacugcagccuaccaaucuuggccggaacaacagccugcaugauaugaaaacaguugugaagaccuggcgcaauagacuccccaucgucucugacgaucugagccacugguccucuaucuucauguggcggcagcaucacuaccaagggaaaccgacauggagcggaaugcauuccucuagcauugugaccgcuuaugaaaacuccagccagcacgacccuucuuccaauaacgccaugcuuggcgugcacgcgagcgcuuccgccaucauucaguacggcaagaucgccagaaaacaggggcugguuaauguggcucucgauauucugucucggauccauacgauccccacaguccccauuguggacuguuuucaaaagauccgccagcagguuaagugcuaucuccagcuggccggagugaugggcaaaaacgagugcaugcaagggcuggaggucauugaaagcaccaaucuuaaguacuucaccaaagagaugacagcugaauuuuacgcccugaagggaauguuccucgcgcagaucaacaaauccgaggaggccaauaaggcuuuuucugccgcugugcagaugcacgacguccuggugaaggccugggcgauguggggcgauuaucuugaaaacauuuucguuaaagagagacagcugcaucucggggugagcgccaucaccuguuaccugcacgcuugccggcaccaaaaugaauccaagagccgcaaauaucuggccaagguccucuggcugcuuucuuuugacgaugacaaaaacacacuggcugaugccguggacaaguacuguaucggaguuccucccauucaguggcucgccuggaucccucagcugcuuacgugccuggugggcuccgagggcaagcuccugcugaaucucauuagccaggucgggagaguguauccgcaagcuguguacuuccccauccggacccuguaucuuacacugaaaauugaacagcgcgagagauacaagucugauccuggacccauccgggcgaccgccccuauguggcgcuguuccagaaucaugcauaugcagcgggagcuccaccccacacugcuuagcucucuggaaggcauuguugaccaaauggucugguuucgcgagaacuggcaugaagaggugcucagacagcugcagcaggggcuggcuaaaugcuacuccguggccuucgaaaagagcggagccgucucugaugcuaaaaucaccccgcacacgcucaauuuugugaagaagcugguuagcaccuucggcguggggcuugagaacgucuccaacgugagcacaauguucuccucugccgcgagcgagucccuggcucggcgcgcccaagccaccgcucaggacccuguuuuucagaaacucaagggacaguucacaaccgauuuugacuucucugugcccggcagcaugaaacugcauaaucuuauuuccaagcugaaaaaguggaucaagauucucgaagccaaaacgaagcaacugccuaaauuuuuccugaucgaggaaaaguguagauuucucucuaacuucagcgcucagacagccgaggucgaaauucccggcgaguuucugaugccgaaaccuacccacuauuacaucaagaucgcgcgguucaugcccagaguggagauuguucagaaacacaauacagccgcucgccggcuuuauaucagagggcauaacggaaagauuuaccccuaucuggugaugaaugacgccugccucaccgaaucccgccgggaggaaagaguccugcagcuucugcgccuccugaacccuugucuggagaagcggaaagagaccacaaagagacaccucuuuuucacggugccccgcguggucgcuguuagcccucaaaugcggcugguggaagauaauccgucuucccuuagccugguggagaucuacaaacagagaugcgccaagaaaggcauugaacaugacaaccccaucucucgcuauuacgaucggcucgcgaccguccaggccagagggacacaggcuucccaccaggugcugcgggacauccuuaaggagguucagagcaauauggugccuagaucuaugcugaaggaaugggcccuccauaccuuucccaacgcuacagauuacuggaccuuccgcaaaauguucacgauucagcuggcccugaucggauuugccgaguucguccuccaccugaaucggcuuaacccugagaugcugcaaauugcucaggacacaggcaagcucaauguggcguauuuuagauucgauaucaacgacgccaccggggaucuggacgcuaaucgccccguuccuuuuagacugaccccgaacauuuccgaguuccucacaaccaucggagugagcggcccccuuacagccucuaugaucgccgucgcucgguguuuugcccagccuaacuucaaaguggauggcauucugaagacgguccugcgcgacgagaucauugcguggcacaaaaagacccaggaagauacauccagcccccucagcgcugccgggcaaccugagaauauggacucccagcagcuggugucucuuguucagaaggccgugaccgcuaucaugacaagacugcauaaccucgcccaauuugaaggaggcgagagcaaagucaauacccugguggcugccgcgaacucccuggacaaucuuugccggauggaucccgccuggcacccguggcucuga

SEQ ID NO: 77334 - RNA, 432 nt, Artificial Sequence
  derived and/or modified sequence opt5 from TSACC__Homo_sapiens__NP_001291755
augggcgagagacccgccgggcuggcucagggaaccacaccugugggcguccaaauggaacggcacacgagccauccgaaccgcaagguucccgccaaagaggaagcgaaugcugugccucucugcagagccaagcccuccccuucuuacaucaaccugcaggccagcucucccccugcuaccuuccuuaauauucagacaaccaaacugccguccguggaccacaagcccaaagagugucucgggcugcuugaaugcauguaugccaaccugcagcuccaaacacagcuggcucagcagcaaauggccguccuggagcaucuccaggcgagcgugacccagcuggccccuggacggggcuccaauaacucuagccuucccgcucuguccccuaauccccuccugaaccaccuuccgcaguuuagcaaguga

SEQ ID NO: 77335 - RNA, 3342 nt, Artificial Sequence
  derived and/or modified sequence opt5 from TSC1__Homo_sapiens__NP_001155899
auggcccagcaagcuaacgugggcgagcugcucgccaugcuggacagccccaugcuuggggucagagaugacguuaccgcgguguucaaggaaaaucugaacuccgaucggggaccuaugcucgugaauacacuggucgacuacuaucuugagacgucuagccagccggcucugcacauccucaccacacugcaggaaccccaugauaaaauggacaccgaugugguugugcugacaaccggcguccucgugcugauuacaaugcuuccuaugaucccccaguccgggaagcaacaucugcucgacuuuuucgauauuuuuggacgccugucuagcuggugccuuaaaaagccuggccacguugccgagguguaccugguccaccuccaugccuccguguaugcucuguuccacagacuguacgggauguaucccuguaacuuugugucuuuccuccggagccacuacuccaugaaagaaaaucuggagaccuuugaggaagucguuaagccuaugauggagcaugugcgcauccacccggaacuugugacgggaagcaaggaccaugagcuggaucccagacgguggaaacgccucgagacccacgacgucgugauugaaugcgccaagaucucucuggauccuacagaggcuuccuaugaagacggcuacagcguuucucaccagaucuccgccagauucccccaucggagcgcggacgugaccacaucuccuuacgccgauacccagaacuccuauggcugugcuacgagcacacccuacuccaccucucgccuuaugcugcucaauaugccggggcagcugccucaaacacugagcucccccagcaccagacucauuaccgagccuccccaggccacacuguggucucccuccauggucugcggaaugacgaccccuccgacaagccccggcaacgugccucccgaccuuucucacccuuauagcaaaguuuuugggaccacagcuggaggcaaggggacgccccugggaaccccggccacauccccucccccugcgccccucugucauucugaugacuacgugcacaucagccugccucaggccaccgucacacccccgcggaaagaagaacgcauggauuccgcuagaccuugccuucaucggcagcaccaucugcucaaugaccgcggcagcgaggaaccucccggcucuaagggguccgugacccugagcgaucugcccggauuccucggcgaccuggccucugaggaagauuccauugagaaggacaaagaagaggcugccaucagcagagagcuuuccgaaauuaccacagccgaggcugaaccggucgugcccagagggggauuugauucuccuuucuaucgggacagccugcccggcucccaacgcaagacgcacucugcggccagcuccagccagggggcuucuguuaacccugagccccuccacuccagccuggacaaacugggaccugauacccccaagcaggccuuuacaccgaucgaccuuccuuguggcucugccgaugaaucccccgcuggcgaccgggagugccaaaccagccucgagacaucuauuuucaccccuagccccuguaaaaucccgccucccacgagagugggguucggauccggccagccuccucccuacgaucaucuguuugaagucgcccugcccaagaccgcgcaccacuucgugauccgcaaaacagaggaacuccugaagaaggcuaaagggaauaccgaggaggacggaguuccgagcacaucucccauggaagugcuugaucggcugauucagcagggcgccgacgcccauuccaaggagcucaacaaacugccucugcccagcaaguccgucgauuggacccacuuugggggcucuccucccagcgacgaaaucagaacgcuucgcgaucaacuccugcugcuccauaaucagcugcuuuaugagcgguucaaaagacagcagcacgcucugcgcaaccggagacuccugcgcaaggugauuaaggccgcugcccuggaggagcauaaugcggccaugaaagaccaacuuaagcuccaggagaaagauauccagauguggaaggugucccugcagaaagaacaagcucgguacaaccagcugcaggagcagagagacacaaugguuaccaagcuccacucucaaauucggcagcugcagcacgaccgcgaagaguuuuacaaccaaagccaggaacuucagacaaagcuggaggauugcagaaauaugaucgccgagcuccggaucgaacugaaaaaggcuaacaauaaagucugucauaccgagcugcuucucucccaggugucucaaaagcugagcaacuccgaaagcgugcagcagcagauggaguuccugaauagacaacuccugguccuuggagaagugaacgagcuguaucucgagcagcugcagaauaaacacucugacaccacaaaggaaguugagaugaugaaggccgcguaccgcaaagaacuggagaagaaccggucccaugugcuucagcaaacgcagagacuggauaccagccagaaacgcauucucgagcuggaaucucaccucgccaagaaagaccaucugcuucuggagcaaaagaaauaucucgaagaugucaagcugcaggcuagaggccagcugcaggccgcugagucccgguacgaagcccaaaagcgcaucacacagguguuugagcuugagauucuggaccucuaugggagacuggaaaaagauggacuccugaagaaacuugaggaagagaaggccgaagcugcggaggccgcugaggaacggcuggacugcugcaaugauggcuguagcgacucuaugguugggcacaacgaggaagccuccggacacaauggcgagaccaaaacaccucgcccgagcuccgccagagggagcucuggcagccggggaggcgggggauccucuagcuccucuagcgaacucuccacccccgagaagccuccccaucagcgcgcuggcccuuucucuagcagaugggagacgacaaugggggaagccuccgcgagcauccccaccaccgugggaucucugccguccagcaagucuuuucugggcaugaaagcucgggagcuuuuccgcaacaaguccgaaagccagugcgaugaggacgggaugacauccucucugagcgagucccucaaaaccgaacugggcaaggaucucggagucgaggccaaaauuccucugaaucuugacggcccccaccccagcccucccacaccugacucuguggggcaacugcauaucauggauuacaacgaaacgcaccacgagcauuccuga

SEQ ID NO: 77336 - RNA, 1713 nt, Artificial Sequence
  derived and/or modified sequence opt5 from TSC22D1__Homo_sapiens__NP_001230728
augcaccagcccccugagagcaccgccgcugccgcggcugccgccgacaucuccgcuagaaagauggcccauccggcuauguucccccggcgcggcucugggagcggauccgccucugcgcugaacgccgcuggcacaggggugggaagcaaugccacguccucugaagauuuuccucccccuagccuccugcaacccccuccgcccgcugccuccagcaccucuggcccucagcccccucccccgcagucccuuaaccugcucagccaggcgcaacugcaggcccagccucuugcucccgggggaacacagaugaaaaagaaaucuggcuuccaaauuaccuccgucaccccugcccagaucagcgcuucuauuuccagcaauaacuccaucgccgaggacacagaaucuuacgaugaccuggaugagagccacacagaagaccucuccagcucugagauucuggauguuucccugagcagagccaccgaccucggcgagcccgaacggucuagcuccgaggaaacgcugaauaacuuucaggaggcugagacccccggggcggugucuccuaaucagccgcaucuuccccaaccucaucugccccaccucccucagcagaacguggucaucaauggaaacgcccacccccaccaucugcaccaucaccaccaaauccaucacggccaucaccuucagcaugggcaccaccauccgagccacguggcuguugccuccgccagcauuacaggaggcccucccucuuccccugugagccgcaagcugucuaccacaggguccagcgauuccaucacccccgucgcuccuacgucugccgugagcuccucuggaagccccgcguccguuaugacaaauaugagagcuccgagcaccacaggcggcauugggaucaacucugugaccggaaccuccacagucaauaacgugaauauuacggccgugggcagcuucaacccuaacgucaccucuuccaugcucgggaauguuaacaucagcacaucuaauauucccagcgccgcuggaguguccgugggccccggggucaccagcggagugaacguuaauauccugucuggcaugggcaacgggacaaucuccagcuccgccgcugugucuagcgucccuaaugccgcggccggaaugaccggcggguccgugucuagccagcagcaacagccgacgguuaacacaucccgguuucgcguggucaaacuggacucuagcuccgaacccuucaagaagggaagauggaccugcaccgaguuuuaugaaaaagagaaugcugugccugccacagaaggcguccucauuaacaaggugguugagaccgugaaacagaaucccaucgaggucacaagcgaacgggagucuacguccgggagcucuguguccagcucuguuuccacccugagccauuacacagaauccgugggcagcggagagaugggcgcuccuaccgucguggugcagcaacagcagcagcaacagcagcagcaacagcagcaacccgcccuucaggggguuacacugcagcagauggauuucggaucuaccggcccucaaagcauucccgcggucuccaucccgcagucuauuagccagucccagaucucucaagugcagcuccagagccaggaacuguccuaucuuacgaugaaggugguccugcucaucguguaccuguguauguga

SEQ ID NO: 77337 - RNA, 234 nt, Artificial Sequence
  derived and/or modified sequence opt5 from TSC22D3__Homo_sapiens__NP_001015881
auggaccuggugaagaaccaccucauguacgccgucagagaggaaguugagauccugaaagaacagauucgggagcuuguggaaaagaauagccaacuggagcgcgagaacacccuccugaaaacacuugcuucccccgaacagcuggagaaguuccagucuugccucagcccugaggaaccggcccccgaguccccucaggugcccgaagcgccuggcgggucugcugucuga

SEQ ID NO: 77338 - RNA, 1188 nt, Artificial Sequence
  derived and/or modified sequence opt5 from TSC22D4__Homo_sapiens__NP_001289972
augagcggcgggaagaaaaaguccucuuuccagaucaccagcgugacaacggacuacgagggacccggcuccccuggggccucugauccgcccaccccucaacccccuacaggacccccuccgagacugcccaacggcgaaccuagccccgacccugggggaaaaggcacaccccggaauggcuccccgccucccggggcuccuucuagccgcuuuagagucguuaagcucccccacggacugggcgagcccuaucggcgcgggagauggaccugcguggauguguacgaacgggaccuugagccucauuccuucggaggccugcucgaagggauucgcggagccagcggcggcgcugggggaagaucucuggauucccggcuugagcuggcgagccucggccugggggccccgacacccccuucuggacugucccagggccccaccagcuggcuccgcccucccccgaccucuccugggccccaggccagauccuuuacgggaggccugggccagcuugucgugccuagcaaagcuaaggccgagaagcccccucuguccgcuucuagcccccaacagcggccgccugaacccgagaccggggaauccgccggaacaagccgcgcggccacaccccucccuucucugagaguugaggcugaggccggcggguccggagcucggaccccgccccuuagccgcagaaaagccguggacaugcggcugagaauggaacucggcgcgccugaggaaauggggcaggucccuccccuggauucucgccccagcuccccugcccuguauuucacccacgacgcuucucucgugcauaagagccccgauccguuuggcgccguugcugcccagaaauucucccuggcccacagcaugcuugcuaucucuggacaucuggacuccgaugacgauagcggcucugggucccucgugggaauugacaacaagaucgagcaagcgauggaccuggucaaaagccaccuuauguuugccgugcgggaagagguggagguccugaaggaacagauuagagagcucgcugaacgcaaugccgcccuggagcaggaaaacggccugcuccgggcucuggccuccccugagcagcuugcgcaacugcccucuagcgggguuccuagacucggacccccggcuccuaauggccccuccguguga

SEQ ID NO: 77339 - RNA, 5424 nt, Artificial Sequence
  derived and/or modified sequence opt5 from TSC2__Homo_sapiens__NP_000539
auggccaagcccaccagcaaagacuccggccugaaggagaaauucaagauccuccuggggcuuggaacaccucgcccgaacccccggucugcugaaggcaaacagacggaguuuauuaucaccgccgaaauucugcgcgagcucuccauggaaugcgggcugaauaaccggauccggaugauuggacagaucugugagguggcgaagacaaagaaauucgaggaacacgcugucgaggcccuuuggaaggccguugcugaucugcuccagccugaacgcccccuggaggccagacaugcugugcuggcccuccugaaagcgaucgugcagggccagggggagcggcuuggaguccugcgcgcccucuuuuucaaggugauuaaagacuacccuuccaaugaagaucugcacgagagacuugaaguuuuuaaggcucugaccgacaacggccggcauaucacauaucucgaggaagaacuggccgauuucgugcugcaauggauggacgucggccucucuagcgaguuucugcuugugcugguuaaucucgugaaguucaacuccugcuaccuggaugaauauauugcucgcaugguccagaugaucugucuucugugcgugagaaccgccucuagcguggacauugaggucucccuccagguucuggaugcggugguguguuacaauugccugcccgccgaaagccucccucuguuuaucgucacacuuugucggaccauuaacgugaaagagcugugcgaaccguguuggaagcucaugcgcaaucugcuugggacgcaccugggacauucugcuaucuauaacaugugccaccucauggaggacagagccuacauggaggaugcuccccugcugcggggcgccguuuucuuuguggggauggcccucuggggagcucaccgccuguauucccuuagaaauagcccuaccucuguccugcccuccuucuaccaggcgauggccuguccuaacgaagugguuagcuacgagaucgugcucucuauuacacggcugaucaaaaaguauagaaaagaacugcaagucguggcuugggacauucuucucaauaucauugagcgccugcugcagcagcuccagacccuggauucccccgaacuucggacaaucguccaugaccugcucaccacgguggaggagcugugcgaccaaaacgaauuucacggcagccaggagagauacuucgaacugguugagcgcugcgccgaucagcggccggaguccucucuucucaaucugaucagcuauagagcccaauccauucauccugcuaaggacggguggauccagaaccugcaggcccucauggaacgcuucuuucggagcgagucuagaggagcggugcgcauuaaaguccuggaugugcuuuccuucguucugcucaucaaccggcaguuuuacgaagaggaacugauuaauagcguggucaucucucaacugagccacauccccgaggacaaggaucaccaggugagaaaacuugcuacacagcuccugguggaccuggccgagggcugucauacccaccauuucaacucccuccuggauauuaucgaaaaaguuauggcccgcucucuuagcccuccgcccgagcuggaagaacgggacgucgcugccuauuccgcuagccucgaagaugugaagacagccgugcugggccugcuugucauucuccagaccaaacuguacacccugccugcgucucacgccacaagaguguaugagaugcucguuucccauauccaacugcacuacaagcacagcuacacgcuuccgauugcuucuuccauccggcugcaggccuuugacuuccuccugcugcuucgcgcugauagccugcauagacucgggcugcccaauaaagacggagugguccgguuuuccccuuauugcgugugugacuacauggagcccgaaagaggcucugagaagaagaccagcgggccucucagcccucccacaggaccucccggccccgcccccgcggggccugccguucgccugggaucugugcccuauagccuucuguuccggguccuccugcagugccugaaacaggaauccgauuggaaggugcuuaaacugguucucggcagacugccggagagccuccgcuacaaggugcugauuuuuaccucuccuuguuccgucgaccaacuuugcagcgcucuguguucuaugcucuccggccccaaaacacuggaaagacugagaggggcccccgagggauucagccgcaccgaucuucaccuggcuguggugccuguccucacggcccugaucucuuaucauaacuaccucgacaagacaaagcagagagagaugguuuauugccuggaacagggccuuauccaccggugugccagccagugcgugguggcucuguccauuuguagcgucgagaugccggauaucauuaucaaagcgcugcccgugcucguugugaagcugacccacauuucugccaccgcuuccauggccgucccucuucuggaauuucucagcacacuggcccgccucccccaucuguacagaaauuucgcugccgagcaauacgcguccguguuugcuaucucucuuccuuauaccaaccccagcaaauucaaucaguacaucguuugccuggcccaccaugugauugccaugugguucauccggugccgccugccuuuuagaaaggacuucguccccuuuauuacaaaagggcuccgguccaacgugcugcuuucuuucgaugacacgccggagaaggauagcuuucgcgcuagauccaccucucugaaugaacggccuaagagccucagaaucgccagacccccuaaacagggacugaacaauucucccccgguuaaggaguucaaagaaagcagcgcggcugaggccuuucgguguagauccauuagcgugucugaacacgucgugcgcucccggauccaaacaagccucaccucugccucccugggcagcgcugacgagaacuccguggcccaggcugaugacagccuuaagaaucugcaucuggagcucacagaaaccugccuggauaugauggccagauaugucuucucuaacuuuacggcgguuccuaaacgcagccccgugggggaguuccuucuggccggcggacggaccaagacauggcucgugggcaauaaacuggucaccgugacaaccuccguugggacgggaacaagaucucuccugggccuugacagcggggaacugcaguccggaccugagucuagcuccucucccggcgugcacguccgccagaccaaggaagcucccgccaagcuggagagccaagcugggcaacaggugucccggggcgccagagaccggguucgcagcaugucuggaggccacgggcucagagugggagcccuggaugucccugcuucccaguuucuuggcagcgcgacaucuccggggccccggaccgccccugcugccaaacccgagaaggccuccgcuggaacccgcgugccuguccaagagaagaccaaccuggccgcguacgugccccuccugacgcagggcugggcugagauccugguuagacggccuaccgggaacacaagcuggcucaugucccuugaaaauccgcugucucccuucagcuccgacauuaacaauaugccucugcaggagcucagcaacgcccugauggccgcugaaagauuuaaggagcaucgcgauaccgcccuuuauaaaucucuguccgugcccgcggcuagcacagccaagccucccccgcucccucggucuaauaccgucgccagcuucuccucucuguaccagagcuccugucaaggccagcugcacagaucugugagcugggcugacuccgccguugugauggaggaaggaagccccggcgagguccccgugcucguggaaccucccgggcuugaggauguugaggcugcccugggaauggaccgccggacggaugcguauucuagauccagcuccgucucuagccaggaagagaagucccugcaugccgaggaacucgugggccgcgggaucccuauugaacggguggucucuagcgagggaggcagaccguccguggaccugagcuuccaacccucucagccucuuuccaaauccucuuccagccccgagcugcagacacuccaggauauccugggggacccuggcgauaaggcugacguuggacgccugucucccgaagugaaagccagaagccaauccggcacccucgauggggagucugcugccuggagcgccuccggagaagacagccggggccagccggaggggccucuucccuccucuagcccucgcucccccucuggacugagaccucggggcuacaccauuagcgacuccgcucccucucgcagaggcaagcgggucgaaagagaugcgcugaaaagccgcgccacagcuuccaacgccgagaaggugccggggaucaauccuagcuuuguuuuccuccagcuguaccacucucccuuuuucggagacgaguccaacaagcccauccuucugccuaaugaaagccagucuuuugagcgguccgugcaacuccuggaucagauuccgagcuaugacacccauaaaaucgccguccuguacgugggcgaagggcagucuaacuccgagcucgcuauucuuagcaaugaacacggauccuauagauacacagaguuccugacgggccuggggcgccucaucgagcugaaggauugccagcccgacaaaguuuaucuuggaggccuggauguguguggcgaagacgggcaauuuaccuacugcuggcacgaugacauuaugcaggccgucuuccauaucgcgacacucaugccuaccaaggauguggacaaacaccggugugacaagaagagacaucugggaaacgauuuugugagcauugucuauaaugacucuggcgaggauuucaaacuggggacaaucaagggacaguuuaacuucguucacgugaucgugacaccccucgacuacgaaugcaaucuugucagccugcagugucggaaagauauggagggccugguggacacguccguugcuaagauugugucugaucgcaaccucccuuucgucgccagacaaauggcccugcacgcuaacauggccagccaggugcaucacucccggucuaaucccaccgacaucuacccuagcaaauggauugcgcgccuuagacauaucaagcggcugcgccagagaauuugcgaggaagccgcuuauuccaacccgucucucccccugguucacccucccagccauuccaaagccccugcucaaacacccgccgagccgaccccuggguacgaagugggacagcggaagcgccugaucagcucugucgaggauuuuacagaguucguguga

SEQ ID NO: 77340 - RNA, 1320 nt, Artificial Sequence
  derived and/or modified sequence opt5 from TSEN2__Homo_sapiens__NP_001138865
auggccgaggcuguguuccacgcccccaagagaaaacggcgcgucuacgaaaccuaugagagcccucugccgauccccuuuggccaggaccaugggccucucaaggaguucaaaauuuuuagagcggaaaugaucaacaauaacguuauugugcggaaugcugaagauaucgagcaacuguacggaaagggcuauuucgggaaaggcauucuuucccgcucuagacccagcuuuacaaucuccgacccuaagcugguggccaaguggaaagauaugaagacgaacaugcccaucauuaccucuaaacgguaccagcacagcgucgagugggccgcugaacucaugcgcagacagggacaggacgaguccacagugcggcgcauccugaaggauuauaccaaaccucuugaacauccgcccguuaagagaaaugaggaggcccaagugcacgacaagcugaacucugggauggucagcaauauggaaggaacagcuggcggcgagcggccuuccgugguuaacggggauagcggaaaaucuggcggggugggagacccccgcgaaccucucggcugccugcaggagggguccggaugucaucccaccacagagagcuucgaaaagucugucagagaggaugccuccccgcugccucacgugugcuguugcaaacaggacgcgcucauucugcagcggggccuucaccaugaagauggcagccaacacaucgggcugcuccaucccggagaccgcggcccugaucacgaguacgugcuggucgaagaggccgaaugugcuaugucugagagagaggccgcucccaaugaagaggccuuuuuccuuguuuaugcgcuggggugccucuccauuuacuacgaaaaggagccccugaccaucgugaaacuguggaaggccuuuacggugguccagccuaccuuccggacaaccuauauggcuuaccacuauuuuagaagcaaaggaugggugccgaagguuggccucaaguacgggacagaccugcuucuguaucgcaaaggacccccuuucuaccaugccuccuauucugugauuaucgaacucgucgacgaucacuuugagggcagccugcggagaccccuuuccuggaaaagccuggcugcccucucucgcguguccguuaacgugagcaaggagcugaugcuguguuaccucaucaagccuucuaccaugacggacaaagaaauggagagccccgaaugcaugaagcggauuaagguccaggaggugauccuguccagaugggucucuagccgcgagcgguccgaucaggacgaucuuuga

SEQ ID NO: 77341 - RNA, 933 nt, Artificial Sequence
  derived and/or modified sequence opt5 from TSEN34__Homo_sapiens__NP_001269261
augcugguggucgagguugccaacggcagaagccucguguggggagcugaagccgugcaggcgcugcgggagcgccuuggggucggcgggagaaccgugggagcucugccccggggcccucgccaaaauuccagacucgggcugccgcuucugcucaugcccgaagaggcccggcugcuggccgaaaucggagcuguuacacucgugucugccccucgccccgacagcagacaccauucccuggcucuuacgucuuucaagcggcagcaggaggagagcuuucaggaacaauccgcccuggcggccgaggcucgcgaaaccagacggcaggagcuccuggagaaaauuacagaaggccaggccgcuaagaaacagaaacuugagcaagccucuggcgcgagcuccagccaggaagccgggucuucccaggcugccaaggaggaugaaaccagcgacggacaggcuucuggcgagcaagaggaagccgggccuuccagcucucaggccggacccuccaacggcgucgcuccucugccgcgcagcgcgcuccuggugcagcuggccacagcuagaccccggccuguuaaggcccgcccccucgauuggagagugcaauccaaggacuggccucacgccgggcggcccgcucaugagcugagauacucuaucuaucgcgaucuuugggaacggggauucuuucugagcgccgcgggcaaauucggcggggacuuucucgucuacccgggagauccucugagauuccacgcucauuauauugcccagugcugggcccccgaggacaccaucccucuucaggaucugguggcugccggccgccucgggacauccgugcggaagacccugcugcucuguagcccccagcccgacggaaaagucguuuacacgucucugcaaugggcuucccuucaguga

SEQ ID NO: 77342 - RNA, 1581 nt, Artificial Sequence
  derived and/or modified sequence opt5 from TSEN54__Homo_sapiens__NP_997229
auggagcccgaaccugagccggccgcuguggaaguccccgccggcagaguucugagcgcgcgggagcucuuugcugcccgcuccagaucucagaagcugccucaacggagccacgggcccaaagacuuucuuccugauggauccgccgcucaggccgaacgccugagacggugccgcgaggagcucuggcagcugcuugcugaacagagaguggagcggcugggcucucucguggccgcggaauggcgccccgaggagggguucgucgaacugaaaagcccugccggaaaauuuuggcaaaccaugggcuucuccgagcaggggagacagcggcugcauccggaagaggcucucuaccugcuugaauguggaucuauccaccuguuucaucaggaccucccccugagcauucaagaggccuaucagcuucugcucacagaucacacggugaccuuccugcaguaccagguuuucucccaucugaagcgccucggcuauguggucagacgguuccaaccuagcucugugcugucccccuacgagcgccagcuuaaccuggacgcuagcguucagcaccucgaagauggcgacgggaaaagaaagcggucuuccagcucuccuagauccaucaauaagaaagccaaggcgcuggauaacagccuucaacccaaaucccuggccgcuucuagcccgccucccugcucccagccuagccagugucccgaggaaaagccccaggagucuuccccuaugaaaggaccgggcgggcccuuucaacuccugggaagccugggcccuucucccgggccugcccgcgaaggagugggcugcagcugggaguccggccgggcugagaauggggucacaggagccggcaagagacgcuggaacuucgaacagauuucuuuucccaauauggccagcgacucccggcacacccuccugagagcuccggcgccugagcuucugcccgccaacguggcugggcgcgaaacagaugccgagagcuggugucagaagcucaaucagcggaaagaaaagcugucuagacgcgagcgggagcaucacgccgaagcugcccaauuccaggaggacgugaacgcggauccugaaguccagagaugcuccagcuggcgcgaguauaaagagcuucugcagcggagacaaguucagcggucucagcgcagagcuccccaucucuggggacagccugugacaccccugcuguccccgggccaagccagcuccccugccgugguccuccagcacaucucugugcugcagaccacccaccuucccgacgggggagcucggcugcucgaaaagagcggcggccuggagauuaucuuugauguuuaccaagccgacgcuguggccacguucagaaagaauaaccccgggaagccuuaugcgcgcauguguaucuccggauucgacgaaccgguccccgaucugugcucucuuaaacggcucagcuaccaguccggcgacgugccucugauuuuugcccugguugaucauggggacaucagcuucuacucuuuuagagauuucacccucccccaggacgugggacacuga

SEQ ID NO: 77343 - RNA, 504 nt, Artificial Sequence
  derived and/or modified sequence opt5 from TSFM__Homo_sapiens__NP_001166166
augagccugcucagaucccugcggguguuccuugucgcccgcaccggcucuuaccccgcugggagccugcucagacaguccccucaaccgcggcacacauuuuaugccggaccccgccugucugcgagcgcuuccucuaaggaacuucugaugaaacucagacggaagacgggcuacagcuucguuaacugcaaaaaggcccuggaaaccugugggggagaccugaaacaggccgagaucuggcuccauaaggaagcucagaaggagggcugguccaaagccgcuaagcugcaggggcgcaaaacaaaggaaggacuuauuggccugcuccaagagggcaauaccacagugcugguggaggucaacugcgaaaccgauuuugugagcagaaaucuuaaauuccagcugcucguucaacagguggcccuggggacaaugaugcacugucagacccugaaggaccagccuucugcguauuccaaggagaacugggagaaaacguga

SEQ ID NO: 77344 - RNA, 1173 nt, Artificial Sequence
  derived and/or modified sequence opt5 from TSG101__Homo_sapiens__NP_006283
auggccgugagcgagucccagcugaagaaaauggucucuaaguacaaauauagagaccucaccguucgggaaacagugaacgugaucacgcuguacaaggaucuuaaacccguccuggacagcuauguguucaaugauggcuccucucgcgagcucaugaaccugaccgggacaauuccuguuccguacagaggaaauaccuauaacauccccauuugccuuuggcugcucgacacauacccuuauaaucccccuaucuguuuugugaagcccaccagcuccaugacaauuaagaccggcaaacacgucgaugcuaacgggaagaucuaccugccuuaccugcaugaauggaaacacccgcaaucugaccuccugggacuuauccaggugaugauuguuguguucggcgaugagcccccugucuuuagccggcccaucuccgccagcuauccucccuaccaggcgacggggccgccuaauaccucuuauaugcccggaaugccuggcggcauuucccccuaccccagcggguauccuccgaaccccucuggauacccuggcugccccuauccucccgggggaccguacccugcuacaaccuccagccaguaccccucucaaccucccgugacaaccgugggcccuucccgcgacgggacgaucagcgaagauacaauuagagccucccugaucucugccgucagcgacaagcuccgguggcgcaugaaagaggagauggauagagcucaggccgaacugaaugcucuuaagcggaccgaggaagaccugaagaaaggacaucagaagcucgaggagaugguuacacgccuggaucaggaaguggccgagguggacaaaaacauugaacugcucaagaaaaaggacgaggaacuguccagcgcgcuugagaaaauggagaaucaaucugaaaacaaugauaucgacgaggucaucauucccaccgccccgcuguauaagcagauccucaaccuguacgcugaagagaaugccauugaagauaccaucuucuaucuuggcgaggcucugagacggggcgugauugaccucgauguuuuucugaagcacgugcgccugcucuccagaaaacaguuccagcugcgggcccuuaugcaaaaggcgcgcaaaacagccgggcugagcgaccucuacuga

SEQ ID NO: 77345 - RNA, 2097 nt, Artificial Sequence
  derived and/or modified sequence opt5 from TSGA10__Homo_sapiens__NP_878915
augaugagaagccgguccaagucuccccgcagaccuagcccgaccgcccggggcgcuaacugcgacguggagcugcucaaaacaacgacccgcgauagagaggaacugaaguguaugcuugaaaaauacgagcggcaccuggccgaaauccaggggaaugucaagguucucaaauccgagcgcgacaagauuuuccugcuuuaugagcaagcgcaggaagagaucacaagacugcggcgcgaaaugaugaagucuugcaaaagccccaaguccaccacagcucaugccauucucagacggguggagaccgagcgcgauguggccuuuacagaccugagacggaugaccacggaacgcgauucucugagagagcggcucaaaaucgcucaggaaaccgccuucaacgagaaggcucaccuggaacagagaauugaggagcuugaauguacaguccauaaucuggacgaugagcgcauggaacaaaugagcaacaugacccucaugaaagagacaaucuccaccguggaaaaggagaugaaaagccuggcccggaaggcgauggacacggagucugaacuuggaagacagaaggccgagaauaacucccugcgccuccuguacgaaaauacagagaaagaucugagcgacacccagcggcaccucgcuaagaaaaaguaugaacugcagcuuacacaagagaaaaucaugugccuggaugagaagauugacaacuuuaccagacagaauaucgcccagcgcgaagagauuucuauccucggcgggacccugaacgaucuugcuaaggaaaaagagugucugcaggccugccucgacaagaaauccgagaauauugcgagccugggagaaucucuggccaugaaggagaaaacaaucuccggcaugaagaacauuaucgcugaaauggagcaagccagccggcaguguacggaagcucucaucguuugcgagcaggacguguccagaaugcgccggcaacuggaugagaccaaugacgaacuugcccagauugccagagagcgcgauauccuggcucaugacaacgauaaucuccaggaacaguucgcgaaggccaaacaagagaaccaggcucugucuaagaaacuuaacgacacacacaaugaacugaacgauauuaagcagaaaguccaggacaccaaucucgaggugaacaagcugaagaauauccugaaaagcgaggaauccgagaaccggcaaaugauggaacagcucagaaaggccaaugaggaugccgaaaacugggagaauaaagcucggcagagcgaggccgacaacaauacacugaaacuugaacugauuaccgcggaggcugaagggaaccgccucaaggagaagguugauucucugaauagagagguggaacagcaccugaacgccgagcgguccuacaagagccaaaucucuacgcuucauaaaagcgucgugaagauggaagaggaacuccagaaagugcaguuugagaaggucuccgcccuggcugaccugucuagcacaagagagcucuguaucaaacuggacuccagcaaggaacuucugaaucgccagcucguugccaaagaucaagagauugaaaugcgggagaacgaacuggacucugcucacuccgagaucgagcugcuuagaagccagauggccaacgaacgcauuucuaugcagaaucucgaggcgcugcugguggccaacagagauaaggaauaucaaucccagaucgcucuccaggagaaggaaagcgagauucagcugcuuaaagagcaucugugccucgccgaaaauaagauggcuauccaaucccgggacguggcccaguuccgcaacgucgugacccagcuggaggcggaucuggacaucaccaaaagacagcuuggaacagaacgguuugagcgcgagagagccguucaagaacuccggcgccagaauuacucuagcaacgcuuaucacauguccucuaccaugaagccuaauacaaaaugucacagccccgagagagcccaucaccgguccccugaucgcggccuggacagaagccuggaagagaaccucugcuaccgggauuucuga

SEQ ID NO: 77346 - RNA, 2295 nt, Artificial Sequence
  derived and/or modified sequence opt5 from TSHR__Homo_sapiens__XP_005268094
augagacccgccgaccugcuccagcuggugcuucugcucgaucugccucgggaccuuggcgggaugggaugcagcuccccgcccugugagugccaccaagaagaggauuuccgcgucaccuguaaggacauccagcggauuccuucucugcccccuagcacacagacgcucaaacugaucgaaacccaucugagaacaauucccucccacgcuuuuucuaaccucccuaauaucagccgcauuuacguuuccaucgaugugacccugcagcaacuugagucucauagcuucuauaaccuguccaaggugacacacaucgaaauuagaaauacccggaaccucacauacaucgacccggaugcccugaaagagcuuccccugcucaaguuucugggcauuuucaauaccgggcugaaaauguuuccugaccucacgaaggucuauagcaccgauaucuucuuuauucuggagaucacagacaaccccuacaugaccucuauuccugugaaugcguuccagggacuuugcaacgaaacacugacccucaagcuguauaauaacggcuuuacguccguucagggguacgcuuucaauggaacaaaacuugaugccguguaucugaacaagaauaaauaccucaccgucaucgacaaggaugccuuuggcggcguguacagcgggcccucucugcuggacguuucccagacaagcgugaccgcucucccgucuaaaggacuggagcaucuuaaggaacugaucgcccgcaacaccuggacacucaagaaacugccucuuucccugagcuuccuccaccugacgagagcugaccuguccuaucccucucacuguugcgccuuuaagaaucagaaaaagauucggggcauccucgagagccugauguguaacgaguccagcaugcaaucucuucgccagagaaaauccgucaacgcgcugaauagcccucuccaucaggaauacgaggaaaaccugggggauucuauugugggauauaaggagaaaagcaaguuccaagacacccacaauaacgcccauuacuauguguucuuugaggaacaggaggaugaaaucauuggcuucgggcaggagcugaagaauccccaagaagagacacuucaggcuuuugacucccacuacgauuauaccaucugcggagacucugaagauauggucuguacacccaaaagcgacgaguucaacccuugcgaggauaucaugggcuacaaguuucuccggauuguugugugguucgugucccugcuggcccuccugggcaaugucuuugugcuucugauccuccugaccagccacuacaaacugaacguuccgcgcuuccuuauguguaaucucgcuuuugccgacuucugcauggggauguaucugcugcucauugcgucuguggaucuguacacgcauuccgaauauuacaaccacgccaucgacuggcagacaggacccggcugcaauaccgcuggguuuuucaccgucuuugccagcgagcuuucuguguauacacugaccguuauuacacucgaaagaugguacgcuaucacguucgccaugcggcuggaccgcaagaucagacugcggcaugccugugcuauuauggugggaggcugggucugcuguuuccuucucgcgcugcugccucucguggggaucuccagcuaugccaaagucuccauuugccugcccauggauaccgagacaccucuugcucuggccuacaucguguuuguucucacccugaacauuguggccuucgucaucguguguugcuguuacguuaagauuuauaucacagugagaaauccccaguacaacccgggagacaaggauaccaaaaucgcuaagcgcauggccguccugauuuuuacggacuucaucugcauggcgccuauuucuuuuuaugcucuuagcgccauccucaauaaaccccugauuaccguguccaacucuaagauccugcucgugcuguucuacccucuuaacagcugugccaaucccuuucuguaugcuaucuucacaaaagccuuucaacgggauguuuucauucuccuguccaaguuuggcaucugcaagagacaggcucaggccuaccgcggccagcgggucccucccaaaaacagcaccgacauucaagugcagaaggugacacacgaaaugagacaggggcugcauaauauggaggaugucuaugagcuuaucgaaaacucucaccugaccccgaaaaagcagggacaaauuuccgaggaauacaugcagacggugcucuga

SEQ ID NO: 77347 - RNA, 3099 nt, Artificial Sequence
  derived and/or modified sequence opt5 from TSHZ1__Homo_sapiens__NP_005777
augugcaacgaggaaaccgagaucaaggaagcccagagcuaccaaaauucccccgugucuagcgcuacaaaccaggacgccggcuauggguccccuuucucugagagcuccgaucagcuggcgcacuuuaaaggaucuagcuccagagaagagaaggaggacccgcagugucccgauagcgucucuuacccucaagacucccucgcucagauuaaagccguuuaugccaaucuguucagcgaaucuugcugguccagccuugcucuggaucucaagaaaucuggcuccacgaccagcacaaacgacgccucccagaaggagucuagcgcucccaccccuacacccccuaccuguccgguguccacaaccgggcccacgaccagcacaccuucuaccuccugcagcucuagcacaucccauucuagcaccacguccacaagcagcuccagcggauacgauuggcaccaggccgcgcuggccaagacccuucaacagacaucuuccuauggccugcuccccgaaccuagccuguuuuccaccgugcagcuguaccggcagaauaacaaacucuaugggucugucuucaccggagcuagcaaguuucgcuguaaagacugcuccgccgcuuacgauacacugguggagcuuacgguucauaugaaugagaccggccacuacagagacgauaaccgggacaaggauucugaaaagacaaagcgcuggagcaagcccagaaaacggucccugauggagauggaaggcaaggaggacgcccaaaaagugcucaaguguauguauugcgggcauagcuucgaaucucugcaggaccuuuccguccacaugaucaaaaccaagcacuaccagaaagugccgcugaaggagccuguucccgcgauuacaaagcucgugccuagcaccaaaaagcgcgcccugcaagaucuggcuccucccuguucucccgagccggccggaauggcugccgaagucgcccucuccgagagcgcuaaagaccagaaggcggccaaucccuaugugacgccuaacaauagauacggcuaucagaacggggcuucuuacacauggcaguuugaagcccggaaagcccaaauccugaagugcauggaguguggaagcucccaugauacccuucagcagcugaccgcucacaugauggugacaggccauuuccucaaggucaccacaagcgccucuaaaaaggggaaacagcugguucuugaccccgugguggaagagaagauucaauccaucccucugcccccgacgacccacacacgccucccugcgagcuccaucaaaaagcagcccgauucuccugcuggaagcaccacauccgaggaaaagaaagagcccgaaaaggagaaaccucccgucgccggcgacgccgaaaagauuaaagaggagucugaagauagccuggagaaguuugaaccguccacccuguauccuuaccucagagaggaggaccuggaugacucucccaagggcgggcuugauauccugaaaagccucgaaaauacgguguccaccgcuauuagcaaggcccagaacggagcucccucuuggggcggguacccuuccauccacgccgcguaucagcugccgggaacaguuaaaccccuuccugccgcugugcaaagcguccaggugcagcccucuuacgccggcgggguuaagucccugagcucugcugagcauaaugcccuccugcacuccccuggaagccugacacccccuccccauaaauccaacgugagcgcgauggaggagcucgucgaaaaggugaccggcaaagucaacauuaagaaggaggagcggccgccugaaaaagagaagucuagccuggccaaagcugccucccccaucgcuaaggaaaauaaagacuucccuaagaccgaggaagugucuggcaagccccagaaaaaggggccggaggccgagacgggaaaagccaagaaagaaggcccucuugacguucacacacccaacgggaccgagccucugaaggcuaaggugacaaauggaugcaacaaucucggcauuaucauggaucauagccccgaacccuccuuuaucaacccucugucugcgcugcaaagcauuaugaauacccaccuugggaaagucuccaagccggugucucccagccucgacccucuggccaugcuguauaaaaucuccaacagcaugcucgauaagcccguuuacccugcuacccccgugaaacaggccgacgccauugaucgcuauuacuaugaaaauucugaccagccuaucgaucugacaaaguccaagaacaaaccgcuugucagcucuguggcugacuccguggccagcccccugagagaauccgcgcucauggauauuucugacaugguuaagaaucugacgggccggcugaccccuaaaagcuccacacccagcaccgucucugagaaguccgaugcugacggaagcucuuucgaggaagcccuugaugagcucagcccugugcacaaacgcaagggcagacaauccaacuggaauccccagcaucugcugauccuccaggcccaguuugcuucuagccugcgggaaacaaccgaggggaaauacaucauguccgaccuuggaccgcaagagagagugcacauuucuaaguucacgggccugagcaugacaaccaucucccauuggcucgccaacgucaaguaccagcugcgccggaccgggggaacaaaauuccugaagaaucuugacaccggccacccuguguuuuucugcaacgauugugcgagccaguuuagaacagcuucuacguauauuucccaccucgaaacccaucugggguucagccugaaagaccucuccaagcugccccuuaaccagauccaagagcagcagaauguuucuaaagugcugacaaacaagacccucggcccccugggagccacagaagaggaucugggcagcaccuuucagugcaaacuuuguaaucgcacguucgccuccaaacacgcugucaagcuccaucugucuaaaacccacgggaagucuccugaagaccaucugauuuacgugacagagcucgagaaacaauga

SEQ ID NO: 77348 - RNA, 3096 nt, Artificial Sequence
  derived and/or modified sequence opt5 from TSHZ2__Homo_sapiens__NP_001180350
augauggccgcugcccugcuccacuacaccggcuaugcgcaggaggaacaacugaaggaggaagaggaaaucaaagaggaggaagaggaagaggacagcggguccguggcucagcuucagggaggcaacgauacagggacggacgaggaacuggagaccggacccgaacagaagggcugcuucucuuaccaaaauagcccugggucccaucucucuaaccaggaugccgagaaugaaagccugcuuuccgacgccucugaucaggucagcgacauuaaauccguuuguggaagagaugcuagcgacaagaaagcccacacacaugugcggcugccgaacgaggcucacaauugcauggauaagaugaccgccguguaugcgaacauccucucugacuccuacuggagcggccugggccugggguuuaagcucucuaauuccgagcgcagaaacugugauacacggaauggaagcaacaaaucugacuucgauuggcaucaggacgcccuguccaagagccuucaacagaaucugcccucccgcucugucagcaaaccuucccucuuuagcucugugcagcuguauagacaguccagcaagaugugcggcaccguuuucacaggggcuucucgguuucgcuguagacaaugcagcgccgcuuacgacacccuuguggaacugacgguccacaugaacgagaccggacacuaucaggaugacaaucggaaaaaggauaagcuccgccccacauccuacucuaaaccuagaaagcgggccuuccaggacauggauaaagaagacgcgcaaaaggugcugaaauguauguuuugcggcgauagcuucgacucccugcaggaucucagcguucauaugauuaagaccaaacacuaccagaaggugccccugaaggagccugucccgacaaucucuuccaaaauggugacccccgccaagaaacgcguguuugacgucaacagaccuuguagccccgauucuacgacaggguccuucgcugacagcuuuuccucucagaagaaugccaaccuucaacugagcuccaacaaucgguauggauaccagaacggcgcuucuuauaccuggcaguucgaagccugcaaaagccagauucucaaguguauggagugcggcuccagccaugacacacugcaacagcuuaccacccacaugaugguuacagggcacuuucugaaggugacgucuuccgccagcaaaaagggaaaacagcucgugcuggauccucuggcugucgagaagaugcagucucucuccgaagcgcccaauagcgacucucuggccccgaaaccuagcuccaacagcgcuucugauugcaccgccuccacaaccgagcuuaagaaggaaagcaaaaaggagcgccccgaagagacauccaaagacgagaaggugguuaaaucugaagauuacgaggacccucugcaaaagccccucgaucccaccaucaaguaucaguaccugagagaagaggaccuugaggauggcagcaaagggggaggcgacauccugaagucccucgaaaauacggugacaaccgccauuaacaaagcucagaauggggccccuucuuggagcgcguauccguccauccaugcugccuaccagcugucugagggaaccaagcccccucugcccaugggcagccaaguccuccagauucggccuaaccugacaaauaaacuuagacccaucgccccgaaguggaaagugaugccucugguuuccaugcccacccaccucgcuccuuacacacaggugaagaaggaaagcgaggauaaagacgaagccgucaaggaguguggcaaagagucuccccaugaagaggcuuccagcuucucucacuccgaaggggauagcuuccgcaagucugagacgccucccgaagccaaaaagaccgagcugggaccgcugaaggaggaagagaaacuuaugaaggaaggcuccgagaaagaaaagccucaaccccucgagcccacaagcgcgcuguccaacgggugcgcccuggcuaaucaugccccugcucucccguguauuaacccccugagcgcccuucagucugugcugaauaaccaccucggaaaagcgaccgagccucugcggagccccuccugcucuagcccuuccucuagcacaaucuccauguuucacaagucuaaucugaacgucauggacaagcccgugcuuagcccugccuccaccagaagcgcuucuguuucccgccgguaucucuucgaaaacagcgaccagcccauugaucugacgaaaucuaaguccaaaaaggccgagagcucccaggcucaaucuuguaugagcccgccucagaaacaugcccuguccgacaucgccgauauggugaagguccuccccaaggcuaccacaccuaaacccgcgucuagcuccagagugccgccuaugaagcuggaaauggacguucgccgguuugaggaugugagcucugaggucagcacccuucacaaaagaaagggccgccaguccaauuggaacccccagcaucugcucauccugcaagcccaguucgcuucuagccuguuucagacauccgaagggaaauaccuucucucugaccugggcccucaggagcggaugcaaauuagcaaguucaccggacuguccaugacgacaaucagccacuggcucgccaaugugaaauaucagcugagaaagaccggcgggacaaaguuucuuaaaaacauggauaagggacaccccauuuucuacugcucugacugugccucccaguuucgcacccccagcaccuauaucucccaucuggaaucucaccucggcuuccaaaugaaagauaugacacggcugagcguggaccagcaguccaagguugagcaggaaauuucuagagucagcuccgcucaacggagcccugagacgaucgccgcggaggaagauaccgacucuaaauuuaagugcaagcuguguugccgcacauucguguccaaacaugcugugaaacuucaccucagcaagacccauucuaaguccccggagcaccacagccaguuugucacagauguggacgaagaguga

SEQ ID NO: 77349 - RNA, 3246 nt, Artificial Sequence
  derived and/or modified sequence opt5 from TSHZ3__Homo_sapiens__NP_065907
augcccagacggaagcagcaagccccucgcagagcugccgcguacgugagcgaggaacugaaagcugccgcccucgucgacgagggccuggauccggaggaacacaccgcugacggggaacccuccgccaaguauaugugcccugagaaagagcuugcucgggccugucccucuuaccagaacagcccugcggccgaguucuccugccacgaaauggauucugaaagccacaucuccgagacaucugaccgcauggcugauuuugagagcggauccauuaagaaugaagaggaaacgaaagagguuaccgugccccuggaagacacaaccgugagcgauucucucgagcagaugaaggccgucuauaacaauuuccuguccaacagcuacuggucuaaucuuaaccugaaucuccaucagccuuccagcgagaagaacaauggaucuuccagcuccucuagcuccuccucuuccagcugugggucuggcagcuuugacuggcaccaauccgcuauggccaaaacacugcaacaggugucucagagcagaaugcugccggaacccucccucuucagcaccguucagcuguaucggcagucuuccaagcuguacggcagcaucuuuacaggggcgucuaaauuccgcugcaaggauuguuccgccgcuuaugacacccugguggagcucacgguccauaugaacgaaaccggacacuacagagaugacaaucacgagacagauaacaauaacccuaaacgguggagcaagccccgcaagagaucccugcuugaaauggagggcaaagaggacgcccagaaggugcugaaaugcauguacuguggccauucuuuugaaagccuccaggaccuguccguucacaugauuaagaccaaacauuaucaaaaggugccucugaaagagcccgucacaccgguggcugccaagaucauuccugccacccggaagaaggcuucucucgaacuggagcuucccagcuccccugauagcacagggggaacacccaaggcgaccaucucugacacaaaugaugcccugcagaaaaacuccaaccccuacaucaccccuaauaaccgcuauggccaccagaauggggcuagcuacgccuggcacuucgaagccagaaagucucaaauucucaaaugcauggaguguggauccagccaugacacccugcaggagcuuacagcucacaugauggugacgggccauuuuaucaaggucaccaacucugccaugaagaaagggaagccgauuguugaaacacccgugaccccuacaaucaccacgcugcucgaugagaaagugcagagcgucccccuggcggcuacaaccuucaccuccccuagcaauacacccgccucuauuuccccgaagcugaacguggaaguuaaaaaggagguggacaaggagaaagccgucaccgaugaaaagccuaaacagaaggacaaacccggagaggaagaggaaaagugcgauaucagcuccaaguaucacuaccucacagagaaugaccuggaggaaucuccuaaaggcggccuugauauucuuaagagccucgagaacacggugaccuccgcuaucaauaaagcccaaaacgggacacccucuuggggaggcuauccuagcauccaugcugccuaccagcugcccaauaugaugaaacuuucccuggggucuagcggaaaauccaccccgcucaagccuauguuuggcaacagcgaaauuguuucucccacgaaaaaucagacccuggugagcccucccagcucucagacguccccgaugcccaagaccaacuuccacgcgauggaggaacuggucaagaaagugacagagaaggucgccaaaguggaggaaaagaugaaagagccugacgggaagcucucucccccuaagcgggcuacccccagcccuuguuccagcgaaguuggagagcccaucaaaauggaagccuccagcgacggcggcuuucgcucucaagagaauagcccguccccucccagagaugggugcaaggacggaucuccucuggcugagcccguggaaaacggcaaagagcuugucaagccgcuggccagcucccucucugggagcacagcgauuaucaccgaucacccucccgaacagccuuucgugaacccccuguccgcccugcagucuguuaugaauauucaucuuggaaaagcugccaagcccagccucccugcucuggacccgauguccaugcuguucaagaugagcaacucucucgccgagaaagccgcuguggcgacgcccccuccccugcaguccaagaaagccgaucaccuugaccgguacuuuuaucaugucaauaacgaucaaccuaucgaccugacaaagggcaaaagcgauaaggggugcucucucggcuccgugcugcugagccccaccuccacagcuccugccaccucuagcuccaccgugacaacggccaagaccagcgcuguugucucuuucauguccaauagcccgcuuagagagaacgcccucucugacaucagcgauaugcugaaaaaucugacagaaucccacaccucuaagagcuccacacccucuagcauuuccgagaaaagcgacaucgauggagcgacccucgaagaggcugaagagucuacgccugcccagaagcgcaaaggccggcaguccaacuggaauccccagcaucugcuuauucugcaagcccaguuugcugccagccucagacagacauccgaggggaaguacaucaugucugaccugagcccucaagaacgcaugcacauuucccgguucaccggacugucuaugaccacaaucagccacuggcuugcgaacgugaaauaucagcucagacgcaccggcgggacaaaguuucugaagaaucuggacacgggacaucccguguucuuuuguaacgauugcgcuucccagauccggaccccgagcacauacauuucucaccucgagucccaucugggcuucagacuucgcgaccugagcaaacucucuaccgaacagaucaauucccaaauugcccagacaaagagcccuucugagaaaauggucaccagcucccccgaagaggaucuggggacgucuuaucaguguaagcugugcaaccggaccuuugccagcaaacacgcugugaaacuucaccucuccaagacacauggcaagagccccgaggaccaucugcuguacguuuccgaacucgagaagcaguga

SEQ ID NO: 77350 - RNA, 480 nt, Artificial Sequence
  derived and/or modified sequence opt5 from TSLP__Homo_sapiens__NP_149024
auguuccccuuugcccugcucuacgugcugagcgucuccuucagaaagaucuuuauucuucagcugguuggccucgugcugaccuaugacuucacaaacugcgauuuugagaaaaucaaggcugccuaccuuucuacgauuagcaaagaccugaucaccuauauguccgggacaaagucuaccgaguucaauaacacagugagcuguuccaaucggccucacugccucaccgaaauucaaucucugacauuuaacccgaccgcgggaugugcuagccuggccaaagaaauguucgccaugaagacgaaggcugcccucgcuaucuggugccccggcuacuccgagacccagaucaaugccacacaggcgaugaaaaagcgcagaaaacggaaggucaccacaaacaaaugucuggaacaggugagccaacuucaggggcuguggcgcagauuuaaucggccucuccugaagcagcaguga

SEQ ID NO: 77351 - RNA, 873 nt, Artificial Sequence
  derived and/or modified sequence opt5 from TSNAX__Homo_sapiens__NP_005990
augagcaacaaggagggcuccgggggauucagaaaacggaagcacgacaauuuuccccauaaccagcgcagagaaggcaaagaugucaauucuagcuccccugugaugcuggccuucaagucuuuucaacaggagcucgacgcucggcacgauaaauacgaacgccugguuaagcugagcagagacaucaccguggaguccaagcggacaauuuuccuucuccaucgcaucacgucugccccggauauggaagacauucugaccgagagcgagaucaaacuugauggggugagacagaagauuuuucaggucgcgcaagaacuguccggagaggacaugcaccaguuccaucgggcuaucacaaccggccuccaggaauauguggaggccguuagcuuucagcacuucaucaaaacacgcucucugauuuccauggaugagaucaacaagcaacugauuuuuaccacagaagacaaugggaaagagaacaagacccccagcucugaugcccaggacaagcaguucggaacguggagacuccgggugaccccugucgauuaccugcuuggcguggcugaccugacaggcgaacucaugcgcaugugcaucaauuccguugggaacggagacauugauacccccuuugaggugagccaguuccugagacaagucuaugacggcuuuucuuucaucgggaauacaggaccuuacgaaguguccaaaaagcuguauacccuuaaacagagccucgccaagguggagaacgcuuguuacgcccugaaaguccggggcuccgagauucccaagcacaugcuggcggauguuuucucugugaaaacggaaaugaucgaccaggaggaagggaucagcuga

SEQ ID NO: 77352 - RNA, 447 nt, Artificial Sequence
  derived and/or modified sequence opt5 from TSN__Homo_sapiens__NP_001248330
augagcguguccgagaucuucgucgaacugcagggcuuucucgccgcugagcaagacauuagagaagagauccggaagguugugcagucucuggaacagaccgcccgcgagauucuuacacugcuccagggggugcaccaaggagcgggcuuccaggauauccccaaaagaugccugaaggcucgggagcauuuugggacggucaaaacccaccuuacaagccugaagaccaaauucccugccgaacaguacuaucgcuuucaugagcacuggagauucgugcuccagcggcugguuuuucuggccgcuuucguggucuaccucgaaacagagacccuggugacacgcgaggccguuaccgaaauucuuggaaucgaggcugugugucaacagagagacugcuggcggcugcucccgacgcccccucaucugcaccuucaccaguga

SEQ ID NO: 77353 - RNA, 1182 nt, Artificial Sequence
  derived and/or modified sequence opt5 from TSPAN10__Homo_sapiens__NP_001277141
augcacagacuggcccagggccggagccaagaccagcccuccucuccugcuaccgaggaaccggccaaccucagccgcagacugugcugggggcuuuccgugcccgcgucucggauggaggaaggagagcgcagcccucugcucucccaggaaacagcuggccagaagccccugucuguccauagaccucccacgagcgggugucuuggaccuguuccgcgggaggaucaagccgaggccuggggcugcuccuguugucccccugaaaccaaacaccaggcucugagcgggacacccaagaaaggaccugcccccucucucuccccgggcagcucuugcgugaaguaccugaucuuccuguccaauuuuccuuucagccuccugggccuucuggcucucgccauugggcuguggggacuugcggugaaaggcucucugggguccgaccucggaggcccccugccugccgaucccaugcuggggcucgcucugggaggccuugucgugagcgccguuucccuggcuggcuaucucggggcccugugcgagaacaccugucuucugcgcggauuuucuggcgggauccucgcguuccuggugcuggaagccgucgcuggagcccucgugguugcucuguggggcccccuucaggacagccuggagcauacacucagaguggccauugcccacuaccaggaugacccugaucugcgguuucuucuggaccaaguccagcucgggcugcgcugcuguggagcugcguccuaucaggauuggcagcaaaaucuguacuucaacugcagcucuccgggcgugcaggccuguucccuccccgcuagcugcugcaucgacccuagagaggauggcgccucugugaaugaccaguguggguuuggaguccugcggcuugaugccgacgcugcccaacgcguuguguaucuggaaggcugcgggcccccucucagacgguggcugcgcgcgaaccuggcugccagcggaggcuacgccauugcugugguccuucuccagggggccgagcugcugcucgcugccagacugcuuggcgcgcuggccgcucggagaggagccgcuuauggccccggggcccgcggagaagaccgggcgggcccgcaguccccuucucccggggccccucccgcugccaagccugcuagaggauga

SEQ ID NO: 77354 - RNA, 762 nt, Artificial Sequence
  derived and/or modified sequence opt5 from TSPAN11__Homo_sapiens__XP_011518982
auggcccacuacaagaccgagcaggacgauuggcugaucauuuaucucaaauaccugcuuuucguguuuaacuucuuuuucugggucggcggggcugccguucuggcggugggaaucuggacacucguggaaaagagcggcuaucuguccguccuugcuucuagcacguuugccgccuccgcuuacauucugaucuucgccggggugcucguuauggugaccggauuucugggcuucggggcuauucugugggagagaaaaggaugccucucuacauauuuuugucugcuucuggucaucuuccucguggaacugguugccggcgugcuugcgcaugucuacuaucaacggcugagcgacgagcucaagcagcaccugaaucgcacccuggccgaaaacuacggccagcccggggcuacacagaucaccgccuccguggauagacuccaacaggacuuuaaaugcuguggaucuaauagcuccgcugauuggcagcauagcacauacauucugcuucgggaggccgagggccgccaggugccugacucuugcuguaagaccgucguugugagaugcgggcaacgggcgcacccguccaacaucuauaagguggaaggaggcugucugacgaaacucgagcaguuccuggccgaucaucuucugcucaugggggcugucggaauuggcguggccugccugcagaucuguggcaugguucugaccugcugucuccaccagcgccugcaaagacacuuuuacuga

SEQ ID NO: 77355 - RNA, 918 nt, Artificial Sequence
  derived and/or modified sequence opt5 from TSPAN12__Homo_sapiens__XP_011514296
auggccagagaggacagcgugaagugccugcggugucuccuguacgcucuuaaccugcucuuuuggcugauguccaucucuguccuugccguuagcgcguggaugcgcgauuaucugaauaacgugcucacccugacagcugaaacgagaguggaggaagccgucauucugaccuacuuucccgugguucacccugugaugaucgccgucugcuguuuccucauuaucgugggcaugcugggguauugcggaacaguuaaacggaaucuucugcuccuggcuugguacuuuggcucccuucuggugauuuucugugucgagcucgccugcgggguguggaccuaugaacaggagcugauggugccgguccaauggucugacaugguuacacugaaggcucgcaugaccaacuacggacuccccagauaucgguggcugacacaugccuggaauuucuuccagcgcgaguuuaaauguugcggcgugguguacuucaccgauuggcuugaaaugacggagauggacuggccucccgauagcuguugcgucagagaauuuccuggguguuccaagcaggcgcaccaggaggaccugucugaucucuaccaagagggaugcggcaaaaagauguauagcuuccugcggggcaccaagcagcuucaggugcugcgcuuucucgggaucuccaucggaguuacacagauucuggccaugauccugaccauuacacuccugugggcucuuuacuaugacagacgggaacccggcaccgaucaaaugaugagccugaaaaacgacaauucucagcaucucuccugcccuagcguggagcugcuuaagccgucucugucccgcaucuucgaacacacgagcauggccaacucuuuuaauacacauuucgagauggaggaacucuga

SEQ ID NO: 77356 - RNA, 615 nt, Artificial Sequence
  derived and/or modified sequence opt5 from TSPAN13__Homo_sapiens__NP_055214
auggugugcggcggguucgccuguagcaagaacugccugugugcucucaaucugcuuuacacccuggucucccuccugcuuaucggaauugccgcguggggcaucggguuuggacugauuucuagccucagaguugugggcguggucaucgcuguggggauuuuccuguuucugaucgcccucguuggacugaucggcgccgugaaacaccaucagguccuucuguucuuuuauaugauuauccuccugcuuguguucauuguucaauuuuccgugucuugcgcuugucuggcccucaaccaggagcagcagggccaacugcuggaagucggguggaauaacacagcuagcgcccggaaugacauccagcgcaaccucaauugcuguggauucagauccgugaaccccaaugauacgugccuggcgucuugugucaagagcgaccacuccugcagcccuugugccccgauuaucggcgaguacgcuggggaagugcuucgguuuguuggaggcauugggcuguucuuuucuuucaccgagauccucggaguguggcugacauaucgcuacagaaaccagaaagauccccgggccaauccuuccgcuuuucuuuga

SEQ ID NO: 77357 - RNA, 444 nt, Artificial Sequence
  derived and/or modified sequence opt5 from TSPAN14__Homo_sapiens__NP_001121781
augcacuacuauagauacagcaacgccaagguguccugcugguauaaauaccugcucuuuucuuauaauaucauuuucuggaaccaguguugcggcgcuuacgggcccgaggacugggaucugaaugucuauuucaacuguagcggagccuccuacucucgggaaaagugcggcguuccuuuuagcuguugcgugccggaccccgcgcaaaaaguggucaauacccaguguggguacgaugugcgcauccagcuuaaguccaaaugggacgagucuauuuucacaaagggaugcauccaggcucuggaaagcuggcucccuagaaacauuuauaucguugccggcguguuuaucgccauuucccugcuucaaaucuucgggauuuuucuggcucggacgcucaucagcgauauugaggccgucaaggcuggacaucacuucuga

SEQ ID NO: 77358 - RNA, 735 nt, Artificial Sequence
  derived and/or modified sequence opt5 from TSPAN16__Homo_sapiens__NP_001269438
auggccgagauccacacccccuacagcucccugaagaaacuccugucucuucugaacggcuucguggcugucagcgggauuauccucguuggacugggcauugggggaaagugcggcggggccucccuuacaaaugugcugggacucucuagcgcguaucugcugcaugugggcaaccucugucuggucaugggcugcaucacggugcuucuggggugugcuggaugguacggcgccaccaaagaauccagagggacacuccuguuuugcauucuuucuaugguuaucgugcugaucauggaggucaccgccgcuacagugguucuccuguucuuuccuauugugggagacgucgcccuggaacacaccuucgugacacuccggaagaauuaucgcggcuacaacgagccggaugacuauagcacccaguggaaucuggugauggaaaaacuuaaguguugcggggucaacaauuacacggauuuuuccggaagcucuuucgagaugaccacaggccauaccuaucccagauccuguugcaagagcaucggcucuguuuccugugacgggcgggaugugagcccuaacgugauucaccaaaaaggaugcuuucauaagcugcucaaaaucacaaagacccagucuuucacgcuguccggcagcucccuuggggcugccgucauucagcugcccggaauccucgcgacacugcugcucuuuauuaaacugggcuga

SEQ ID NO: 77359 - RNA, 777 nt, Artificial Sequence
  derived and/or modified sequence opt5 from TSPAN18__Homo_sapiens__XP_006718435
augcccgaggaacugccuagauggagcaccauggagggcgacugccucuccuguaugaaguaccugauguucguguuuaacuucuuuaucuuccuugggggagccugccugcucgcuauuggcaucugggucaugguugauccgacaggguuucgggaaauuguggccgcgaauccccugcuucugacgggagcuuauauccuccuggccaugggcgggcuccuguuccugcuuggauuucugggcuguugcggcgccgugcgcgagaacaaaugucuccugcuuuucuuuuuccuguuuauucucaucaucuuccuggcugaacugucugccgcuauucucgccuuuaucuucagagagaaucugacccgggaguucuuuacaaaggaacuuaccaaacacuaccaggggaacaaugacacagaugucuucagcgcgaccuggaacuccgugaugauuacauuuggaugcuguggcguuaaugggccugaggacuucaaguuugccucuguguuccgccugcucacccuggauagcgaagagguccccgaggcuugcuguagacgggaaccucaaucccgcgacggagugcuucugucuagagaggaaugccuccugggccggagccuguuucucaacaaacagggguguuauacgguuauccugaauaccuucgagacauacguguaucuugccggagcucuggccauuggcguccucgcgaucgaacuguuugccaugauuuucgcuaugugccuuuuucgcggcauccaguga

SEQ ID NO: 77360 - RNA, 633 nt, Artificial Sequence
  derived and/or modified sequence opt5 from TSPAN31__Homo_sapiens__NP_005972
auggugugcggcggguucgccuguagcaagaacgcucugugcgcccucaaugucguuuacaugcuggugucccuucugcucaucggaguggcggcuuggggcaaagggcugggacuugucucuagcauucacaucauuggcggggugaucgccguuggaguguuucugcuccugauugccgucgcuggccuggugggcgccguuaaccaucaccaggugcuccuguucuuuuauaugaucauccuugggcuggucuucauuuuucaauucgugaucuccuguucuugccucgcuauuaauagaagcaagcagaccgacgugaucaacgccuccuggugggucaugucuaauaaaacacgggaugagcuggaacgcagcuuugacuguugcggacuuuucaaccugacgacccucuaccagcaggauuaugacuuuuguacagcgauuugcaagucccaaagccccaccugucagaugugcggcgagaaauuccugaagcauucugaugaagcccugaagauccucgggggaguuggccuguuuuucuccuuuacagagauucuugggguguggcuggcuaugagauuccggaaucagaaagacccucgcgccaacccgagcgcuuuccucuga

SEQ ID NO: 77361 - RNA, 963 nt, Artificial Sequence
  derived and/or modified sequence opt5 from TSPAN32__Homo_sapiens__NP_620591
augggccccuggagcagagugcgggucgccaagugccagaugcugguuaccuguuucuuuauccuccugcuugggcuguccguggcuacaauggugacgcucaccuacuucggagcccacuuugcggucauucgcagagcuucucuggagaaaaacccuuaucaagccgugcaucagugggccuucagcgcuggccuuucccugguugggcuccugacacugggagccgugcucucugcugccgcgaccguccgggaagcccagggccugauggcugggggauuucuuugcuucagccuggccuuuugugcucaggugcaaguuguguucuggcgccuccacuccccgacacaggucgaggacgccaugcuggauaccuacgaccuuguguaugaacaggcgaugaagggcacaucucaugugagacggcaggagcuggccgcuauccaagaugucuuucucugcuguggcaaaaagagccccuucucccgccuggggagcaccgaagccgaccugugccagggagaggaggcugccagagaagauugucuccagggcauucggucuuuucugcgcacgcaccagcaaguugccuccagccuuaccucuaucgggcuggcucucacaguguccgcgcugcuuuucagcucuuuucugugguucgccauuagaugcggauguucccucgaccggaaaggcaaguacacccugacaccucgcgcuugcgggagacagccccaggagccuagccugcuccgguguucccaaggaggccccacccauugccugcacucugaagccguggccaucggcccucgcgggugcagcggaucccuuagauggcugcaggagagcgaugcugccccgcucccccugucuugucaccuugcggcucaucgggcccugcagggcagaucccgcgggggacucagcggcugcccugagcgggggcugucugacuga

SEQ ID NO: 77362 - RNA, 852 nt, Artificial Sequence
  derived and/or modified sequence opt5 from TSPAN33__Homo_sapiens__NP_848657
auggccagacggccccgcgcuccugccgcgagcggcgaggaauuuuccuuugugucuccgcuggucaaguaccuccuguucuuuuucaacaugcuuuucuggguuaucagcauggugaugguggcugucgggguguaugccagacugaugaaacacgccgaggcugcccucgcuugccuggccguugaccccgcgauucuucugaucguggucggagugcucauguuccugcugaccuuuuguggcugcauugggucccuccgggaaaauaucugucugcuucagacauucucucugugccucacggccguuuuucugcuucaacuggcugccggcauucucggauucguguuuagcgauaaggcucgcgggaaagucuccgagaucaucaacaaugccauugugcauuacagagacgaucuggaccugcagaaccucaucgauuucggacagaagaaauuuucuuguugcggcggcauuagcuauaaggacuggucccagaauauguacuucaacuguagcgaagauaauccuucucgggagcgcugcuccgugcccuauagcuguugccugccuacccccgaccaagcggucaucaacacaaugugugggcagggaaugcaggccuucgauuaccuugaggcuucuaagguuauuuauaccaauggcugcaucgacaaacuggugaacuggauucacuccaaucucuuucugcuugggggaguggcccugggccucgcuaucccucagcuggucgggauccugcucagccaaauucuggugaaccagaucaaggaucagauuaaacuucagcuguacaaucaacagcauagagccgacccgugguacuga

SEQ ID NO: 77363 - RNA, 717 nt, Artificial Sequence
  derived and/or modified sequence opt5 from TSPAN4__Homo_sapiens__XP_005253159
auggccagagcuugccugcaggccgugaaguaccucauguucgcguuuaaccugcuuuucuggcugggcggguguggaguccucggcguugggaucuggcuggcugccacccaaggcagcuuugccacacuuuccucuagcuuccccucccugucugcugccaaucuccugauuaucacgggagcuuuugugauggccauuggguucgugggaugccugggcgcgaucaaagagaacaagugucuccugcuuaccuuuuuccugcuccugcuucuggucuuucuccuggaagccacaauugcuauccuguucuuugccuauaccgacaaaaucgaucgguacgcucagcaggaccucaagaaaggccugcaccuuuaugggacacagggaaaugugggccugaccaacgccuggagcauuauccaaacagauuuccgcugcugugggguuuccaauuacaccgacugguuugagguguauaacgcgacgagagucccugauucuugcugucucgaguucagcgaauccugcggacugcaugccccgggcaccugguggaaggcucccuguuacgaaacagugaagguuuggcuucaggagaaucugcucgccguggggauuuucggacugugcaccgcucugguccagauccucggccugacauuugccaugaccauguauugucagguggugaaagccgacacguacugcgcuuga

SEQ ID NO: 77364 - RNA, 738 nt, Artificial Sequence
  derived and/or modified sequence opt5 from TSPAN6__Homo_sapiens__NP_003261
auggccagccccuccagacggcugcagaccaagccugugaucacaugcuucaaaucuguccuccugauuuacacguuuaucuucuggauuaccggcguuauccuucuggcuguggggauuuggggaaaggugagccucgagaacuauuuuucccugcuuaaugaaaaagccacaaacgucccguucgugcugaucgcgaccggcacaguuaucauucuccuggggaccuuuggauguuucgcuacaugccgcgccucugccuggaugcugaagcucuacgcuauguuucugacccuuguguuccuggucgagcucguggccgcuaucguuggcuuuguguucagacacgaaauuaaaaauagcuuuaagaacaauuaugagaaggcccugaaacaauacaacuccacgggggacuaucggucucaugcggucgauaagauccagaauacccuucacuguugcggagugacagacuaccgcgauuggaccgacacaaacuauuacagcgaaaaaggcuuccccaaguccuguugcaaacuggaggauuguaccccucagagagacgccgauaaggugaauaacgagggcugcuuuauuaaggucaugacgaucauugaaagcgagauggggguuguggcuggaaucucuuucggcguggccuguuuccagcucaucgggauuuuucuggcuuacugccugucccgggccaucacaaauaaccaauaugaaauugucuga

SEQ ID NO: 77365 - RNA, 750 nt, Artificial Sequence
  derived and/or modified sequence opt5 from TSPAN7__Homo_sapiens__NP_004606
auggccagcagacggauggagaccaagcccgugaucacaugccugaaaacgcuccugauuaucuacuccuucgucuuuuggauuaccggcguuauccuucuggcuguggggguguggggaaagcucacacugggcaccuauauuucucuuaucgccgaaaacagcacaaaugcgccuuacguccugaucgggaccggaacaaccauugugguuuucggccucuuuggguguuucgcuacgugccgcggauccccguggaugcugaaacuguaugccauguuucucucucugguguuccuugccgagcuggucgcuggcaucagcggcuuuguguucagacacgaaauuaaggacaccuuucuccggacauacaccgaugccaugcagacauauaacgggaaugacgagcgcuccagagcuguugaucaugugcaacggucucugagcuguugcggaguccagaacuacaccaauugguccacgagccccuauuuccuugaacacggcaucccucccucuuguugcaugaacgagacagacuguaauccucaggaucugcauaaccucaccguggccgcgacaaaagugaaucagaaggggugcuacgaccuggucaccuccuuuauggagaccaacaugggaauuaucgccggcguugcuuucgggauugccuuuagccaacugaucggaaugcuccuggcuuguugccuuucucgcuucaucacagccaaucaguacgaaaugguguga

SEQ ID NO: 77366 - RNA, 714 nt, Artificial Sequence
  derived and/or modified sequence opt5 from TSPAN8__Homo_sapiens__XP_006719646
auggccggcgugagcgcuugcaucaaguacuccauguucaccuuuaacuuccuguuuuggcucugugggauucugauccuugcccuggcgauuugggucagaguuucuaaugacagccaggcuaucuucggauccgaggaugugggcucuagcuccuauguggccgucgacauucucaucgccgugggggcuaucauuaugauccugggauuucuuggcugcuguggggccauuaaagaaucucggugcaugcugcuccuguucuuuaucggacugcuccugauucuucugcuccaaguugcuacaggcauccugggcgccguguucaagagcaaauccgaucgcauugucaacgagacgcuuuacgaaaauaccaagcugcucagcgcgacaggggagucugaaaaacaguuucaggaggccaucaucguguuccaggaggaauuuaaguguugcggacugguuaacggcgcugccgacugggggaauaacuuccaacacuaucccgagcugugugcuugccucgauaagcagagaccuugucaguccuacaauggaaaacagguguauaaggaaaccugcauuagcuuuaucaaagacuuccuggccaagaaccuuauuaucgucauuggcaucucuuucgggcuggcggugaucgagauucucggacugguguuuuccaugguccuuuacugucaaaucggcaauaaauga

SEQ ID NO: 77367 - RNA, 720 nt, Artificial Sequence
  derived and/or modified sequence opt5 from TSPAN9__Homo_sapiens__NP_001161792
auggccagaggcugccuguguugccucaaguacaugauguuccuguuuaaccuuaucuucuggcugugugggugcggacuccugggcguggggauuuggcuuagcgucucccagggaaauuuugcuaccuucucucccagcuuuccuucccugucugccgcgaaccucguuaucgcuauuggcacaaucgugauggugacgggguuccugggaugucugggcgccauuaaagagaauaagugccuccugcuuagcuuuuucaucguccugcucgugauccugcuugccgaacugauucuccugauccuguuuuucguuuauauggacaaagugaacgagaaugcuaagaaagaucucaaggaaggccugcuucuguaccacaccgagaacaaugucgggcucaagaacgccuggaauauuauccaagcugaaaugcgguguugcggagugacagacuauaccgauugguacccgguucugggcgagaacacagugcccgaccgcuguugcauggaaaauucccagggguguggaagaaacgccaccacaccucuuuggcggaccggcugcuaugagaaagucaagaugugguuugaugacaauaaacaugugcuggggacggugggaaugugcauucucaucaugcagauucugggcauggcguucucuaugacccuguuucagcacauccaucgcacaggcaagaaauacgaugccuga

SEQ ID NO: 77368 - RNA, 1806 nt, Artificial Sequence
  derived and/or modified sequence opt5 from TSPEAR__Homo_sapiens__NP_001258966
augagcuuccccgccuccagaaucuuuucucagugcgaccuguucccugaggaauuuagcauuguggucacccuccggguuccgaaccugcccccuaagcgcaaugaguaccuucugacagugguggcugaagaguccgaucuccugcuucugggccucagacugucucccgcccaacugcacuuccucuuucugcgggaagacacggcgggggcuuggcagacccgcgucagcuucagauccccugcccuuguggauggacgguggcauacacugguucucgccgugucugcuggcgucuuuagccugaccacagacugugggcuucccguggauaucauggccgacguuccuuucccggcuacccuguccgugaaaggagcccgcuuuuucgucggcagcagacggcgcgcgaaggggcucuuuaugggacuggugagacagcuggugcuccugcccggcucugaugccacaccucggcuuugccccucccgcaacgcuccucuggccguccucagcauucccagaguucugcaggcucuuaccggcaaaccggaggacaaugaggugcugaaguauccuuacgaaacgaacauccgggugacccucgggccccaaccucccuguacagaggucgaagaugcccaguucugguuugacgcgucucgcaaaggacuguaucugugcgugggcaaugaguggguuuccgugcucgccgcuaaggagagacuggauuacgucgaagaacaccagaaccuuagcaccaauucugaaacacuggggauugagguguuccggaucccccagguuggacucuucguggccaccgcuaacagaaaggccacguccgccgucuauaaauggacagaagagaaguuugugagcuaccaaaauaucccuacccaucaggcucaggcguggcgccacuucacaauuggcaaaaagaucuuucuggccgucgcuaacuucgagccggacgaaaaagggcaggaguuuuccgugauuuauaaguggucucaucggaaacuuaaguucacccccuaccaaagcaucgccacccacuccgccagagauugggaggcuuuugagguugacggagaacacuuccuggccguggcgaaucaucgcgagggcgacaaccacaauauugauagcgucaucuacaaguggaacccugcuacacggcucuuugaggccaaucagacgauugccaccucuggcgcuuaugacugggaguucuuuuccguggggcccuacagcuuccugguuguggccaacacauuuaacggaaccucuacaaaaguccauagccaccuguauaucagacuccugggcuccuuccagcuuuuccaaucuuuuccuaccuucggggcugccgauugggaaguguuucagaucggagaacgcauuuuccuggcgguggccaauagccacuccuacgacguugagaugcagguccagaacgauagcuaugugaucaauucugugauuuacgaacucaacgucacggcucaagccuuugugaaguuccaggacauccugacauguuccgcucuggauugggaguuuuucagcguuggcgaggacuauuuucuuguggucgccaauucuuucgaugggcggaccuuuuccgugaacagcauuaucuacagauggcagggauacgaaggcuucguugcggugcauucccuccccaccgucggcugccgcgacugggaggccuuuucuacaaccgcuggggccuaucugaucuacagcuccgcuaaagaaccgcugucucgggugcucagacugcgcacacgguga

SEQ ID NO: 77369 - RNA, 513 nt, Artificial Sequence
  derived and/or modified sequence opt5 from TSPO2__Homo_sapiens__XP_011512699
augagacugcagggcgccaucuucgugcuccugccccaccuugggccuauucuggucuggcucuuuacccgggaccauaugagcggauggugcgagggcccgcgcaugcuguccuggugucccuucuacaagguucuucugcucgugcaaacagcuaucuauucuguggucggguacgccagcuaucugguguggaaagaucugggaggcgggcucggauggccucuggcgcuuccccugggccucuacgcuguucagcugacgauuuccuggaccgugcuuguccuguuuuucacagugcacaacccuggccucgcccugcugcaucuccugcuucuguaugggcucguugugucuaccgcccugaucuggcaccccauuaauaaacuugcugcccugcuccugcugccuuaccucgcuuggcugacagucaccagcgcccuuacauaucaucuguggagagacucccucugcccggugcaccagccccagccuaccgaaaagucugauuga

SEQ ID NO: 77370 - RNA, 510 nt, Artificial Sequence
  derived and/or modified sequence opt5 from TSPO__Homo_sapiens__NP_001243459
auggcucccccuugggugccggccaugggcuucacccuggcccccagccucgggugcuuugucggauccagauucguucacggcgaggggcugcggugguacgcgggacuucagaagccuucuuggcaucccccucacugggugcugggccccgugugggggacacucuauagcgcuaugggauacggcuccuaucuggucuggaaagaacuuggcggguuuacggagaaggccgugguuccucugggacucuacaccggccaacuggcccugaacugggcuuggccgcccaucuucuuuggggcccgccagaugggaugggcucucguggaccugcuucuggucucuggcgccgcggccgcuacaaccguggccugguaucagguuagcccucucgcugccagacugcuuuaccccuaucuggcguggcucgccuucacaaccacacugaauuacuguguguggcgggauaaccauggguggcgcggaggcagacggcugccugaauga

SEQ ID NO: 77371 - RNA, 927 nt, Artificial Sequence
  derived and/or modified sequence opt5 from TSPY10__Homo_sapiens__NP_001269398
augagacccgagggcagccugaccuaccgggugccugaacgccucagacagggguucugcggagucggccgggccgcucaagcccugguuugugcguccgcuaaggaggggacagccuuucgcauggaagccgugcaggagggagcugccggcguggaaucugagcaggcugcccuuggggaggaagcgguccugcuccuggacgauaucauggccgagguggaaguuguggcugaggaggaaggacuugucgagagacgggaagaggcccagcgcgcucaacaggccgugccgggccccggcccuaugacgcccgaaagcgcgcuggaggagcuccuggccguucagguggaacuggagccugucaacgcucaggccagaaaagccuucucccggcaacgcgaaaagauggagagacggcgcaaaccccaccucgacagacgcggggcugugauucagucugugccuggauuuugggccaaugucaucgcuaaccauccgcagaugagcgcgcugauuaccgaugaagacgaggauaugcuuuccuauaugguuucucuggagguggaagaggaaaagcaccccgugcaucucugcaaaaucaugcuguucuuucggagcaauccuuacuuccagaacaaggucauuacaaaggaguaucuugugaauaucaccgaauacagagccucccacagcacacccaucgagugguauccugacuacgagguugaggcuuaucggagacgccaucacaacucuucccugaacuuuuucaauugguuuagcgaucacaauuucgccggcucuaacaaaauugccgaaauccucuguaaggaccuguggcggaauccccugcaauacuacaaaagaaugaagccgccugaagaggggaccgagacauccggagauagccagcuccugucuuga

SEQ ID NO: 77372 - RNA, 927 nt, Artificial Sequence
  derived and/or modified sequence opt5 from TSPY1__Homo_sapiens__NP_003299
augagacccgagggcagccugaccuaccgggugccugaacgccucagacagggguucugcggagucggccgggccgcucaagcccugguuugugcguccgcuaaggaggggacagccuuucgcauggaagccgugcaggagggagcugccggcguggaaucugagcaggcugcccuuggggaggaagcgguccugcuccuggacgauaucauggccgagguggaaguuguggcugaggaggaaggacuugucgagagacgggaagaggcccagcgcgcucaacaggccgugccgggccccggcccuaugacgcccgaaagcgcgccugaggagcugcucgccguucagguggaacuggagcccgucaacgcucaggccagaaaagccuucucccggcaacgcgaaaagauggagagacggcgcaaaccucaccuggacagacgcggggcugugauucagucugugccgggauuuugggccaaugucaucgcuaaccauccccagaugagcgcgcucauuaccgaugaagacgaggauaugcuguccuauaugguuucucuugaggugggcgaagagaagcacccugugcaucugugcaaaaucaugcuguucuuucggagcaaucccuacuuccagaacaaggucauuacaaaggaauaucucgugaauaucaccgaguacagagccucccacagcacaccuaucgaaugguaucccgacuacgagguugaggcuuaucggagacgccaucacaacucuucccuuaacuuuuucaauugguuuagcgaucacaauuucgccgggucuaacaaaauugccgaaauccuguguaaggaccucuggcggaauccgcugcaauacuacaaaagaaugaagccucccgaggaaggaaccgagacauccggcgauagccagcugcucucuuga

SEQ ID NO: 77373 - RNA, 867 nt, Artificial Sequence
  derived and/or modified sequence opt5 from TSPY3__Homo_sapiens__XP_011542306
augagacccgagggcagccugaccuaccgggugccugaacgccucagacagggguucugcggagucggccgggccgcucaagcccugguuugugcguccgcuaaggaggggacagccuuucgcauggaagccgugcaggagggagcugccggcguggaaucugagcaggcugcccuuggggaggaagcgguccugcuccuggacgauaucauggccgagguggaaguuguggcugaggaggaaggacuugucgagagacgggaagaggcccagcgcgcucaacaggccgugccgggccccggcccuaugacgcccgaaagcgcgcuggaggagcuccuggccguucagguggaacuggagccugucaacgcucaggccagaaaagccuucucccggcaacgcgaaaagauggagagacggcgcaaaccccaccucgacagacgcggggcugugauucagucugugccuggauuuugggccaaugucaucgcuaaccauccgcagaugagcgcgcugauuaccgaugaagacgaggauaugcuuuccuauaugguuucucuggagguggaagaggaaaagcaccccgugcaucucugcaaaaucaugcuguucuuucggagcaauccuuacuuccagaacaaggucauuacaaaggaguaucuugugaauaucaccggccugcucaucccccugcaacuguccgggauuagaaucaugaaauggcggagaauugccgcugacacaaccacagccgcccucaccagcucuacgggaucccugaccacaaccagccaggaucuuacacgccugcuccggucuuacguuagaaccuguggcgcuaucccuugcaacacgacacgcggguga

SEQ ID NO: 77374 - RNA, 945 nt, Artificial Sequence
  derived and/or modified sequence opt5 from TSPY4__Homo_sapiens__NP_001157943
augagacccgagggcagccugaccuaccgggugccugaacgccucagacagggguucugcggagucggccgggccgcucaagcccugguuugugcguccgcuaaggaggggacagccuuucgcauggaagccgugcaggagggagcugccggcguggaaucugagcaggcugcccuuggggaggaagcgguccugcuccuggacgauaucauggccgagguggaaguuguggcugaggucgaggugguugccgaagaggaaggacuuguggagagacgggaagaggcucagcgcgcccaacaggcggucccgggccccggcccuaugacgcccgagagcgcccuggaggaacuccuggcuguccagguggaacuggagccugugaacgcccaggcuagaaaagccuucucccggcaacgcgaaaagauggagagacggcgcaaaccccaccucgacagacgcggggccguuauucagucugugccuggauuuugggcuaaugugaucgcgaaccauccgcagaugagcgcccugauuaccgaugaggacgaagauaugcuuuccuauauggucucucuggagguggaagaggaaaagcaccccguucaucucugcaaaaucaugcuguucuuucggagcaauccuuacuuccagaacaaggugauuacaaaggaguaucuugucaauaucaccgaguacagagcuucccacagcacacccaucgaaugguauccugacuacgagguggaagccuaucggagacgccaucacaacucuucccugaacuuuuucaauugguuuagcgaucacaauuucgccggcucuaacaaaauugcugagauccucuguaaggaccuguggcggaauccccugcaauacuacaaaagaaugaagccgccugaggaagggaccgagacauccggagauagccagcuccugucuuga

SEQ ID NO: 77375 - RNA, 1314 nt, Artificial Sequence
  derived and/or modified sequence opt5 from TSPYL1__Homo_sapiens__NP_003300
augagcggccuggacggggugaagagaaccacaccccuccagacgcacuccaucauuaucucugaucaagucccuagcgaccaggaugcccaucaguaccugcggcuucgcgaccaguccgaggcuacccaaguuauggccgaaccgggagagggcgggucugaaacaguggcgcugcccccucccccucccagcgaggaaggaggcgugccucaggaugcugccgggagaggaggcaccccgcagauucgggucgugggcgggcgcggacacguugccaucaaagcuggccaggaggaggggcaacccccugccgaaggacucgcugccgcguccguggucauggccgcugacagaucucugaagaaaggcgugcaagggggagagaaggcccuugaaauuugcggcgcucagcggagcgccuccgagcugacagcgggcgccgaggcugaagccgaggaaguuaaaaccgggaagugugcuacagugagcgccgccgucgcugagcgcgaaucugcggagguggugaaggagggacucgccgaaaaagaggucauggaggaacagauggaaguugaggagcagcccccugaaggcgaggaaaucgagguggcugaagaggauagacuggaggaagaggcccgggaagaggaggggcccuggccgcugcaugaagcccuccgcauggacccucuggaggcuauccagcuugaacuggauaccgugaacgcccaggcggacagagcuuuccaacagcucgagcacaaguuuggacggaugcgcagacauuaucuggaacggcgcaauuacauuauccagaacauucccggcuucuggaugacggccuuuagaaaucacccucagcuuuccgccaugauccgggggcaagaugcugagaugcugagauauauuaccaaccucgaggucaaagaacugcgccacccccggacaggaugcaaguucaaauuuuucuuuagacgcaaucccuacuuccggaacaagcugaucgugaaggaguaugaaguuagaagcucuggccgcguggucucccucagcaccccuauuaucuggcggagaggccaugagccgcagucuuuuauccgccggaaucaggaccugauuuguuccuucuuuacaugguucagcgaucacucccuucccgaaucugacaaaaucgccgagauuaucaaggaggaccuguggccuaacccccuccaguacuaucugcuuagagaaggggugcgccgggcuagacggcgcccucugagagagcccguugaaauuccgcggccuuuuggauuccaaagcggcuga

SEQ ID NO: 77376 - RNA, 2082 nt, Artificial Sequence
  derived and/or modified sequence opt5 from TSPYL2__Homo_sapiens__NP_071400
auggacagacccgaugagggcccuccggccaagacccggcgccugagcuccucugaaagcccccagagagacccucccccucccccuccgcccccuccccuccugcggcuuccucugcccccgccucaacagcgccccagacuccaggaggaaacagaggcugcccaggugcuggcggauaugcgcggggucggacuuggcccugcucugcccccucccccgcccuacguuauccucgaagagggagggauucgcgccuauuucacgcugggcgccgagugcccugggugggacuccaccaucgaaucuggauacggcgaggcucccccucccacagaaagccuggaggcccucccgaccccugaggcuuccggcgggucucuggaaauugauuuucaaguggugcagagcuccagcuucggaggcgagggggcccuugaaacauguucugcggucggaugggcuccccagagacugguggacccuaaauccaaggaggaagcuaucauuaucguugaggaugaggacgaagaugagcgggaaagcaugcggucuuccagacggcgcagacggcgcagacggagaaaacagcgcaaggugaaacgggagagcagagaacgcaacgccgagcggauggagucuauccuccaagcucuggaagacauucagcuugaucuggaggccgucaauaucaaggcgggcaaggccuuucucagacugaaacgcaaguucauucagaugcggagacccuuucuggaacgccgggaccucaucauucagcacaucccuggguucugggugaaagccuuucugaaccaucccagaauuuccauccuuaucaaucgccgggaugaggacauuuucagauaucugaccaaccuccaaguucaggaccugcggcacaucagcaugggauacaagaugaaacuuuauuuucagacaaauccguacuucaccaacauggugauugucaaggaauuucaacgcaauagauccggccggcuggugucucauagcacgccuaucagauggcaccgcggccaggagccccaggcccggagacaugggaaccaggaugcuucccacagcuucuuuucuugguucuccaaucacagccuccccgaggccgaccgcauugccgaaaucaucaagaacgaucugugggugaauccucugagauauuaccuccgggagcgcggaucuagaauuaaacggaagaaacaagaaaugaagaaacgcaagaccagaggccggugcgaggucguuaucauggaggacgcuccggauuacuaugcgguggaagacauuuucagcgagaucuccgauauugacgaaacaauccaugauaucaaaauuucugacuuuauggagaccacagauuacuucgaaaccacggacaacgagaucacagacauuaaugagaacaucugugauagcgaaaaucccgaccacaacgaggugccuaacaaugaaaccacagauaacaaugaguccgccgacgaucaugaaaccaccgacaacaaugagagcgcugaugacaacaaugagaaccccgaagauaauaacaagaauacagacgauaacgaggaaaauccuaacaauaacgagaacacguaugggaauaacuuuuucaagggaggcuuuugggggucucacggaaauaaccaggacuccagcgauucugacaaugaagccgacgaggccuccgaugacgaggauaacgacggcaaugaaggcgauaacgaggggagcgacgaugacggaaaugaaggcgauaacgagggguccgacgaugacgaucgcgacauugaguacuaugaaaaagucaucgaggacuucgauaaggaccaggcugauuacgaagacgugauugagaucaucucugaugaaagcguugaggaggaaggaauugaggaaggcauccagcaagacgaggauauuuaugaagaggggaauuacgaggaagagggcuccgaagacgugugggaggaaggagaggauucugacgauagcgaccuggaggacguccuucaggugcccaacggcugggccaauccugggaaaagaggaaagaccggcuga

SEQ ID NO: 77377 - RNA, 1245 nt, Artificial Sequence
  derived and/or modified sequence opt5 from TSPYL4__Homo_sapiens__NP_067680
augagcggccuggacgggggaaacaagcucccccuggcccagaccggcgggcuugcugccccugaucacgcguccggagacccggauagagaccaaugccagggccugcgggaggaaacagaggcuacacaggugauggccaauaccgggggaggcucucucgaaacagucgccgagggcggggcuagccaggaucccguugacuguggaccugcccugcgcgugcccguggcuggcuccagagggggagccgcgaccaaagccggccaagaagaugcuccucccucuacaaaggggcuugaggccgcuagcgccgcggaggccgcugacuccucucagaaaaacggaugccagcugggcgaaccucggggcccggccgggcagaaggcucucgaggccuguggagccggcgggcugggaagccaaaugauccccggcaaaaaggcuaaggaagucaccacgaaaaagcgcgcgauuuccgccgcuguggagaaagagggggaagccggagccgcuauggaggaaaagaaaguugugcagaaggagaagaaagucgccggcggcgugaaggaagagaccagaccucgggcgcccaaaaucaauaacugcauggauagccuggaggcuauugaccaggaacucucuaauguuaacgcccaggccgaucgcgcuuuccugcaacuugagagaaaguuugggcggaugcgcagacugcauaugcagcggcgcuccuucaucauucagaauaucccuggauuuugggugacggccuucagaaaccacccccaacucagcccgaugaucucuggccaggacgaagauaugcugcgguacaugauuaaucuugaggucgaggaacugaaacauccucgcgcuggguguaaguuuaaauucaucuuucagggaaaccccuauuucagaaaugagggccucgugaaggaauacgagcggagauccagcgggcgcguggucucucuguccaccccuauucgguggcacagaggccaggacccccaagcccauauccaccgcaaccgggaaggaaauacaauucccagcuuuuucaacugguuuuccgaccacucucugcucgaguucgauagaaucgcggaaauuaucaagggcgagcuguggccuaauccgcuucaguauuaccugaugggggagggaccccgccggggcaucagagggccuccccgccagccuguugaaagcgcccgguccuuuagauuccagagcggauga

SEQ ID NO: 77378 - RNA, 1254 nt, Artificial Sequence
  derived and/or modified sequence opt5 from TSPYL5__Homo_sapiens__NP_277047
augagcggcagaucccgggggcgcaagucuagcagagccaaaaaccggggaaagggccgcgcuaaagccagagugcggcccgcgccugacgaugcuccgcgcgaccccgauccuucccaguaccaaucucugggggaggacacccaggccgcccagguccaggcuggagccggcuggggagggcucgaagcugccgcgagcgcccaacugcuuagacugggcgaggaagcugccugccggcucccccuggauuguggccuugcucugcgcgccagagcggccggggaccacggacaggcugccgcucggccuggccccgggaaggccgccucccucucugagcgccuggcugcggauacaguuuucgugggaacggccggcaccguggggagaccuaaaaaugcuccgcgggucggaaaccgcagaggccccgccggcaagaaggccccugaaacaugcagcaccgcugggcggggaccccaggugaucgccggcgggagacagaaaaagggagcggcuggcgagaauacauccguuagcgccggggaggagaaaaaggaggaacgcgacgccggaucuggcccucccgcuaccgagggcuccauggauacacuggagaacgugcaacucaaacuggaaaauaugaacgcccaggcugaccgggccuaucuuagacugagccgcaaguuugggcagcuccggcugcagcaucuugagagacgcaaucaccugauucaaaacaucccgggauucuggggccaggcguuucagaaucauccucaacucgccucuuuccugaacucccaggaaaaggagguccugagcuaccucaauucucuggaaguggaggagcuugggcuggcucggcucggauauaaaauuaaguuuuacuucgauagaaaccccuauuuucagaauaaaguucugaucaaggaauacggcugugggccuuccggccagguggucagccgcuccacccccauucaauggcuucccggacacgaccugcagucucucagccagggcaacccugagaauaaccgguccuucuuugggugguucagcaaccauucuuccaucgaaagcgauaaaaucguggagauuaucaaugaagaacuguggccgaacccccugcaguuuuaucuccugucugagggagccagaguggaaaagggcaaagagaaggaagggcgccaaggaccuggcaagcagcccauggagacgacccagccuggggucagccaguccaauuga

SEQ ID NO: 77379 - RNA, 2415 nt, Artificial Sequence
  derived and/or modified sequence opt5 from TSR1__Homo_sapiens__NP_060598
auggccgcucacagacccggcccucugaagcagcaaaacaaagcccauaaagggggacggcaccgcggcagagggagcgcgcagcgggacggaaagggccgccucgcucugaagacccuuuccaaaaaggugagaaaggagcugucucgggucgaucagcgccauagagccagccagcuccggaaacaaaagaaagaagccguucuggcugagaagcgccagcuugggggaaaagacggcccgccccaccaggugcugguggucccucuccauuccagaaucucucugcccgaagccaugcagcugcuccaagaucgggacacaggcacggugcaccugaaugagcuugggaacacccagaauuucaugcugcucugcccucgccugaagcacagaugguuuuucacaagcgcucggcccggagaucuucauguugugcuggacauggccaaggucgcggauaccauucucuuucugcuggacccucucgaaggcugggauuccacaggggacuacugucugucuugccuuuucgcccagggacugccgaccuauacacucgcugugcagggcaucagcgggcugccccuuaaaaagcaaauugauacccgcaaaaagcuguccaaagccguugagaagagauuuccucacgacaaacuccugcugcucgauacgcagcaggaggcuggaaugcugcuucggcaacuggccaaccagaagcagcagcaucucgcguucagagaccgccgggccuaccuguuugcucacgccguggacuucguccccagcgaagagaauaaccuugugggcacccugaagaucucuggcuaugugagagggcaaacacucaaugucaaccgccugcugcacauuguuggauacggcgauuuucagaugaaacagaucgacgcuccuggggaucccuucccgcucaauccucggggaaucaagccccagaaagacccugauauggccauggaaauuugugccaccgacgcuguggaugacauggaggagggccugaaggugcuuaugaaagcggaucccgggagacaagaaucccugcaggccgaggucauccccgacccuauggaaggagagcagacauggccgaccgaagaggagcucagcgaagcuaaggauuuucugaaggagucuuccaaagugguuaagaaagugcccaagggcacgagcucuuaucaggccgaauggauucuggacggcgggucccaaagcggaggcgagggggacgaauacgaguaugaugacauggagcaugaagauuucauggaggaagagucccaggacgaaucuagcgaggaggaagaggaauacgagacaaugaccaucggagaguccguccacgaugaccuuuacgauaaaaagguggacgaagaggccgaagcuaagaugcucgagaaauauaagcaggaacgccuggaggagauguuuccugaugaaguugacacaccccgggauguggccgcgcgcauuagauuccagaaauaccggggccucaagagcuucagaaccucuccuugggaccccaaagagaaccugccgcaagauuaugcucgcaucuuucaguuccagaauuuuaccaacacacggaaguccauuuucaaggaagucgaggaaaaagagguggagggggccgaagucggcugguacgugacgcugcauguuagcgaggugccugucucugugguugaaugcuuuagacaaggaacaccccuuaucgccuucagccugcucccucacgagcagaagauguccgugcugaauauggucgugcggcgcgaccccggcaacaccgaaccugugaaagcuaaggaggagcugaucuuucauuguggguucagacgguuuagagccucuccccuuuucagccagcacaccgcugccgacaaacacaagcuccagcgcuuucugacagcggauauggcccugguugcuaccgucuaugccccgauuacguucccucccgcuuccgugcuccuguuuaaacaaaagagcaauggaaugcauucucuuaucgccacaggccaccugauguccguggaccccgaucggauggucauuaagagagugguucucagcgggcauccuuucaaaaucuucaccaagauggcggugguccgcuacauguuuuucaacagagaagacgugcugugguuuaaaccgguugagcugcggaccaaguggggacgcagaggccacauuaaagaaccccuugggacacacggccauaugaagugcucuuucgauggaaagcucaaaucccaggacaccgugcugaugaaccuguauaagcgggucuuuccuaaauggacauacgaucccuacgugccugagcccguuccuuggcucaagagcgagaucuccucuacggugccccagggcgggauggaauga

SEQ ID NO: 77380 - RNA, 1164 nt, Artificial Sequence
  derived and/or modified sequence opt5 from TSSC1__Homo_sapiens__NP_003301
auggaggacgaugcccccgugaucuacggccuggaguuccaggcuagagcccucaccccucaaacagcggaaacggacgcuauucgguuucuggucgggacccagagccuuaaguaugauaaccagauccacauuaucgacuucgaugacgaaaauaacauuaucaauaaaaacguucugcuccaucaggccggagagaucuggcacauuuccgccucuccggcugaucgcggcgugcugacaaccugcuacaauagaacaagcgacuccaaggugcuuaccugugccgcugucuggcggaugcccaaagaacuggagucugggagccaugaguccccugaugacucuagcuccacagcccaaacccucgaacugcugugccaccucgauaacacggcgcauggaaauauggccugugugguuugggagcccaugggcgacgggaagaaaaucauuagccuggcugauaaccacauccuucugugggaccuccaggaaucuuccagccaggccgugcuggcuucuuccgccagccuugagggaaagggccagcugaaguuuaccucuggccgcugguccccucaccauaauugcacacaagucgcgaccgccaacgacacaacccucagagggugggauacgcggagcaugucccagauuuauuguaucgagaaugcucacggacagcuggugcgcgaccuggauuucaaccccaauaaacaguacuaucucgccucuugcggcgacgauuguaagguuaaauuuugggacacaagaaacgugaccgaaccugucaagacacuggaggaacauagccacuggguguggaaugugcgguacaaccacucccaugaucaacuuguccugaccgggagcucugacucccgcguuauucucagcaacauggugucuaucagcuccgagccguucggacaccugguggaugacgaugacaucucugaccaggaagaucauagaagcgaggagaaauccaaggaaccccuucaggacaaugucauugcuaccuaugaggaacacgaggauagcguguacgccguugacuggucuuccgccgauccuuggcuguuugcuagccucucuuacgacggccggcuggugaucaaccgcguccccagagcgcugaaguaucauauucuccuguga

SEQ ID NO: 77381 - RNA, 1104 nt, Artificial Sequence
  derived and/or modified sequence opt5 from TSSK1B__Homo_sapiens__NP_114417
auggacgaugccgcugugcugaagagacggggcuaccuccugggcaucaaccuuggagagggcagcuaugccaaagucaaguccgcguacucugaacgccugaaauucaauguugcuauuaagaucauugaccggaaaaaggcccccgccgauuuucucgagaaguuccugccuagagaaaucgagauucuugcuaugcugaaccacugcagcaucaucaaaaccuaugaaauuuuugagacaucccaugggaagguguacaucgugauggagcucgccguccagggagaccugcuggaacucauuaaaacgcgcggcgcucugcacgaggaugaagccagaaagaaauuccaucaacuuucucuggcgaucaaguauugucacgaccucgaugugguucaucgggaccugaagugcgauaaucuucugcucgacaaagauuuuaacauuaagcugagcgacuucuccuuuucuaaacgcugucugagagaugacagcgggcggauggcccucuccaagaccuucugcggaagcccggcuuacgccgcucccgaggugcugcagggcaucccuuaucagcccaaagucuacgacauuuggucucuuggcgugauccuguacaucaugguuuguggguccaugccuuaugaugacagcaauauuaagaaaaugcuccgcauccagaaggagcacagagugaacuuuccccggucuaagcaccugacaggagaaugcaaagaucuuauuuaccauaugcugcaaccugacgucaaucgcagacuccacaucgaugagauucugucccauuguuggaugcagccgaaggcccggggcagccccucuguggcgaucaacaaagaaggggaguccagccgcggaaccgaaccucuguggacacccgagccuggcuccgacaagaaaucugccaccaagcucgagcccgaaggggaggcucagccgcaggcccaaccugaaacaaagcccgagggaaccgcuaugcagaugagcagacaguccgaaauccugggcuucccuagcaaacccucuacgauggagaccgaggaagggcccccucagcaaccgcccgagacacgggcccaguga

SEQ ID NO: 77382 - RNA, 1077 nt, Artificial Sequence
  derived and/or modified sequence opt5 from TSSK2__Homo_sapiens__NP_443732
auggacgaugccaccgugcugagaaagaaaggcuacaucgucgggauuaaccucggaaagggcagcuaugcuaaaguuaaguccgccuacucugagcggcugaaauucaauguggcggugaagaucauugaccgcaagaaaacacccacggauuuugucgaaagauuccuuccucgggagauggacauccuggcuaccgugaaccacgggagcauuaucaagacauaugaaaucuuugagaccuccgauggacgcauuuacaucauuauggaacucggcguucagggggaccugcuugaguucaucaaaugccaaggagcccugcaugaggauguggccagaaagauguuucggcagcucucuagcgcugucaaauauugucacgaccuggauauugugcaucgcgaccugaagugcgaaaaucuccugcuugauaaggacuucaacaucaaacuguccgauuuuggcuucucuaagagaugucuccgggacagcaauggccgcauuauccuguccaaaacauuuugcgggagcgccgcuuacgccgcgccggagguucuucagucuauccccuaucagccuaagguguacgacauuuggucccugggagucauccucuacauuaugguguguggcagcaugcccuaugaugacucugauaucagaaaaaugcugcggauucaaaaggaacaccgcguggacuucccuagauccaaaaaccugaccugcgaguguaaggaucucaucuaccggaugcugcagcccgacgucagccagcgccuucauaucgaugagauucugucucacuccuggcuccagccuccgaagcccaaagccacaagcuccgcuucuuuuaagagagaaggggagggaaaauaucgggccgaaugcaagcuggacaccaaaacgggccuuagaccugaucaccgccccgaccauaagcugggggcuaagacccaacaccggcuccugguugugccugagaaugaaaacagaauggaggaucgccuggccgagacaagccgggcgaaagaccaucacaucuccggagccgaagugggcaaggcuagcaccuga

SEQ ID NO: 77383 - RNA, 1017 nt, Artificial Sequence
  derived and/or modified sequence opt5 from TSSK4__Homo_sapiens__NP_001171668
augggcaagggggacgugcuggaggccgcucccaccacaacggccuaccacagccucauggaugaauauggauacgaggucggcaaagcgaucgggcauggauccuauggcucuguuuacgaggcuuucuauaccaagcagaaagugaugguggccgucaagauuaucagcaaaaagaaggccuccgacgauuaccugaacaaauuucuuccuagagaaauucaagugaugaagguucugcggcacaaauaucucaucaauuucuaccgcgcuauugaaucuacaagcagaguguacaucauccuggagcuugcccaagggggagacguccuggaguggauucagcgguauggcgcuugcuccgaaccgcucgccggcaagugguuuucucagcugacccuggggaucgcguaccuccauagcaaauccauugugcaccgccugaugcccagccuuucugccgcuggaagagaucugaagcucgagaaccugcuucuggacaagugggaaaauguuaaaaucuccgauuucggcuuugccaagauggugccuagcaaccagcccgucggguguucuccuuccuaucgccaggugaauugcuucagccaucucucucagacauacuguggauccuuugcuuaugccugccccgagauucugcggggccugccuuacaacccguuccucagcgacaccugguccaugggggugauccuguauacacuugucguugcgcaucugcccuuugaugacaccaaucucaaaaagcugcuuagagagacgcagaaagaagugaccuucccugccaaccacacaauuucucaagaguguaagaaucugauccuccagaugcugcggcaggcuaccaaacgcgccacaauccuggauauuaucaaggacagcugggugcucaaguuucagcccgaacaaccuacccacgagauuagacugcuugaagcuaugugccagcugcacaacacgacaaaacagcaucaaucccuccagaucaccacauga

SEQ ID NO: 77384 - RNA, 966 nt, Artificial Sequence
  derived and/or modified sequence opt5 from TSTA3__Homo_sapiens__NP_003304
augggcgagccccaggggagcaugagaauccuggugaccggaggcuccgggcucgucggaaaggccauucaaaaaguuguggcugacggcgccgggcugccuggagaagauuggguguucgucucuagcaaggacgcggaucuuacagacacggcucagacccgggcccuguuugagaaagugcagccgacacacguuauccaucucgccgcuauggugggcggccuguuccgcaacauuaaguacaaucuugauuuuuggcggaaaaacguccacaugaaugacaacgugcugcauuccgccuucgaaguuggggcuagaaagguggucucuugccucagcaccuguaucuuucccgauaagacaaccuauccuauugacgagacaaugauccacaauggacccccucauaacuccaauuucggcuacucuuaugccaaacgcaugaucgaugugcagaacagagcguacuuucaacaguaugggugcaccuucacggccgugauucccaccaaugucuuuggaccucacgacaacuucaauaucgaagauggccacguucugccggggcugauucauaaggugcaccucgcuaaaagcuccggaagcgcccugacaguguggggcaccggcaacccccggcgccaguuuaucuacucucuugaccuggcucaacucuucauuuggguccugagagaguauaaugagguggaaccuaucauucuuuccguuggggaggaagaugaggugagcaucaaggaggccgcggaagccgucguggaggcuauggacuuucauggagaaguuacauucgacaccacgaaaucugauggccaguucaagaagacagccuccaacagcaaacugcggaccuaccuccccgacuuucgcuucacaccuuuuaagcaggcugugaaagagaccugugccugguucaccgauaauuacgaacaggccagaaaguga

SEQ ID NO: 77385 - RNA, 330 nt, Artificial Sequence
  derived and/or modified sequence opt5 from TSTD1__Homo_sapiens__NP_001106676
auggccggcgcucccaccgugagccugccugagcucagaucccugcuugccucugggcgggcgcgccuguucgacgucagaagccgggaagaggcugccgccggaacaaucccgggcgcucucaacauucccguuuccgaacuggagucugcccuucagauggaaccugcugccuuucaagcgcuguacagcgccgagaagcccaaacucgaggaugaacaccugguguucuuuugccagauggggaagcgcggacugcaggcuacgcagcucgccagaucccugggcuauaccggguacggagagguguggcuucuggcuggccgguga

SEQ ID NO: 77386 - RNA, 894 nt, Artificial Sequence
  derived and/or modified sequence opt5 from TST__Homo_sapiens__NP_003303
auggugcaccagguccuguacagagcccucguuagcaccaaguggcuggcugaguccauccggacaggcaaacuugggcccggacugcgcgugcucgacgccucuugguauagcccuggcacgagagaagcgcggaaggaguaccuggaacgccaugugccgggggcuuccuucuuugauauugaggaaugcagagacaccgccucucccuaugagaugaugcuuccuagcgaggccggauucgcugaauacgucggccggcuggggaucuccaaccacacacaugugguuguguaugauggagagcaccucggcucuuuuuacgcuccccgcgucugguggauguucagaguguuuggccaucggaccguuagcgugcugaaugggggauuccgcaacuggcugaaagaaggccacccugucacauccgagcccagcagaccugagccggccguguuuaaggccacccucgaccggucucugcuuaaaacauaugaacaagugcuggagaaucucgaauccaagcgcuuccagcuggucgauagcagaucucaggggcgguuucuuggaaccgagcccgaaccugacgcgguuggccuggauuccgggcacauucgcggagccgugaacaugcccuucauggacuuucucacggaggauggcuucgagaagggcccugaggaacugagagcucuguuucagaccaaaaagguggaccucagccaaccccugaucgccacaugucggaaaggggucaccgcuugccauguggcccuugcggccuaccuguguggaaagccggauguugcuguguacgacggcucuugguccgaaugguucagacgcgccccucccgagagccgggucucccaggggaaaucugaaaaggcuuga

SEQ ID NO: 77387 - RNA, 3966 nt, Artificial Sequence
  derived and/or modified sequence opt5 from TTBK1__Homo_sapiens__NP_115927
augcagugccuggccgcugcccucaaggacgagaccaacaugagcggcgggggagaacaagcggauauccugcccgcuaauuacguggucaaagacagauggaagguucuuaaaaagauuggcgggggaggcuucggggagaucuaugaagccauggaucugcucacacgggagaacguggcccugaaaguggaauccgcucagcagccuaagcagguccuuaagauggagguggccguucugaaaaagcuccaaggaaaagaccacgugugucgcuuuauuggcugcggcagaaaugagaaguucaacuacgucgugaugcagcugcaggggcggaaucuggcugaucuccgcagaucucagccgcggggaacguuuacccugagcacaacccuucgccugggcaaacaaauccucgaauccauugaggccauccauucuguuggguuccugcacagagacaucaagcccagcaacuuugcgaugggacggcuuccuuccacauaucgcaaguguuacaugcuggauuucggccucgccagacaguauaccaauacaaccggggacgugcggcccccucgcaacgucgcuggauuuagaggcacggugcgguacgccucugugaaugcucauaaaaaccgcgaaaugggcagacacgaugaccuguggagccuguucuauaugcucgucgaguuugccguugggcagcugcccuggcggaagauuaaagauaaggaacaggugggaaugaucaaagaaaaguacgagcauagaaugcuucugaaacacaugccuuccgaguuccaccucuuucuggaccauauugcgagccuugauuacuucaccaagccggacuaucaacugaucaugucuguguuugaaaauuccaugaaggaacgcggcauugccgagaacgaggcuuucgacugggaaaaagccgggacagaugcucuccugagcaccucuacauccacgcccccucagcagaauacccggcaaacagccgccauguucggagucgugaacguuacccccgugccuggcgaccugcucagagagaauacagaagauguccugcagggggagcaccuuagcgaccaggaaaacgcucccccgauccugccuggacgccccucugagggccucggcccuagcccccaucuggugccccacccugggggaccggaggcggaaguuugggaggaaaccgaugugaaccggaauaaacuuagaauuaacaucggcaagagccccugcgucgaggaggagcagucccgcgggaugggagugccuucuagccccguccgggccccucccgacuccccgaccacaccugugagaagccugcgcuaccggagaguuaauucucccgaguccgaacgccucagcacggcugauggccggguggagcugccugaaagacggucucgcauggaccugcccgggagcccuuccagacaagccuguucuagccagcccgcccagaugcucuccgucgauaccggccacgcugaccggcaggccagcggaagaauggaugugucugcguccguugagcaagaggcucugagcaacgccuuucgcucugugccgcuugccgaagaggaagacuucgacuccaaggagugggucaucauugauaaagaaacagagcugaaggacuuuccucccggcgcugagcccagcaccuccgggacaaccgaugaggaaccugaggaacuccggccgcugcccgaagagggagaggaaagacgcagacugggcgccgagccuacggugcggccccgcgggagaucuaugcaggcucuugccgaagaggaccuccagcaucugccuccccagccucugcccccgcaacucagccagggagauggccgguccgaaacaucucagccucccaccccugggagccccucccacagcccgcugcauucuggcccucgccccagacggcgcgaguccgacccuaccggaccccagagacaaguguucagcguugcgcccccuuuugaggucaauggccuuccgcgggccgugccccugucucucccuuaucaggauuucaagcgcgaccuguccgauuacagagaacgggcuagacugcuuaaccgcgugcggagagucggguuuagccacaugcuccugacaacaccccaggugccucuggcccccguucaaccucaggcuaauggaaaagaggaagaggaggaagaggaagaggacgaagaggaggaagaggaagaugaggaagaggaggaagaggaagaggaagaggaggaagaggaagaggaggaagaggaagaggaagaggaggccgcggccgcuguggcccucggcgaaguccuggggccgcgcucuggaagcuccagcgagggcucugaacgguccaccgacagaagccaggagggggcucccuccacgcuucuggccgaugaccagaaggaaucucgcggccgggccagcauggcugacggagaucucgagccugaggaaggcuccaaaacccuggugcugguuucucccggggacaugaagaaaagcccugugacagcggagcuugcccccgauccggaccucggaacccuggcugcccugacaccucaacaugaaagaccccagcccaccggcucccagcucgaugucucugagccugggacgcugagcuccgugcuuaagagcgaacccaagccuccgggacccggcgccgggcugggcgcuggaaccguuacaaccggcgucgggggagucgccgugacaucuuccccuuucaccaaaguggagcgcacguuuguccacaucgcggagaagacacaccucaacguuaugagcucuggcgggcaggcucugcgguccgaagaguucagcgccggaggcgaacugggccuugagcucgccucugacgggggagcuguggaggaaggcgccagagcgccccuggagaaugggcuggcucucuccggacugaacggcgccgaaauugaggggagcgcccuuuccggagcuccucgggaaacccccagcgagauggccacaaauucucugccgaacggcccugcucucgccgauggccccgcgccugugagcccccuggagccuucccccgaaaaagucgccaccaucucuccgcgcagacaugcuaugccugggagccggccccgcucccgcauucccgugcugcuuucugaggaagacaccggaagcgagccuuccggcucucugagcgccaaggaacggugguccaaaagagcucgcccgcaacaggaucucgcccggcugguuauggagaagagacaggggcgccuccugcuucggcuggccagcggagcuucuuccuccucuuccgaggaacagagacgcgcgagcgagacacucuccggcacggggucugaagaggacacccccgccagcgaaccugcugccgcccugccccggaaguccggcagagcugccgcgacacgcagcagaaucccucggcccaucggacugcgcaugccuaugccgguggcugcccaacagcccgccucuagaucccacggcgcugccccugcgcuugauaccgcuauuacaagccggcugcagcuccaaacgcccccugggucugccaccgccgcugaccugcgccccaaacagccgccuggaagaggccucgggcccggacgggcccaggcuggcgccagacccccugcgccccgcagcccucggcugccggccuccacaucugcugccagaaaugcuagcgccucccccagaucucagagccuuucccggagagagagcccuucucccucccaucaagcccggccuggggugcccccgccucgcggagugcccccugcuagagcgcagcccgauggcaccccuagccccggcggguccaagaaaggaccgcggggcaagcugcaggcccagcgcgcuaccacaaaagggagagccggaggcgccgaggggcgggcuggagcccgcuga

SEQ ID NO: 77388 - RNA, 3735 nt, Artificial Sequence
  derived and/or modified sequence opt5 from TTBK2__Homo_sapiens__NP_775771
augagcggcgggggagagcagcuggacauccucuccgugggcauucuggucaaggaaagauggaaaguucuucggaagaucgggggaggcggguucggagagauuuacgaugcccuggacaugcucacccgcgaaaacguggcucugaaaguggagucugcccaacagcccaagcagguccuuaaaauggaaguggcgguucugaagaagcuccagggcaaagaucacgugugcagauuuaucggcugugggcggaaugaccgcuucaacuaugucgugaugcaacugcagggaagaaaucuggcugaucuccggcgcagccaguccagaggcacauuuacgauuucuaccacacugcggcuugggcgccagauccuggagagcaucgaguccauucauucuguuggauuccuccacagagacaucaagccuagcaacuuugccaugggccgguucccgucuaccugccgcaaauguuacaugcuggauuuugggcuugccagacaauucacaaauagcugcggagacgugcggcccccucgcgcugucgccggcuuuagaggcaccgugcgguaugcuucuauuaacgcccauagaaaucgcgaaauggggcggcacgaugaccuguggucccucuucuacaugcugguggaguuugucguuggacagcugcccuggagaaagaucaaagauaaggaacaggugggcagcauuaaggagcgcuaugaccaucggcucaugcugaaacaccuuccucccgaguucucuaucuuucuggaucacauuuccagccucgacuacuucacaaagccugacuaucagcugcuuaccucuguguucgauaacuccaucaaaacguuuggggucaucgaaagcgacccguucgauugggagaagaccggaaaugacggcucccugacaaccacaaccacgucuacaacaccccaacuccauaccagacugaccccugcggccauugggaucgcuaacgccacccccauuccuggagaucugcuccgcgaaaauacagacgagguguuucccgaugaacagcugagcgacggcgagaacggcaucccgguugggguguccccugauaaacuucccggaagccugggccacccucggccccaggagaaggacgucugggaagagauggaugcuaauaaaaacaagauuaagcucgggaucuguaaagccgcgacggaagaggaaaauucucauggacaagccaacggccugcuuaacgcucccucccuggggagcccuaucagagugcgcucugagauuacccagccggaccgggacaucccccucguuagaaagcugcgcagcauucacuccuucgagcuggaaaaacggcucacacuggagccuaagcccgauaccgacaaauuucuugaaacaugccuggagaagaugcagaaggauaccucugccggcaaagaaagcauccucccugcucugcugcacaagcccugugugccggccgucuccagaacggaccauauuuggcacuacgaugaggaguaccuuccugacgccagcaaacccgcuucugcgaauacaccugaacaggccgauggaggcggguccaacggauucaucgcugugaaucucagcucuugcaagcaagagaucgacuccaaagaaugggucauuguggauaaggagcaggaccugcaggauuuucggaccaacgaggccguuggccauaagaccacagggagccccuccgacgaggaaccugaagugcugcagguccucgaggccucuccccaagaugaaaaacugcagcuuggaccgugggcugagaaugaccaccugaagaaagagaccagcggcgugguucucgcccuguccgcggaagggccucccacagcugccucugagcaguauacggaccgccuggaacuucagcccggcgccgcuagccaauucaucgccgcuaccccuacaucccucauggaggcccaggcggaaggaccgcugaccgccauuacaauccccagaccuagcguggcuucuacccaguccacgagcggcucuuuucauugugggcagcaacccgagaagaaagaucugcagccuauggagcccaccgucgaacucuacuccccucgggagaacuucagcggacugguggugacagaaggcgagcccccgucugggggaagcagaaccgaccuuggccugcagauugaucacaucgggcacgacaugcucccuaauauucgcgaauccaacaagagccaagaucugggccccaaggagcugccugaccauaaucggcuuguugucagagaguuugaaaaccuccccggagagacagaagagaaaucuauccugcuggaguccgauaaugaagacgagaagcucagccgcggccagcacugcaucgaaauuuccucucugccgggggaucuugugaucguggagaaagaccauagcgccaccacggaaccucuggaugucacaaagacccagacauucuccgugguucccaaccaggacaaaaauaacgagauuaugaagcuccugaccgugggaaccucugagaucagcuccagagauauugacccucacgucgaaggccaaaucggacagguggcugagaugcagaaaaauaagaucucuaaggacgaugacauuaugagcgaagaucugcccgggcaccagggcgaccuuuccacauuucuccaucaagaggggaaacgggaaaagaucacgccccgcaacggcgagcuguuccacuguguuagcgagaacgaacauggagccccuaccagaaaagauauggugcggucuuccuucgucacacgccacagccggauuccggugcuggcgcaggagaucgacucuacccucgaauccagcucucccguuuccgccaaggagaaacugcuucagaagaaggcuuaucagccugaucuggugaaacuccuggucgaaaagagacaauuuaagagcuuccugggcgaccuuuccagcgccucugauaaacugcucgaggagaaacuggcuacagugcccgccccuuuuugcgaagaggaagugcucacccccuucagccgccugacggucgacucccaucuuucuagaagcgccgaggauuccuuucugucuccuauuaucagccagucccggaagucuaagaucccgcgccccguuagcugggugaauacagaccaggugaacuccagcaccucuucccaauucuuuccuagacccccucccgggaaaccgccuacccggcccggagucgaggcuagacuccgccgguacaaggugcugggcagcucuaauuccgacagcgaucuguucuccagacuugcgcagauucugcagaacgggucucagaaaccccgcagcacaacccaaugcaaguccccuggaagcccccacaauccuaaaacaccgcccaagucuccuguugugccccggagauccccuagcgccucuccccgcagcuccucucucccgcggacgagcuccucuagcccuuccagagcuggccgcccccaccaugaccagcggagcuccuccccucaccugggcagaagcaagucucccccuucccauagcggguccucuagcucccggcgcagcugucagcaggaacacugcaaacccucuaagaacggacucaaaggcuccgggagccugcaucaccacucugccuccaccaagacaccgcaaggaaaaagcaagccugccucuaaacuuagcagauga

SEQ ID NO: 77389 - RNA, 2118 nt, Artificial Sequence
  derived and/or modified sequence opt5 from TTC12__Homo_sapiens__NP_060338
auggacgccgauaaggagaaagaccugcagaaguuccugaaaaacguggaugaaaucagcaaucugauucaagagaugaacuccgacgaucccgugguucagcagaaggcugugcuugaaaccgagaaaagacugcuccugauggaagaggaccaggaggaagaugagugccggacaacgcuuaauaagaccaugaucucuccuccgcaaacagccaugaagucugcggaagagauuaacuccgaggcuuuucuggccucuguggaaaaagacgccaaggagcgcgcuaaaagacggcgcgaaaauaagguccucgccgaugcucugaaagagaagggcaacgaagccuucgcggaggggaauuacgagaccgccauccugagauauagcgaaggacucgagaagcugaaagacaugaaggugcuuuacacaaaccgggcucaggccuauaugaaacuggaagauuacgagaaggcucucguugacugugaaugggcccugaaaugcgaugagaaguguaccaaagcguauuuucacaugggcaaggccaaucuugcucugaagaacuacuccgugucucgcgagugcuauaaaaagauucucgaaaucaaucccaaacugcagacacaggucaagggguaccugaaccaaguggaccuccaggagaaagccgaccugcaggaaaaggaggcucaugaacuucuggauagcggaaagaauaccgccguuacgaccaaaaaccuccuggagacacuuuccaagccugaccagaucccccuguucuacgccggcgggauugagauccucaccgaaaugauuaaugaguguacagaacaaacccuguuuagaaugcacaacggauucagcaucauuucugauaacgaggugauccggcgcugcuuuuccacggcuggcaaugacgcggucgaggaaauggugugugugagcguccugaaacucuggcaggccguuugcucuagaaacgaggaaaaucagcgggugcuggugauucaucacgaucgcgcuagacuucuggccgcccuccuguccagcaagguccuugcuauccggcaacagucuuucgcccugcuccugcaucuggcgcagacagaguccggccgcagccucaucauuaaccaccuggaccuuaccagacugcucgaagcucugguguccuuucuggauuucucugacaaagaggccaauacagccauggggcuuuuuaccgaucucgcucuggaggaacgguuccagguuugguuucaagccaaccugccuggagugcuccccgcucugaccggcguccuuaagacagacccuaaggugagcuccagcucugcccugugucagugcaucgcgauuauggggaaucucuccgccgagccgacgaccagacgccacauggcugccugugaagaguucggagauggcugccugagccugcuugcucggugcgaagaggacguugaccucuucagagaggugaucuauacacugcuggggcucaugaugaaccugugucuucaggcccccuuugucucugaagugugggcggucgaggugagccgccggugccugucccuccugaauagccaggauggaggcauucugaccagagccgcuggcguucuuagccgcacacucuccagcucucugaaaaucguggaagaggcccugcgggcuggggucgugaagaaaaugaugaaguuccucaaaaccggaggcgaaacggccuccagauacgccaucaagauucuggcuaucuguacaaacagcuaucaugaggcgcgcgaggaaguuauucggcuugacaagaaacugucugugaugaugaagcuccuguccagcgaggaugaaguccugguggggaaugccgcucuuugccucggaaacuguauggaggugccuaauguugccuccucucugcugaaaaccgaccuccugcaaguccuucugaagcucgccggcagcgauacccagaaaacagcuguccaggugaacgccgggaucgcgcugggaaagcugugcaccgcugagcccagauuugccgcccagcuucgcaaacugcacggccucgaaauucucaauuccacaaugaaguacaucucugacagcuga

SEQ ID NO: 77390 - RNA, 3426 nt, Artificial Sequence
  derived and/or modified sequence opt5 from TTC17__Homo_sapiens__NP_060729
auggccgcugccgugggcgucagagggcgguacgagcugcccccuugcagcggaccgggcuggcuccugucccuuucugcgcugcucagcguugcugcccgcggggccuucgcuaccacacacuggguggugacggaagacggaaagauccagcaacaggucgauucccccaugaaccugaaacauccucacgaccuugugauucugaugagacaggaggccaccguuaauuaucucaaggaacuggagaaacagcugguggcucaaaagauccauauugaagagaacgaggaucgggacacaggccucgaacagcgccacaauaaagaggaucccgacuguaucaaggccaaggucccucugggggaucuugaccuguacgauggaaccuauauuacacucgaaucuaaagacaucagccccgaggauuacaucgacaccgaguccccugugccgcccgauccugaacagcccgacugcacaaagauucuggagcuuccuuauucuauccaugcguuucagcaccugagaggcguucaagaacgggugaaccucagcgcuccccugcugccgaaagaggacccuauuuucaccuaccucuccaagcgccugggcagaagcaucgaugacauugggcaccuuauccaugaaggacugcagaaaaauacgucuuccuggguccucuauaacauggcuagcuuuuacuggcggauuaagaaugagcccuaccaggugguggagugugccaugcgcgcucugcacuucucuuccagacauaacaaggauaucgcccuugucaaucuggcgaacguucuccaccgggcccacuuuagcgcugacgccgcuguggugguccaugccgcccuggaugacucugauuucuuuaccuccuauuacacacugggcaauaucuaugcuaugcucggggaauacaaccacagcgugcugugcuaugaccaugcgcuucaggcccgcccuggauucgagcaagcuauuaaaagaaagcacgccguucugugucagcagaaacucgaacaaaagcuggaggcccagcaucggucccuucagcgcacccugaaugaacucaaagaguaccagaagcaacacgaucacuaucugagacagcaggagauccuggaaaaacauaagcucauucaggaggaacaaauccugcggaacauuauccacgagacacagauggcuaaggaagcccagcuuggcaaucaucagaucugcagacuggugaaccaacagcacucucuccacugucagugggaccagcccguccgcuaccauagaggggauauuuuugagaacguggacuacguucaauucggagaggacagcuccaccagcucuaugauguccgugaauuuugauguccagagcaaccagucugacaucaaugauagcgugaaauccucucccgucgcgcacagcauucuguggaucuggggccgggacuccgaugcuuaucgcgacaagcaacauauucuguggccuaaacgggccgauugcacggaaagcuacccgagagugcccguuggcggggagcuuccuacauauuuccugcccccugaaaacaagggacuccgcauccacgagcugucuuccgacgauuacagcaccgaggaagaggcccagacacccgacuguucuaucaccgauuuucggaaaucccauacccucagcuaucuggugaaggaacuugaggucagaauggaccugaaggcuaaaaugccggaugaccacgcccgcaagauucuccugucccggaucaauaacuacacaauuccugaagaggagaucggcucuuuccuguuccacgcuauuaauaaacccaacgccccuaucuggcuuauucucaaugaagcggggcuguauuggagagccgugggaaacagcacguuugcuaucgccugccugcagcgcgcucucaaucuggcgccccuucaguaccaagacguuccucuggugaaccucgccaaucugcugauccauuacggccuucaccucgaugccaccaagcugcugcuccaggcucuggccauuaacuccucugagccccuuacauuccugagccucgggaaugcuuaucuggcccugaaaaacaucuccggagcccuugaagccuuucggcaggcgcucaagcugaccacaaaguguccggagugcgaaaacagccugaaacucauuagaugcaugcaguucuacccuuuucuguauaauaucaccucuuccgucuguagcggcacggugguggaggagucuaacggcuccgacgaaauggagaauagcgaugaaacaaagaugucugaggaaauucuugcccugguugacgaguuccaacaggcuuggccccucgagggguuuggaggcgcccuggaaaugaaagggcggcgccuggaucuucagggaaucagaguccugaagaaaggcccccaggacgggguggcccggagcuccugcuacggcgauuguagaagcgaggacgaugaagcuaccgaguggaucaccuuccaagugaagcgcgucaagaaaccuaagggagaccauaaaaagacaccgggcaaaaagguggagaccgggcagauugaaaacggacaccgguaucaggccaaucucgagaucacaggccccaaaguugcgucuccugggccccaaggaaagaagagagauuaccagcgccugggcuggccuucccccgacgaaugccucaaacugagauggguggagcuuacggcuauugucagcaccuggcuggccguguccucuaagaacaucgauauuacagaacauaucgacuuugccaccccuauccagcagcccgcuauggagccgcucuguaaugggaaccugccuacaagcaugcacacccuggaccaccuucauggcguuuccaaucgggccucucugcacuauacgggagagagccaacucaccgaagugcugcagaaccucggcaaagaucaguacccccagcaaucccuggagcagauugggacacgcaucgcgaagguccuugagaaaaaucagaccucuugggugcugagcuccauggcugcccucuacuggagaguuaagggacagggcaagaaagccauugacugccugcggcaagcucugcauuaugccccucaccagaugaaggaugugccccuuaucagccuggcuaacauucuccacaaugccaaacuguggaacgacgcggucaucguggccacaauggcuguggaaaucgccccgcauuucgcugucaaucacuuuacccucgggaacguuuacguggccauggaagaguucgagaaggcccuggugugguaugaaucuacgcuuaaacugcagccugaguuuguccccgcuaagaaccgcauucagacaauccaaugucaucugaugcucaagaaaggaagacgguccccuuga

SEQ ID NO: 77391 - RNA, 1143 nt, Artificial Sequence
  derived and/or modified sequence opt5 from TTC19__Homo_sapiens__NP_060245
auguucagacugcucagcuggucccugggccggggguuucuucgcgccgcuggaagacggugccgcggcuguucugccagacugcuccccgggcuggcgggaggcccugggccggaggugcagguucccccuagccgggucgcuccccacggacgcggcccuggccuucugccccuccuggccgcccuggcuugguucuccagaccugccgcugccgaagaggaagaacaacagggggcggacggagccgcugccgaagauggcgcugacgaggccgaggcggaaaucauucagcuccugaagcgggccaaacuuucuaucaugaaggaugagccggaagaggcugagcugauucuccaugacgcccugcgccuugcuuaccagaccgauaacaaaaaggccaucacauauacguacgaccugauggccaaucucgcuuuuauuagagggcaacuggaaaacgcggagcagcuguucaaagccaccaugagcuaucuccugggaggcgggaugaagcaggaagauaaugcuaucaucgagauuucccuuaagcuggccucuaucuacgccgcucagaaccggcaagaauuugccguggcgggauaugaguucugcauuagcacacucgaggagaaaaucgagcgcgaaaaggagcuggcugaagacauuauguccguggaggagaaagccaauacccaccuucugcucggcaugugucuggaugccugcgcuagauaccugcucuuuagcaagcagcccucucaggcccagcggauguaugaaaaagcucugcaaaucuccgaggaaauucagggcgagcgccauccucagacaaucguccuuaugagcgaccuggccaccacacucgaugcgcaagggagauucgacgaagccuacaucuacaugcagcgggcuucugaucuggccagacagauuaaccaccccgagcuucauauggugcuguccaaucucgcugccguucugaugcaccgcgagcgguauacccaggcgaaggaaaucuaccaagaggcccugaagcaggcuaaacucaagaaagacgaaauuagcgugcagcacaucagagaggagcuggccgaacuuucuaagaaaucccgcccucugacgaacagcgucaagcucuga

SEQ ID NO: 77392 - RNA, 879 nt, Artificial Sequence
  derived and/or modified sequence opt5 from TTC1__Homo_sapiens__NP_001269429
augggcgaaaagagcgagaacugcggggugcccgaggaccugcucaauggacugaaagucaccgauacacaggaagccgagugugcuggcccuccgguucccgacccuaagaaccaacacucccagucuaaacuucugagagaugacgaagcccaucuccaggaggaucagggggaggaagagugcuuccacgacuguagcgcguccuuugaagaggagcccggagcugauaagguggaaaauaaaucuaacgaggacgugaauagcuccgaacuggaugaggaauaccuuaucgagcuggagaagaacaugucugacgaagagaagcaaaaacggcgcgaagagagcacgagacucaaggaagagggcaaugagcaguucaaaaagggggauuauauugaagccgaguccagcuacucucgggcccuggaaaugugcccuuccuguuuucagaaagagcgcagcauccuguucucuaacagagcugccgcucggaugaagcaggacaagaaagaaauggccauuaaugauugcuccaaggcgauccaacucaaccccagcuauauucgcgccauccugagacgggcugagcuuuacgagaaaaccgacaagcuggacgaagcccucgaggauuauaaaucuauccuggaaaaggacccuuccauucaucaggcucgcgaggccuguaugagacuuccgaaacagaucgaggaacggaaugagcgccugaaggaagagaugcucggaaagcugaaagaucugggcaaccucguccugagacccuuuggccuuagcacagaaaauuuccagauuaagcaagacuccucuaccgggagcuacuccaucaacuuugugcagaauccuaacaacaaucgguga

SEQ ID NO: 77393 - RNA, 3951 nt, Artificial Sequence
  derived and/or modified sequence opt5 from TTC21B__Homo_sapiens__NP_079029
auggacagccaggagcugaagacccucaucaacuacuauugccaagaaagauacuuccaccaugugcugcuugucgccuccgagggcauuaaacgguaugggucugaucccguuuuucgcuucuaccacgcuuauggaacacugauggaaggcaagacgcaggaggcccucagagaauuugaggcgaucaaaaauaagcaggacgugagccuguguucccuucuggcucucauuuacgcccauaaaaugucuccuaacccggaucgggaggccauccuggaaagcgacgcucgcgugaaggagcagagaaagggggccggagaaaaagcucuguaucacgccggccucuuccuguggcauauugggcggcacgauaaggcgcgcgaguacaucgacagaaugaucaaaauuuccgauggaucuaagcaaggccacguccuuaaagccuggcuggacaucacccggggcaaggagcccuacacaaagaaagcucucaaguauuuugaagaggggcugcaggauggaaaugacaccuucgcccuucugggcaaagcucagugccucgaaaugcgccagaacuacagcggggcccuggagacagugaaucaaauuaucguuaacuuuccuuccuuccugcccgcguuugugaagaaaaugaagcuccagcuggcccuucaggauugggaccagaccgucgaaacagcucaaagacugcuccugcaggauagccagaauguggaggcccuucggaugcaagcucuguauuacguuugucgcgagggagacauugaaaaagccucuaccaagcucgagaaccugggcaauacgcuggacgccauggaaccucagaacgcucagcuguucuauaauaucacccuggcguuuuccagaacaugcgggcggagccagcuuauucugcaaaagauccagacccuccuggagcgcgccuucucucuuaacccccagcaguccgaauuugcuacagagcugggauaccaaaugauccuccagggcagagugaaagaggcccugaagugguauaaaaccgccaugacgcuggaugaaacaagcgucucugcucucgugggcuucauucagugucagcugaucgaggggcaacuucaggacgccgaucagcagcuggaguuccucaaugaaauucaacaguccaucggaaagagcgcggaacugauuuaccugcaugcugugcuugccaugaaaaagaacaagcggcaggaggaggucaucaaucuccugaacgacguucuggauacccacuuuucccaacucgaaggccugccucuugggauccaguacuucgagaaacugaacccggacuuucuccuggaaauugugauggaguaucugucuuucugccccaugcagccugccagccccggacagccucuuuguccccuccugagacgcugcaucuccgugcuggagacagucgugcggaccguuccgggccuccugcaaaccguguuucuuauugcuaaggucaaauaccugagcggggauaucgaagccgcuuucaauaaccuccagcauugucuggagcacaauccuucuuaugccgacgcgcaccuccuucucgcccagguguaccugucccaggaaaagguuaaacugugcagccaaucucucgagcugugucuuagcuaugauuuuaaggugagagacuacccccuguaucaucucauuaaggcucagucccagaaaaagaugggagaaaucgccgaugcuaucaaaacacugcacauggccaugucucugccuggcaugaagcgcauuggcgcgagcacgaaauccaaggaccggaagaccgaggucgacacaagccauagacuuucuaucuuccucgagcugauugaugugcaccgccugaacggggaacagcaugaggccaccaaaguccuccaagacgcuauccacgaauuuuccggaacaagcgaggaagugcggguuaccauugccaaugcugaucuggcccuugcccagggcgacaucgagagagcucugucuauucuccagaacgugacggcggagcaacccuacuucaucgaagcccgcgagaagauggcugauaucuaccugaaacaccggaaggacaaaaugcuguauauuacaugcuuuagagaaaucgccgagcgcauggccaauccccgguccuuccuucugcucggggaugcuuacaugaacauucuggaaccugaggaggccaucgucgcguaugaacaggcucucaaucagaacccgaaggacggaacccuggccagcaaaaugggcaaggcccuuauuaagacccauaauuacuccauggcuaucacauauuacgaggccgcgcugaaaaccgggcagaagaacuaucucugcuacgaucuggcugaacugcuucugaaacucaagugguacgacaaagccgagaaggugcugcaacacgcccucgcucaugagcccguuaaugaacugucugcccuuauggaggauggcagaugucaggugcugcucgcuaaggucuauagcaaaauggaaaagcugggagacgccaucacagcgcugcagcaggcccgggagcuucaagcucgcgugcugaaaagagugcagauggaacagccugaugccguucccgcucagaagcaccucgccgccgagauuugcgcugagaucgcgaaacacuccgucgcccaacgggacuacgaaaaggcuauuaaguuuuauagagaggcccuggugcauugugaaacggacaacaaaaucaugcucgagcuggcccgccuuuaccuggcucaggaugacccugauucuugccugcggcagugugcccuccugcuucagagcgaccaagauaaugaagcggcuaccaugaugauggccgaccugauguucagaaagcaggauuaugagcaggccguguuccaccuccaacagcugcucgagcgcaaacccgacaacuacaugacacuguccagacuuauugaucugcugcggcgcugcggcaagcucgaagacgucccgagauuuuucagcauggcugagaaacggaacucucgcgccaagcuggaaccuggguuucaguauuguaagggacuuuaccugugguacaccggcgagcccaaugaugcgcucagacauuucaacaaagcucggaaggaccgcgauugggggcagaaugcccuguauaacaugaucgaaaucugccucaauccugacaacgagacagugggaggcgagguuuuugaaaaucuggacggggaucuuggcaacuccaccgagaaacaagaaagcgugcagcuggccgucagaacggcugagaagcugcucaaagagcugaagccccagaccgugcagggacacguucaacuucggauuauggaaaauuacugucugauggccacaaaacagaagucuaacguggagcaggcucucaauaccuucacagaaaucgccgcguccgagaaggaacauauuccugcccugcucggcauggcuaccgccuauaugauccugaaacagacgccccgcgcuagaaaccaacuuaagcggauugccaaaaugaauuggaacgccaucgacgcugaggaguuugaaaagagcuggcugcugcucgcggauaucuacauucagucugccaaauaugacauggcugaggaucugcuuaagagaugccugcgccacaaucggagcuguugcaaggccuacgaauauaugggguacaucauggagaaagaacaggccuacacagacgcugcccucaacuaugagauggcguggaaguacuccaacagaaccaauccggcugucggauauaaacuggccuucaacuaccugaaggccaaacgcuauguggauagcauugacaucugccaccaaguucucgaggcucauccuacauaccccaagauucggaaggauauccuugacaaagccagagcgucucugcgccccuga

SEQ ID NO: 77394 - RNA, 7446 nt, Artificial Sequence
  derived and/or modified sequence opt5 from TTC28__Homo_sapiens__NP_001138890
auggagcagagcccuccuccggcccccgaaccuacccaaggccccacacccgcucggucccggcgccgccgggagcccgagucuccuccggcuagcgcgcccaucccucuguucggggcugacacgauuggacagcgcucccccgauggcccugugcucucuaaggcugaguuugucgaaaagguucgccagagcaaccaggccugccacgacggggauuuccauaccgcuaucgugcuguacaaugaggcccuugcuguggacccccaaaacuguauucuguauuccaaucggucugccgcguacaugaagauccagcaguaugauaaagcccuggacgaugcuauuaaggcccgccugcuuaacccgaaauggccuaaggcuuacuuuagacagggagucgcccugcaauaucucggacggcacgcggacgcccuggcugccuucgcuagcgggcuggcccaggaucccaagucccuccagcugcuugugggaaugguugaggccgcuaugaaaagcccuaugcgcgacucucuggaacccaccuaccagcaacuccagaagaugaaacuggauaagucccccuuuguggucgugagcguugugggccaggagcuucugaccgcgggccaucacggggccucugucguggugcucgaagcugcccugaaaaucggaacaugcucccugaagcucagaggcagcgucuucucugcccuguccagcgcuuauuggucccuugggaauaccgagaagucuacaggauacaugcaacaggaccuggauguugccaaaacccucggcgaccagacgggggagugucgggcgcauggaaaccugggcagcgccuuuuucuccaagggcaauuaccgcgaagcccuuaccaaccacagacaccagcuggugcucgccaugaaacugaaggaccgggaggcugccagcucugcucuguccagccucgggcauguguauacagccaucggagauuacccuaaugcgcuggccucucacaaacaaugcguccuucuggcuaagcagagcaaagacgaacucuccgaggcccgcgaacugggcaacaugggggcuguguauauugccaugggagauuuugagaaugcgguucagugucaugagcagcaccuuaagaucgccaaggaccugggcaacaaaagagaagaggcucgggccuacucuaaucucgggagcgcuuaucacuacagacgcaacuucgauaaggccauguccuaucauaauuacgugcuggaacuggcccaagagcucauggaaaaagcuauugagaugcgggcguacgccggacugggccacgcugccagaugcaugcaggaccuugagcgcgccaagcaguaucaugaacagcaacugggcaucgcugaggaucucaaagaccgggccgcggaagggagagcuagcucuaaccugggaauuauccaccagaugaagggcgauuacgacaccgcccugaaacuucauaaaacacaccucuguauugcccaggagcuguccgauuaugcugcccaggggcgcgcguacggaaacaugggcaaugcuuauaacgcccuggggauguacgaccaagccgucaaguaucaccggcaggaacuccagaucagcauggaggugaaugacagagcuucucaagccuccacccauggcaaccuggcuguugccuaccaggcgcuuggagcccacgaucgcgcucugcagcauuaccagaaucaccucaacaucgcccgggagcugagagacauucaaagcgaagcucgcgcccuguccaaucuuggcaacuuucacugcucuagaggggaguaugugcaggccgcuccguacuaugaacaguaccucagacuggcgcccgaucugcaggacauggagggagagggcaaagucugucauaaucucggguaugcccacuacugccugggaaacuaucaagaagcugugaaguacuacgagcaggaucuugcccuggccaaagaccuccaugauaagcugagccaggcuaaggccuauuguaaucugggccuugcguucaaagcucuccugaacuuuuccaaggccgaagagugccagaaauaccugcucucucuggcccaaagccuuaauaacucccaggcuaaguuccgggcccuggggaaucucggcgacaucuucauuugcaaaaaggauaucaacggagcgauuaaguuuuaugaacagcaacugggccuggcucaccaggucaaagaccgcagacuugaggccagcgccuacgcugcccucgggacggcuuaucggaugauccagaaguacgauaaagcccugggauaucauacacaggagcuggaaguguaccaagagcucucugaccugccuggcgaauguagagcgcacgggcaccuugccgcuguuuacauggcccugggaaaguauaccauggcuuucaaaugcuacgaggaacagcucgaucugggccagaagcugaaagaccccucccuugaggcccagguguaugggaacaugggcaucacaaagaugaauaugaacgucauggaggaagccauuggauacuuugagcaacagcuggcuaugcuccagcagcugagcggcaaugaaucugugcucgaccgcgggcgggcguauggaaaccugggcgauuguuacgaggcccuuggggacuaugaagaggcuaucaaguacuacgagcaauaucuguccguugcccagagccucaauagaaugcaggaucaggccaaggcuuaccgcggacugggcaacgggcauagagccaugggcucucugcaacaggcgcuugugugcuucgaaaagcggcuggucguggcucacgagcucggagaagccuuuaauaaagcccaggcuuauggcgagcuggggagccuccauucccaacugggaaacuacgagcaggccauuagcugucuugaacgccagcugaauaucgcgagagacaugaaggaucgggcccucgagucugacgcugccugcggccucgggggaguguaucagcaaaugggcgaauacgauaccgcucugcaguaucaccagcuugaccugcagauugccgaggaaaccaacaauccuacaugucaaggccgcgcuuacgggaaccucggacugacguacgagucccucggcaccuucgagagagccguugucuaucaggaacagcaucugagcaucgcggcccagaugaaugaucuugcugccaaaacaguguccuacucuagccuggggcggacccaccacgcucugcaaaacuauucccaggccgugauguaccuccaggagggacugcgccuugccgaacaacugggcagacgggaggacgaagcuaagauccgccaugggcucggacugucucucugggcgagcggcaaucuggaggaggcccagcaccagcuuuauagagcuuccgcccuguuugaaacaauucggcaugaggcccagcugucuaccgauuacaagcucagccuguucgaccuucaaacguccagcuaucaggcucugcagagaguccucgugucucugggccaccacgaugaagcccucgcgguugccgagcgcgggcggacaagagcuuuugccgaccugcuuguggaacgccagaccggacaacaggacuccgaucccuacagcccggucaccaucgaccagauucuggagauggugaacggccagcgggggcugguucucuacuauucucuggcugccggauaccuuuauuccuggcugcucgcgccuggcgccgggaucgugaaauuccaugagcacuaccugggagaaaacacagucgagaauagcucugauuuucaggcuuccagcuccgugacccuccccacagccacgggcagcgcucuggaacagcauauugccucuguuagagaggcucuuggcguggagagccacuauucccgcgccugcgcgucuagcgaaaccgaguccgaagccggggacaucauggaucagcaguucgaggaaaugaacaauaagcugaacucugucacagacccuaccggauuucugcggauggugagacgcaauaaccucuucaaucggagcugucaauccaugacaucucuguucagcaacaccgugucccccacgcaggauggcaccagcucucuuccuagacggcaguccagcuuugcuaaacccccgcugcgcgcccucuacgaccugcugauugcuccuauggaagggggacucaugcauucuuccggccccgucgggagacaccggcaacuuauccugguucuggagggagaacucuaucugauccccuucgcccuucugaagggcagcuccucuaaugaguaccucuacgaacgcuuuggccugcuggccgugccuagcauuagaucccucagcgugcagucuaaaucccaccuucggaagaacccgcccacauauagcucuagcaccuccauggcggcugucaucgggaauccuaagcugcccucugccgugauggauagauggcuguggggaccuaugcccagcgcugaggaagaggccuacaugguuuccgagcuccugggcugccagccucuuguggggucugucgccacaaaagaacgcgugaugagcgcucugacccaggccgaguguguucauuucgcgacgcacauuuccuggaagcucagcgcccuggugcugacacccucuauggacggaaacccggcuuccagcaaauccucuuuuggccauccuuauaccauccccgaaagccuccggguccaagaugacgccuccgacggggagucuauuagcgauugcccuccccuucaggaacugcugcucacagcugccgacgugcuggaucuucagcugccgguuaagcucgugguccugggauccagccaggagucuaauuccaaagugaccgcggacggcgugaucgcccugaccagagcuuuccucgccgcuggcgcccaaugcguccuuguuagccuguggccugugcccguggcugccucuaagauguuuauccacgcguucuacuccagccugcucaacgggcugaaggccucugcugcccuuggagaggcuaugaaagucgugcagagcuccaaggccuuuucucacccuagcaauugggccggcuucaugcugauuggguccgauguuaaacucaacagccccuccucucugaucggacaggcgcugacagaaauucuccagcaucccgagcgcgcucgggacgcccuuagagugcugcugcaccucgucgaaaagagccugcaacgcauccagaacggccagcggaaugccauguauacgucccaacagucuguggagaacaaaguugggggcauuccuggcuggcaggcccuucugaccgccgugggcuuuagacucgauccgcccacaagcgggcugccugcugccgucuucuuucccaccuccgacccuggagaucgccugcagcaauguucuagcacacuccagucccuucugggccugcccaauccugcgcuccaggcccugugcaaacuuaucaccgcuagcgagacgggggaacagcugaucucuagagccgugaaaaacauggucggaaugcuccaucaagugcugguucagcugcaggcuggcgagaaggaacaggaccucgccuccgcgccgauucaagugagcaucucuguccagcuuuggcggcugcccgggugucacgaguuccuggccgcucucggauucgaucugugcgaagugggccaggaggagguuauucuuaagacaggcaaacaagccaaucgcagaaccgugcauuuugcucugcagucccuccugagccuguucgacucuaccgaacucccuaagcggcuuucccuggauagcuccagcucucuggagagccucgccuccgcucagucugucagcaacgcccugccccuuggguaccagcaaccucccuuuuccccgacaggagcggacucuaucgccagcgacgcuauuuccguguauucucugagcuccaucgccagcucuauguccuucgugagcaaaccugaaggcgggucugagggaggcgggcccggcggacgccaggaucacgacagauccaagaaugccuaccuccagcggagcacccugcccagaucccagcugccuccccaaacacgcccugcuggcaacaaagaugaagaggaguacgaaggguuuucuaucauuagcaaugagccgcucgccacguaucaggaaaaccggaauaccuguuucucccccgaccacaagcagccucagcccggaacagcgggcgggaugagaguuagcgucucuuccaagggaagcaucucuaccccuaacagccccgugaaaaugacacuuauuccguccccuaauucucccuuucaaaaggugggcaaacuggcuagcuccgauaccggggagucugaccagagcuccacggaaaccgauagcacagucaagucucaggaggaguccaacccuaaacuggacccccaggaacucgcccaaaagauccuggaggaaacccagagccaucuuauugccguggagcgccugcagcgguccggcggacaaguuucuaagagcaauaacccugaggauggcgugcaggcucccuccucuacagccgucuucagagcuagcgaaaccuccgccuuuagccggccggugcucucucaccagaaaucccagccuagccccguuacagugaagcccaaaccuccggcgagaucuuccagccugcccaaggucucuuccggguacagcucuccuaccacgagcgagauguccaucaaagacagccccucccaacauucuggaagaccuagccccggcugcgauucccagacaucucagcuggaccagccucucuucaagcugaaguauccgagcucccccuacucugcccacauuagcaaauccccucggaauaugagccccucuuccgggcaccaaagcccugcuggaucugcccccuccccggcucuuagcuauucuuccgccggcagcgcgagaucuuccccugccgaugcucccgacaucgacaagcugaaaauggccgcuaucgaugaaaaggugcaggccguucauaaccucaaaauguuuuggcagagcacaccccaacacagcaccgggccuaugaagauuuucagaggcgcccccggaacaaugaccuccaagcgggacgugcugucucuucugaaccucagcccucgccauaauaaaaaggaggaaggcgucgauaaacuggagcugaaggagcucucccugcaacagcacgacggggcuccgcccaaagcgccucccaacggacauuggagaacggaaacaaccucucuuggcagccugccucuccccgccgggccgccugcuacagcccccgcccggccucugcgccuucccuccggaaauggcuacaaguuccugucuccuggcagauuuuuccccagcuccaaauguuga

SEQ ID NO: 77395 - RNA, 1506 nt, Artificial Sequence
  derived and/or modified sequence opt5 from TTC29__Homo_sapiens__NP_001287690
augauccccauguucaccgugacacuggaggacagcggcacgcucuggaagucccugcacucuagcuccgaaucugagaugaccacacuuccuccgcugcccaugaccagaccuaaacucacagcccuggcucggcagaaacuucccugcagcucccgcaaaauuccuagaucucaacugaucaaggaaaaagaugacauugaucauuaccucgaggucaacuuuaaggggcugagcaaggaagagguugccgcguaucggaauagcuacaaaaagaacaucuguguggacaugcugcgcgauggauaucacaaauccuucaccgagcucuuugcucugauggaaagaugggacgcccuucgggaggccgcucgcgugagaucucuguucuggcuccagaagccccuggaagaacagccugauaaacuugacuaccuguaucauuaccucacacgggccgaggaugcugaacgcaaggaguccuuugaagacguccacaauaaccuguaugcccuggcgugcuacuucaauaacagcgaggauaagugggugagaaaucauuuuuacgaacgguguuucaaaauugcccagcucaucaagaucgacugcggcaaaaaggaggcugaggcccacaugcacauggggcugcuuuaugaagaggauggacaacugcucgaagcugccgagcauuacgaagcguuucaccagcugacccagggccgcauuuggaaagacgagacggggagaucucuuaaccugcucgccugugagucccugcugcggaccuaucgccuccugagcgacaagaugcuugaaaauaaagaguacaagcaggcuaucaagauucugaucaaagccucugaaauugcuaaggagggauccgauaaaaagauggaagccgaggccagcuauuaccucggccuggcucaucuugcggccgaggaauaugagacagcucugaccguucucgacacauacugcaaaaucuccaccgaucuggacgaugaccugucucucggcagaggguacgaagccauugccaaggugcugcaaagccagggagagaugacggaggcuaucaaguaucuuaaaaaguucgucaaaaucgcccggaacaauuuucagucccuggaucucgugagagcgagcacaaugcugggcgacauuuacaacgaaaagggguauuacaauaaggcuucugaguguuuccagcaagccuuugauaccacaguugaacugauguccaugccgcuuauggacgagaccaaggugcacuauggaaucgccaaggcucaccagaugaugcucaccgucaacaauuacauugaaagcgccgaucugacaucucugaacuaucuccugagcuggaaagagucccgcggcaacaucgagcccgacccugugacggaagaguuccgggggucuaccguggaagcugucagccaaaauuccgagagacuugaggagcugagccgcuuccccggagaccagaagaacgagacauga

SEQ ID NO: 77396 - RNA, 4695 nt, Artificial Sequence
  derived and/or modified sequence opt5 from TTC37__Homo_sapiens__NP_055454
augagcuccaaggaggugaaaaccgcccugaagucugcuagagacgccauccggaacaaagaauacaaggaggcgcucaaacacugcaagacaguccugaagcaggaaaagaauaacuauaaugcuuggguuuucauuggcguggccgccgcugagcuugaacaacccgaucaggcccagagcgcuuacaagaaagccgcggagcuggagccugaccagcuccuggccuggcaagggcuugcuaaccuguaugaaaaguacaaucauaucaacgccaaagaugaccucccgggaguguaucagaagcugcuggaucucuacgaguccgucgacaagcagaaauggugugaugugugcaagaaacugguugaccuuuauuaccaggaaaagaaacaccuggagguggcucgcacguggcauaagcucauuaaaaccagacaagagcagggcgccgaaaaugaggaacugcaccagcuuuggcggaagcugacacaguuucucgcggagucuaccgaagaucaaaacaaugagacacagcagcugcuguucaccgccuuugagaacgcucucgggcugagcgacaagauccccuccgaagaucaucaaguccuuuaccgccacuucauucagucucugagcaaauuuccucacgaguccgccagacucaagaaagcgugugaaggaaugaucaauaucuaucccacagugcaguacccucuggagguucuuugccugcaucucauugaaagcggcaaccugaccgacgaggggcagcaauauuguugccggcugguggagauggauucuaaguccggacccggccucaucggccuggggauuaaagcccuucaggacaagaaguacgaagacgccguccgcaaucugacggagggacucaaagaaagcccuguguguaccucuggcugguaucaccuggcugaggcucaggugaagaugcauagaccgaaagaagccguccuuuccugcagccaggcucugaagaucguugauaaccucggggccucuggaaauucccuguaccaacggaaccugugucuccaccugaaagccgaggcucuuauuaagcugagcgacuaugauuccucugaggaagccauccgcacacucgaccagauuagcgaugcggacaacauccccggccugcuggugcuuaagucccucgcuuacagaaauaaagggagcuucgaugaggccgccaagaucauggaagaccugcugucuuccuacccugaucucgcugaggugcacgcccuggaggcucuuauucauuuuaccaaaaaggacuaucugcaggccgaaaaaugcuuccagcgggcgcucgagaaggauacagaagucgccgaguaccacuaucaacugggacugaccuacugguuuaugggcgaagagacgcgcaaggacaaaacaaaggcucuuacccauuuccucaaagccgcuagacuggacacauauaugggcaagguguuuuguuaccuggggcacuauuaccgggauguugugggagacaaaaaccgcgccagaggcugcuaccggaaggcguucgagcucgaugacaccgaugccgaaagcggggcugccgcugucgaccugucuguggagcuugaagauauggagauggcccuggccauccucaccacaguuacgcagaaagcuagcgcgggaaccgccaagugggcuuggcugagacgcggccuguauuaccuuaaggccgggcagcauucccaggccguggcugaccuccaagccgcgcugcgggcugaucccaaagacuuuaauugcugggaaucucugggagaggccuaucucagcagaggcggcuacacaaccgcccugaaguccuucacaaaagcuagcgagcuuaacccugaaucuauuuauuccgucuucaagguggccgcgauccagcagauucuggggaaauacaaggaggcugucgcccaauaucagaugaucaucaagaaaaaggaagauuacgugcccgcccucaaaggacugggcgagugucaccugaugauggcuaaggccgcucuuguugacuaccucgaugggaaagccguggacuauauugaaaaggcgcuggaguacuuuaccugcgcccugcagcaccgcgcugacgucagcugucucuggaagcuggccggagaugcuugcacgugucuuuaugccguggccccgucuaaaguuaaugugcauguccugggcgugcuccuggggcagaaggagggcaaacaagugcugaagaaaaacgaacuucugcaccucggaggccggugcuacgggagagcucugaagcucauguccacaagcaauaccuggugugaccugggaaucaacuauuaccgccaggcgcagcaucuugccgagaccggcuccaauaugaacgaucugaaggaacuccuggagaaaucucugcacugccuuaagaaagcuguucggcuggacagcaauaaccaccucuauuggaaugcccugggggucguggccuguuacuccggaauuggcaacuacgcucucgcccagcauugcuucaucaagucuauucaaagcgagcagaucaaugcgguggcuuggacaaaccuggggguccuuuaucugaccaacgaaaauaucgagcaggcccacgaagccuuuaaaauggcucagucccucgauccuagcuaccugauguguuggauuggccaagcccugaucgcggaggcugugggaucuuaugacacaauggaucuuuucagacauacgaccgaacugaacaugcacacagagggcgcccucggguacgccuauuggguuugcaccacacugcaggacaaguccaaucgcgagaccgaacucuaccaguauaacauucugcaaaugaaugcuauccccgccgcucaggugauucuuaacaaauacgucgagcggauccagaauuacgccccugcguuuacgaugcugggauaucugaacgaacaucuccagcugaagaaggaggccgcuaaugccuaccaaagagcuauucuucugcuccagaccgccgaagaucaggacacauauaacguggccauccgcaauuacggccggcugcucugcagcaccggggaguaugauaaagcuauccaggcguucaagucuacaccccuggagguucuugaagacauuaucggauuugcccuggcucuguucaugaaaggccucuacaaggaguccagcaaagccuaugaaagagcccugucuauuguggagagcgaacaagauaaggcucacauccuuaccgcccuggcgauuacggaguacaagcaggggaaaacagacgucgcuaagacccuccuguuuaaauguuccauccucaaggagcccacaaccgaaagccugcaggcccuuugcgcccugggccuggcuaugcaggacgccacccucucuaaagcggcccugaacgagcuucugaagcacaucaagcauaaagauuccaauuaccaacggugucuccugacaagcgcuauuuaugcccuccagggacgcuccguggcuguucagaagcagaucucuaaagccgugcacagcaacccuggcgacccggcucuguggucccuucugucuagagucguggcccaauacgcgcagcggaaugccaaagggggaguggucgcuggcaacguugcccauauucuggauagcaaccacgggaaaaaggcucuccuguauacggccgugaaucagcuugccaugggauccucuagcgcugaagacgagaagaacaccgcgcugaaaacaauccaaaaggccgcucuccugucccccggcgauccugccauuugggccgggcugauggcugccugccaugcggacgauaaacucgcccuugugaauaacacccagcccaagagaaucgaccuguaccuggcucuccugagcgccgucucugcuuccaucaaagaugagaaguucuuugaaaauuauaaccagagccuugagaaguggucucugucccaggccgugacaggccucauugacaccggacgcaucagcgaagcggagacgcuguguaccaaaaaucugaagucuaacccugaucaacccgccguuauucuccuucugcggcaagugcagugcaaaccgcugcucgaaucccagaagccucugcccgacgcuguccuugaggagcugcagaaaacagugaugagcaauuccaccagcguuccugccuggcaguggcucgcucacguguaccagucucagggcaugaugagagccgcugaaauguguuaucgcaagagccugcaacuggccucccagagagggucuuggagcggaaaacucuccucucuucugcggcuggcgcuccuggcccuuaaggucugcauggcuaacaucagcaaugaccacuggcccucccuggugcaggaggccacaaccgaagcucucaagcuguguuucugcccucuggccguucuccuucaagcccugcugcaguuuaaacgcaagaugggcgcgagagagacacggcgccuccuggaaagaguggucuaccagcccggguacccgaaaucuauugcuagcacggcccggugguaucuucugcgccaucucuacgcuaaggaugacuaugagcugaucgaugugcuggugaacaaugccaaaacccacggagacacaagagcccucgagcuuaaccagcggcuguccagccaauga

SEQ ID NO: 77397 - RNA, 1734 nt, Artificial Sequence
  derived and/or modified sequence opt5 from TTC39A__Homo_sapiens__NP_001284592
augaccagcgccggcggggcucccggagcccugccugcgggcacaccggaguccucucuccacgaggcucuggaccagugcaugacggcccuugaucuguuccucaccaaccaauuuagcgaggcccuguccuaccuuaagcccagaacaaaagaaucuauguaucauagccugaccuacgcuacaauccucgagaugcaggccaugaugaccuucgacccucaggauauucugcuggcugggaauaugaugaaggaagcccagaugcucugucaacggcaccgcagaaaauccucugugacagacagcuuuuccagccuggucaaccggcccacccuuggacaguucacggaggaggaaauccaugcggagguuugcuaugccgaaugucugcuccagcgcgcugcccugaccuuucuucaggaugagaauauggugucuuucauuaagggcgggaucaaagugagaaacuccuaccaaacauauaaggagcuggacagccucguccagucuucccaguacugcaagggagaaaaucacccucauuuugagggcggcgugaaacuggggguuggagcuuucaaccugacccucagcaugcugcccacacggauucuucgccugcucgaauuugugggcuucucugggaauaaggauuauggacugcuucagcuggaggaaggcgccuccgggcacagcuuuagauccguccucugugugaugcugcugcucugcuaccacaccuuccugacguuuguucuuggaacaggcaacgugaauaucgaggaggcggaaaaacugcucaagccuuaccugaaccgguauccgaaaggcgccaucuuccuuuucuuugcugggcgcauugaggucaucaagggaaauauugacgccgcuaucagacgguucgaagaguguugcgaagcccaacagcauuggaagcaguuucaccauauguguuacugggagcugauguggugcuucaccuauaaaggccaauggaagaugucuuacuuuuaugccgaucuccugagcaaagagaacuguugguccaaggcuacauacauuuauaugaaagcggccuaccugagcauguucgggaaggaagaccacaaacccuuuggagaugacgagguggaacucuuccgcgcugugccuggccugaaacuuaagaucgccgggaagucucugcccaccgagaaguuugccauuagaaaaucccggcgcuacuucagcucuaauccuaucagccuccccgucccggcucuggaaaugauguauaucuggaacggauacgccguuauuggcaagcagccuaaacugaccgauggcauccuugagauuaucacaaaggcggaggaaaugcucgagaaggggcccgaaaaugaguauuccguggacgacgagugccuggugaaacugcucaagggacugugccuuaaauaccugggcagaguccaggaagcugaggaaaacuuucggucuauuagcgccaacgagaagaaaaucaaguaugaucacuaccucaucccuaaugcccugcuggaacuugcucuccugcugauggagcaggacagaaacgaggaagccauuaagcuccuggaguccgcuaaacaaaauuauaagaacuacagcauggaaucucgcacgcauuuccggauccaggccgcgacccuucaggccaaauccagccuggaaaauucuuccagaagcaugguguccucuguuagccucuga

SEQ ID NO: 77398 - RNA, 2010 nt, Artificial Sequence
  derived and/or modified sequence opt5 from TTC39B__Homo_sapiens__NP_001161812
auggacgccgugcuggcuugcagacuccggggccgcgggaacagagucgccgcgcugcggccccgcccuagaccgggaggcagcgcugggcccuccccuuucgcccuucugugugccggacucucucccgagccucgggcuggcguugggagcgaauuucccgccugguuccugggaggcuccucucagcgcagaaauauggcccuucugggcagccgggcugagcucgaagcggaugaggacguguuugaagaugcccuggagaccaucuccauuucuagccacuccgacauggcuacaagcucucugcauuucgccuccugcgauacgcaacaggcuccucgccagagaggggccagcaccgugucuuccucuagcuccacaaaggucgaccucaaaagcggacuggaggaaugugcgguggcccuuaaccuguuucucuccaauaaguucaccgaugcucuggagcuucugcggccgugggccaaagaaucuauguaccacgcucucggcuauagcacaaucguugugcugcaggccguccugaccuuugagcaacaggacauucagaacgggaucuccgccaugaaggaugcucuccagacaugccaaaaauaccgcaagaaguauaccgugguugagagcuucucuucccugcuuagcagaggaucucuggaacagcucagcgaggaagagaugcaugcggaaauuuguuacgccgagugccugcuucagaaagcugcccugacguuugugcaggacgagaauaugaucaacuucaucaagggcgggcucaaaauucggaccuccuaucaaaucuacaaggaaugucugucuauucugcacgagauccagaaaaauaagcuccagcaagaauuuuucuaugaguuugaaggaggcgucaagcugggcagcggggccuucaaccuuaugcugucccuccugcccgcucgcauuaucagacuucuggaguucauuggauuuagcggcaaucgggagcucgggcugcugcagcucagagaaggagccucuggccgcuccaugcggagcgcgcugugcugucuuacaauccuggcuuuccauaccuacaucucucucauucuggggacaggagaggugaacguggccgaagccgagagacugcuugcuccuuuucuccagcaguuccccaauguccgcuccguuuuucaaagcgcccaggaaguguuccagaaaugcaucuccgugcaggaggaguggaagcaauuucaccaccuguguuacugggaacugauguggauuaacgucuuccagcagaauuggaugcaggcuuauuacuauucugaucuccugugcaaagagagcaagugguccaaagccaccuacguguuucuuaaggcggccauccugucuaugcucccugaagaggacguuguggcuacgaacgagaaugucgugacacuguuccggcaaguugauagccugaaacagagaauugccggcaaguccauccccaccgaaaaguuugcugugcgcaaagcccggagauauagcgcgucucuuccggccccugucaagcucauccugcccgcucuggagaugauguacguguggaacggcuucuccauugucagcaaacgcaaggaccucucugaaaaccugcuugugacaguugagaaagccgaagcugcccugcagucccagaauuuuaacagcuucucuguggacgaugagugccucgucaagcugcugaagggguguugccuuaaaaaucuccaacggccucugcaggccgagcuguguuauaaccaugugguugaaagcgagaagcuccugaaauacgaccacuaccuugugcccuucacccuguuugaacucgcuucccuguauaagagccagggagagaucgauaaagcgauuaaguuccuggaaaccgccagaaauaacuacaaggacuauucucuugagucccgccuccauuuucggauccaagcugcccugcaccuguggagaaaacccagcuccgauuga

SEQ ID NO: 77399 - RNA, 6078 nt, Artificial Sequence
  derived and/or modified sequence opt5 from TTC3__Homo_sapiens__NP_001001894
auggacaacuucgccgaaggcgauuuuaccguggcugacuacgcccugcucgaagauugcccccacgucgacgauuguguuuucgcggcugaguuuaugagcaaugacuaugugagagugacacagcuguacugcgauggggucggagugcaauauaaggacuacauccaguccgaacggaaccuugaguucgauauuuguucuaucuggugcagcaagccuauuuccguucugcaggacuauugugaugccaucaagauuaauaucuuuuggccgcuccuguuccagcaucaaaacucuagcgugaucucccgccuucaccccugcgucgacgccaauaacucuagagcuagcgaaauuaaucugaagaagcuccagcaucuggagcugauggaggauaucguggaccucgccaaaaagguugcuaacgacuccuuucugauuggcgggcuucugcggaucggauguaagauugaaaauaaaauccucgccauggaggaagcgcugaacuggauuaaguacgccggcgaugugacgauccuuaccaaacuggggagcaucgacaauugcuggccuaugcucucuauuuucuuuaccgaguauaaguaccacaucaccaaaauugucauggaggauuguaaccugcuggaagaacucaagacacaguccugcauggacuguaucgaagagggagaacugaugaagaugaaaggcaaugaggaguucagcaaggaacgcuuugauauugcuaucaucuacuauaccagagccauugaguaccggcccgaaaacuaucuucuguacggcaaucgcgcucucugcuuccugagaacagggcaguuucggaacgcccuuggagacggcaaacgcgcgaccauccugaagaacacguggccuaaagggcauuauagauacugcgaugcccucucuaugcugggagaguaugacugggcucugcaagccaauauuaaggcucagaaacucuguaagaacgaucccgaaggcaucaaggaccugauucagcagcacgugaaacuucaaaagcagaucgaggaucugcaggggcggaccgccaauaaagacccuaucaaggccuucuacgagaaccgcgcuuacacaccgagaucccucagcgcgcccauuuucaccacaucucugaauuuuguggaaaaagagcgggacuuccgcaagaucaaccacgaaauggccaauggaggcaaccaaaaucuuaaggucgcugaugaggcccugaaaguugacgauugcgacugucauccugaauuuucucccccuagcucccagcccccgaagcacaaaggcaagcagaaaucuagaaacaaugagagcgagaaguucuccagcagcuccccucucacccugcccgccgaucugaagaacauucucgaaaaacaguuuagcaagucuagccgggcugcccaucaagacuucgcgaauaucaugaaaaugcugagaucccuuauucaggauggguauauggcucugcucgagcagcgcugccggucugccgcccaggcuuuuacggaacugcugaacggacuugacccucaaaagaucaaacagcucaaucuggccaugauuaacuacgugcugguggucuauggccucgcuaucagccugcuugggaucggacagcccgaggagcuguccgaagccgagaaccaguucaagagaauuaucgaacacuaccccagcgagggccucgauugucuggcguauugcgggauuggaaagguguaccugaaaaagaaucgcuuucuugaagcccucaaccacuucgagaaagcucggacacugaucuauagacugccuggcguucucaccuggccgacaucuaaugugauuaucgaggaaucccaaccccagaagaucaaaaugcugcuugagaaguuugucgaagaguguaaauucccucccgugccugacgccauuugcuguuaccagaagugccauggcuacagcaagauccagauuuauaucaccgaucccgacuuuaaaggguucauucgcaucucuuguugccaauacugcaagaucgaguuccacaugaacuguuggaaaaagcugaaaaccacaacguuuaaugauaagauugacaaggacuuccuccagggaaucugccugaccccggauugugagggcguuauuuccaaaaucauuaucuuuagcuccgggggagaggugaagugcgaguucgagcauaaagucaucaaggaaaaagugccuccccggccuauucugaagcagaaguguucuagccuugagaaacucagacugaaggaagacaaaaagcugaaacgcaagauccaaaagaaagaggcuaagaaacucgcccaggagcggauggaagaggaucugagagaauccaaucccccuaagaaugaggagcagaaagaaacagucgacaacgugcagcgcugccaauuucuugaugaccggauucugcaguguaucaagcaguaugcggauaaaauuaagucuggcauccagaauaccgccaugcuccugaaggagcugcuuagcuggaaaguucucuccacagaagacuacaccacgugcuucagcucuagaaacuuucugaaugaggcuguggauuaugucauucggcaccugauccaagaaaacaaucgcgugaagacaagaaucuuccuccauguucuguccgagcuuaaagagguggaacccaagcuggccgcuuggauucagaaacucaacagcuuugggcuggacgccaccggcaccuucuuuucucgguacggagccucccugaaacuucuggauuucagcaucaugacauuucucuggaaugagaaguauggccacaaacuggacucuauugaagggaagcagcucgauuacuucagcgagccggcuucccugaaagaagcgagaugucuuaucuggcugcucgaggagcaccgcgacaaguucccugcccugcauagcgcucuggacgaauuuuucgauauuauggacucucggugcaccguccuuagaaaacaggauuccggagaggcccccuuuagcuccacaaaggugaagaacaaaucuaagaaaaagaaacccaaggacagcaagccuaugcuggugggcuccgggacgaccucuguuacaagcaacaaugaaaucaucaccuccucugaggaucacagcaaccgcaauuccgacagcgccggaccguucgcuguccccgaucaucucagacaagacguggaagaguuugaggcccuguacgaucagcacucuaacgaauaugugguccggaauaaaaagcucugggacaugaacccuaaacagaaguguuccacacuguacgauuauuucagccaauuucuugaggaacacggcccccuggacaugucuaauaaaauguucuccgcggaguacgaguuuuucccugaagagacccgccagauucucgaaaaggcugggggccugaagcccuuucugcuuggaugcccuagauucgugguuaucgacaacugcauugcccugaaaaagguggccagccggcucaaaaagaaacgcaagaaaaagaauaucaagacgaaagucgaggaaauuucuaaggcuggcgaguaugugagaguuaaacugcagcucaaccccgccgcgcgggaguucaagccggaugugaaauccaagccugucagcgacuccagcucugcucccgccuuugaaaaugugaagccuaaacccguuagcgccaacuccccgaagccugcuugugaggaugugaaagccaagcccgucucugacaauagcucccgccaggugucugaagaugggcaaccuaaaggagugagcuccaacucucccaagcccggcagcgaggacgcuaauuacaagagagucuccugcaacagcccuaaaccgguucuggaagaugugaagcccaccuauugggcccagucucaucuugugacaggguacuguaccuaccugccuuuccagcgguuugacaucacacagacacccccugcguauaucaacguccugcccggacucccucaauacacguccauuuauacaccgcuggccagccuuucucccgaguaccagcugccucgcuccgugcccguugugccuagcuucgucgcuaaugauagagccgacaaaaacgcugccgccuauuuugagggccaccaucucaaugcugaaaacguggcggggcaccagaucgccuccgagacccagauucuggaaggcucucucggaaucagcguuaagucccauugcagcacaggcgaugcucacaccgugcugucugaguccaaucggaacgacgaacacugugggaauagcaacaauaaaugcgaggucauucccgagucuaccagcgccgugacaaacaucccgcauguucaaaugguggccauucaggucuccuggaauaucauccaccaggaagugaacacggagccuuacaaucccuucgaagagagacagggagagauuucucgcaucgaaaaggagcaucaagugcuucaggaucagcugcaagaagucuaugagaacuacgaacagauuaagcugaaaggccucgaggagacccgggaccuggaagagaaacuuaaaagacaccuggaagagaauaagaucagcaaaacagaacucgacugguuucugcaggaucucgagcgcgagauuaagaaauggcagcaagaaaagaaggagauccaggaacggcugaaaucccuuaagaaaaagaucaaaaagguuucuaacgcuagcgagauguacacccagaagaaugacgggaaagaaaaggagcaugagcugcaccuggaucagucccucgaaauuagcaacacacugaccaacgagaaaaugaagaucgaagaguauauuaaaaagggaaaggaggacuacgaagagucucaccaaagagccguggcggcugaaguguccguccuugagaauuggaaagaaagcgagguguauaagcugcagaucauggagucccaggccgaagccuuccucaaaaagcugggccucauuucucgcgaucccgcugccuacccugacauggagagcgauauccgguccugggaacuguuucuuucuaacguuacgaaagagaucgaaaaggcgaagucccaguucgaggagcaaauuaaagcuaucaagaauggguccagacugagcgaacugucuaaagugcagauuuccgagcucagcuuucccgccuguaacacaguccauccugaacugcuuccggagucuuccggcgacgauggacagggccuggugaccagcgccucugacguuaccgggaaucacgcugcccuccaucgcgaucccagcguguucuccgcuggagacucuccuggcgaagcccccagcgcgcugcugccugggcccccgccuggacaacccgaggccacacagcucaccggcccuaagcgggcuggccaggccgcucuuuccgagagaagccccgucgccgaucggaaacagccugugcccccggggcgcgccgcuagauccucucaaagcccuaagaaacccuuuaacuccaucauugaacaccugucugucguguuccccugcuauaauagcacagagcuggcgggauucaucaagaagguucgguccaaaaacaagaacucucucagcggccuguccauugacgaaaucgugcagcgcgucacggagcacauccuugacgagcagaaaaagaaaaagccuaacccggggaaggauaaaagaaccuacgaacccagcucugccacaccugugacccgguccagccagggaucucccuccguuguggucgcuccuagccccaagacaaaaggccaaaaggccgaggacgugccugugagaauugcccugggggcuucuuccugugaaaucugccaugagguuuuuaaaagcaagaauguccgcgugcucaaguguggacacaaauaucauaagggcugcuucaaacaguggcugaagggccaguccgccugcccggcgugucaggggcgggaucugcucaccgaagagagccccucuggaagaggcuggccuagccaaaaccaggagcuucccuccugcucuagccgcuga

SEQ ID NO: 77400 - RNA, 1323 nt, Artificial Sequence
  derived and/or modified sequence opt5 from TTC5__Homo_sapiens__NP_612385
augauggccgacgaggaagaggaagugaagcccauccugcagaaacuccaagagcuggucgaucagcuuuacagcuucagagacugcuauuuugaaacccacuccguugaggaugcuggccggaagcagcaggacgugcaaaaagagauggaaaagacacugcagcagauggaggaaguggucggcucugugcagggaaaagcccaaguucucaugcugacgggcaaggcgcuuaacgugaccccugauuacagcccgaaggcugaggagcugcucuccaaagccgucaagcuggaacccgagcugguggaagccuggaaucagcucggggagguuuauuggaaaaagggagacguggcugccgcucauacauguuucucuggcgcccugacccacugccgcaacaaagucagccuucagaaucuguccauggugcucagacagcugcggacagauaccgaagacgagcauucucaccaugugauggauagcguccgccaagcgaaacuugccguucagauggacgugcacgaugggagauccugguacauucugggaaacagcuaucucucucuguacuuuuccacaggccagaauccuaagaucagccaacaggcucugucugccuaugcucaggccgagaagguggaccggaaggcguccagcaaccccgaucuccaccugaaucgcgccacccuucauaaauacgaagagucuuacggcgaagcucuggagggguucuccagagccgcugcccucgacccugccuggcccgaaccucggcagcgcgagcaacagcugcuugaguuucuggacagacucacgagccugcuggaauccaagggaaaagucaagaccaaaaagcuccagucuaugcugggcagccuucggccggcucaccuggggcccuguuccgauggacauuaucagagcgcgucuggccaaaaggugacacucgagcugaaaccucuuuccacccugcagcccgggguuaacagcggagccgugauucucggcaaggucguguucucucugacaaccgaagagaaaguuccuuuuacguucggccugguggacagcgaugggcccugcuacgcugucaugguguauaauaucguccaguccuggggagugcucauuggcgacucuguugccaucccggaaccuaaccugcgccuucacagaauccagcacaaggggaaagauuacagcuuuuccagcgugcgggucgagacaccccugcuccuggugguuaauggaaagccucaagggucuuccagccaggccguggcuaccgucgccucucgcccccagugugaguga

SEQ ID NO: 77401 - RNA, 3972 nt, Artificial Sequence
  derived and/or modified sequence opt5 from TTC6__Homo_sapiens__XP_011535733
auguacgccuaucccgaguucaccaagcuguuuuggaacacagcugccccuaaauucagcgugccggaauccgucaugaaggagacgcucuaccccaaauaugaaucuguucaggcgagcagacugcuuaccgacaagcuguccuacaaaucuagcgugaucacacuccaccaacauucccggaccaauuuuuggugcuuccugccucgcaagucugcuagcuuugaguccauucagaagugguucagcgcccagcccacacagcuuagacgggugaaaucuuccgucgaucugcgcaaggaaaagaucauugccccucucgagaucaagaacgacaugcaaagcucuauuaaagaggugauguuucagaaggcuaaggaacugaaaagacagcugcagcucaccaagcaaaauaaaacagaggaacccaacuauguuaaggaguccaucgaugacaucuucgauaauaugugugagaaacacagccugcggaaccuuucucugacccucauugaagccuccaagaaagcuggcaucagcuacauuguguauccuaagaagaaaaagaugcgcuggaaaaagagacugaaacagcagaagcugaucuuuguccaugaggaacuguccaagccgcccaaaucucucgagcggagcgccucccacgggauucugccuggacagaagaaauaccuguucaaggugccccucuacgaacgccaaaucagaugcccuagccugccccuuuaucugaauuuugagaaauucguucaggcgaagggcgggauuccggagaacaucgacccucggacgugggcccucgaucgccugaucgaauacaaggacgcuucuauucccgugaaagagaaggaugacaaaaucuccgucccugaagauccucccgagagagugaaggaacccccgaaacuuaagcugaaugacuauguggagagcgaucucccccaggaggucauuaaguacuaugaaucugagguuaaaauccugaccgaagagauuaacgacaagacaaaauacccugccuuugcuuauugucggcgcggagccaucuacagaaagcugggcaaacuccaaagcgcgaugaaugaccugcagcgggugauccuucuggaaccccucuuccugaacgccuacuggcauagacaccuuauuuaucuguuccaggauaagaucaaugaggcucucgacgaucugaacuacauucacaaauauaauaagaacaacaccgaggccuaccuguccaaggcugaaaucuaucgcgggaaaaaggacauuacacucgccauccugaauuacacccaggccaucaaaucuacgccuacagaugcugacauuuauuuucggagaggagagauguacgaaaucaccaacaaggugcuugcgauugaugacuucagcaaaugcaucuuuuacgaucccaagcgcacagacgcccugcucaagcggggccuguucuauugugagaaugagaacugguuugcugccauugaagauuucaccgcccugcuuaauaucgaccaucaaaacucccaggcuagaaccuaccgcggcauugccuaugucaaauggaaguuuuacaaagaggcgacacaggacuucagcgcugccauccaccucgauccgaauaacuggcuggcccuguauuaccgggggugccucuuuagaaagucuaauccuuuccgcgcucugcaggacuauuccgugagcgcccuuaucaacgauggauacgaaaaucugggcuguuuucuccaucgggggauuguuuacgcucaccugaaacuguggcuucucgccaucugcgacuucgagacggugauuucucuggaaagaaccaucacacuggcguaugucaacauuggacucauccaccuucuucaucuggauaauuacaccgaggccaucuggcaauuuuccgaggcuauucgcaucgacccccucuguauucagagcuaucugugccgggccgaaacauacuucaagcugcacaaacuuaaaaaggcugugaacgagcucuccagagccauccaucugcagccugauggcauucagcuguauauccggcgcgggcaauaccuccugaugaugaaauauuacgaccuugcgaaguucaccaucuaccagauugccgaaauggauaaaggacugucugagcucagccccaugcagcaggcucugaucuauuccuuuugugaaaaucacgacaaggccauugagguucuggauggcaucucuuggaacagagcugagaugacgaugugcgcccuucucgccaaggugcaaaugaaagcuaagcggacaaaagaagcggucgaggugcugaagaaagcccuggacgcuauuagccauuccgauaagggcccugacgccaccgccaucagcgcugacugccucuacaaccuggggcuuuguuauauggaagagggaaaucugcagauggccuucgauucuuuuaccaaagcggucaaggcuaaccccgacuucgccgaauccuuuuaccagagaggccucugcaaggugaaacugcacaaggauagcucuauccuggacuucaaucgcgccauuacacuuaacccgaaacacuaucaagagaugcauaccgggggacugggcgcuuaccucucccggguugccuuuuaugggcugaagggaagauacagcaaagcgauccucaauuguaacaaggcuauuaagaucuacccugagucugugcgcgccuaucuguacagaggcguccuuaaauauuacaauaagacauauaaacuggccauuacggaucucaccacagcuaucagcauggacaagaacuccuacaccgccuucuauaaucgggcucugugcuacacaaaaauucgcgaacugcagauggcccuuaccgauuacggcaucgugcugcuccuggacgcgacggagaccguuaagcucaacacauuucugaauagagggcuuaucuauguggaacugggacaguacggcuucgcccucgaggauuuuaagcaggcugcccugauuagccggaccaacgggucucugugucacgcuacagccaugugccaucaccgcaucaaugaguucgaagaggccgucaacuuuuucaccugggcucuuaaaauuaaucccuguuuccuggacgcguaugugggaagaggcaacuccuacauggaauaugggcacgaugaggccacgaagcaagcucagaaagacuuucucaaggcccugcauaucaaccccgccuacauuaaagcucggaucagcuucggcuauaaucuccaggcccagggaaaguuucaaaaggcguggaaccacuucacaaucgcuauugauaccgacccuaaaaauuaccuggccuacgaaggccgcgccgugguuugccuucagauggggaacaauuuugcugccaugcaggacaucaacgcggcuaugaagauuuccacaaccgccgaguuccugaccaauagaggagucauccaugaguuuaugggccacaaacagaacgccaugaaggauuaucaagacgcuauuacacugaauccgaaauacucucucgccuauuucaacgcugggaauaucuacuuucaucaccggcaguucagccaggccuccgauuauuuuucuaaggcgcugaaguucgaccccgaaaacgaguacgugcuuaugaaucgcgccaucacgaacaccauucugaaaaaguaugaagaggcuaaagaagauuucgccaaugugaucgagagcuguccuuuuugggcugccgucuacuucaacagagcccacuuuuacuauugccucaagcaauacgagcuggcugaagaggaccucaacaaagcgcugucccuuaagcccaaugaugcccugguguauaacuuccgggcuaaaguuagaggaaagauuggccugaucgaagaggccauggccgacuacaaucaggcucucgaucuggaagacuaugccucugugauuuga

SEQ ID NO: 77402 - RNA, 2475 nt, Artificial Sequence
  derived and/or modified sequence opt5 from TTC7A__Homo_sapiens__NP_001275882
auggugcccagcuccucuagaaccccuggcuucaagcagagcucccaccaucugcggcucccgaaaugcugggacuaccgcgaugacuuugggaagcugcuucuggccgaggcucuccuggaacaaugucuuaaagagaaccacgccaagaucaaagauucuaugccccugcucgaaaagaaugagccuaagaugagcgaagcgaaaaacuaucuguccucuauucugaaucauggaagacucagcccccaguacaugugcgaggcuaugcugauccuuggcaagcugcacuaugucgagggguccuaccgggacgccauuagcauguaugcccgcgcuggaaucgaugacaugucuauggaaaacaaaccucucuaccagaugagacugcuuuccgaggccuucguuauuaagggccugagccucgaacggcugcccaauucuaucgcuucccgcuuuagacugacagagcgggaggaagaggugaucacguguuucgaacgcgccagcuggauugcucagguguuucuccaagagcuggagaaaaccacaaacaauucuaccuccagacaucuuaaggggugccacccucuggauuaugaacucacauacuuccuggaggccgcgcuucagagcgccuacgucaagaaccugaaaaagggaaauaucgugaaaggcaugcgggaacuccgcgagguucugagaaccguggaaacaaaggcuacccagaacuuuaaagucauggccgcgaagcaccuggccggcgugcuccugcauucccuuucugaggaauguuauuggagcccgcugucccacccccucccugaguucauggggaaagaggaaagcucuuuugcuacgcaggcccugcggaagccccaucuuuacgagggagacaaucuguauugcccuaaggauaacauugaagaggcucuccugcugcuccugaucuccgaaagcauggccacccgcgacguugugcuuucuagaguccccgagcaagaggaagaucggacagugagccugcagaaugccgcugcgauuuacgaccuccuguccaucacccugggcagacgcgggcaguaugugaugcuuucugagugucucgaacgggccaugaaauucgcuuuuggagaguuccaccugugguaccaggucgcccugagcaugguugccugcggcaaguccgcuuaugccgugagccuccugagagagugugugaaacuucgcccgucugauccuacagucccccugauggcggcuaaggugugcauugggucccuccgguggcuggaagaggccgaacacuuugccaugaugguuaucagccugggagaggaagcuggcgaguuccuuccuaaaggcuaccucgcccuggggcugaccuacucucuccaagcuacggacgccacacugaaguccaagcaggacgagcuucauagaaaagcgcugcagacccucgaacgcgcccaacagcuggcucccagcgauccccaggugauccuguaugucucccuucagcucgcccuggugcggcaaauuucuagcgcuauggagcagcugcaggaagcccucaagguuagaaaagacgaugcgcacgcccugcaucuucuggcucuccuguucuccgcccagaagcaccaucaacacgcucuggacguggucaacauggccaucacagagcacccugaaaauuuuaaccuuauguucaccaaagugaagcucgagcagguccugaagggaccggaggaagcccuggugaccugucgccagguucuccggcuguggcagacacuuuacucuuuuagccaacugggcgggcucgagaaagauggauccuucggcgaagggcugacgaugaagaaacagagcggaaugcaucugacccuucccgacgcucacgaugcggacucuggcuccagacgcgccagcucuauugcugccucccggcuggaggaagccaugagcgagcucacaaugccuucuagcgugcugaagcagggccccaugcagcucuggaccacacuggagcaaaucuggcuucaggcugccgaacuguuuauggagcagcaacaucucaaagaagcgggguucugcauucaggaggcugccggacuguuuccuaccucccacagcguccuguauaugagaggccggcuugccgaggugaaggggaaccuggaagaggcuaagcagcucuacaaagaagcccugacgguuaaucccgauggagugcgcaucaugcacucucucggccugaugcuuuccagacuggggcauaagagccucgcgcagaaaguccugcgggacgcuguggagagacaauccacaugccacgaagccuggcagggccugggagaggugcuucaggcccagggccaaaacgaggcugccguugauuguuuccugaccgcucucgaacuggaggccucuagcccgguccucccuuuuuccaucauuccccgcgaacuguga

SEQ ID NO: 77403 - RNA, 2532 nt, Artificial Sequence
  derived and/or modified sequence opt5 from TTC7B__Homo_sapiens__NP_001010854
auggccaccaagaaagcuggcagcagacuggaaacagaaaucgagcggugccgcuccgaaugucagugggagcggauucccgaacucgugaagcaacugucugccaaacuuaucgcgaacgacgauauggcugagcugcuccugggggagagcaaacuugaacaguaccugaaggagcacccucucagacagggagccuccccgcgcggccccaagccucagcugacggaagucagaaagcaucugaccgccgcucucgaccgggggaaucugaaaucugaguuccuucaagagagcaaccugauuauggccaagcucaauuauguugaaggagauuacaaagaggcucugaacaucuaugcccgcgugggccuugacgaucugccccucacagcggugccucccuacagacugcgggucauugccgaggcuuaugccaccaaggggcugugccucgaaaaacugccuaucuccucuagcacauccaaucuucacguggaccgcgaacaggauguuaucaccuguuacgagaaggcuggagacauugcccugcucuaucugcaggagaucgaaagagugauucuuagcaacauccagaaucggucuccgaagcccggcccugcgccccaugaucaagagcugggcuuuuuccucgaaacagggcugcagcgcgcccacguccuguacuuuaaaaacggaaaucucaccagaggcguggggcgguuccgcgagcugcuuagagcuguugaaacgcggaccacacagaaccugagaaugaccauugcccgccagcucgcugagauccugcuucggggaaugugcgagcaauccuacuggaauccucuggaagaucccccgugucagagcccucucgacgacccccugagaaagggcgccaacacaaaaaccuauacgcugacacgccgggccagaguguacucuggggagaauaucuuuugcccucaggaaaacaccgaggaagcucuccugcuucugcucauuuccgagagcauggcgaaucgcgaugccguccugucucggauccccgagcauaaguccgacagacugauuagccuucaauccgcuucugugguguaugaccuccugacaaucgcccugggacgccggggccaguacgaaaugcucagcgagugucuggaaagagccaugaaauucgcuuuugaggaguuccaccuuugguaucaguuugcccugucccucauggcggcuggcaagagcgcccgcgccgucaaaguucugaaggaaugcauucggcugaagcccgaugacgcuaccaucccucuucucgccgcuaaacuguguauggggucucugcacuggcucgaggaagccgagaaguucgcgaaaaccgugguggaugucggagaaaagacauccgaguuuaaagccaagggcuaccuggcucuugggcugacguauagccuccaggccaccgacgcuucucugagaggaaugcaagaggugcugcagcggaaggcccuucucgcguuccagcgcgcccauagccuguccccgacagaucaccaggcugccuuuuaccuggcucuccaacuggccauuucuagacagauccccgaagcccuuggcuacguucggcaggcucugcagcuccaaggggacgaugcgaacagccugcaucugcuugcccuccugcuguccgcucagaaacacuaucacgacgcccucaacaucauugauauggcccugagcgaguacccugaaaauuucauccuucuguucucuaaggugaaacuccagucccugugcagaggacccgacgaggcucugcuuaccuguaagcauaugcugcagauuuggaaaagcugcuauaaccucacaaauccuucugauuccggccgcggcagcucccugcucgaccggaccaucgccgacagacgccaacugaacacgauuacacuucccgauuuuucugacccggaaaccgggagcguccacgcgaccuccguggcugccucuagaguugagcaggcccugagcgagguggcuuccagccuccagucuuccgccccuaagcaaggaccccugcauccuuggaugacacuggcgcagaucuggcuucacgcugccgaagucuacaucggcauugggaagcccgccgaggcuaccgccugcacacaggaagcugccaaucuguucccuaugagccauaacgugcucuauaugcggggacagaucgcggagcugcgcggcucuauggaugaagccagacggugguacgaggaggcucucgccauuucccccacgcacgucaaaagcaugcaacgccuggcucuuauccugcaccagcucgggagauauucucuggccgaaaagauucugcgggacgccgugcagguuaauagcaccgcucaugagguguggaacggccuuggagaaguccugcaggcgcaaggcaaugaugccgcugccacagaguguuuucucaccgcccuggagcucgaggcuuccagcccggccgugccuuucacaaucauuccccgcguucuguga

SEQ ID NO: 77404 - RNA, 1596 nt, Artificial Sequence
  derived and/or modified sequence opt5 from TTC8__Homo_sapiens__NP_001275710
augagcuccgagauggaaccccugcuccuggccuggucuuacuucagacggcgcaaguuucagcuuugcgcugaccuguguacccaaaugcucgagaaaagcccuuaugaucaggccgcguggauccugaaggcuagagcccuuacagaaaugguguacauugacgagaucgaugucgaccaggaaggcauugccgagaugaugcuggaugagaacgcuaucgcccagguuccgcggcccgggacgucccucaaacugccuggaaccaaucaaacaggcgggcccucucaggcugugcgcccuauuacccaggccggaagacccaucacaggcuuccugcggccuagcacccaguccgggcgcccgggaacaauggaacaagcgaucagaacgccccggaccgccuauaccgcucgcccuauuacaucuagcuccggcagauuugugcggcucggcaccgccagcaugcugacaucucccgacgggccuuucaucaaccuuucccgccugaaucucaccaaguacagccagaaacccaagcuggcuaaggcccuuuuugaguauauuuuccaccaugaaaacgaugucaaaacgauccaccuggaggacgugguucuccaucugggaauuuacccguuucugcucagaaauaagaaccacaucgagaaaaaugcgcuggaucuugccgcucugucuacagaacauucccaguauaaggacuggugguggaaagugcagauuggcaagugcuacuaccggcucgggauguaucgcgaggccgaaaagcaauucaaaagcgcucugaagcagcaggagauggucgauaccuuucuuuaccuggccaaaguguauguuucucucgaccaaccugugacagcccugaaccuguucaagcagggacucgauaaauuucccggcgaagucacccugcuuugugggaucgcuagaaucuacgaggagaugaauaacauguccagcgcggccgaauauuacaaggaggugcugaaacaggacaauacccacguggaagcuauugccugcaucggauccaaccacuucuauucugaccagccugagauugcccuccgguuuuacagacgccugcuucaaaugggcaucuacaauggccagcuguucaacaaucucgggcuguguugcuucuaugcucagcaguacgauaugacacugacgagcuuugaacgggcccucucccuggcggagaacgaggaagaggcugccgacgucugguauaaccuuggacauguugccgugggcauuggggauaccaaucuggcucaccaauguuucagacucgcccuggugaacaauaacaaucaugcugaagccuacaacaaucuggcgguccuugagaugcgcaagggacacguggaacaggcccgggcucuccugcagacagccagcucucuggcuccccacauguaugagccccauuuuaacuucgccaccaucuccgacaagaucggcgaucuccagagaagcuacguugcggcccaaaaaucugaggcugccuuuccugaccacguggauacacagcaucugauuaagcagcuucgccagcacuucgcuaugcuguga

SEQ ID NO: 77405 - RNA, 720 nt, Artificial Sequence
  derived and/or modified sequence opt5 from TTC9B__Homo_sapiens__NP_689692
augcagagaggcgcccugagccccgugcucaugcuguccgcugccccugagccgcccccucggcccccucccgcgcuuucuccuccggggagcggacccggcuccgggucucgccacggaagcgcuagaccuggccccaccccugaacccuccgggucucugggagccgcccucgacagcucccugcgggcugccgucgcuuucaaggccgagggccaacgcugcuacagagagaaaaaguuucgggaggcgaucggcaaauaucaucgcgcccuucugcagcucaaggcugcccagggggcuagaccgagcggacugccugcccccgcgccuggccccacaucuucccccgggccugcccggcugagcgaagaacagcgcagacucguugagucuacggaaguggaguguuacgauucccugaccgcuugccuucugcaaagcgaacucgugaacuaugagcggguccgcgaguacugucugaaagugcuugaaaagcagcagggaaauuucaaggccacauauagagcuggcauugccuuuuaccaccugggggacuaugcccgggcucuccgcuaccugcaggaggcgagaucucgggaaccgaccgauacaaacguucugagauacauccaacucacccagcugaaaaugaaucgcugcucccuucagcgggaggacagcggagccggcucccagacaagagaugugauuggcuga

SEQ ID NO: 77406 - RNA, 516 nt, Artificial Sequence
  derived and/or modified sequence opt5 from TTC9C__Homo_sapiens__NP_776171
auggagaagagacugcaggaagcccaacucuacaaagaggaaggcaaccagcgguaucgcgaggggaaguacagagacgcugugagccgguaucaccgcgcccugcuucagcugagaggacucgaucccucccugccuucuccgcuucccaaucugggcccucaggggcccgcgcucaccccugaacaagagaacauccugcauacaacgcagaccgacugcuacaauaaccuggcugccugucuccugcagauggagcccgucaauuaugaacggguucgcgaguacagccagaaagugcuugaaagacaaccugauaacgccaaggcucuguaucgggccggaguggcuuucuuucaccuccaggacuacgaucaggcccgccauuaccugcuugcggccgucaauagacagccgaaagacgcuaacgugcggcgcuaucugcaacucacacaguccgagcugucuagcuaccacagaaaggagaagcagcuguaucucggcauguucggguga

SEQ ID NO: 77407 - RNA, 669 nt, Artificial Sequence
  derived and/or modified sequence opt5 from TTC9__Homo_sapiens__NP_056166
auggagagaaagggcagcgccgcuggggccaaaggaaaccccuccccuccggcggcuggcgaagggcagcggcccccucccccucugugcgugcccggaggcgggggaggcgccccugcccgcggccaagucggggcugccgcugagccggccgaacucaucagacgggcgcacgaguucaagucucagggagcccaguguuacaaagacaagaaauuucgcgaagcuauuggcaaguaucauagagcccugcuugagcugaaggggcuccugcccccucccggagagcgggaacgcgauagcagaccugcuucccccgccggcgcgcuuaaaccggggcggcugucugaggaacagagcaagaccguugaggccaucgagauugacugcuacaauucccucgcugccugucugcugcaagcugaacucgugaacuaugagcgcgugaaagaauacugccugaagguccuuaaaaaggagggagaaaauuucaaggcccuguauagaucuggcguggccuuuuaccaccucggcgauuaugacaaagcucuguacuaccuuaaggaggcgcggacacagcagccuacggauaccaacguuauccgcuauauucagcugacagagaugaaacucagcagauguucccaacgggaaaaggaggccauguga

SEQ ID NO: 77408 - RNA, 2718 nt, Artificial Sequence
  derived and/or modified sequence opt5 from TTF1__Homo_sapiens__XP_006717336
auggagggcgaaagcuccagauucgagauccacacccccgugucugacaagaaaaagaaaaagugcagcauucauaaagaacggccucagaagcacucccaugagaucuuucgcgauucuagccuggucaacgaacaaucccagauuacaagacggaagaaacgcaagaaagacuuccagcaccucaucucuagcccgcugaagaaauccagaauuugugaugagacggccaaugcuaccagcacacuuaagaagcggaaaaagcgcagauacucugcccuggagguugacgaagaggcgggggugaccgugguccucguggauaaagaaaacaucaauaacacacccaagcauuuucggaaagacguugauguggucugcguggacauguccaucgagcagaagcugccucgcaaacccaagaccgauaaguuccaaguucuugcuaaaagccacgcccacaagucugaggcccugcauuccaaagugagagaaaagaaaaauaagaagcaccagcggaaagcugccagcugggagucucagcgcgcuagagacacacucccucaguccgaaagccaucaagaggaauccuggcugucugucggacccggcggggagauuaccgagcugccugccagcgcgcacaagaacaaauccaagaaaaagaagaaaaagagcucuaaucgggaauaugagacgcucgccaugccggaaggaucccaggcuggccgcgaggccgggaccgauaugcaggaaagccagcccacagugggacuggacgaugagaccccucaacuucugggccccacacacaaaaagaaaucuaagaagaaaaagaaaaagaaaagcaaccaucaggaguuugaagcucucgccaugccugagggcucccagguggggucugaagucggagcggacaugcaagagagcagacccgccguuggccugcacggggaaaccgcuggaaucccggccccugcuuacaagaauaaauccaagaagaaaaagaaaaagagcaaccaucaggaguucgaggccguggccaugcccgaaucucuugaguccgcuuauccugaaggcagccagguggggucugaggucggaacgguggagggcuccacagcgcugaaaggcuuuaaggaaagcaauuccaccaagaaaaagucuaaaaagcggaaacucacaagcguuaagagagcccgcguguccggggacgauuucucuguccccagcaagaacuccgagagcacccuguuugacucuguggaaggagauggcgcuaugauggaggaagggguuaaaucccggcccagacagaagaaaacccaagccugucuggccagcaagcacgugcaggaggcuccucgccucgagccggccaaugaggaacauaacgucgaaacagcggaggacucugaaauucgguaccuguccgcugauagcggagacgccgaugacucugaugccgaccuuggcagcgcugugaaacagcugcaggaguucauccccaauauuaaggauagagccacguccaccaucaagcgcauguaucgggacgaccucgagagauuuaaagaauuuaaggcucaaggggucgccauuaaauuuggaaaguucagcgugaaagagaacaagcagcuggaaaagaacguugaggauuuccuugcgcugacaggcaucgaaucugccgacaagcuccuguacaccgaucgcuauccugaggagaaguccgugaucacaaaucugaaacggagauacagcuuucgccuccacauuggccggaacaucgcuagacccuggaagcugauuuacuaucgggccaaaaagauguucgacgucaauaacuacaaagggcgcuauuccgaaggagauaccgagaaacuuaagauguaccacucucugcucggcaaugacuggaaaacgaucggggaaaugguggcuagaagcucccugucuguugcccuuaaguuuagccagauuuccucucagcggaacagaggagcguggagcaaauccgagacacgcaagcugaucaaagccguggaggaagucauccucaagaagaugagcccucaagagcugaaagaaguggauucuaagcugcaggagaaucccgaauccugccucagcauugugcgggagaaacuguauaagggcaucucuuggguugaggucgaagcuaaagugcagaccagaaacuggaugcaguguaaguccaaguggaccgagauucuuacaaaacgcaugaccaaugggagacggaucuacuauggcaugaacgcccugcgcgcuaaggugagccucauugaaagacuguacgagaucaaugucgaagacacaaacgagaucgauugggaggaccuggccucugccauuggagaugugccgccuuccuacguucaaacgaaauucagccggcuuaaggcuguguauguccccuuuuggcagaaaaagaccuucccugaaaucauugacuaccucuaugagacaacccugccccugcucaaggaaaaacuggagaagaugauggagaaaaagggcacaaaaauccagaccccugcggcccccaagcaaguguuuccguuccgcgauauuuucuacuaugaagacgacuccgagggggaagauaucgagaaagaaagcgagggacaggcuccuugcauggcccaugccuguaauucuagcacgcuuggcgggcagggaagauggauuaucuga

SEQ ID NO: 77409 - RNA, 3453 nt, Artificial Sequence
  derived and/or modified sequence opt5 from TTF2__Homo_sapiens__XP_011540606
auggccagaaucaaggagcgggcuagcacaugcgccggccagacccgcgcggcuuccugugggcccccuucuagcauuccggugucccacugccugcuccaugaagacuucgucguugagcugcaaggacuucugcucccccaggauaaaaaggaauacagacuguuuuuccgguguauccgcucuaaagccgagggcaagagauggugcgggagcauuccuuggcaggaccccgauuccaaagaacacucugugagcaacaagucccagcaugccagcgagacguuucaccauucuuccaauuggcuucggaacccuuucaaggugcuggacaaaaaucaagagcccgcucucuggaagcagcugaucaaaggagaaggcgaggaaaagaaagccgauaagaagcagcgcgagaaaggggaccagcuguuugaucaaaagaaagagcagaagccugaaaugauggagaaagaccucagcucuggacuggucccgaagaaaaagcaguccgugguucaggaaaagaaacaagaggaaggcgcugagauucagugugaggccgaaaccggcgggacacacaagagagauuucagcgagaucaaaucucagcaaugccagggaaacgaacuuacccggcccuccgcgagcucccaggagaagucuagcggcaaaucccaggacgugcaacgcgaaagcgagccucugagagagaaggucacacagcuccugccccagaaugugcacucucauaacuccaucagcaagccucagaaagggggaccccuuaauaaggaauauaccaacugggaggccaaagaaacaaaggcuaaagauggcccgucuauucaagccacccaaaagagccugccucaggggcacuuucaggagcggcccgaaacgcauuccguuccugcucccggaggccccgccgcgcaggccgcuccugccgcuccgggccucucucugggggagggacgcgaggccgccaccagcuccgacgaugaagaggaagacgacguggucuucgugagcucuaagcccggcuccccucugcucuuugauagcacacuggaccuugagaccaaagagaaucugcaguuccccgauagaucugugcagcggaaggucuccccugcuagcgggguuuccaaaaagguggaacccucugacccgguggcgcgcagagucuaccucacaacccagcugaaacaaaagaaaagcacgcuugccuccgugaacauccaggcucugccugauaaaggacagaagcucauuaaacaaauccaggagcuggaagagguucugucuggccucacacugagccccgaacaggggaccaaugagaaguccaacagccaggugccucaacagucucacuuuacaaaaaccaccacaggacccccucaccuugugcccccgcagccucugccccggagaggcacgcagcccgucggcucccucgagcuuaagagcgccugucaaguuaccgccgggggaucuucccagugcuaucgcggcaauacauaccuuuaugcugggcauaccaaccaggaccacgugcaugccgucuggaaaauuacaagcgaagcgaucggacagcugcaccggucucucgagagcuguccuggcgaaaccguggucgcugaggauccggccgggcugaaggugccccugcuccugcaucaaaagcaggcccuugcuuggcugcucuggagagaaucccagaaaccucaaggcggcauucuggccgacgauaugggacuggggaagacgcuuacaaugaucgcucucauccugacccagaaaaaucaggagaagaaagaggaaaaggaaaagagcaccgcccugacauggcucucuaaagacgauuccugcgacuucaccagccacggaacacugauuaucugucccgcgucccuuauucaccauuggaagaacgaaguugagaaacgcgugaacucuaauaagcugcgggucuaccucuaucacggcccuaacagagacagccgcgcccgggugcuguccacguacgauaucguuauuaccacauacucucugguggcuaaagaaauccccaccaauaagcaggaggccgagaucccuggggcuaaccuuaaugucgaaggaacaagcacgccccuccugagaauugccugggcgcgcaucauucuggacgaggcccauaacgugaagaauccgcgggugcaaaccuccaucgcuguuugcaaacuccaggccugcgcuagaugggccgucaccggcacaccuauucagaacaaucugcuugauauguauucucugcucaaguuucugcgcuguagccccuucgacgaguucaaccuguggcggucccagguggauaaugggagcaaaaagggcggagagagacuuucuauccucaccaaaucccugcugcuccggcgcacaaaggaccaacuggauagcaccggcagaccucuugugauccugccccagcggaaguuucagcuccaccaccugaaacugucugaggacgaagagacggucuacaacguguucuuugccagaucccgcagcgcucugcagucuuaucucaagcggcaugaauccagagggaaucaaagcggacgcuccccgaacaauccuuucagcagaguugcgcuggaguuuggcucugaggaaccccggcacagcgaggccgcugauuccccucgcucuagcacagugcauauucugucccagcuccugagacuucggcagugcuguugccaccugucucuccugaaaagcgcccuggaccccauggaacuuaagggggagggacugguccucucccuggaggaacagcucucugcccugacccuuagcgaacugcgcgauuccgagcccagcucuacagugucccucaacggcaccuucuuuaaaauggagcuguucgaagggaugagagagagcaccaagaucucuucccugcuugcugaacuggaggccauucaacggaacagcgcgucccagaaaucuguuaucgugagccaguggacaaauaugcucaaggucguggcucugcaucucaagaaacacggccugacguacgccaccauugacggauccguuaacccuaagcaacgcauggaucuuguggaagccuuuaaucacagcagaggcccgcaggucaugcugaucucucuccuggcugggggagugggccugaaccuuacagggggaaaucaucuguuccuccuggacaugcacuggaaccccucccucgaggaccaggccugugaucggauuuaucgcgugggccagcaaaaagacgucguuauccauagauuugugugcgaggggaccguggaagagaagauccugcagcuucaggaaaagaagaaggaucuggcgaaacagguccugagcggcucuggagagagcgugacaaagcucacccuggcugaccuucggguucuguucggcauuuga

SEQ ID NO: 77410 - RNA, 3270 nt, Artificial Sequence
  derived and/or modified sequence opt5 from TTI1__Homo_sapiens__NP_001290386
auggccguguucgacacccccgaggaggcuuuuggcguccugagaccuguuugcgugcagcucacaaagacgcaaaccguggagaacgucgaacaucugcagacacggcuucaggccgugagcgauuccgcgcugcaggagcuccaacaguacauccuguucccgcuucgcuuuacccugaaaacacccgggccuaagagagaacggcucauucagucuguuguggagugucugaccuucguccugagcuccacaugcgugaaagagcaggaacuccugcaagagcuguuuucugaacuuagcgcuugucucuauucccccucuagccagaagccugccgccguuuccgaggagcugaaacuugcugugauccagggacugagcacccucaugcacucugccuacggcgacauuauccugacguucuaugaacccuccauucugccucgccucggguuugcugucagccugcuucugggacucgccgagcaggaaaagucuaagcaaaucaaaaucgcggcccugaagugccuucaggugcugcuccugcagugugauugccaagaccacccgagaucccuggaugagcucgaacagaaacagcugggcgaccuuuucgcuagcuuucugcccgggauuucuaccgcccucacacggcugaucaccggagauuucaagcagggccauuccauuguggucagcucccuuaaaaucuuuuacaagacaguuucuuucauuauggcugacgagcaacugaagcgcaucagcaaagugcaggccaagccugcgguggagcacagagucgccgaacucaugguguaucgggaggcugauuggguuaaaaagaccggcgacaaacugacgauucugaucaagaaaaucauugaauguguguccguccauccccacuggaaggugcgccucgagcugguugaacuuguggaggaucugcuccugaagugcagccagucucuggucgagugugccgggccucuucucaaagcucuggugggacuggucaaugacgaaucccccgagauccaggcccaaugcaacaaggugcucagacacuuugccgaucagaaaguuguggucggcaauaaggcucuggcggacauucuuagcgaaucucugcauagccucgccacaucccugccgcggcugaugaacucucaggacgaucaggggaaauucagcacccuuucccuccugcugggauaccucaagcugcuuggcccuaagaucaauuucgugcugaacagcguugcucaccuccaacgccugucuaaagcccugauucaggugcuugagcucgacgucgccgauaucaagaucguggaagagagacgguggaacuccgacgaucugaaugcuagccccaaaacaucugccacccagccuuggaaucgcauucagagacgguauuuuagauucuuuaccgacgagcgcaucuucaugcugcuccggcaagugugucagcugcuuggguacuacggaaaccuguaucuccugguugaucauuuuauggaacuguaccaccaguccgucguguauagaaagcaagcggcuaugauucuuaaugagcucgugacaggcgccgccggccuggaagucgaggaccugcacgagaaacauaucaagacgaaccccgaagaacuccgcgaaauugugaccagcauccuggaggaauacacaucccaggagaauugguaucuuguuaccugccuggagacagaagagaugggggaggaacucaugauggaacaccccggacugcaggcuaucaccucuggcgagcauacgugccaggugaccagcuuccuggccuuuuccaagccuucuccgaccauuuguagcaugaacuccaauaucuggcaaauuugcauccagcuugaggggauuggacaguucgcuuacgcccugggcaaagauuuuugucuccugcucaugagcgcgcuguaucccguccuugaaaaggccggggaccagacccugcucaucucucaaguggcuacauccaccaugauggauguuugccgggccuguggauacgacagccugcagcaccugauuaaccagaacucugacuaccuugugaauggcaucucccugaaccucagacaucuggcucuccacccucacacacccaaaguccuggaggugaugcuucgcaauagcgaugccaaccugcucccucugguugcggacgugguccaggaugugcuggccacgcuugaccaauucuaugauaagcgggcugccucuuuugugagcguccugcaugcucucauggccgcccuggcucagugguuccccgacaccggcaaucucgggcaucugcaggaacaaucccuuggagaggaaggcagccaccugaaccagagaccggcggcccuggagaaaucuacaaccacagcugaggauaucgaacaguuucuccugaauuaccuuaaggagaaggacguugccgaugggaacguguccgacuucgauaaugaagaggaggaacagagcgugccucccaaagucgacgagaacgauacccgcccugacguggaacccccucugccccuccaaauucagaucgccauggacguuauggagcggugcauucaucugcucuccgauaagaaucugcagaucagacuuaaagugcuggacguccuggaucucugugugguugugcugcagucucacaagaaccaacuucugccgcucgcucaccaggccuggccuagccugguccaccgccucacgcgggacgcgccccuggcugugcuuagagccuucaaaguucugcggacccugggauccaagugcggcgauuuucuccgcucuagauucuguaaagacgugcugcccaaacuugccgggagccuggucacacaggcuccuauuuccgcccgggcgggcccgguguauucucauacccucgcuuuuaagcugcagcucgccgugcugcaaggacuuggcccccugugcgaaagacuggaucucggggagggagaccugaauaaggucgccgaugcuugucuuaucuaccugagcguuaagcagccugugaaacuccaggaggccgcucgcuccguguuccugcaccugaugaaggucgaccccgauagcacaugguuucuccuuaacgaacuguauugcccugugcaguucacacccccucaucccucucugcacccgguucaacuccacggcgccuccgggcagcagaauccuuacacgacaaacgugcugcaacuucugaaagagcuccaguga

SEQ ID NO: 77411 - RNA, 1527 nt, Artificial Sequence
  derived and/or modified sequence opt5 from TTI2__Homo_sapiens__NP_079391
auggagcuggacagcgcccucgaagcucccucccaggaggauucuaaccugagcgaggaacuuucccacucugccuucggccaggcguuuagcaagauccugcauugccucgcuagaccugaagcccggcgcgggaaugugaaagacgccguccugaaggaucuuggagaccugauugaggcuaccgaguucgauagacucuuugaaggcacaggggcccggcugcgcggaaugccggagacgcugggccagguugcuaaagcccucgaaaaguacgcggcccccuccaaagaggaggaagggggaggcgacggccacucugaggcugccgaaaaggcugcccagguggggcugcuuuuccugaagcuccugggaaaaguggagaccgcgaagaacagccuugucggcccugccuggcagacagggcugcaucaccucgcuggacccguguauaucuuugccauuacccauucccuggaacaaccuuggacaacccccagaagccgggagguugcucgcgaggugcugacaucucuccugcaggucaccgaauguggcuccguggccggguuccuucacggagagaaugaagaugagaaaggcagacugagcguuauccucggccugcuuaagccugaccuguacaaagaaucuuggaagaacaauccggccauuaagcacguguuuuccuggacgcuccagcaggucacccggcccuggcugagccaacaucuggagcgcgugcucccugcuucucuggugaucuccgaugacuaucagacagagaacaaaauccuugggguccacugccugcaucacauuguucucaaugugcccgcggccgaucugcuucaguacaacagagcucaggugcuguaucacgccaucagcaaucaucucuacaccccugaacaccaucugauucaagccguccugcucugucugcuugaccuguuccccauccucgagaagacacugcacuggaaaggagauggcgcucggccgaccacgcauugcgacgaagugcugcgccuuauucucacacacauggagccugaacacagacugcugcuccggcgcaccuaugccagaaaccugcccgcguuuguuaaucggcuugggauccugacagugagacaucucaagcgccuggagcgggucauuaucggauaccuggagguguacgacggcccugaagaggaagcuagacuuaaaauccucgagacccugaagcugcucaugcagcacaccuggccccgcguuuccugucggcuggugguccuucugaaagcccuccugaagcugauuugcgauguggccagagaccccaaccuuacaccugagucugucaagagcgcucuccugcaggaagccacggauugucugauccuccuggaccgcugcucccaagggcgggugaaaggacuucuggcuaagauuccgcagagcugugaggauagaaaaguugugaauuauauccgcaagguccaacaggugucugaaggcgcccccuacaacggcaccuga

SEQ ID NO: 77412 - RNA, 2574 nt, Artificial Sequence
  derived and/or modified sequence opt5 from TTK__Homo_sapiens__XP_011534401
auggagagcgaagaccuguccggcagagagcucaccaucgauucuauuaugaacaaggugcgggacaucaaaaauaaguucaaaaacgaagaucugacagacgagcuuagccugaauaagauuuccgccgauacgaccgacaacucugggacagucaaucagaucaugaugauggcuaacaaucccgaagauuggcucagccugcuucugaaacucgagaagaacuccguuccucugucugacgcccugcucaauaagcugauuggacgcuacagccaagcgaucgaggcucugccgcccgauaaauauggccagaacgaauccuuugccagaauccaggugcgguucgccgagcugaaggcuauucaggaaccugacgaugcccgcgacuacuuucaaauggcuagagccaauugcaaaaaguucgcguuugugcacaucagcuucgcccaguuugagcucucucaggggaacgucaaaaaguccaagcagcugcuucaaaaagcuguggagcggggagccguuccccuggaaaugcucgagauugcucugcgcaaucugaaccuccagaagaaacagcugcuuagcgaagaggaaaagaaaaaucugucugccuccaccgugcucacagcgcaggagagcuucucuggcucccuggggcaucuucaaaacagaaacaauagcugugauucccggggacagaccacaaaggcccgcuuucuguauggcgagaacaugccuccccaggacgcugaaaucggcuacagaaauucucuccggcaaaccaacaaaacgaagcagagcugcccuuucgggcgcgucccggugaaucugcugaacucccccgacugugauguuaagaccgacgauagcguggucccuugcuuuaugaaaagacagacaucucgguccgagugucgcgaccucguggugcccggaagcaagccuucuggcaaugauagcugcgaacugagaaaccuuaaauccguccaaaauucucacuucaaggagccccugguuagcgacgaaaaauccagcgagcucauuaucaccgauucuauuacacugaagaacaagaccgaguccagccuucuggccaaacucgaagagacgaaggaauaucaggagccggaagugccugagucuaaucagaaacaguggcaguccaagcggaaaagcgaguguaucaaccaaaaucccgcugccuccucuaaccauuggcagaucccugaacuggccagaaaggugaauacagagcagaagcacaccacauuugaacagcccgucuucagcguguccaaacaaucucccccuauuagcaccuccaagugguucgacccgaaaagcaucugcaagacccccucuuccaacacacuggaugacuacaugagcuguuuucgcacgccuguugugaaaaacgauuucccgccugcuugccagcucucuacccccuaugggcagccggcguguuuucagcaacagcagcaucaaauucuggccacaccucuucagaaucugcagguccucgcuuccagcucugccaacgagugcaucagcgugaagggacggauuuacuccauccugaagcagaucggcagcgggggaucuuccaaaguuuuccaagugcugaaugagaagaaacagauuuacgccaucaaguaugucaaccuugaagaggcugacaaucagacccucgacagcuacagaaacgaaauugccuaucugaauaaacugcagcaacacuccgauaagaucauucgccucuacgacuaugagaucacagaucaguacaucuauauggugauggaaugcggcaacauugaccuuaauucuuggcuuaaaaagaagaaaagcaucgaucccugggagcggaaguccuacuggaaaaacaugcuggaggcgguccacaccauucaucagcacggcaucgugcauucugaccucaagccugcuaauuuucugauuguugaugggaugcugaaacuuaucgacuucggaauugccaaccagaugcaacccgauacgacaagcguggucaaggacucccaggugggcaccguuaauuacaugccucccgaagccaucaaggauaugucuagcuccagagagaacgggaaaagcaagucuaaaaucucccccaagagcgacguguggucucucggauguauucuguauuacaugaccuauggcaaaacaccuuuucagcaaaucauuaaucagaucuccaagcugcacgcuauuaucgaucccaaccacgaaaucgaguuccccgacauuccugaaaaggaccuccaggauguccugaaaugcugucuuaagcgcgacccgaaacagcggaucagcauucccgagcugcucgcccauccuuacgugcaaauccagacccaccccgugaaccagauggcuaaggggacaacggaggaaaugaaauauguucugggacagcuggucggccuuaauucuccuaacuccauucucaaggccgcgaagacccuguacgagcauuauagcggcggggaaucccacaauagcucuagcuccaaaacauuugagaagaaaagaggaaagaaauga

SEQ ID NO: 77413 - RNA, 1134 nt, Artificial Sequence
  derived and/or modified sequence opt5 from TTL__Homo_sapiens__NP_714923
auguacaccuucguggucagagacgagaacagcuccguuuaugccgaagugucucggcugcuccuggcuacaggccacuggaagcgccuuagacgggauaauccccgcuuuaaccugaugcucggggagagaaaucggcugccuuucggacgccuuggccaugaaccggggcuggugcagcucgucaacuacuauagaggagccgacaaacugugccggaaggcgagccuggugaaacucaucaagacgucccccgagcuggcugaaucuuguaccugguuuccugagagcuacguuauuuaucccacaaaucuuaaaaccccuguggcccccgcccaaaacggcauccagccuccgauuuccaauucucgcacagaugagagagaguucuuucuggcuagcuacaaccggaagaaggaagacggggaaggaaaugucuggaucgccaaauccagcgcuggcgccaagggcgaggggauucucaucucuuccgaggcgagcgaacugcuugauuucaucgacaaccagggacaggugcacguuauucaaaaauaucuggagcauccccuccugcuggaaccuggccaccgcaaguuugauaucagaucuugggugcucgucgaccaucaguacaauauuuaccuguaucgggagggggugcuucgcaccgccuccgaacccuaccacguggauaacuuccaggacaaaacaugccaccugaccaaucauuguauccagaaggaguauagcaagaacuacggaaaauaugaggaaggcaaugagauguuuuucaaggaauuuaaccaauaccucacgucugcucugaacauuacccuugaguccagcauccugcuccagauuaaacacaucaucagaaauugccugcuguccgucgaaccugccauuucuacaaagcaucuccccuaucagagcuuccagcuguuuggguucgauuucaugguugacgaggagcuuaaaguguggcugaucgaagugaacggagcuccggccugugcgcaaaagcucuacgccgagcugugccagggcauugucgauaucgcuauuuccagcguguuuccucccccugacguugaacagccccaaacccagcccgccgcuuucaucaaacuuuga

SEQ ID NO: 77414 - RNA, 1578 nt, Artificial Sequence
  derived and/or modified sequence opt5 from TTLL10__Homo_sapiens__XP_011539472
auggaccacagcugcaccagauucauccaucggcgcgggcccccuacaagaacgcgggccggguuuaagcgcggaaaaagaccgcggauucagcaacgccccagagcucggguguccggcaccaucccugccucucgccugcaccccgcgccugcuagccagcccgggccuuguccggcccccggacauugcccugucggccccgcccacgagagaccuaugggguccucucaggaagagggacuccggugucagcccagccaaccggaucaugacgcugauggccacugcggcccugaccuggaaggggccgagcgcgcuuccgccacacccggaccucccggccuucugaacucucacagacccgcggauagcgacgauaccaaugccgcugggccuuccgccgcucuccuggaaggacuucugcucggcgggggaaagccgagcccccauucuacacggccuggccccuucuuuuacauuggcggguccaacggagccaccaucauuagcucuuauuguaaauccaagggcuggcagcgcauccacgacagcagacgggaugacuacacacugaaauggugcgagguuaagucuagagauuccuaugggagcuuccgcgagggagaacagcugcucuaccagcugccuaauaacaaacuucugaccacgaagaucggccuccuguccacccuucgggggagagcgcgcgccaugucuaaggcuagcaaagugcccggaggcgugcaagcccggcuggagaaggacgcugccgccccggcucucgaagaucugccuuggacaucccccggcuaucugagaccucagcgcguccuccggauggaggaguuuuuccccgaaaccuacagacuggaccuuaaacaugagcgcgaagcguuuuucacacuguuugacgagacccagauuuggaucuguaagccuacggccagcaaucaggggaagggaauuuuccuccugcggaaccaagaagagguggcugcccuucaggccaaaacaagaucuauggaggaugaccccauccaccacaagaccccguuucgcggcccucaggcucggguugugcaaagaugcgggggaggcugucccgaaggguauauucagaauccccugcucgucgauggccggaaauucgacgugcgcuccuaccugcugaucgccugcacaaccccuuacaugaucuuuuucggacauggcuaugcgagacucacccugagccuuuacgauccgcacucuagcgaccugggcggacaucucacaaaccaguucaugcagaagaaaucuccccuguauaugcuucugaaggagcacacgguuugguccauggaacaucucaaucgguacauuagcgauaccuuuuggaaagcuagaggccuggccaaggacuggguguucacaacccugaagcgccucuguucccugagcuggcaaugccuuucuccugccgcuuccaaagggcccgauggaaagccuagccggggcucugucgggacaucccccgccggcagccuggcugugggauccggcgacucuagcgccuccgugaccgcgacgauguga

SEQ ID NO: 77415 - RNA, 2403 nt, Artificial Sequence
  derived and/or modified sequence opt5 from TTLL11__Homo_sapiens__NP_001132914
auggccgcugccgcgagcgugaccggcagagucacaugggcugccucccccaugcggucucuggggcucggacgcagacugagccuuccuggcccgcggcuggacgccguuacggcugccgugaaccccucccucucugaucacgggaauggacugggccgcgggaccagaggaagcggcugcuccggcgggucucuuguggcugacuggggaggcggggccgcggccgcugccgcugucgcccuggcgcucgccccugcucugagcacaaugcggcgcggauccagcgagucugaacuggccgcuagaugggaggccgaagccguggcugcggccaaggcugccgccaaagcugaggccgaagcgaccgcugagacaguugccgaacaggugcgggucgaugccggcgcugccggggaacccgaguguaaggcuggagaggagcaaccuaaagugcucgcccccgcgccugcccagccguccgcugccgaggaaggcaacacccagguucugcagagacccccucccacacuuccucccagcaagccgaaaccugugcaaggccugugcccccaugggaagccucgcgacaagggacggucuuguaaacgcuccagcggccacgggucuggagagaauggcucccagagacccgucaccguggauagcuccaaggcucggacgucucucgacgcccugaaaaucagcauucgccagcuuaaguggaaagaguuccccuuugggagacggcugccuugcgauaucuacuggcauggaguguccuuccacgacaacgauauuuuuagcggccaggucaauaaguucccgggcaugaccgagaugguuagaaagaucacacucucucgcgcggugcggaccaugcaaaaccuguuucccgaagaguauaauuucuacccuagauccuggauucugcccgacgaguuucagcuuuucguggcccagguccagauggugaaagaugacgauccuagcuggaagcccacauuuaucguuaaaccggacgggggaugucaaggcgacgggaucuaucugauuaaggauccuucugacauccgccuugcuggaacccugcagagccggcccgccgugguccaggaauacauuugcaaaccucuccugaucgauaagcucaaauucgacauuagacuguaugugcuccugaagucccuggauccccucgagaucuacauugcuaaggacggccugucucgcuuuuguacggaaccuuaucaagagcccacaccgaaaaaccuucaucggaucuucaugcaccugaccaauuacagccucaacauccacuccgggaauuuuauucauagcgauucugccuccacaggcagcaagagaaccuucucuuccauccugugccgccuuagcuccaaaggaguugacauuaagaaaguguggucugauaucauuagcgucgugaucaagaccgucaucgcccugacaccugaacucaagguguucuaccaguccgacauucccacgggccggcccgggccuaccuguuuucagauccugggauucgauauucugcucaugaaaaaccugaagccgauccuucuggagguuaaugcuaaccccucuaugagaauugagcacgaacaugagcucagcccuggcguguuugaaaauguccccucccugguggacgaggaaguuaaaguggcggucauccgcgacacacugcggcuuauggauccucucaagaaaaagagagagaaccagagccaacagcuggagaagcccuucgccgggaaagaagacgcucuggauggagagcucaccucugccccugacugcaacgccaaucccgaagcucaucugccguccaucugucuuaaacagguguuuccuaaguaugccaagcaguucaacuaccugcggcucguggaucgcauggcgaaucuguuuauuagauuccugggcaucaaagggacaaugaaacuuggccccaccggauuucggacguucauuagaagcugcaagcucucuuccagcucucugagcauggcugccguugacauccuguauauugauaucacacgccgguggaacuccaugacccucgaccaaagagauagcggcaugugccugcaggccuuugucgaggcuuucuuuuuccuugcccagcgcaaguucaagaugcugccucuccacgaacagguggcgucucugauugaccugugugaauaccaccuuucccuccuggaugagaaaagacuggugugcgggcggggaguccccagcggcgggcgcccgccucacagaggacccccucaagaacccucccccucugcucagccugccggcgacaauccgcccccucggaccagcugugccaacaagcucucccauccccgccacacacugucuuga

SEQ ID NO: 77416 - RNA, 1935 nt, Artificial Sequence
  derived and/or modified sequence opt5 from TTLL12__Homo_sapiens__NP_055955
auggaggccgaaagaggccccgagcggcgcccugcugaaagaagcuccccggggcagacccccgaggaaggagcccaagcgcuggcugaguucgccgcccuccacggcccugcucugcgggccucuggggugcccgagcgcuacuggggaagacuucugcauaagcucgaacacgaggucuuugacgcuggcgaaguuuucgggaucaugcaaguggaggagguggaagaggaagaggaugaagccgcgcgggagguccgcaaacagcagccuaaccccggaaaugagcugugcuauaaggugauuguuacaagagaaagcggccuucaggccgcucauccuaacuccaucuuucugauugaccacgccuggacgugucggguggagcaugcucgccagcagcuccagcaagucccgggccugcugcacagaauggccaaucucauggggaucgaguuccacggagaacugcccucuaccgaagcgguggcccuuguucuggaggagauguggaaauuuaaccagacauaccagcucgcucauggcaccgccgaagagaagaugccugugugguauauuauggaugaguucgggagccggauccagcacgcugacguccccuccuuugccacagccccuuucuuuuacaugccccaacagguggcuuauacccugcuuuggccgcugcgcgaucucgacacaggagaagaagugaccagagauuucgcguacggcgagacggacccucugauccggaaaugcaugcugcuccccugggccccuaccgauaugcuggaccuuucuagcuguacacccgagcccccugcugaacauuaucaggccauucuggaggaaaauaaggagaagcucccgcuggauaucaaccccgucguucacccucacgggcauauuuuuaaaguguacaccgacgugcaacaggucgccuccagccuuacacacccccgcuucacccugacgcagucugaggcugaugccgacauccucuuuaauuucucccauuucaaggacuacagaaaacugagccaggaacggccuggagugcugcucaaccaauuucccugcgagaaucugcuuacaguuaaggauugucuggcgucuauugcuagacgcgccggcggcccggaagggccucccuggcucccucggaccuucaaccugagaacagagcuuccccaguuuguguccuauuuccagcagcgcgaacgguggggagaggacaaucacuggaucugcaaaccuuggaaccuggccagaagccucgauacccaugucaccaagucucugcacuccauuauccgccaccgggagagcacacccaaggugguuuccaaauacaucgaaucuccggugcuguuucucagagaggacgucggcaaggugaaauucgauauucgcuauaucguccugcuucggagcgugagaccucugcgccucuuuguuuacgacguguucuggcugcgguuuuccaauagagcuuucgcccugaacgaucuugacgauuaugaaaagcauuuuacggucaugaauuacgaccccgaugugguucucaaacaagugcacugugaggaguucauucccgaauuugagaagcaguauccugaguucccguggaccgacguccaggcugaaaucuuccgggccuuuacagaacuguuccagguggcgugcgccaaacccccuccccuggggcucugugacuacccuagcucucgcgcuauguacgccguggaucugaugcuuaagugggacaacggacccgauggcagacggguuaugcaaccucagauucuggaggucaacuuuaaucccgacugcgaaagagcuugucgcuaucauccgaccuucuuuaacgauguguucuccacacucuuucuggaccagccugggggaugccacgugaccugccuggucuga

SEQ ID NO: 77417 - RNA, 1272 nt, Artificial Sequence
  derived and/or modified sequence opt5 from TTLL1__Homo_sapiens__NP_036395
auggccggcaaggugaaaugggucaccgacaucgaaaagagcguucugauuaacaauuucgagaaaagaggguggguccaggugacagagaacgaagauuggaauuuuuacuggauguccgugcaaacgauccggaacguguucucuguugaggcuggauaucgccucagcgacgaucagauugugaaucacuuucccaaccauuacgaacugaccagaaaggaccuuauggucaaaaauaucaagcgguaucgcaaggagcuggagaaagaaggcuccccucucgccgagaaggaugaaaacgggaaauaccuguaucuugacuucgugccgguuacauacaugcugcccgcggauuauaaucucuuuguggaggaguucagaaagucuccuagcuccaccuggauuaugaaacccugcggaaaggcucagggcaaggggaucuuucugaucaacaaacugucucagauuaagaaauggagccgggacuccaagacaagcucuuucgucucccaaagcaauaaagaagccuacgugaucucucucuacauuaacaauccucugcuuaucggaggccgcaaguuugaucugagacucuaugugcuggucuccaccuaccggccccuucgcuguuauauguacaaacugggcuucugcagauuuuguacaguuaaguauaccccuagcacgucugagcucgacaacauguucgugcaccugaccaauguggccauucagaagcauggggaagauuacaaccacauccauggaggcaaauggacagucuccaaccugcggcucuaucuggagagcacccgcgggaaggaagugacauccaaacuuuuugacgagauucacuggaucaucguucagucucugaaggcuguggccccggucaugaauaacgauaaacacugcuucgaguguuacggauacgacauuaucauugacgauaagcucaagcccuggcugaucgaagugaaugcuagcccuucccuuaccagcucuacggccaacgaccggauucugaaauauaaucucaucaacgauacacugaauaucgcgguucccaacggcgagauuccugacugcaaguggaauaaauccccgcccaaggaagugcuggggaacuacgagauccucuaugaugaggaacuggcccagggagacggcgcugauagagagcuucgcagcagacaaggccagucucuggggccucgggccggaagaagccgcgacuccggccgggcuguccucaccacauggaaauga

SEQ ID NO: 77418 - RNA, 2748 nt, Artificial Sequence
  derived and/or modified sequence opt5 from TTLL3__Homo_sapiens__NP_001021100
augcagggccccgacgccccucugcuccugagcgcuagagaacuugggccgggacggcgcggcuccgccucuugguacagacaagaagggggagcggugugcaacuggcugcggaagccccagccucucgagccccgcaccagcuucccuuccgcuagacggucugaauuuagacccccucgccggcugccgugggccggccccgccagcgcucaguccgaggaagggcacgccggaggccgcugucaggcuggcucuccugcccccgcgagacggcuuagcggggccuucaaaacacuggucccuggaacgcaugcucaaggcgccuccgauacccacccccucgggccgccucauacacccguucuggacccuagcccccaggauggauuucccgugcuguggcgcgggucuuccaaggcuagccacaugaauagacuccggaacgccaaaaucuauguggagcgcgcggucaagcagaaaaagauuuucaccauccagggcugcuacccugugauuagaugucugcuucggagacgcggauggguugagaagaaaauggugcaucggucuggcccgacacugcuucccccucaaaaggaccuggauuccagcgccaugggcgacucugauaccacagaagacgaggaugaagacgaggaugaggaauuucagcccucccagcuuuucgacuuugaugaccugcucaaauucgacgaucuggacgggacccacgcucugauggucggacucugccugaaucuuagaaaccugccuugguuugaugagguggacgccaauagcuucuuuccccgcuguuauugccucggcgcugaagaugacaagaaagccuucaucgaggauuuuuggcugacggccgcucggaacguucuuaagcugguggucaaguccgaauggaaaucuuacccgauucaggcgguggaggaggaagccagcggggacaagcaaccuaaaaagcaggagaaaaaucccgugcucgucuccccugaguucguugaugaagcucugugugccugcgaagaguaucugagcaaccucgcccacauggacaucgauaaggaccuggaggcuccccuuuaccugaccccugaaggauggucucucuuccugcagagauauuaccaaguggugcaugagggcgccgaacuucgccaccuggacacacagguccagcggugugaggauauccuccagcaacugcaggcggugguuccccagauugacauggaaggggauagaaauaucuggauugugaaaccgggagcuaagucccgcggccggggcaucaugugcauggaccaucuggaggagaugcucaagcuggucaacgggaauccugugguuaugaaagauggaaagugggugguccagaaauacauugaaagaccccuucugaucuuuggcaccaaguucgaccuccgccaaugguuucuggugacagauuggaacccccugaccgucugguucuaucgggacagcuacauuagauuuucuacgcagccuuucagccuuaaaaaucucgauaacuccgugcaccuguguaauaacucuauccagaagcaccuggagaacagcugccaucggcacccgcuccugcccccugacaauaugugguccagccagcgcuuucaagcccaucuucaggaaaugggggcccccaacgcuuggucuacaaucauuguuccuggaaugaaggaugccgugauccacgcucugcagaccucccaggacacaguccaaugcagaaaagccagcuucgagcucuauggcgcggauuuuguguucggggaggacuuucagcccuggcugauugaaaucaaugccucuccuaccauggcucccuccaccgccguuacagcucggcugugugccggcgugcaggcggacacgcuuagagucgugauugaucgcaugcucgaccggaacugcgauaccggagccuucgagcugaucuacaagcaaccggcuguggaaguuccucaguaugucggcaucagacugcucguggagggguuuacaauuaaaaagcccauggccaugugucaucgcagaaugggagugcggccugcugucccccugcuuacccagcgcggcagcggggaagccagacaccacuucccgucccugcauacaaaagcccagcucccuucuccccacgugcugcggcaucaaggacagguucugcgcagacagcacagcaagcucgugggcaccaaggcucucuccacgacagggaaagcgcugcggacccugccuaccgccaaggucuucaucucucucccucccaaucuggacuuuaaaguggcucccagcauucuuaagccgcgcaaagcccccgcccugcucugccugagaggcccucagcuggagguucccuguugccuuuguccucucaaguccgagcaauuccuggcucccgugggacggagccgcccuaaggccaacucuagaccggauugcgacaaaccccgggcggaggcuuguccuaugaagagacugagcccccucaaaccucugccccuugucggcacauuucagcgccggagagggcugggagauaugaagcucggcaaaccgcugcugcgcuucccuaccgcccuugugcuggaccccacacccaauaagaaaaagcagguuaaguaccucgggcuggauuccaucgccgugggaggcucucgggucgacggggcuagaccuugcacgcccggcuccaccgcccgcgcguga

SEQ ID NO: 77419 - RNA, 3600 nt, Artificial Sequence
  derived and/or modified sequence opt5 from TTLL4__Homo_sapiens__NP_055455
auggccagcgcuggcacccagcacuacuccaucgggcugagacaaaagaacucuuucaaacagagcggacccuccggcacagugccugccacgccgcccgagaagccuucugaagggcgggucuggccccaggcgcaucagcaaguuaaaccuauuuggaagcucgagaaaaagcaaguggaaacccugagcgcuggacuuggccccgggcugcucggagugccuccgcagcccgccuacuuuuucugcccuuccacacuguguucuagcggcaccacagccgucaucgcuggccacuccagcucuugcuaucuucauucccugcccgaccucuuuaauagcacccugcuguaucgcagaucuuccuaccggcagaagccuuaucagcagcucgagagcuucugucugagaucuucccccagcgaaaaauccccguuuucucuuccucaaaagagccugcccgugucccucacagccaacaaagcuaccagcucuaugguuuucuccauggcccagccuauggcgagcucuagcacggagcccuaccugugccuugccgcugccggggagaaucccuccggaaagucucuggcuagcgccauuuccggcaaaaucccuagcccgcucucuuccagcuauaagcccaugcugaacaauaacucuuuuauguggccuaauuccacccccgugccucugcuccagacaacccaggggcugaagcccgucagcccgccuaaaauucagcccguguccuggcaccauucuggaggcacaggggauugugcgccucaacccguugaccacaaggugccuaaaagcaucggaaccguccccgccgaugcuuccgcccacaucgcucuuucuacggccagcucccaugacacaagcaccacaucuguggccuccagcugguacaacagaaauaaccuggcuaugcgggcggaaccgcucucuugcgcccuggaugacuccagcgauucucaggacccuaccaaggagauucgcuucaccgaagcugugagaaaacuuacagcccggggcuuugagaagaugccccgccagggcugucagcuggagcaaagcuccuuccucaaucccagcuuucaguggaacguccugaauagaucucggcgcuggaaaccuccggccguuaaccagcaguucccccaagaagaugcuggguccgugagacgggugcugccuggagccagcgacacgcucggccuggauaauaccgucuuuugcacaaagcgcaucuccauucaccuucuggcgucucaugcuagcgggcucaaccacaaccccgccugugaguccgugaucgacucuagcgccuucggagaaggcaaggcuccugggcccccuuucccccagacccugggaauugccaauguugcuacaagacuuuccucuauccagcugggccagagcgagaaagaacggccggaggaggccagagaacucgauuccagcgaccgcgacauuucuuccgcgaccgaucugcaaccugaccaggccgagacggaagauacagaggaggaacugguggacggccucgaggauugcuguagccgggacgaaaacgaggaagaggaaggggauucugagugcuccagccugucugcugucucccccagcgaguccguggccaugaucagcagaucuugcauggaaauccuuaccaagccucugagcaaucacgagaaaguugugcgccccgcucucauuuacucccuguuuccgaacgucccucccaccaucuauuucggaacacgggacgaaagaguggagaagcugccuugggagcagcgcaaacuucuccgguggaagaugucuaccgucacacccaauauugugaagcagacgaucggcagaagccauuuuaaaauuuccaagcgcaacgaugacuggcugggguguuggggacaccauaugaaaucucccagcuuccgguccaucagagaacaccaaaagcugaaucauuuuccuggcucuuuccagaucgggcgcaaagaucggcucuggagaaaccugagccggaugcagucccgcuuuggcaagaaggaguucagcuuuuucccgcaaucuuuuauucuuccccaggacgccaaacugcucagaaaggcgugggaauccagcucucggcagaaauggaucguuaagccucccgccuccgcuagaggaauuggcauccaggugauucacaaauggagccaacugccuaagcgccggccccugcuuguccagagauaccuccacaagccuuaucugaucuccgggucuaaauucgaccugcgcaucuacguguauguuaccagcuacgauccgcucagaauuuaucuguuuuccgacggacuugugcgguucgccagcugcaaguacucucccuccaugaaaagccugggcaauaaguucaugcaucucacaaacuacucugucaauaaaaagaacgcugaguaucaggccaaugccgaugaaauggcuugucaggggcacaaaugggcgcugaaggcccuguggaacuaccuuagccaaaagggagugaauagcgacgcuaucugggagaaaauuaaggaugugguugucaaaaccaucauuucuagcgagccuuaugugacaucccuccugaagauguacgugcgcagacccuauucuugccaugaacuguuuggcuucgacaucaugcucgaugagaaccugaaaccuuggguccuugaagugaacauuagccccucccugcacuccucuuccccgcucgacaucagcaucaaggggcagaugauucgggaucugcugaaucuugccggcuuuguucucccuaacgccgaggacaucauuuccucucccagcuccuguucuagcuccaccacgagccugcccaccucuccuggagauaagugccgcauggcucccgaacacgugacagcccagaaaaugaagaaagcguacuaucugacccagaagaucccugaccaagauuucuacgcuuccguccucgacgugcugacaccggacgauguucgcauucuuguggagauggaggacgaauuuagccggcgcggccaguucgagagaaucuuucccucucauaucuccagccgguaccugcgcuucuuugaacagccuagauauuucaauauucucaccacgcaaugggagcagaaauaccacgggaacaagcugaagggagucgaucugcuucggucuugguguuauaaaggcuuucauaugggggugguuagcgacuccgcccccguguggucucugccuacaagccuccugaccaucuccaaggaugacgucauucucaaugccuucagcaaauccgaaacaucuaagcugggaaaacagagcuccugcgaggugucucuucugcucagcgaggauggcaccacccccaaguccaagaaaacacaggcugggcugucuccguacccucaaaagcccagcuccagcaaagacucugaagauacguccaaggagccuagccugucuacccagacacuucccgugaucaaauguuccggccagaccagcagacugucugccuccagcacauuucaguccauuagcgacucucuccuggcggucagcccuuga

SEQ ID NO: 77420 - RNA, 3846 nt, Artificial Sequence
  derived and/or modified sequence opt5 from TTLL5__Homo_sapiens__NP_055887
augcccaucgugauggccagagaccuggaggaaaccgcuagcuccucugaggaugaagaggucauuagccaggaagaccacccuugcaucauguggacaggcgggugucggcgcauuccgguucucguguuccaugccgaugcgauccugacgaaggacaacaauauuagagugaucggagagcgguaccaccuuuccuauaaaaucguccgcaccgauucuagacuggugcggagcauucucacagcucauggcuuucacgagguucaucccuccucuaccgacuacaaccugauguggacagggagccaccuuaagccuuuccugcuccgcacccuguccgaagcccaaaaagugaaucacuuucccagaagcuaugagcugacacggaaggaucgccucuacaaaaacaucauuagaaugcagcauacccacggauucaaggccuuucauauccugccucagacguuccuucugcccgcugaauaugccgaguuuugcaauucuuacuccaaggaccggggcccuuggauugucaaaccgguggcuagcucucgcgggagaggaguuuaucucaucaacaaucccaaccagauuucccuggaggaaaauauccuugugagccgguacaucaacaauccucugcucauugaugacuucaaguuugauguccgccuguacgugcuggugaccucuuaugacccccucgucaucuaccuguaugaggaaggccuugccagauucgcgacaguucgguacgaucaaggcgccaaaaacauuagaaaucaguuuaugcaccugaccaacuauuccgugaauaagaaaagcggggacuacguguccugugacgauccugaggucgaagacuauggaaacaaguggucuaugagcgcuaugcuccgcuaccugaagcaggagggccgggauacaaccgcccuuauggcucacguggaggaccugaucauuaaaacgaucaucuccgccgaacucgcgauugccacagcuugcaagaccuucguuccccauagaagcucuuguuuugagcuguacggguucgaugugcugaucgacuccacacucaaaccguggcugcuugaagucaaccugagcccuucucucgccugcgaugcuccccuggaccuuaagauuaaagccagcaugaucuccgauauguucaccgugguuggauuugugugucaggacccugcccaacgcgcuucuacccggcccauuuaucccacauucgagagcuccagacgcaauccuuuucagaagccgcagcggugcagaccccugagcgcgucugaugccgaaaugaaaaaccucgucggcuccgcucgcgagaaggggccuggaaagcugggcggcagcgugcuggggcucucuauggaggaaaucaaaguccugcggagagugaaggaggaaaaugaccgccggggaggcuucaucagaauuuuucccacguccgagaccugggaaaucuacgggagcuaucuugagcacaaaacauccaugaacuacaugcuggccacccggcuuuuccaggaccgcaugacagccgauggagcuccugagcugaagauugaaucucugaauagcaaagccaagcuccaugcggcucucuaugagagaaagcugcugucccucgaaguucggaaaagacgccggagaucuagccgccugagagccaugcggcccaaguacccggugaucacccaaccugccgagaugaacgucaaaacggagacagaauccgaggaagaggaagagguggcucuugacaaugaggaugaggaacaggaagccagccaggaggaaucugcuggcuuucugcgcgagaaccaagccaaguauacccccucccucaccgcgcugguugagaauacaccuaaagaaaacagcaugaaggugagagaguggaauaacaaagggggacacuguugcaagcuggaaacccaggagcuugaacccaaguucaaucucaugcagauucugcaggacaacggcaaucugucuaaaaugcaagcccggaucgcuuuuuccgccuaccuccagcauguccagauucgccugaugaaggauagcggcgggcagacauucucugcuagcugggccgcgaaagaggacgagcaaauggaacuuguggugagauuucugaagcgggccuccaacaaccuccagcacagccugcgcaugguucugccuucuagacggcuugcucuccuggagcgcagacggauccuggcccaccagcucggagauuucaucauugucuacaauaaggaaacggagcagauggcugagaaaaaguccaaaaagaaaguggaagaggaagaggaagacggcgugaacauggagaauuuucaagaguucaucagacaggccagcgaagccgagcuggaagagguccuuaccuucuauacacagaagaacaaauccgcuucuguguuucuggggacccauagcaagauuuccaagaauaacaauaacuacucugauagcggagcgaaaggcgaccaccccgaaacaaucauggaggagguuaagauuaaaccgccuaagcagcaacagaccacggaaauccauuccgauaaacucucucgcuucaccacaagcgccgagaaggaagcuaagcugguguauuccaauucuagcuccgggcccaccgccacacugcagaaaauccccaacacccaccuuagcucugucacgacauccgaccucagcccuggcccgugucaccauucuucccugagccaaauucccuccgccaucccuagcaugccccaccagccuaccauucugcucaauacagugucugcuagcgccucccccugccugcauccuggagcgcagaacauccccucuccgaccggccuuccucggugcagaagcgggucccacaccauuggacccuuuucuagcuuccaguccgcugcccauaucuacucucaaaagcugagccgcccuuccagcgccaaagcuggcucuuguuaucucaauaagcaccacuccgggaucgccaaaacacagaaggagggagaagaugcgagccuguacucuaagcgguauaaccaguccaugguuacggcugagcugcagagacuugccgagaaacaagccgcucgccaguacagccccuccucucauauuaaucugcucacccaacaggugacaaaccugaaccucgccaccggcaucauuaaucggagcuccgcuagcgccccgccuacacugagacccaucauuucuccuuccgggcccaccuggagcacgcagucugacccccaggcgccugaaaaccacagcuccucuccgggcagccgcucccuucagacaggaggcuuugccugggagggggaagucgagaauaacguguacucucaagcuaccggaguugugccccagcauaaguaucacccuaccgccggcagcuaccagcugcaguucgcucuccaacagcuggagcagcagaaacugcaaucccggcagcuucuggaccagagcagagcccggcaucaggccaucuuugggucucaaacacuccccaauuccaaccuguggaccaugaauaacggagcuggcugccgcaucagcuccgcgacagccucugggcagaagccuacgacccucccccagaaagucgugccuccgcccagcuccugugcuucucuggugccuaagcccccucccaaucacgaacagguccuuagacgggccacaagccaaaaggccuccaaaggcagcucugcugagggacagcugaacggccuccaguccagccugaauccggccgcguucguuccuauuaccucuuccacagaucccgcucacaccaagaucuga

SEQ ID NO: 77421 - RNA, 2676 nt, Artificial Sequence
  derived and/or modified sequence opt5 from TTLL6__Homo_sapiens__NP_001124390
augggcgcccugcuccugcaccccagcagacgggggccugcuggaguggucgccuccuggaccucuagcccggcgggccgcgacgggggaguuggcaucgcuggggccugguacuuccccagagccuccucucaggcucgggagaugccucaaugccccacacuugaaagccaggagggagaaaacuccgaggaaaagggcgauucuagcaaagaggacccuaaggagacgguggcccuggcuuuugugcgcgaaaaucccggcgcccagaacgggcuccagaaugcgcaacagcaggggaaaaagaaaagaaagaagaaacggcuggucauuaaccuuuccagcugucgcuaugagucugugagacgggccgcucagcaauacggcuuccgcgaagggggagaggaugacgauuggacccuguauuggacagacuacuccguuagccucgagagagugauggaaaugaagucuuaucagaaaaucaaucauuuuccuggcauguccgagauuugccggaaggaucugcuggcccgcaacaugagcagaaugcucaaaauguucccgaaggacuuucgguucuuuccccgcaccuggugucugccugcugauuggggagaccuucagacauacucuagaucccggaagaauaaaaccuauaucugcaagcccgauagcggaugucagggcaaaggcauuuucaucacaagaaccgucaaggaaaucaaaccuggggaggacaugauuugccaacuguacaucuccaagcccuuuauuaucgauggauucaaauuugaccuccgcauuuacgugcugguuacgucuugugacccgcuucggaucuucguguauaacgaaggccuggccagauuugcgaccacaagcuacucccgcccuugcaccgauaaucucgacgauauuuguaugcaccugacaaacuauagcaucaauaagcauucuuccaacuucagccgggacgcccacucugggagcaagagaaaacuguccaccuucucugcuuaccucgaggaucauagcuauaaugucgagcagaucuggcgcgacauugaagaugugaucauuaagacgcugaucuccgcccaccccauuauccggcacaacuaccauacaugcuuuccuaaucacacccuuaacagcgcuuguuucgagauccugggauuugacauucuccuggaucauaaacuuaagcccuggcugcucgaagugaaccacucucccuccuucagcacagacucuagacuggauaaagaggucaaggacggccugcucuaugacacccugguucuuaucaaucuggaauccugcgauaagaaaaaggugcucgaggaggaacgccagcgggggcaauuucugcagcagugcuguagcagagagaugcgcauugaagaggccaaaggauuccgggccgugcagcuuaagaaaaccgaaacauacgagaaggagaacugcggcggcuuuagacugaucuacccuucccucaauucugaaaaguaugagaaauucuuucaagacaacaauagccuguuccagaacacggucgcuucccgggcgcgcgaagaguacgccagacagcugauucaggagcuccggcugaagagagagaaaaagccguuucaaaugaaaaagaagguggaaaugcagggggaaucugcuggagagcagguucgcaaaaagggcaugcggggguggcagcaaaaacagcagcagaaggauaaagccgccacccaagcuagcaagcaguauauccagccccuuacacugguguccuacaccccugaccuccugcugagcgucagaggagaacgcaaaaaugagacagauucuucccuuaaccaagaggcccccaccgaagaggcgagcucuguguucccuaagcucacguccgcuaagcccuuuagcucucugccggaccugagaaauaucaaccucagcuccagcaaacuggaaccuucuaagcccaauuucuccauuaaagaggccaagagcgccuccgcuguuaacguguucacaggcaccguccaccuuaccucuguggaaacaaccccugagagcacaacgcagcuguccaucucucccaaaagcccucccacccucgccgucacagcuuccucugaguauagcgggccggaaaccgaucgggugguuuccuuuaaguguaagaaacagcagacaccuccccaucugacccaaaagaaaaugcuuaagagcuuccugcccacgaaaucuaaguccuuuugggagagcccuaauaccaacuggacacuccugaagucugacaugaauaaaccgcaccugauuuccgaacuccugaccaaacuucagcugagcggcaaacucucuuucuuucccgcccauuacaacccuaagcugggaaugaacaaucugucccagaaccccagccuuccuggcgagugccacucccgcagcgauucuagcggggaaaagagacagcucgacguguccucucugcugcuccaaagcccccaguccuauaaugucacacugcgggaucuucuggugaucgcgaccccugcccagcucgacccccgcccguguagaucucaugcuagcgccaugcgggauccuugcaugcaggaccaagaggcuuacucccacugucugauuucuggacagaagggcugcgagcgcagcuga

SEQ ID NO: 77422 - RNA, 2490 nt, Artificial Sequence
  derived and/or modified sequence opt5 from TTLL7__Homo_sapiens__XP_011540457
augcccagccugccucaggagggcgugauccaagggccgagcccccucgaccugaacaccgaacuuccuuaccagucuacaaugaagagaaaaguccggaagaaaaagaaaaagggaacgauuaccgccaauguugcuggcacaaaguucgagaucgugcgccuggugauugaugaaaugggguuuaugaaaacccccgacgaggaugaaacaagcaaccucaucuggugcgacuccgccguccagcaggagaagauuucugagcugcaaaauuaucagagaaucaaccacuucccuggaaugggcgaaaucugucggaaagauuuucuugcgcgcaauaugaccaagaugauuaaaagcagaccccuggacuacacauucgugccucggaccuggaucuuuccggcugaguauacgcaguuccagaacuacguuaaggaacucaagaaaaagcgcaaacaaaagaccuuuauugugaaacccgccaauggggccaugggacauggcaucucccugauuagaaacggcgauaagcugccuucucaggaccaccucaucguccaggaguauauugagaaacccuuccugauggaaggguacaaguuugaucuucggaucuauauccuggugacaagcugcgacccucucaagauuuuccuguaccaugauggacuuguucgcaugggcaccgagaaauacauucccccgaaugaauccaaccugacacagcucuauaugcaccugaccaauuacagcgugaacaagcauaaugagcacuuugaaagagacgagacggagaacaaagggucuaagcgguccaucaaaugguucacagaauuucugcaagcuaaucagcacgaugucgccaaguucuggagcgacaucucugagcucguggugaagacccugauugucgcugaaccucauguucuucacgccuaucgcauguguagacccggacagccucccggcuccgagagcgugugcuucgaagugcugggguuugacauccuccuggaucggaaacuuaagcccuggcugcucgagaucaaccgcgcgccuucuuucggaacagaccagaaaauugauuacgacgucaagagaggcgugcugcugaacgcccucaaacugcuuaauauccggaccuccgauaagagacgcaaccuggcuaagcaaaaagccgaggcucagcggagacucuauggccagaauagcauuaagcgccugcuuccgggguccucugacugggaacaacagcggcaucagcuggagagacgcaaagaggaacucaaggaacggcuggcccagguuagaaaacaaaucagccgcgaggagcacgaaaaccggcacaugggaaauuacagacgcauuuaucccccugaggauaaggcgcugcucgaaaaguacgagaaccugcuugccguggcuuuucagaccuuccuguccggccgggccgcuagcuuucagagagagcucaauaacccccugaaacggaugaaggaagaggacauccuggaucuucucgaacagugugagaucgacgaugaaaaacugauggggaagacaacgaaaacccgcggaccuaagccccugugcucuaugccggaguccacagagauuaugaaaagaccuaaguacuguagcucugacagcuccuaugacucuagcuccuccucuuccgaaagcgaugagaaugaaaaggaggaauaccaaaacaaaaagcgggagaaacaggucaccuauaaucucaagcccucuaaccauuacaaacugauccagcagccuuccagcauuagacgcuccgugucuugcccccggagcaucuccgcccaaucuccuagcuccggcgacacaagacccuucagcgcccagcagaugauuucuguuucccgcccgaccagcgcuucuagaucccacagccuuaaucgggcgucuagcuauaugcgccaucugccucacuccaacgaugccuguagcacaaauucucaaguguccgagagccucagacagcugaagacgaaggaacaggaggacgaucugaccucccagacccuuuuuguccucaaagacaugaagauccgguuccccgggaaaucugaugcugaaagcgagcugcugauugaagacaucaucgauaacuggaaguaccauaaaacaaagguggccuccuauuggcucauuaagcuggacucugucaaacaacgcaaggugcuugauaucguuaaaaccagcauuagaacagugcugccccggaucuggaaggucccugacguggaggagguuaaccucuaccgcauuuuuaauagaguguucaaccggcugcuguggucccgcggacagggccuuuggaauugcuuuugugauucuggcuaccuccugccggggagcacgcaguucuuucugagaacccccacauauaaccucaaauacaauuccccuggaaugacccggagcaacguccuguucacaucuagauauggccaccuuuga

SEQ ID NO: 77423 - RNA, 2424 nt, Artificial Sequence
  derived and/or modified sequence opt5 from TTLL8__Homo_sapiens__XP_011529043
augaagaccagcagacuguggaaaguggcccgguccgagggccccgggggagcuggcguccgcggggccaagggaaaacucucugaagcgagcauggagccugaaagaaagggccugucccuugcuucuagcuccgacggggauggacgggaggaaaacaaacugaagcagggcaucucucaagaccucgccagcuccagccgccuggauagauacaagauugcccggcagcuuacagagaaagcuaucaaggagaaaaagauuuucucuaucuauggccacuacccgguugugcgcgccgcucugagacggaaaggguggguggaaaagaaguuucauuuccuccccaaagucauuccugacguggaggaugaaggagcccgcguuaaugacgauacgugcgcgaaggugaaagagaaccaggagauggcccuggaaaagaccgacaauauccacgaugucauguccagacuggugaaaaacgagaugcccuaucuccuguggacaaucaagcgggacauuaucgauuaccauagccuuaccuaugaccagaugcugaaucacuacgcuaaaacagccucuuuuaccacaaagauuggccucuguguuaacaugcgcucccugccuugguaugugcccgcuaauccugauagcuucuuuccgagaugcuacucucuuuguaccgaauccgagcaacaggaguuccuggaagacuuucggcgcacgauggccagcuccauccucaagugggucgugucucaucagagcugcuccagaagcucucgguccaaacccagagaccagcgcgaggaagcggggagcucugaucugagcucccggcaagacgccgagaacgcugaagccaagcugagaggacucccuggccagcugguggauauugcuuguaaagucugccaggccuaccuugggcagcuggagcacgaagacaucgauaccucugccgacgcuguugaggaucucacagaggcggaaugggaggaccugacccaacaguauuacagccuugugcacggagaugccuucauuuccaauagccgcaacuauuuuucucagugucaagcucugcucaaucggaucacauccgugaacccccagaccgacaucgauggccugagaaauauuuggaucauuaagccugccgccaaaagccgcggccgggacaucgucugcauggacagaguggaagagauucuggaacucgcugccgcggaucauccccugucucgcgacaacaaguggguugugcagaaguacaucgagacgccgcuucugaucugugauacaaaauucgacauucggcagugguuucucgucaccgauuggaauccucugacaaucugguucuauaaggaguccuaccuuagauuuagcacccaacgcuucucccuggacaaacucgauucugcuauucaccugugcaacaacgccgugcagaaguaucugaaaaaugacguugggcggagcccccuccugccugcccauaacauguggaccuccacaagauuccaggaauaccuucagcggcaaggacgcggcgcugugugggggucugucaucuaccccagcaugaagaaggccauugcucacgccaugaaaguggcgcaggaucacgucgagcccagaaagaacuccuuugaacuguauggagccgacuucgugcucggccgggauuuuagaccuuggcugaucgagaucaauagcucuccgacgaugcaucccuccaccccuguuacagcucagcugugugcccaggugcaagaggacaccauuaaagucgcuguggaucgcagcugcgacaucgggaauuucgaacuucucuggcggcagcccguuguggagccucccccguuuucuggauccgaccugugcgucgccggcgugagcgugagacgcgcgagacggcagguucugccugucuguaaccucaaggccucugcuagccugcuugaugcccagccccugaaagcucgcggcccuuccgccaugcccgacccugcccaagggcccccgagcccugcucuccagagagaucugggacugaaggaagagaagggccuuccccucgcgcugcuggcuccccuccgcggggccgccgaaucuggaggcgccgcucagccuacacggaccaaagccgcggggaagguggagcugccggcuugccccuguagacacguggacucccaagccccuaauacgggcguccccguggcccagccugcuaaaagcugggaucccaaccagcuuaaugcccauccucuggagcccguucuccggggacugaagacagcggaaggcgcucugcgcccgccucccgggggaaaaggccaccagagagaggccgccgggggacuugcucaaugccagauuaccaugcucaagcggaaagaccugcugugucucuga

SEQ ID NO: 77424 - RNA, 1320 nt, Artificial Sequence
  derived and/or modified sequence opt5 from TTLL9__Homo_sapiens__NP_001008409
auggugcccagcagagaggcccugcucggcccugggaccacagcuauccggugcccgaagaaacugcagaaccaaaauuacaagggacacggccuuuccaaagggaaggaacgcgagcagagagccucuauucgguucaaaacgacccugaugaacacacucauggacguccugcgccauagacccggauggguugaagugaaggaugagggcgaaugggacuuuuauuggugugaugugagcuggcuucgggagaauuucgaccacaccuacauggaugagcauguccgcaucucccacuuuagaaaccauuaugaacugacacggaagaauuacauggugaaaaaccucaagcgcuucagaaaacagcuggagcgggaagcggggaagcuggaggcugccaaaugcgacuuuuucccuaagaccuuugagaugcccugugaauaucaccucuucguugaggaauuucgcaagaauccuggaauuacauggaucaugaaacccguggccagaucucagggcaagggcauuuuccuguuucggcgccuuaaagauaucgucgacuggagaaaggauacccggagcuccgacgaucaaaaagacgauaucccuguggagaacuacguugcucagagauauauugaaaauccguaccugaucgggggacgcaaguucgaccuccggguguacguccuggugaugucuguguuugccgagugccuucuguggagcggccacagacgccaggacguccaucucacgaacguugcugugcagaaaaccucccccgauuaucacccuaagaagggguguaaauggacacugcaacgguucagacaguaccuggccagcaagcauggacccgaggcgguggaaacccucuuccgcgacauugauaauaucuuugucaaaucucugcaguccgugcagaagguuauuaucagcgacaaacacugcuucgagcuuuauggcuacgauauucugaucgaccaagaucucaagccuuggcugcuugaagugaacgccucucccucccugacagcuagcucucaggaggacuaugaacucaagaccugucugcuggaggauacgcuccacgucguggacauggaggcccggcugacagggagagaaaaacgcguuggaggcuuugaucuuauguggaaugacggcccggugucccgggaggaaggggcuccugaccugagcggaaugggcaacuucgucaccaauacacaucucgggugcgugaacgauagaaagaaacagcugcgccaacuguuuuguucccuucagguccagaagaaagccucuagcuga

SEQ ID NO: 77425 - RNA, 837 nt, Artificial Sequence
  derived and/or modified sequence opt5 from TTPA__Homo_sapiens__NP_000361
auggccgaggcuagaagccagcccuccgccggcccucaacugaacgcgcucccggaccacucuccccugcuucagccugggcuggcugcccuccggcgcagagcccgggaagcuggagugccccuggccccucuuccccugaccgauagcuuccuccugcgcuuucugagagcucgggacuucgaucucgaccuggccuggcgccuucugaagaauuacuauaaauggagagcggagugcccugaaaucuccgccgaucuccauccgcggucuauuaucggccugcuuaaggcuggguaccacggaguccugcgcagcagagaccccacaggcuccaaaguucucauuuaucggaucgcccauugggauccuaagguguuuacggcuuacgacguguuccgcgucucucugauuaccagcgagcugaucgugcaggaaguugagacacagagaaacgggaucaaagccauuuuugaucucgagggauggcaauucucccacgcguuucagaucacccccagcguggccaagaagauugcugccguccugacagacucuuucccucuuaaagugcggggcauccaucugauuaaugaacccguuaucuuucacgcuguguucuccaugauuaagccguuucucaccgagaaaaucaaggaacgcauccacaugcauggcaacaauuauaaacagagccugcuucagcacuucccugauauucugccccucgaguacgggggagaggaauuuucuauggaggacaucugucaagaauggacaaacuucauuaugaaguccgaggauuaucugagcucuaucuccgaaagcauucaguga

SEQ ID NO: 77426 - RNA, 444 nt, Artificial Sequence
  derived and/or modified sequence opt5 from TTR__Homo_sapiens__NP_000362
auggccagccacagacugcuccugcuuugccuggcuggccucguguucgucuccgaggccgggcccaccggaacaggcgaaucuaaguguccucugaugguuaaagugcuugacgcggugcgggggagcccggcuaucaacgucgccgugcauguuuuucgcaaggccgcugaugacacgugggagcccuucgccuccggaaaaaccucugaaagcggcgagcugcacgggcucacaaccgaagaggaguuuguggaaggaauuuacaaggucgagaucgauacaaaauccuauuggaaggcucugggcauuucuccuuuccaugaacacgccgaggugguuuuuaccgcgaaugacagcggccccagacgguacacaaucgccgcucugcucuccccuuauagcuacucuaccacggccguggucaccaaccccaaggaguga

SEQ ID NO: 77427 - RNA, 1383 nt, Artificial Sequence
  derived and/or modified sequence opt5 from TTYH1__Homo_sapiens__NP_001005367
augggcgcucccccuggguacagaccgagcgcuugggugcaucugcuccaccagcugccccgggccgacuuccaacuucgcccuguccccuccguuuucgcgccucaggagcaggaauaucagcaagcucugcuccugguggccgcccuugcuggacugggccucgggcugucucugaucuucauugccguguaccucaucagauuuugcuguugccggcccccugagccgcccggaagcaagauuccuucccccggcgggggaugugucaccuggucuugcaucguggcucugcuugccggcuguacaggcauugggaucggauucuauggcaacagcgaaacguccgaugggguuucucagcugagcuccgcgcuccugcacgccaaucauacccuuagcacaaucgaccaccuggugcucgagaccgucgaacgccugggagaggcugugagaacagagcugaccacacucgaagagguucuggaaccucggaccgagcuuguggccgcugcccgcggcgcgagacggcaggccgaggcugccgcucagcaacugcaggggcucgccuuuuggcagggagucccccugucuccgcuucagguggccgaaaacguguccuucgucgaggaauaccgcuggcuggcuuauguucuccugcugcuccuggagcuucuggugugccucuuuacgcugcuuggccuggcgaaacaaagcaaguggcucgugauugucaugaccgugaugucucugcugguucucgugcuguccuggggcagcauggggcuugaagccgcuacagccgucggacugucugauuucuguuccaauccugaccccuacgugcucaaccugacccaggaggagacaggccugagcuccgauauccuuucuuauuaccuccugugcaauagagccguuagcaacccuuuucagcaacggcugacccucucccagcgcgcucuggccaauauucauagccagcuucuggggcucgaaagagaggcggugccccaguuccccucugcucaaaaaccucugcugucccuugaagagacgcucaacgucacagaaggaaauuuucaccagcugguggcccugcuccacugucggagccugcauaaggacuacggcgccgcccuucgcgggcugugcgaggaugcccucgagggacugcuguuccuucuccuguuuucucugcucagcgcuggcgcccuggcgaccgcccuuuguucccugccgagagcuugggcccucuuucccccucggaaccccucugcucugugcagcggcuccagacugagcgaaccucuucuccccgccgggcuggagccgggaucuccucugcgcuccuuccccggcugccggagacgcccucacuga

SEQ ID NO: 77428 - RNA, 1605 nt, Artificial Sequence
  derived and/or modified sequence opt5 from TTYH2__Homo_sapiens__NP_116035
augcaggccgcuagaguggacuacaucgcccccuggugggucguuuggcugcacagcgugccucaugugggccuccggcugcaaccggucaacuccaccuucucucccggggaugagagcuaucaggaaucccuucuguuucucggacugguggcggcuguuugccuuggccugaaucucauuuuccugguggccuaccuggucugugccugccacugucgcagagacgaugcugugcagacaaagcagcaucacucuugcuguaucacguggaccgccguuguggcugggcucauuugcugugccgcggucggagugggcuuuuaugggaacagcgagacaaaugacggagccuaccaacugauguauucccuugaugacgcuaaccauaccuucucuggcaucgaugcccuggugagcggcacaacccagaaaaugaaggucgaccucgaacagcaccuggcucggcuuuccgagauuuuugccgcgcgcggggauuaccugcagacacucaaauucauccaacagauggccggaagcguuguggugcagcugucuggccugccugucuggagagaagugaccauggagcucacgaagcuguccgaccagaccggguauguugaguacuaccgguggcuuagcuaucugcuccuguuuauccuugaucuggugauuugccucaucgcuugucugggacuggccaaacgcucuaagugccuccuggcuuccaugcuuuguugcggcgcccugagccuccugcuuucuugggccucccuggcugcggacgggagcgccgcugucgccacauccgauuucugcguggcccccgacaccuuuauucucaauguuacagaaggacaaaucucuaccgaggugacgagauacuaucuguacuguagccaguccggcagcucuccuuuccagcaaacacugaccacauuucagcgggcucucaccaccaugcagauucaggucgccggccugcuucaauucgcggugccccuguuuuccacagcugaagaggaccuccuggccauccagcugcuucucaacagcucugagagcucccugcaccagcugacggccauggucgauugccgcgggcuccauaaggacuaucuggaugcucuugccggaauuuguuacgacggccugcaggggcuccuguaucugggacuuuucucuuuccucgcugcccuggcguuuagcaccaugaucugcgccggcccuagagcuuggaaacacuucacaacccggaaucgcgauuacgacgauaucgacgaugacgauccguuuaacccccaagccuggagaauggcugcccauuccccuccccgggggcagcugcacagcuucuguucuuacuccagcggacucggcucucagacaucccugcagccucccgcgcaaaccauuagcaaugccccgguguccgaauauaugaaccaggcuaugcuuuuuggccgcaauccuagauacgagaacguuccccugaucgggcgggccucuccuccucccacguauagccccuccaugagagcuacauaccucucuguggccgacgaacaucugcgccacuauggaaaucaguucccggccuga

SEQ ID NO: 77429 - RNA, 1356 nt, Artificial Sequence
  derived and/or modified sequence opt5 from TUBA1A__Homo_sapiens__NP_001257328
augagagagugcaucagcauucacgugggccaggccgggguccaaaucggaaacgcuuguugggaacuguacugccucgagcauggcauucagcccgacgggcagaugccuuccgauaagaccaucggaggcggggacgauucuuucaauacauuuuucagcgaaacgggagccggcaaacacguuccgcgggcgguguuuguggaccuggagcccaccgucauugaugaagugcgcacaggcaccuauagacagcuuuuccauccugagcaacugaucacagggaaggaggacgcugccaacaauuacgcccggggacacuauaccaucggcaaagaaauuaucgaucucguucuggaccgcauuagaaaacuugcugaucaguguacagggcugcagggauuucucguguuccauuccuuuggcgggggaaccggcucuggcuucacgagccugcugauggagcggcucuccgucgacuacgggaagaagucuaagcuggaauuuagcaucuaucccgccccucagguguccaccgcuguuguggagcccuacaacagcauucuuacaacccacacaacccuggagcacucugauugcgccuucauggucgacaaugaagcgaucuaugauauuugucgcagaaaccucgacaucgagcggccuacguacacaaaucugaaccgccuuaucggacaaauuguguccagcaucaccgccucucugagauuugacggcgcucucaauguggaucugacagaguuccagaccaaccuggucccguacccccggauucauuuuccucucgccaccuaugcucccguuaucuccgccgaaaaagcguaccacgaacagcugagcguggccgagauuacaaaugcuugcuucgagccugccaaccagauggugaagugugacccccgccaugggaaauauauggcuugcugucuucuguacagaggagaugucgugccgaaggacguuaaugccgccaucgcuacgaucaaaaccaagcggacaauucaauucguggauuggugcccuaccggcuuuaaggucgggaucaacuaucagcccccuacagugguucccggaggcgaccucgcgaaagugcagcgcgccgucuguaugcugucuaauaccacggcuauugccgaagccugggcuagacuugaucacaaguucgaccugauguacgccaaacgggcguuugugcacugguaugucggcgaggggauggaagagggagaguucuccgaagcuagagaggauauggccgcccucgaaaaggacuacgaggaagugggcguugauagcguggagggggaaggagaggaggaaggcgaggaauacuga

SEQ ID NO: 77430 - RNA, 1356 nt, Artificial Sequence
  derived and/or modified sequence opt5 from TUBA1B__Homo_sapiens__NP_006073
augagagagugcaucagcauucacgugggccaggccgggguccaaaucggaaacgcuuguugggaacuguacugccucgagcauggcauucagcccgacgggcagaugccuuccgauaagaccaucggaggcggggacgauucuuucaauacauuuuucagcgaaacgggagccggcaaacacguuccgcgggcgguguuuguggaccuggagcccaccgucauugaugaagugcgcacaggcaccuauagacagcuuuuccauccugagcaacugaucacagggaaggaggacgcugccaacaauuacgcccggggacacuauaccaucggcaaagaaauuaucgaucucguucuggaccgcauuagaaaacuugcugaucaguguacagggcugcagggauuucucguguuccauuccuuuggcgggggaaccggcucuggcuucacgagccugcugauggagcggcucuccgucgacuacgggaagaagucuaagcuggaauuuagcaucuaucccgccccucagguguccaccgcuguuguggagcccuacaacagcauucuuacaacccacacaacccuggagcacucugauugcgccuucauggucgacaaugaagcgaucuaugauauuugucgcagaaaccucgacaucgagcggccuacguacacaaaucugaaccgccuuaucucccaaauugugagcucuaucaccgccucccugagauuugacggagcucucaauguggaucugacagaguuccagaccaaccuggucccguacccccggauucauuuuccucucgccaccuaugcucccguuaucagcgccgaaaaagcguaccacgaacagcugucuguggccgagauuacaaaugcuugcuucgagccugccaaccagauggugaagugugacccccgccauggcaaauauauggcuugcugucuucuguacagaggggaugucgugccgaaggacguuaaugccgccaucgcuacgaucaaaaccaagcgguccauucaauucguggauuggugcccuacaggauuuaaggucggcaucaacuaucagcccccuaccgugguucccgggggagaccucgcgaaagugcagcgcgccgucuguaugcugagcaauacaaccgcuauugccgaagccugggcuagacuugaucacaaguucgaccugauguacgccaaacgggcguuugugcacugguaugucggcgagggcauggaagagggggaguucuccgaagcuagagaggauauggccgcccucgaaaaggacuacgaggaagugggaguugauucuguggagggcgaaggggaggaggaaggagaggaauacuga

SEQ ID NO: 77431 - RNA, 1245 nt, Artificial Sequence
  derived and/or modified sequence opt5 from TUBA1C__Homo_sapiens__NP_001290046
augcccagcgacaagaccaucggcgggggagaugacuccuucaacacauuuuucucugagacgggcgccgggaaacacgugccuagagcugucuuuguugaucuggaaccgaccgugauugacgaggugcggacaggaaccuaccgccaacucuuccaucccgaacagcugaucacaggcaaggaggaugccgcgaauaacuaugcuagagggcacuacaccauuggaaaagaaaucauugaccuuguccuggaucggauccgcaagcucgccgaccagugcacaggccugcagggcuuucuuguguuccauagcuuugggggaggcaccggguccggauucacgucucugcucauggagagacugagcguugauuauggcaaaaaguccaagcuggaguuuucuaucuacccugcuccccaggugagcaccgcugucguggaaccuuauaauuccauucucacaacccacacaacccuggagcauagcgacugugccuucaugguugauaacgaagcuaucuacgacauuugccggcgcaaucuugauaucgagagacccacguauacaaaccugaaucggcucauuucucaaaucguguccagcauuaccgccucucugcgcuuugacggggcgcuuaacgucgaccugacagaguuccagaccaaucucgugccuuacccgagaauccacuuuccccuggccaccuacgcuccugugaucuccgccgaaaaagccuaucacgagcagcugacagucgccgaaauuacgaacgcguguuucgagcccgccaaucagaugguuaagugcgauccucggcauggaaaauacauggcuuguugccuccuguaucgcggcgacguggugcccaaggaugucaacgccgcuaucgccaccauuaaaacaaagagaaccauccaauucguggacugguguccgacaggcuuuaagguugggauuaauuaccagccucccaccguggucccuggaggcgaucuugccaaagugcagcgggcuguuugcaugcugagcaacacgacagcgguggccgaggcuugggcccgccucgaccacaaguucgaucugauguaugccaaaagagcuuuuguccauugguacgugggggaaggaauggaggaaggcgaguucucugaagcccgggaggacauggcggcucuugaaaaggauuaugaggaggucggggccgacuccgccgauggagaagacgagggcgaagaguacuga

SEQ ID NO: 77432 - RNA, 1353 nt, Artificial Sequence
  derived and/or modified sequence opt5 from TUBA3D__Homo_sapiens__NP_525125
augagagagugcaucagcauucacgugggccaggccgggguccaaaucggaaacgcuuguugggaacuguacugccucgagcauggcauucagcccgacgggcagaugccuuccgauaagaccaucggaggcggggacgauucuuucaauacauuuuucagcgaaacgggagccggcaaacacguuccgcgggcgguguuuguggaccuggagcccaccgucguggaugaaguucgcacaggcaccuauagacagcuuuuccauccugagcaacugauuacagggaaggaggacgcugccaacaauuacgcccggggacacuauaccaucggcaaagaaaucguggaucucguccuggaccgcauuagaaaacuugcugaucuguguacagggcuccagggauuucugaucuuccauuccuuuggcgggggaaccggcucuggcuucgccagccugcucauggagcggcuguccguggacuacgggaaaaagucuaaacuugaauuugcuauuuaucccgccccucagguuagcacggcgguggucgagcccuacaacuccauccugaccacacacaccacacucgagcacagcgauugcgccuucaugguggacaaugaagcuauuuaugauaucugucgcagaaaccuggacauugagcggccuaccuacacgaaucuuaaccgccugaucggacagaucgugucuuccauuacagccagccucagauuugacggcgcucugaaugucgaucugaccgaguuccaaacaaaccucguuccguacccccggauccauuuuccucuggccaccuaugcgcccgugauuucugccgaaaaggcuuaccacgaacagcuuuccguggccgagaucaccaaugcuugcuucgagccugccaaccagauggucaagugugacccccgccaugggaaguauauggccugcuguaugcuguacagaggagaugugguuccgaaggacgugaaugcugcgauugccacaaucaaaacgaagcggaccauccaguucgucgauuggugcccuacaggcuuuaagguggggauuaacuaucaacccccuaccguugugcccggaggcgaccucgcuaaaguccagcgcgccguguguaugcugagcaauacaaccgccaucgcugaagccugggcgagacuugaucacaaguucgaccugauguacgcuaaacgggccuuuguccacugguaugugggcgaggggauggaagagggagaguucucugaagccagagaggaucucgcugcccuggaaaaggacuacgaggaaguuggcguggauuccgucgaggcugaagccgaggagggggaagaguacuga

SEQ ID NO: 77433 - RNA, 1302 nt, Artificial Sequence
  derived and/or modified sequence opt5 from TUBA4A__Homo_sapiens__NP_001265481
augggcaacgccugcugggagcuguacugucucgaacacgggauccagcccgacggacaaaugccuagcgauaagaccauuggcgggggagacgauuccuucacaacguuuuucugcgagaccggcgcugggaaacaugugccgagagccgucuuuguugaccuggaacccacagugaucgaugagauucggaauggaccuuaucgccagcuuuuccaccccgaacagcugaucaccggcaaggaggacgcggcuaacaauuacgccagaggccauuauacaauugggaaagagaucaucgauccugugcucgaccggauucgcaagcugucugaucaguguaccggacuucaaggcuuucuggucuuccacagcuuugggggaggcacaggguccggauucaccucucuccugauggaaagacugagcguggacuacggcaaaaaguccaagcucgaguuuucuaucuaucccgccccucagguuagcacggcuguggucgaaccguacaacuccauucugaccacacauaccacacuugagcacagcgauugcgccuucaugguggacaaugaggcuaucuaugauauuugucggcgcaaccuggacaucgaaagacccaccuacacgaaucucaaccggcugauuucucagaucguuuccagcaucacagccucucuucgcuuugacggcgcgcugaauguggaucucaccgaguuccagacaaaccuggucccuuacccccggauucacuuuccucuggccaccuaugcucccgugaucuccgccgaaaaggcuuaccaugagcaacucagcguggccgaaauuaccaaugcgugcuucgagccggccaaccagauggucaaaugugacccuagacacgggaaauauauggcuugcugucugcuuuaccgcggagauguugugcccaaggacgugaaugccgcuaucgccgccauuaaaacaaagagaucuauccaguucgucgauuggugcccuacgggcuuuaagguggggaucaacuaucagccucccaccguugugcccggaggcgaccuggcuaaaguccaacgggcgguguguaugcucuccaauacaaccgccauugcugaggccugggcccgccuggaucauaaguucgaccuuauguacgcuaaaagagccuuuguucacugguaugugggggaaggaauggaggaaggcgaguucagcgaagcgcgggaggauauggcugcccuggagaaggacuacgaagaggucggcaucgauuccuacgaagacgaggacgaaggggaggaguga

SEQ ID NO: 77434 - RNA, 1152 nt, Artificial Sequence
  derived and/or modified sequence opt5 from TUBA8__Homo_sapiens__NP_001180343
augaucgaccuggaacccaccguggucgaugaaguuagagccggcacauaccggcaacucuuccacccugagcagcugauuacggggaaggaagacgcugccaacaauuaugcgcgcggacauuacaccgugggcaaagagagcaucgaucuugugcuggaccggauucggaagcucacagaugcuugcuccgggcugcagggauuucuuaucuuccacucuuuuggcgggggaaccggcagcggcuucacaucccugcucauggaacgccugucucuggacuaugggaaaaagagcaaacucgaguuugccauuuacccggcuccccaggucuccaccgccgugguugagccuuauaacucuauccugacaacccauacgacccuugaacacagcgauugugccuucaugguggacaaugaggcuaucuacgauauuugcagacggaaccuggacaucgaacgccccacauauaccaaucucaacagacugauuucccagaucgucagcucuauuacagccucccuucgguuugauggagcgcugaauguggaccucaccgaguuccaaacgaaccugguuccuuacccccgcauccauuuuccucuggugacauacgccccgauuaucagcgcugagaaggccuaucacgaacagcucucugucgcugagaucaccuccagcuguuucgaacccaauucucagauggugaagugcgauccuagacacggcaaauacauggccuguugcaugcuguauagaggggacgugguccccaaggacguuaacguggcgauugccgcuaucaaaacaaagcgcaccauucaguuuguggauugguguccuaccggauucaaagucggcaucaauuaccaacccccgacagugguuccugggggagaccuugccaaggugcagagagcugucugcaugcuguccaacacgaccgccauugccgaggcuugggcgcggcucgaucauaaguuugaccugauguaugccaaacgcgcuuucgugcacugguacguuggcgaaggcauggaggagggggaguucagcgaagccagagaagaucuugccgcucuggagaaggacuaugaagaggugggaacagauuccuuugaggaagagaaugaaggcgaggaguucuga

SEQ ID NO: 77435 - RNA, 1356 nt, Artificial Sequence
  derived and/or modified sequence opt5 from TUBB1__Homo_sapiens__NP_110400
augagagagaucgugcacauucagaucggccaaugcgggaaccagauuggagccaaguucugggaaaugaucggcgaggaacaugggauugaccuggcuggaagcgaucggggcgccuccgcgcuccagcuggagcgcaucucugucuacuauaaugaagccuacgggagaaaauauguuccccgggccgugcuuguggaccuggagccuggaaccauggauagcauccgcuccucuaagcucggcgcccuguuucagccggacagcuucguccacggcaacuccggggcuggaaauaacugggccaaaggccauuacacagagggggcugaacuuauugagaaugugcuggaaguugugagacacgagucugagagcugugauugccuccaaggauuucagaucguccauucccugggcgggggaacgggcagcggcauggggacccugcucaugaacaagauucgggaagaguaucccgaccgcaucaugaacucuuucuccgugaugccuagccccaaaguuucugauacaguggucgaaccuuacaaugccgugcuguccauucaccagcuuaucgagaaugcggacgccuguuuuugcauugauaacgaagcucuguaugacaucuguuucagaacccucaagcugacaacccccacauacggagaucuuaaucaccuggugagccucaccaugucuggcaucacgaccucccugcgguuuccugggcagcugaacgccgaccuccgcaagcuggcugucaauaugguuccguuccccagacuucacuuuuucaugccuggauuugcuccccugacagcgcaaggcagccagcaguaccgggcccucuccguggcugagcugacccagcaaauguucgaugcccgcaacacaauggcugccugcgaccuuagacgggggcgcuaucugaccguggccuguauuuuuagaggaaaaaugucuacgaaggaggucgaccagcagcuccugagcgugcaaacaagaaauuccagcugcuucguugaauggaucccuaacaacgugaaagucgcugugugugauauucccccgcggggccugucuauggcggccaccuucaucggcaauaacacagcuauucaggagaucuuuaaucgcguuuccgaacauuucagcgccauguuuaagcggaaagccuucgugcauugguacaccucugaggggauggacaucaacgaauuuggagaggcugagaauaacauucacgaucucgucagcgaauaucagcaguuccaagacgccaaggcggugcuggaggaagaugaggaagucaccgaggaggcugaaauggagccugaagacaagggccacuga

SEQ ID NO: 77436 - RNA, 1338 nt, Artificial Sequence
  derived and/or modified sequence opt5 from TUBB2A__Homo_sapiens__NP_001060
augagagagaucgugcacauucaggccggccaaugcgggaaccagaucggagcuaaguucugggaagucauuagcgacgagcauggcaucgaucccaccggguccuaccacggagacucugaucugcagcucgaacggauuaauguuuauuacaacgaggccgcgggcaauaaauaugugccucgcgcuauccugguggaccuugaaccggggacaauggauagcgucagauccggacccuuuggccagaucuuccggccugacaacuuuguguucggccaaucuggggccggaaauaacugggccaagggccauuacacggagggggcugagcugguugauagcgugcucgacgucgugcgcaaagaauccgagucuugugauugccugcagggauuucagcuuacccacagccugggcgggggaacaggcuccggcauggggacccuccugauuagcaagaucagagaagaguaucccgaccggauuaugaauacauucucuguuaugccuucccccaaagugagcgauaccgucguggagccuuacaacgccacacugucugugcaucagcucgucgaaaauaccgacgagacguauuccaucgauaacgaagcucuguacgacauuuguuuucgcacccuuaagcugacaaccccgacauacggagaccucaaucaccugguuagcgccaccaugucuggcgugacgacaugccuuagauuccccgggcaacugaacgcggaucuccggaagcuggccgugaauauggucccuuuuccccgccugcacuucuuuaugccuggauucgcuccccucaccuccagaggcagccagcaguaucgggcccugacagugccggagcuuacccagcaaauguuugacuccaaaaacaugauggcugccugugauccucgccaugggagauaccugaccguugcggccaucuuccggggacgcaugucuaugaaggaaguggacgagcagaugcucaauguccagaacaaaaacagcuccuauuucguggaguggauucccaauaacguuaagacagcugugugcgauaucccucccagaggccugaaaaugagcgccacguuuaucggcaauucuaccgcuauucaagaacuuuucaagcggaucuccgagcaguuuacagccauguucagacgcaaggccuuucugcacugguacaccggggaaggaauggacgagauggaguucacagaagcugagagcaacaugaaugaucucgucucugaauaucagcaguaccaagacgcgaccgccgaugagcagggcgaauuugaggaagaggagggggaagacgaggcuuga

SEQ ID NO: 77437 - RNA, 1338 nt, Artificial Sequence
  derived and/or modified sequence opt5 from TUBB2B__Homo_sapiens__NP_821080
augagagagaucgugcacauucaggccggccaaugcgggaaccagaucggagcuaaguucugggaagucauuagcgacgagcauggcaucgaucccaccggguccuaccacggagacucugaucugcagcucgaacggauuaauguuuauuacaacgaggccacaggcaauaaauaugugccucgcgcgauccugguggaccuugaaccggggacgauggauagcgucagauccggacccuuuggccagaucuuccggccugacaacuuuguguucggccaaucuggggcuggaaauaacugggccaagggccauuacaccgagggggccgagcugguugauagcgugcucgacgucgugcgcaaagaauccgagucuugugauugccugcagggauuucagcuuacacacagccugggcgggggaaccggcuccggcauggggacacuccugauuagcaagaucagagaagaguaucccgaccggauuaugaauaccuucucuguuaugccuucccccaaagugagcgauacagucguggagccuuacaacgcuacccugucugugcaucagcucgucgaaaauacggacgagaccuauuguaucgauaacgaagcccuguacgacauuugcuuucgcacacuuaagcugaccacaccgaccuacggagaccucaaucaccugguuuccgcuacgaugagcggcgugacaaccugucuuagauuccccgggcaacugaacgccgaucuccggaagcuggcggugaauauggucccuuuuccccgccugcacuucuuuaugccuggauucgcuccccucacaucuagaggcucccagcaguaucgggcccugaccgugccggagcuuacccagcaaauguuugacagcaaaaacaugauggccgcuugcgauccucgccaugggagauaccugacaguugccgcgaucuuccggggacgcauguccaugaaggaaguggacgagcagaugcucaauguccagaacaaaaacucuagcuauuucguggaguggauucccaauaacguuaagacggccgugugugauaucccucccagaggccugaaaauguccgcuaccuuuaucggcaauagcacagccauucaagaacuuuucaagcggaucucugagcaguuuaccgcuauguucagacgcaaggccuuucugcacugguacacaggggaaggaauggacgagauggaguucaccgaagccgaguccaacaugaaugaucucgucagcgaauaucagcaguaccaagacgcuacggcggaugagcagggcgaauuugaggaagaggagggggaagacgaggccuga

SEQ ID NO: 77438 - RNA, 1137 nt, Artificial Sequence
  derived and/or modified sequence opt5 from TUBB3__Homo_sapiens__NP_001184110
auggacagcgugagauccggcgccuucgggcaccuguuucggcccgauaacuucaucuuuggacagucuggcgcugggaauaacugggccaagggacauuacaccgagggcgcggaacucgucgacagcguucuggauguggugcgcaaagagugcgaaaauugugacugccuucaaggguuccagcugacacacucccucggaggcggcacggggucuggaaugggcacccugcuuauuagcaaggucagagaggaauauccugaucggaucaugaacacauuuuccgugguuccgucucccaaagugagcgacaccgucguggagccuuacaaugcuacacuguccauucaucagcucguugagaacaccgaugaaacauauuguaucgacaaugaggcccuguacgauauuugcuuccgcacccugaagcucgccacgcccaccuauggggaccugaaccaccuugugagcgcuacaaugucuggagucaccacaucccugagauuuccuggccagcucaaugccgaucugcggaaacuugcugugaacauggugcccuucccucgccugcacuuuuucaugccgggguuugcuccccucaccgcgagaggaagccaacaguaccgggcccugacggucccugaacugacacagcagauguucgacgcuaagaauaugauggccgcuugugauccccgccauggcagauaucucaccguugccacaguguuucggggccgcaugucuaugaaggagguggacgagcaaaugcuggcgauccaguccaaaaacagcucuuacuucgucgaauggaucccuaauaacgugaagguugccgugugcgacauucccccgagagggcuuaaaauguccagcaccuucaucggaaauuccaccgcuauucaggagcuguuuaagcggaucucugaacaguucacagccauguuucgcagaaaagccuuccuccacugguacacgggcgaggggauggaugaaauggaguuuaccgaggccgaaagcaacaugaacgaccuggucuccgaguaucaacaguaccaggaugccacagcugaagaggaaggagagauguaugaggacgaugaagaggaaagcgaggcgcaaggcccuaaguga

SEQ ID NO: 77439 - RNA, 1470 nt, Artificial Sequence
  derived and/or modified sequence opt5 from TUBB4A__Homo_sapiens__NP_001276056
augagacggggcgccgcugaccgcgagaccgaagggcccugcagcgccguguccgcggcuucuagcacacuggccgccgcugccgcuccuagagcccgggcgacggccgcugccuccacccucucugcuacagccaugcgcgagaucguccaucugcaggcgggacaauguggcaaccagauuggggccaaguucugggaaguuaucagcgaugagcacggaauugacccgaccggcacauaccacggggauuccgaccuucagcuggaaagaaucaauguguauuacaacgaggcuaccggaggcaauuaugugccccgggccguccucguggaucuggagccuggcacaauggacucuguucgcagcgggcccuuuggacagauuuucagaccugauaacuuuguguucggccaauccggggcuggaaauaacugggccaaaggccauuacaccgaaggggccgagcuugucgacgcugugcuggauguugugcggaaggaagcggagagcugcgacugucuccagggauuucagcugacgcacucucugggcggcgggaccggauccggcauggggacacuccugaucagcaaaauccgcgaggaguuccccgauagaauuaugaauaccuuuucugucgugccuuccccgaaggugagcgacacagucguugaacccuauaacgccacccuuucugugcaucagcugguggaaaauacggaugagacauacugcaucgacaacgaagcucucuaugacauuuguuuccggacccugaaacuuacaaccccuaccuacggagaucugaaucaccucgucuccgccacaaugagcggcgugacgaccugccugcgcuuucccgggcaacugaacgccgaccucagaaagcuggcuguuaauauggugccuuucccccggcuucacuuuuucaugccgggauuugccccucugacaucccgcggcucucagcaguacagagcgcucaccguccccgagcugacacagcaaauguucgaugcuaagaacaugauggccgccugugacccucggcauggcagauaucuuaccguggcugccguuuuccgcgggcggaugagcaugaaagagguggaugaacagaugcuguccguccagagcaaaaauucuuccuacuuuguggaguggauccccaacaacgucaagacggcugugugcgacauucccccuagaggacucaagauggccgcgacauucaucggcaauagcaccgccauucaagaacuguuuaaacgcaucucugagcaguucaccgcuauguuucggagaaaggccuuccugcacugguauacaggggaaggaauggaugagauggaguuuaccgaagcugagagcaacaugaaugaccucguuuccgaauaccagcaguaucaagaugccacagcggaggaaggcgaguucgaggaagaggccgaagaggagguggcuuga

SEQ ID NO: 77440 - RNA, 1338 nt, Artificial Sequence
  derived and/or modified sequence opt5 from TUBB4B__Homo_sapiens__NP_006079
augagagagaucgugcaucugcaggccggccaaugcgggaaccagauuggagcuaaguucugggaagucaucagcgacgagcacggcauugaucccaccgggacauaccacggagacuccgaucuccagcuggaacggaucaauguuuauuacaacgaggccacgggcgggaaauaugugccucgcgcggugcuugucgaccuggaaccgggaaccauggauucugugagaagcggccccuuuggccagauuuuccggccugacaauuuuguuuucgggcaauccggagcuggcaacaauugggccaaggggcauuacacagagggagccgagcucguggauucuguccuggacgugguucgcaaagaagcugagagcugugauugccuucagggcuuucagcugacccacucccucgggggaggcacaggcucugggaugggaacccugcugaucagcaagaucagagaagaguaucccgaccggauuaugaacacauucuccguggucccuagccccaaagugucugauaccguggucgagccuuacaaugccacgcucuccguucaucagcugguggaaaacaccgacgagacauauuguaucgauaaugaagcucuuuacgacauuugcuuucgcacccugaagcucacaaccccgacguacggcgaccugaaccaccuugugagcgccacaaugucuggggucaccacaugucugagauuccccggacaacucaaugcggaucugcggaagcuggccgugaacaugguuccuuuuccccgccuccacuucuuuaugccuggcuucgcuccccugaccuccagagggagccagcaguaucgggcccuuaccgugccggagcugacacagcaaauguuugacgcuaaaaauaugauggccgcgugcgauccucgccauggaagauaccucacggucgccgcuguguuccggggccgcaugucuaugaaggaaguugacgagcagaugcugaacgugcagaauaaaaacuccagcuauuucgucgaguggauccccaacaaugugaagaccgccgucugugauauuccucccagaggccuuaaaauguccgcuacauuuaucgggaacucuaccgccauucaagaacuguucaagcggaucagcgagcaguuuacagccauguucagacgcaaggcuuuucuccacugguacaccggagaaggcauggacgagauggaguucacggaagcggaguccaauaugaacgaucuggugagcgaauaucagcaguaccaagacgccacagcugaggaagagggggaauuugaggaggaagccgaggaagagguugccuga

SEQ ID NO: 77441 - RNA, 1230 nt, Artificial Sequence
  derived and/or modified sequence opt5 from TUBB6__Homo_sapiens__NP_001290455
augagagagaucgugcacauucaggccggccaaugcgggaaccagaucggaaccaaguucugggaagucauuagcgacgagcauggcaucgaucccgcugggggauacguuggcgacuccgcccugcagcucgaacggauuaauguguauuacaacgagucuagcugucagacaggggcgggaaauaacugggcuaaaggccacuauacggaaggcgccgagcugguggaugccguccuugacgugguucgcaaggagugcgaacauugugauugccugcaaggguuucagcucacccacucccugggaggcgggacaggaucuggcauggggacccuucugaucagcaaaaucagagaggaguucccugaccggauuaugaauacauuuuccgugaugccgucucccaaggucagcgauaccgugguugagccuuacaacgcuacacucuccgugcaucagcuggucgagaauaccgacgaaacguauuguaucgauaacgaggcccuguacgacauuugcuuccgcacccucaaacugacaacccccacauauggagaucuuaaucaccuggugagcgcuaccaugucuggcgugacgacaucccucagauuuccuggccagcugaacgccgaccuucggaagcuggcggucaauaugguucccuucccucgccuccacuuuuucaugccgggguuugcuccccugaccagcagaggaucucaacaguaccgggcccugacagugccugaacucacccagcagauguucgaugcccgcaacaugauggcugccugugaccccagacauggccgguaccugaccguggcgacagucuuucgcgggccuauguccaugaaggagguggacgaacaaaugcuugccauccagagcaaaaauucuuccuauuucguugaguggauucccaacaaugugaaggucgcugugugcgauaucccgccuagaggacugaaaauggccagcacguuuauuggcaacuccaccgcuauccaggaacucuucaagcggaucucugaacaauucagcgccauguuucgcagaaaagccuuccugcacugguuuacaggggagggaauggacgaaauggaguucaccgaagcugaguccaacaugaaugaucuuguuagcgaguaccagcaguaucaggacgcgacagccaacgauggcgaagaggcuuuugaagacgaggaagaggagauugauggcuga

SEQ ID NO: 77442 - RNA, 729 nt, Artificial Sequence
  derived and/or modified sequence opt5 from TUBB__Homo_sapiens__NP_001280142
augagagagaucgugcacauucaggccggccaaugcgggaaccagaucggagcuaaguucugggaagucauuagcgacgagcauggcaucgaucccaccgggacauaccacggagacuccgaucugcagcucgaccggauuucuguuuauuacaaugaagccacgggcgggaaauaugugccucgcgcgauccugguggaucuugagccgggaaccauggacagcgucagauccggccccuuuggccagaucuuccggccugauaacuuuguguucgggcaaucuggagcuggcaauaacugggccaaggggcauuacacagaaggagccgagcugguugacagcgugcucgaugucgugcgcaaagagguugacgaacagaugcugaaugugcagaacaaaaauuccucuuauuuugucgaguggauucccaacaaugugaagaccgcugugugugauaucccucccagaggccuuaagauggccgucacauucauugggaacagcaccgcuauccaggaacuguuuaagcggauuuccgagcaauucacagccauguuucgcagaaaagcguuccuccacugguacaccggagagggcauggacgaaauggaguuuacggaagccgagagcaauaugaacgaucugguuucugaauaucagcaguaccaggacgcuaccgccgaggaggaagaggacuucggcgaagaggcugaagaggaggccuga

SEQ ID NO: 77443 - RNA, 1197 nt, Artificial Sequence
  derived and/or modified sequence opt5 from TUBD1__Homo_sapiens__NP_001180538
augagcaucgugaccguccagcugggccaaugcgggaaccagauuggauucgagguuuuugacgcccuccuguccgauucucacagcucccagggccuuuguucuaugagagaaaaugaggcuuaccaggccagcugcaaggaacgguucuuuuccgaggaagagaacggggugcccaucgcgcgcgcugugcuggucgacauggagccuaaagugauuaaucaaaugcucucuaaggccgcccagagcggacaguggaaauauggccagcaugcuuguuucugccaaaagcagggguccggaaacaauugggccuacggcuauagcguucacggcccgagacaugaagagucuaucaugaacauuauccggaaagaaguggagaagugugauuccuuuagcggguucuuuaucauuaugucuauggcuggaggcacaggguccggacugggcgccuucgucacgcagaaucuugaggaccaguacagcaacucucugaagaugaaucaaaucauuuggcccuaugggaccggagaagugaucguucagaacuacaauuccauucucacacugagccaccuguaucgcuccucugaugcgcuccugcuucaugagaacgacgccauccacaaaauuugcgcuaagcugaugaauaucaaacagaucagcuuuuccgauauuaaccaagugcucgcccaccagcugggcagcgucuuccagccuaccuacucugcugaauccagcuuucauuacagacggaauccccuuggcaucgaccgccacguguggccuccccugucugggcucccuccgcugagcaagaugucccugaacaaagaucuccauuucaacacaucuauugccaaucuggugauccuuagaggaaaggacguccagagcgcggauguugagggcuuuaaggaccccgcccuguauaccuccuggcucaaaccugugaacgcuuucaauguguggaagacacaacgggccuucagcaaauacgaaaagucugcuguccugguguccaacagccaguuucuuguuaaaccccuggauaugauuguggggaaggccuggaauauguucgccucuaaggcuuauauccaccaguacaccaaauuuggaaucgaggaggaagacuuccucgacuccuuuacgagccuggagcaggucguggcguccuauuguaaccuguga

SEQ ID NO: 77444 - RNA, 1428 nt, Artificial Sequence
  derived and/or modified sequence opt5 from TUBE1__Homo_sapiens__NP_057346
augacccagagcguggucguucaagugggccagugcgggaaccagaucggauguugcuucugggaccuggcccucagagagcacgcugccgugaaucagaagggcauuuacgaugaagcgaucuccagcuuuuuccggaacgucgacacacgcgugguuggggauggaggcucuauuuccaaagggaagaucuguucucugaaagcuagagccgugcuuauugacauggaggaaggagucgugaaugagauccugcaaggcccccuccgggauguuuuugacacgaagcagcugaucaccgauauuagcggcuccgggaacaauugggccgugggacauaaagucuucggcucucuuuaucaggaccagauccuggaaaaguuucgcaagagcgcugagcacugcgauugucuccaaugcuucuuuauuauccauuccaugggagggggcacagggagcggacugggcaccuuccugcucaaagugcuggaggacgaauuuccugagguguacagauucgucacaucuauuuauccguccggcgaagaugacguuaucaccagccccuacaacucuauucuugccaugaaggagcugaaugagcacgcugauugugugcucccuaucgacaaccagucccuguuugacaucauuagcaaaaucgaucuuauggucaauucugggaagcugggaacaaccgugaaacccaagucccucgugacgagcuccucuggcgcccugaagaaacagcauaagaaaccuuucgacgcgaugaacaauauuguugccaaccugcuccugaaucuuaccagcuccgcucgguuugaagggagccugaacauggaucucaaugagaucucuaugaaccuggugcccuucccucagcuucacuaucuggucuccagccucacaccgcuguacacccugacagacgugaacauucccccucgcagacucgaucaaauguucucugacgccuuuagcaaggaucaccagcugcuucgggcugaccccaaacauucccuguaucucgccugcgcgcugaugguucgcggaaaugugcagaucucugaucuuagacggaacaucgaacgccugaagccuagccuccaauucgucuccuggaaucaggagggcuggaaaaccagccuguguucugugcccccggucgggcacucccauagccugcucgcccuggcuaacaauacgugcgugaagccuacauuuauggaacuuaaggagagauucaugcggcuguacaaaaagaaagcccaccuccaccauuaccugcagguugagggaauggaagagucuuguuuuaccgaagcuguguccagccuguccgcccuuauucaggaguaugaccaacucgaugccacaaagaacaugcccguccaggaccugccucgccugucuaucgcuauguga

SEQ ID NO: 77445 - RNA, 1356 nt, Artificial Sequence
  derived and/or modified sequence opt5 from TUBG1__Homo_sapiens__NP_001061
augcccagagagaucauuacccugcagcucggccaaugcgggaaccagaucggauucgaauuuuggaagcagcugugugccgagcacggcauuagcccugaagggaucguggaggaguucgcuacagaaggaacggaccggaaagaugucuuuuucuaccaggccgacgaugagcauuauauuccgcgcgcgguucuucuggaccucgaacccagagugauccacuccauccuuaauucuccuuacgcuaagcuguauaaccccgagaauauuuaccugagcgaacauggcgggggagccggcaacaauugggccuccggcuuuucucaaggggagaaaauccacgaggauauuuucgacaucauugaucgggaagcugacggaagcgauucccucgagggcuuugugcugugccauucuaucgccgggggaaccggcagcgggcugggauccuaucuccuggaacgccuuaacgacagauacccuaagaaacugguccagacauauagcguguuccccaaucaggaugagaugucugacguugugguccagccuuacaacucccuccugacccuuaagcggcugacacaaaaugcugauugugugguugugcucgacaacaccgcccugaaucgcauugcgacagacagacugcacauccagaacccgagcuuuucucagaucaaucagcucgucuccaccauuaugagcgccucuacgaccacacugcgguaccccggcuauaugaacaaugaucuuaucggccugauugcuucccucaucccuacaccccgccugcacuuccuuaugaccggguacaccccucugacgacagaccaaagcguggccuccgugagaaagaccacaguccucgauguuaugcggcgccugcugcagcccaaaaacgugauggugucuaccggaagagaccggcagaccaaccauugcuauauugcuauccucaauaucauucaaggcgaagucgauccgacacaggugcacaagagccugcagcgcaucagagagcggaaacuugccaacuuuauuccuugggggcccgcguccauccagguugcccugagcagaaagucuccuuaccuccccuccgcucaucgcgugagcggacugaugauggccaaucacacgucuauuagcucccuuuucgagcggaccuguagacaauaugacaaacugcgcaagcgggaggcuuuucucgaacaguucagaaaggaagauauguucaaagacaacuuugaugagauggacacaucucgcgaaaucguccagcagcugaucgaugaguaccacgccgccacccggcccgacuauauuagcuggggcacacaagagcaguga

SEQ ID NO: 77446 - RNA, 1356 nt, Artificial Sequence
  derived and/or modified sequence opt5 from TUBG2__Homo_sapiens__NP_057521
augcccagagagaucauuacccugcagcucggccaaugcgggaaccagaucggauucgaauuuuggaagcagcugugugccgagcacggcauuagcccugaagggaucguggaggaguucgcuacagaaggaacggaccggaaagaugucuuuuucuaccaggccgacgaugagcauuauauuccgcgcgcgguucuucuggaccucgaacccagagugauccacuccauccuuaauucuccuuacgcuaagcuguauaaccccgagaauauuuaccugagcgaacauggcgggggagccggcaacaauugggccuccggcuuuucucaaggggagaaaauccacgaggauauuuucgacaucauugaucgggaagcugacggaagcgauucccucgagggcuuugugcugugccauucuaucgccgggggaaccggcagcgggcugggauccuaucuccuggaacgccuuaacgacagauacccuaagaaacugguccagacauauagcguguuccccuaccaggaugagaugucugacguugugguccagccuuacaauucccuccugacccuuaagcggcugacacaaaacgcugauugugugguugugcucgacaauaccgcccugaaccgcauugcgacagacagacugcacauccagaauccgagcuuuucucagaucaaccagcucgucuccaccauuaugagcgccucuacgaccacacugcgguaucccggcuacaugaauaacgaucuuaucggccugauugcuucccucaucccuacaccccgccugcacuuccuuaugaccggguauaccccucugacgacagaccaaagcguggccuccgugagaaagaccacaguccucgauguuaugcggcgccugcugcagcccaaaaaugugauggugucuaccggaagagaccggcagaccaaccauugcuacauugcuauccucaacaucauucaaggcgaagucgauccgacacaggugcacaagagccugcagcgcaucagagagcggaaacuugccaauuuuauuccuugggggcccgcguccauccagguugcccugagcagaaagucuccuuaucuccccuccgcucaucgcgugagcggacugaugauggccaaccacacgucuauuagcucccuuuucgagucuagcugucaacaguuugacaaacugcggaagagagaugcuuuccucgaacaguuccgcaaggaggacauguuuaaagauaauuucgacgaaauggaucgguccagagaggucgugcaggaacugaucgacgaguaccacgccgccacccaacccgacuauaucagcuggggcacacaggagcaguga

SEQ ID NO: 77447 - RNA, 2793 nt, Artificial Sequence
  derived and/or modified sequence opt5 from TUBGCP2__Homo_sapiens__NP_001243546
augagcgaguucagaauccaccaugacgugaacgaacugcucucccugcuucggguccacggcggggauggagccgagguuuacauugaccugcuccagaagaaucgcacccccuaugugacaacgaccgugucugcucauagcgccaaagucaagaucgcggaauuuuccagaacaccugaggauuuccugaaaaaguacgacgaacuuaaaucuaagaacacccggaaucuggauccgcucguguaucugcugagcaagcucacagaggacaaagagacccugcaauaccuucagcagaacgcuaaggaacgcgccgagcuggccgcugccgcuguuggcuccucuacaaccagcauuaaugugcccgccgcggccuccaaaaucagcaugcaggaacucgaggagcugagaaagcaacuugggucugucgcuacgggauccacccugcagcagagccucgaacugaaacggaagaugcugcgcgauaagcagaacaaaaagaauagcggccaacaccucccuauuuuucccgccuggguguaugagagaccugcucugaucggggacuuccuuaucggagccggcauuuccacagauaccgcgcugcccaucguucuccugcgguggaaccuugcccugagcccucgccucaaaugcucuggcgugauuuccgcucauuguaaucugcaucugccggggacacucccccuggccagccaggaauccgcugucguggaggaccuucuguacgugcucgucggaguugauggcagauaugugucugcccagccucuggccgggcggcagagccgcaccuuucuuguggaccccaaccuggaucucuccaucagagaacugguccaccggauucugccuguggcugcgagcuacucugccguuacgcgcuucaucgaggagaaguccagcuuugaauacggacaagugaaucacgcucucgccgccgcuaugagaacacuggucaaagagcaccuuauucuggugucucagcucgaacagcugcaucggcaaggccugcuuagccuccagaagcugugguucuauauccagcccgccaugagaaccauggacauccuggcgucccucgcuacaucuguugacaaaggggagugccugggaggcagcacccuuucccugcuccacgaucgcagcuuuucuuacaccggcgacucccaggcccaagaacugugucuguaucuuacaaaggccgcuagcgccccguacuucgaggugcucgagaaguggauuuaucgggggaucauucacgauccuuacucugaauuuauggucgaggaacaugagcugagaaaagaacgcauccaggaggacuauaacgauaaguacugggaccagcgguacacgauugugcagcaacagauccccuccuuccugcagaaaauggcugauaagauccucagcaccggaaaauaucugaaugucgugagagagugcggccacgacguuacauguccuguggccaaggaaauuaucuacacccuuaaggagcgcgcguaugucgaacagauugagaaagccuuuaacuacgcuuccaaggugcugcucgauuuccugauggaggaaaaagagcugguugcccaucuucggucuaucaagagauauuuccucauggaccaaggggacuuuuucgugcacuuuauggaucuggcugaagaggaacugcgcaaacccgucgaggacauuacacccccucggcucgaggcccugcuugaacuggcgcucagaaugagcaccgccaauacggauccguucaaggacgaucugaagaucgaccugaugccccaugaucuuaucacacagcuccugcgcgugcuggcuauugagaccaaacaggaaaaggccauggcucacgccgacccuaccgagcucgcccuguccggacuugaggcuuuuucuuucgauuacaucgugaaauggccccugagccucauuaucaaccggaaggcgcugacaagauaucagaugcuguuucggcacauguucuacugcaaacauguugaacgccaacuuuguuccgucuggauuagcaacaagaccgccaagcagcacucucugcauuccgcucagugguuugccggcgccuucacacucagacaacggaugcugaauuuugugcagaacauccaguacuauaugauguucgaggugauggaaccuacguggcacauucucgagaaaaaucugaagucugcuucuaacaucgacgauguccuugggcaccauaccggauuucuggacacaugccucaaagauuguaugcugaccaaucccgaacugcuuaagguguucuccaaacugaugagcguuugcgugauguucacaaacuguaugcagaaguuuacccaaucuaugaaacucgacggcgagcugggcgggcagacgcucgaacacagcaccguccugggacuuccggccggcgcggaggagagagcucgcaaggaacuggcccggaagcaucucgccgagcacgcugauacagugcagcugguuuccggguucgaagccaccaucaauaaauuugacaagaacuucagcgcgcaucugcuugaccugcucgcuagacugucuauuuacuccacaagcgauugcgagcacggaauggccuccgugaucucucgccucgacuuuaauggcuucuauaccgagagacuggaacggcuuagcgccgagcgcucccagaaagcuacgccucaaguccccgugcugagagggccucccgccccugcuccccggguugccgugacagcgcaguga

SEQ ID NO: 77448 - RNA, 2724 nt, Artificial Sequence
  derived and/or modified sequence opt5 from TUBGCP3__Homo_sapiens__NP_006313
auggccacccccgaccagaaaagcccuaacgugcugcuccaaaaucugugcuguagaauccuuggccgguccgaggcugaugucgcccagcaguuccaguacgcgguucgcgugauugggucuaacuuugcuccgacaguggaaagagacgaguuccuggucgccgaaaagaucaagaaagagcucauucggcaacgcagagaagccgaugcugcccuguuuagcgagcuucaccggaagcugcauucccagggagugcucaaaaauaaguggucuauccuguaucugcuccugagccuuuccgaggacccccgcagacagccuucuaagguuagcuccuacgcuacgcuguucgcccaggcgcucccccgggaugcccacagcaccccuuauuacuaugcucgcccccaaacacugccucuuucuuaccaggacagauccgcccagagcgcucagucuuccggcagcguggggucuuccggaauuagcuccaucggccugugcgcccucucugggccggcgcccgccccucaaagccugcugcccggacaguccaaccaggcuccuggcgucggcgauugucuccggcaacagcuggggagccgccuugccuggacccugacagcuaaucagcccucuucccaggccaccacaagcaaaggagugccgucugccguuagcagaaacaugacccggucccgcagagaaggcgacaccgggggaacgauggagaucacagaagcugcgcucgugcgggauauucuguaugucuuucaaggcaucgacgggaagaauauuaaaaugaacaauaccgagaacugcuacaagguggagggaaaagccaaucuuucuagaagccugcgcgauacagcugugcggcucuccgaacugggcuggcugcauaacaagaucagacgcuacaccgaccagcggagccucgauagaucuuucggccuggucgggcaguccuuuugugccgcccuucaccaggagcugcgcgaauauuaccggcuccugagcguucuucauucucaacugcagcucgaggacgaccagggagugaaucugggccuggaauccagccucacgcugagacgccuucugguguggacauaugauccuaagauucggcucaaaacccuggcugcccuggucgaccacugccaggggagaaagggaggcgagcuugcguccgcugugcacgccuacacaaaaaccggggaucccuauaugcgcucucucguucaacauauccugagccuggugucccacccuguccucucuuuccuguaccgguggauuuaugacggagagcuugaagauaccuaccaugaguuuuucguggccagcgaccccacaguuaagacggauagacuguggcacgacaaauacacccuccggaaguccaugauccccagcuuuaugacaauggaucagucucgcaaagugcugcugaucggcaaguccauuaacuuccuucaccaggucugucaugaccagaccccuacaaccaagaugaucgcugugacgaaaagcgccgaaucuccgcaagaugcugccgaccucuuuacagaccuggagaaugcguuccagggcaagauugaugccgcuuauuucgaaaccuccaaauaccugcucgacguccugaacaagaaauauagccuucuggaucacaugcaggccaugagacgguaccuccugcuggggcaaggagacuuuaucagacaucuuauggaucuccugaagcccgagcuggugcgcccugcuaccacacucuaucagcacaaccugaccggcauucuugagacagccguucgggcgacgaaugcccaguucgacucucccgaaauccugagacgccucgaugugagacugcuggaggucagcccuggggacaccggaugggauguguuuucccuugacuaccauguugauggccccaucgcuacaguguucacccgggaaugcaugagccacuaucuccgcgucuuuaacuuccuguggagagccaagcggauggaguacauucugacagacauccgcaaagggcacauguguaaugcuaagcuccugagaaacaugccggaauuuucuggcgugcuucaucagugccacauucuggccuccgagauggugcauuucauccaccaaaugcaguacuauauuaccuuugagguucucgaauguagcugggaugagcuguggaauaaaguccagcaggcccaagaccuggaccacaucaucgcugcgcaugaaguguuccuugauacgauuaucucccggugccugcucgacucugauagccgcgcccugcucaaccagcugagagcuguguuugaccagauuaucgagcuucagaaugcccaagaugccauuuaccgggcugcccuggaggaacuccagcgcagacugcaguucgaggaaaagaaaaagcaacgggagaucgaaggacaguggggcgucaccgcggcugaggaggaagaggaaaacaagagaauuggggaguuuaaagaauccaucccuaagaugugcucucagcugcgcauccuuacacacuucuaucagggaauugugcaacaguuccugguucuccugaccacaagcuccgacgagucucuccgguuucugagcuucagacuugauuuuaaugagcauuacaaagcccgcgaaccccggcugagagugucccucggcacccgcgggcggagaagcucucacacguga

SEQ ID NO: 77449 - RNA, 2004 nt, Artificial Sequence
  derived and/or modified sequence opt5 from TUBGCP4__Homo_sapiens__NP_001273343
augauccacgagcugcuccuggcccuuagcggcuaccccggguccauuuucaccuggaacaagagaucuggacugcaagugagccaagacuuuccuuuccuccauccguccgaaacaucuguccugaaucggcuuugccgccugggcacggauuauaucagauuuaccgaguucauugaacaguacacagggcacguucagcagcaagaccaucaccccagccagcagggacagggcgggcuccauggaaucuaucugcgggcuuuuuguaccggccuggauuccgugcuccaaccuuaccgccaggcccugcuugaccuggagcaggaguuccucggcgauccccaccugucuauuagccacgugaacuauuuucuugaccaguuccaacugcucuuuccuuccgucauggugguuguggagcagaucaaaagccagaagauccaugggugccaaauucuggagacagucuacaaacacucuuguggaggccugcccccugugagauccgcgcucgaaaagauccuggcuguuugccauggggugauguauaaacagcuuagcgccuggaugcugcacggacuccugcuugaucagcacgaggaguucuuuauuaagcagggcccgucuuccgggaaugucagcgcccaacccgaagaggacgaagaggaucugggaaucggcggccucaccgggaagcagcugcgggaacugcaggaccuccgccugauugaggaagagaacaugcuugcuccuucucugaaacaguucucccucagaguggagauccugcccagcuacauuccugugcgggucgccgaaaagauccuuuuuguuggagaguccgugcaaauguucgaaaaucagaacgugaaucugacacgcaaaggcucuauccucaagaaccaggaggauaccuucgcugccgaacugcauagacugaaacagcaaccccucuuuagccuggucgacuucgaacaggugguugaucggauucgcuccacgguggcggagcaccuuuggaagcugauggucgaagagagcgaccuccuggggcagcugaagaucauuaaagacuuuuaccuucucggaagaggcgaacuguuccaggccuuuaucgauaccgcucaacauaugcugaagacaccgccuaccgccgugacagagcacgacguuaauguggcuuuccagcagucugcccauaaaguccuccuggaugacgauaaccuucugccccuccugcaccugaccauugaauaucacgggaaggagcauaaagcggacgccacgcaagcucgggagggaccuucccgcgaaacaagccccagagaggcccccgcuucuggcugggccgcccuuggccucagcuacaaggugcaguggccucugcacauccuguuuaccccggcuguccucgaaaaauauaaugugguuuucaaguaccugcuuuccgugcggagaguccaggcggagcugcagcauuguugggcccuccaaaugcagcgcaagcaccugaaaucuaaccagacagaugcuaucaaguggcggcugagaaaucacauggccuuucuuguggacaaccuccaguauuaccugcaaguugaugugcuggagagccaguucucccagcuccugcaucagauuaauagcacccgcgacuuugaaucuauccggcuugcccacgaucauuuccuguccaaccuccuggcucagagcuuuauucugcuuaaacccgucuuccacugccucaacgagauccuggaccugugucauucuuucugcucccucgugagccagaaucuggggccucuugacgaaagaggagccgcgcagcuguccauucucgugaagggcuuuucucgccaaagcucccugcuguucaaaauccuuucuagcguucggaaccaccagaucaauuccgaucuggcucagcuccugcucagacuggacuauaacaaguacuacacccaggccgggggaacacuuggcagcuuugggauguga

SEQ ID NO: 77450 - RNA, 3075 nt, Artificial Sequence
  derived and/or modified sequence opt5 from TUBGCP5__Homo_sapiens__NP_001096080
auggccagacacgggcccccuuggagccggcuggacgcucagcaagagcgcgaugugagagaacucguccgcggcguugccggacugcaggacgaggcggauccgaacuuccagcuugcucugaauuuugccugguccaacuuccgcuuucauagauuccucgacgucaauucucacaagaucgaaaagaccauugagggcaucuacgaaaaguuugugauucauagcgaucuguccaaagccgcuucuuggaagcggcuuacagaggaguuccugaacgcuccccucccuagcaucaaagaaauuaagacggacgcccacuauuccauccugucucugcuccugugccuuagcgauucccccagcaauucuuccuacguggagaccccucgcaacaaggaaguggagaaaaaggacgauuuugacugggggaaauaucugauggaggaugaagagauggacaucggacccuacauggauacaccuaauuggagcgaagagucugaagaggagaacgaccagcaaccgcucuccagagaagacagcggcauucagguugaucggacaccccuggaggaacaggaccagaaucgcaaacuugauccuuguaucucuuggaaagacgagcccgaugacagauccuggcuggaacaucacgugguccaccaauauuggaccgcccggccuagccaguucccccauucccuccaucugcacucuaaccuggcggccgugugggaucagcaccucuacagcuccgacccgcuguauguuccugaugaccgcgugcuugucaccgagacacaggugauuagagagacccuguggcuccugagcggggugaagaaacuuuuuaucuuccaacugauugauggaaaagucacgguucggaauaacaucauugugacccaccucacacauucuugccugcgcuccgugcuggaacagaucgcugccuacggccaggucguguuuagacuccaagaguucaucgacgaaguuaugggccacagcucugagagcaugcugcccggguccggaucugugccuaagaaaagcaccgaagcucccuuucggacauaccaggccuucaugugggcgcuuuauaaguacuucauuuccuuuaaagaggagcuggccgaaaucgagaaguguauuaucaauaacgacaccacgauuacacucgcuaucgucguggauaaacuggcccccagacuuagccagcugaagguucuccauaagguguucucuaccggcgucgcugaagugccuccggacacacgcaaugucgugcgggccucccaucugcugaacacccucuauaaagccauccuggaguacgauaacguuggggaggcuagcgaacagaccgugucucuucuguuuucccucugggucgagacagugagacccuaucugcaaacgguugacgaauggauugugcacggacaccugugggauggcgcgcgcgaguucaucauucagcggaauaagaacgucccugugaaucacagagacuuuugguacgccaccuauacacuuuacagcguguccgaaaagaccgagaacgaggaaaagaugucugauaaugcuagcgccuccucugggagcgaccagggacccuccagccgccagcauacaaugguuucuuuccucaaaccuguccugaagcaaaucauuauggccggcaaguccaugcagcugcucaaaaaccugcagugcgcugagagcaccacgugucaggccggcgcgcgggaugcugaaagaaagucucuuuacacacuguuucucgaguccgugcaaagccgccugcggcacggggaagacucuacaccccaggugcugaccgagcagcaggccaccaaagagaaucuuaugaagaugcaaagcaucgccgaaucccaucucgagcuggaugacguccacgauccgcugcucgcuaucaacuucgccagaauguaucuggaacagagcgacuuucacgagaaauucgcuggaggcgacgugugcguugaucggucuuccgaaagcgugaccugucagacauuugagcuuacgcugcgguccugccucuacccucauauugacaagcaauaucuggauuguugcgggaaucugaugcagacccuuaagaaagacuacagacucgucgaguaucugcaggccaugcggaacuucuuucugauggaaggaggcgauacaauguacgacuucuauaccucuaucuucgauaagauucgcgagaaagaaacauggcagaaugugagcuuucucaacguucaacugcaggaggcgguggggcagagauaccccgaggacuccucucggcuuagcaucuccuucgaaaaugucgauaccgccaagaaaaagcugccugugcacauucucgacggacugacgcugucuuacaagguucccuggccuguggauaucgucauuagccuugagugucagaaaaucuauaaccaaguguuucuccugcugcuccagaucaagugggcuaaauacucccuggacgugcuucuguucggcgaacucgucagcaccgccgagaagcccagacugaaagaaggccugauucaugagcaggauacaguugcucaguuugggccgcaaaaggagccugugcgccagcagauccaccggauguuccuucugagagugaaacucaugcauuuugucaauucucugcacaacuauauuaugacccgcauccuccacuccacaggacuggaguuccaacaucagguggaagaagccaaggaccuugaccagcugauuaagauccacuacagauaucucagcaccauccaugaucggugccugcugcgcgagaaaguuucuuuugugaaggaagcgauuaugaaaguccuuaaccuggcccucauguucgcugacggcuggcaggccgggcugggaacguggagaauggaguccaucgagaagauggaaagcgauuuuaaaaauugccacauguuccucgugacaauucugaacaaggcuguuugucggggcucuuuuccccauugcgaguacaucaugcuuaaguauuucuaccuguguauuucccucuga

SEQ ID NO: 77451 - RNA, 5460 nt, Artificial Sequence
  derived and/or modified sequence opt5 from TUBGCP6__Homo_sapiens__NP_065194
auggccagcaucacccagcuguucgacgaucucugcgaggcucugcuucccgccgccaagacacaccugggccaaagauccgugaaccggaaacgcgcuaagagaucucucaaaaaggucgccuauaaugcccuguuuacgaaccuuuuccaggacgaaacccagcagcugcaaccugauaugagcaaacuccccgcucggaauaagauccugaugcuguccuuugaccuccgcguugggggacugggccccaaggccgauagacuugaggaacugguggaggaacucgaggcugccccuuguugcccccugcuugagguggggucuguccuggaccuccuggugcagcuggcgggaagcggcccuccccagguucucccucggaaacgcgauuauuuccugaacaauaagcauguggggagaaacgucccguacuccggauaugacugugaugaccuuucuguguuugaaauggauguucagagccugaucucccgggaggaaugccucugucacagcaugauucaagagacacuccaggugauggaggccgcucccggcaccggccuuccuacagucgggcuguucucuuuuggagaccccugcggcgaucgcuucgaaagagacacccgggugucccucuuuggggcccuggugcauagccgcacauacgacauggaugucagacugggacucccucccguuccggacaaugcugaucugucuggccuugccaucaaagugccucccuccguggaccagugggaggaugaaggguuccagagcgcgucuaaccugaccccugacucccaaagcgagcccuccgucacgcccgauguggaccucugggaagccgcucugaccuaugaggccucuaagcggcgcuguugggagagaguuggaugcccuccgggccaccgggaagaacccuaccuuacagaagcuggcagagaugccuuugacaaauucugucgccugcaucagggggagcuccagcugcuggccggaggcgugcuccaagcuccucagcccguccuggugaaggaaugcgagcuuguuaaggaugugcugaauguccucauugggguggucagcgcgaccuuuucccugugucagccugcccaggcuuucgugguuaaacggggagugcacgucagcggcgccucucccgaguccaucagcucucugcuuagcgaaguggccgaguaugggacaugcuacaccagacucucccacuucucucugcaaccgguucuggacagccucuacuccaagggacugguguuucaggcuuucacgagcggccuucgccgguaucugcaguacuauagagccugcguccucucuacaccucccacccugucccugcuuacaaucggcuuucucuucaaaaagcuggggcgccagcugcgguaccucgcggaacuguguggagugggcgcugugcuuccugggaccugcggaggcgggcccagagccgccuuuccuaccggcguuaaacugcucagcuaucuguaccaagaggcucugcauaacuguucuaaugaacacuaucccguccuucucucccugcugaagacaagcugcgagccguacacgcgcuucauucaugacuggguguacuccggaguguuucgggaugccuauggcgaguucaugauccaggucaaccacgaauaccucucuuuuagagacaaacuguauuggacccacggguacgugcuuauuagcaaggagguugaagauugugugccugucuuccugaagcauaucgcucacgacauuuaugugugcggaaaaacaaucaaucuccugaagcuguguugcccccgccauuaccuuuguugguccgauguucccgugccucggauuucugucaucuuuagccucgaggagcugaaagaaaucgagaaggacugcgccguguauguuggcagaauggaacggguggcgcgccacuccagcgucucuaaagaggaaaaggagcugagaauggagauugccaagcaggaacucaucgcucaugcccgggaggcugccuccagagugcugagcgcgcuuucugaucgccagauguccgaacggauggcccuggacgcuagaaaacgcgagcaauuccagagacucaaggaacaguuugugaaagaucaggagcggcgccaagccgcuagacaggaggaacuggacgaugacuucagcuacgcccgggagcugcgcgauagagaacggcgccuuaagucucuggaggaagaacuggagagaaaagcccggcaggcucuggucgaccacuacagcaagcucuccgcggaagccgcucgcagagagcaaaaggcccuguggcggauucagagacaccgccuugaaagcgcccggcugagauuccuccuggaggacgagaaacauauccaggaaaugcugaaggcuguuucugaggcccaccagccgcaagaacccccugaugugcuucuguccgugcauccccaggucaccagcccugggcccgagcacccugaaggaggccaggggugugacuccggcucugcggagcagcacagccccgcuugggauggauggaaccgcccgggccuccugacaccucaaccccucaaaccucuggccgugggggccggaggccgggggcuucagcaggcugagggagccagacccuuuuccgacucucugagcauuggcgauuuccucccgguugggccuggcgcggaacccuccgugcagaccggaauggucccucugcuggagguggcccuucaaacgaucaaucuggaccugccgcccucugcuccuggcgaagccccggcugccgcuagcacacagcccucccgcccucaggaguaugauuuuagcaccguucugcggcccgccguggcgaccucuccugcccccgggccucuccaagcugccgaaugcucccugggaagcucuggccuucagcugugggaggacuccugcgggaagauggaugcuuguggaagcgccucuagagagacacugcucccgucccaucccccucgccgggccgcucuggaagagggcagcucccagcccaccgaaagacuuuucgggcaggucagcggcggaggccugccuacaggggacuacgcgucugagaucgcccccacgcggccgcgcuggaacacccacggacaugugagcgaugcuuccauuagaguuggcgaaaacgugucugacgucgccccuacacaaccccgguggaauacccacgggcaugugagcaacgccuccaucucucucggagagagcguguccgaugucgcucccacacgcccuagauggaauauucacggccacguuucuaacgccagcauccgggugggcgagaauguguccgacgucgcgcccaccagaccucgcuggaacacgcaugggcacgugagcaaugcuucuauucggguuggagaaaacguguccgacgucgccccgaccagaccccgcuggaauacacauggccacgugagcgaugccucuaucucccugggggagagcguuuccgacauggcuccugcccggcccagauggaacacccauggacacgugucugaugcgagcaucucccucggcgaaagcgucucugacauggcuccuacacgcccccgguggaauacccacgggcauguguccgauacgagcauuagagucggagagaacgugucugacguugccccgauccgcagcagaugcaauacacacggccauguguccgaugccucuauuagccugggcgagccugucuccgacgugguuucuacccggccccgcuggaacacacacgugccuauucccccuccccacaugguccuuggggcucugagcccggaagccgagccuaauacccccagaccccagcaguccccuccgggacauaccagccagucugcucugucccucggcgcccaaagcacagugcuggauugugggccccggcuuccuguggaaguuggacccucccugucuagcccuuccucuggcugcggggagggaagcauuuccgucggcgaaaacgugagcgacguggcgcccacgcagccuugguggccgaacacccccggcgauucugucuccgaggagcucgggccuggacgcagcggcgacacagaagaccugucucccaauuggccucucaacucccaggaggauaccgccgcucagagcucucccgggagaggagaagaggccgaagcuagcgccgccgaggcucaaggcggggagcaggcguaucuggccggacuugcuggccaguaccaccuggaacgguauccggacuccuacgagucuaugagcgaaccucccaucgcccaucugcucagacccgugcugccucgcgccuuugcuuuccccguugauccucaggugcaauccgccgcggacgagacagcuguccagcuuagcgaacugcucacccugccggugcucaugaaacgguccauuacggcgccccuggccgcucacaucucucuuguuaauaaggccgcgguggauuacuuuuucgucgagcugcaucuggaggcccacuacgaagcucucagacacuuucugcuuauggaggacggcgaguucgcccagagccuguccgaucuccuguuugagaagcugggggcuggacaaacaccuggcgagcuccuuaacccccuggugcucaauucuguucucagcaaagcccugcaguguucccuucauggggacaccccucacgcuucuaaccugagccucgcccugaaguaccugcccgaaguguucgcgccgaaugccccugauguccucuccugccuugagcugcgcuauaaaguggacuggccccugaacaucgugauuaccgaaggaugucucagcaaguacucuggcgucuuuuccuuccugcuucagcugaaacucaugaugugggcucugaaggauguuugcuuccaucugaaacggacagcccuccuuagccacauggcugggucugugcaguuuagacaacugcagcuguucaagcacgagaugcagcauuuugugaaggucauccagggauauauugccaaucaaauccuccacgugaccuggugugaguuccgggcccgccuggcuacaguuggcgaccuugaggagauucagagagcgcaugccgaauaccugcacaaagcuguguuucggggccuccugacggagaaggccgccccugucaugaacgugauccauuccaucuucagccugguucucaaauuucgcucucagcuuauuucccaggcuugggggcccccuggaggccccagaggggccgaacacccgaauuucgcgcugaugcaacagagcuauaacaccuuuaaguacuauucccacuuccuguuuaaaguggucacaaagcucgugaaucggggauaccagccucaucuggaggauuuccuucugcgcaucaacuucaauaacuacuaucaagacgccuga

SEQ ID NO: 77452 - RNA, 1686 nt, Artificial Sequence
  derived and/or modified sequence opt5 from TUB__Homo_sapiens__NP_003311
augggcgccagaacaccccugccuagcuucuggguguccuuuuucgcugagaccgggauccucuuuccgggaggcacgcccuggccuauggggucucagcacagcaagcaacaucggaaacccggaccucugaagcgcggccacagacgggaccgcagaaccacacggcgcaaauacuggaaggaagggagagagauugcccggguccuugaugacgaaggacgcaaccugagacagcagaaacucgaucggcagcgcgcgcugcuugagcaaaagcagaagaaaaagagacaggaaccccugaugguucaggcuaaugccgacggccggccucgcuccagacgggccagacaaucugaggagcaggcuccgcucguggaaagcuaucuguccucuagcggcuccaccagcuaccaggugcaggaggccgauucucuggcuuccguccaacucggggccacacgccccaccgcgccugccagcgcuaaacggacaaaggccgcugccaccgcgggaggccaagggggagccgcuagaaaagaaaagaagggcaaacauaaggggacgucuggacccgccgcucuggccgaggacaaauccgaggcccagggcccugugcagauccuuaccguuggccagagcgaucacgcucaggacgcgggggaaacagccgcuggaggcggggagcgccccucuggacaggaucugcgggccaccaugcaaagaaagggcauuuccagcuccaugucuuucgacgaagaugaggaagacgaggaggaaaacagcuccucuagcucccagcucaauagcaacacacgcccgucuagcgccaccucccggaaaucugugagagaggcugccagcgcgccuucccccacggcuccugaacagcccgucgauguggagguucaggaccuggaagaguuugcccuucgccccgccccucaagggaucacaauuaagugccggaucaccagagacaaaaagggaauggaucgcggcauguauccgacauacuuccugcaucucgaccgggaggauggcaagaaaguguuucugcuggcugggagaaagcggaaaaagagcaaaaccucuaauuaucucaucuccgucgaccccaccgaucugagccgcggaggcgacucuuacauugggaaacuuagauccaaccugaugggaacaaaguucacgguguaugauaauggcgugaacccucagaaggccagcuccucuacccucgaaagcgggacacugcggcaggagcuugcugccgucuguuacgaaaccaauguucugggcuuuaagggacccagaaaaauguccgugaucgugccuggcaugaacaugguccacgagcgcgugucuauucggcccagaaaugaacacgagacacuccuggcgcgcuggcagaacaagaauaccgagagcaucauugaacugcaaaacaaaacgccgguuuggaaugacgauacacaguccuacgugcucaacuuccaugggagagucacccaggccagcgugaagaacuuucagaucauucacggaaaugacccugauuauaucguuaugcaauucggccggguggcugaggacgucuuuaccauggacuacaacuauccccugugcgcccuucaggcuuucgccaucgcgcugucuuccuucgauagcaagcucgccugugaauga

SEQ ID NO: 77453 - RNA, 1368 nt, Artificial Sequence
  derived and/or modified sequence opt5 from TUFM__Homo_sapiens__NP_003312
augaccacaauggccgcugccacgcugcucagagcgacaccccacuucagcggccuggcugccgggcggaccuuucuucugcagggacuccugcgccuucugaaggccccugcucucccgcugcugugcagaggccucgccguggaggcuaaaaagaccuacguccgggacaaaccccauguuaacguggggacaaucggacacguggaucauggcaagaccacacugaccgccgcgauuacgaaaauccuugccgaagggggaggcgcuaaguucaagaaauaugaggaaauugacaaugccccugaggaacgcgcuagaggcaucaccauuaacgccgcgcacgucgaguacuccacagccgcucggcauuaugcccacaccgauugucccgggcacgcugacuacgugaagaauaugaucacaggaaccgccccucuggauggcugcauccucguuguggccgcuaacgacgggcccaugccucaaacgcgcgagcaucugcuucuggcgagacagauuggagucgaacacgugguuguguaugucaauaaagccgaugcugugcaggacucugagaugguggaacucgucgagcuggagauccgggaacugcucacagaguuuggcuacaagggggaagagaccccgguuauugugggaagcgcccugugugcccuugaaggccgcgaucccgagcugggccucaaauccgugcagaagcugcuugacgcugucgauacauauaucccugugcccgccagagaccuggagaagccuuuccuccugcccguugaagcgguguacucugucccggggcggggaaccgugguuaccggcacacuggagcgcgggauucucaaaaagggagaugaaugcgagcugcuuggccauagcaaaaacaucagaacgguggucaccgggauugaaauguuucacaagucccuggagcgggcugaggccggagacaaucucggcgcccuggugcgcggccuuaaaagagaagaccugcggagagggcucgucauggugaagccuggaucuaucaaaccccaccaaaagguugaggcucagguguacauccugagcaaggaagagggcgggcgccauaaaccuuucgucucccacuuuaugcccgugauguucagccugacaugggauauggccugucggauuauccugcccccugaaaaggagcucgcuaugccgggagaggaccuuaaauuuaaccugauucucagacagcccaugauccuggaaaagggccagcgcuucacccugcgggaugggaauagaacaauuggcaccggacuuguuacgaacacacucgccaugaccgaggaagagaaaaauaucaaguggggcuga

SEQ ID NO: 77454 - RNA, 1098 nt, Artificial Sequence
  derived and/or modified sequence opt5 from TUFT1__Homo_sapiens__NP_001119809
augaacggcaccagaaauuggugcacacugguggacguccaccccgaggaucaggccgcugccgggcggaagacguacgcgaugguuagcucccauucugcuggacacagccucgccuccgaacugguggagucucaugacggccacgaagagaucauuaaaguguaucuuaaggggcgcagcggagauaaaaugauccaugaaaagaacauuaaucaacugaaauccgagguccaguacauccaggaggccagaaacugucuccagaagcugcgggaagacauuucuagcaaacuugaucgcaaucugggcgacucccuccacagacaagagauccaggugguucuggaaaagccuaacggguucagccagucuccgaccgcucuguauuccucucccccugagguggauacaugcaucaaugaggacgucgaaagccuccggaagaccgugcaggaucugcuugccaaacugcaagaggcuaagcgccagcaccaguccgacuguguugccuuugaagugacacucagcagauaccagcgggaggcggaacaaucuaacgucgcccugcagcgcgaggaggauagaguggaacagaaagaggcugaagugggagagcuucaacggcgccugcucggcauggaaaccgagcaucaggcccugcuggcuaaggucagagagggcgaaguugcccucgaggaacugcgguccaauaacgcggacugccaggccgagcgcgaaaaggcugccacacuugagaaagagguggcugggcugagagaaaagauucaccaucucgaugacaugcugaaaagccagcaacggaaggugagacagaugaucgagcagcuucaaaauuccaaagccgucauucagucuaaggacgccaccauccaggaacugaaagagaagauugcuuaucucgaggcggaaaaccuggagaugcacgaucgcauggaacaccugaucgagaagcagauuagccauggaaauuucuccacgcaggcccgggcuaaaaccgaaaaccccggcagcaucagaaucucuaagccucccuccccuaaaccgaugcccgugauucgcguuguggagacauga

SEQ ID NO: 77455 - RNA, 1470 nt, Artificial Sequence
  derived and/or modified sequence opt5 from TULP1__Homo_sapiens__NP_001276324
augccccugagagacgagacccuccgggaagugugggccagcgauuccggccacgaggaagagucucugagcccugaagcuccgcgcagacccaagcaacggccugcccccgcgcaacgccuucggaaaaagagaacagaggcuccugagucccccugcccuacggggucuaaaccgcgcaagcccggagaagaggaagaggaggaagaggacgaagaggaugaagaggaggaagccgaggagaaaaaggaaaagauccugcucccucccaaaaagccucugagagaaaaauccuccgccgaccuuaaggagcggcgcgcuaaagcccagggccccagaggggaucugggaucuccggacccucccccuaagccccuccggguccgcaacaaggaggcucccgccggcgaagggaccaaaaugagaaagaccaaaaagaaaggaagcggcgaggcggauaaggacccuuccggcagcccggccucugcucggaaaucccccgccgcuauguuccugguuggggaaggaagcccugauaagaaggcccugaaaaagaaaggcacacccaagggggcgcgcaaagaggaagaggaggaagaggaagccgcuacagugauuaagaagucuaaucagaaaggaaaggccaaaggcaaggggaaaaagaaggcuaaagaggagagagccccuagcccgcccguggaagucgacgagccucgggaauuugugcucagacccgccccucagggacgcaccguucgguguagacugacacgcgauaagaaaggcauggaccggggcauguaccccagcuauuuccuucaucuggauaccgagaagaaaguguuucuccuggcugggagaaagcgcaagcggucuaaaacggcgaacuaccuuaucuccauugacccuaccaaucugagcagaggaggcgaaaacuucaucgggaagcuccgcuccaaucugcugggaaaccgguuuacagucuucgacaauggccaaaacccccagagaggguauucuaccaauguggccagccuccgccaggagcuggcugccguuauuuacgagacaaacgugcuuggauuucggggcccgagacggaugaccgucaucaucccuggcauguccgccgaaaaugagcgcgugcccauuagaccccggaacgcuagcgaugggcugcucgugagauggcagaauaaaacgcuggaaucucuuaucgagcugcacaacaagccuccggucuggaaugacgauuccggaagcuauacacucaacuuccaaggccgcguuacccaggccucugugaaaaacuuucagauugugcaugcggacgaucccgacuacaucguccugcaguucgggcggguggcugaagaugccuuuacacuggacuauagauacccucucugcgcccugcaggcuuucgccauugcucuuagcuccuuugauggaaagcuggccugugaguga

SEQ ID NO: 77456 - RNA, 1563 nt, Artificial Sequence
  derived and/or modified sequence opt5 from TULP2__Homo_sapiens__NP_003314
augagccaggacaacgauacccugaugagagacauccucggccacgagcuggccgcuaugcggcuucaaaagcuggaacagcagcgcagacucuucgagaaaaagcagcggcaaaaacgccaggaacugcuuauggugcaggccaaucccgaugcguccccuuggcuguggagaucuugccuccgggaggaacgccugcugggggacagaggacucggcaacccguuucugcggaagaaagucagcgaggcucaucuucccuccgggauucacucugcccugggaacaguuagcuguggcggggauggacgcggcgagagaggccucccuacgccccggaccgaagccguguuccgcaaucuggggcuucaguccccuuuucugucuuggcuccccgacaacagcgaugcugagcuggaagagguguccgucgagaauggaagcgugucuccuccgcccuucaagcaauccccuagaauccggcgcaagggcuggcaggcccaucagagacccgggacacgggcugaaggagagagcgacucucaggauaugggcgacgcccacaaauccccuaacauggggcccaauccgggaauggauggcgacugcguuuacgaaaaccuggcguuucaaaaggaggaagaucucgagaaaaagagagaggccagcgaaucuaccggcacaaauuccagcgcugcccauaacgaggaacuguccaaagcucuuaagggggagggaggcaccgacucugaccacaugcgccacgaagccagccuggcgauucgguccccuugucccgggcucgaggaggauauggaagccuaugugcugagaccugcucuccccggaacaaugaugcagugcuaccugacccgcgacaagcauggcgucgauaaagggcuuuucccccuguauuaccuguaucucgagacgagcgacucucugcagcgguuucuucuggccggaagaaagcgccggagauccaaaaccagcaauuaccucaucucucuggauccuacacaccuuagccgcgacggcgauaacuucgugggcaagguucgguccaauguguuuucuaccaaauucacaauuuuugacaacggggucaauccggauagagaacaucugacccgcaacacggcucggaucagacaagagcucggagccguguguuaugaacccaacgugcugggcuaccuggggccucggaagaugacagucauccuccccggaaccaauagccagaaccagcgcauuaauguucagccucugaacgagcaagagucccuucugagcagauaccagcggggcgacaaacaggggcuccugcugcuucacaauaagacacccucuugggauaaggaaaacggcguguauacccucaauuuccacggaagagugacccgcgccuccgucaaaaacuuucagaucguggacccgaagcaucaagagcaccugguucugcaguucggccggguggggccugacacauucacgauggauuuuugcuuccccuuuagcccucuccaggcuuucucuauuugucuguccagcuuuaauuga

SEQ ID NO: 77457 - RNA, 1506 nt, Artificial Sequence
  derived and/or modified sequence opt5 from TULP3__Homo_sapiens__NP_001153880
auggaggccagcagaugccggcugucccccucuggcgacagcguguuccacgaagagaugaugaagaugcgccaggcuaaacucgauuaccaaagacugcuucuggaaaagcggcagcgcaaaaagagacucgagccuuuuaugguccagccgaaccccgaagcccggcugcgcagagcgaaaccucgggcuuccgacgagcagacaccccuuguuaauugucauaccccucacucuaacgugauccugcaugggauugauggacccgccgccgugcucaagccugacgagguccacgcuccgagcguguccucuagcguuguggaagaggaugccgaaaauacggucgacaccgcuuccaagcccggccugcaagagcgccugcagaaacaugauaucagcgagucugugaacuucgacgaagagacagaugggauuucccagagcgccugccucgaaagaccuaauucugcguccagccagaacucuaccgacacaggaaccuccggcagcgccacagcugcccaacccgcugauaaucugcuuggggacaucgaugaccuggaggacuuuguuuauuccccugcgccccagggagugaccguccggugucgcauuaucagagauaagcggggcauggaccgcggccucuucccgacguacuauauguaccuggaaaaagaggagaaccagaagaucuuucuucuggccgccagaaaacggaagaagucuaaaaccgcuaauuaucucauuagcaucgauccuguggaccuguccagagaaggggagagcuacgugggaaagcugcgcucuaaccucaugggcacaaaauucaccgucuaugaucgggggauuugccccaugaagggaagaggccugguuggggccgcucacacacgccaggaacuugccgccaucuccuacgagaccaaugugcugggauuuaaaggcccucggaagaugagcgugauuauccccggcaugacgcucaaccacaaacaaauucccuaccagccucagaauaaccaugacucucugcuuagcagauggcaaaaucgcacaauggaaaaccuggucgagcuccacaacaaggcuccgguguggaacuccgauacccagucuuauguucugaauuuccgggggagagugacacaggcgagcgucaagaauuuucagaucgugcauaaaaacgaccccgauuacaucguuaugcaauucggacgcguggccgacgaugucuuuacccuggacuauaauuacccucucugugcugugcaggccuucggcauugggcuguccagcuuugacaagugcauccagacccuucggaugcaggagcugugugaacuccacagacaacaccauucugccgcuucccugguccaccgcacagugugccagcgguggguuggacaucccuggagacuucugccucagacgagccuccuguggaccgaucugucucccccgccugugguccccgccccucaccagauuuccauguga

SEQ ID NO: 77458 - RNA, 2037 nt, Artificial Sequence
  derived and/or modified sequence opt5 from TULP4__Homo_sapiens__NP_001007467
auguacgccgcuguggagcacggccccguccugugcagcgacuccaacauccucugucugucuuggaaggggagaguuccuaaaagcgaaaaggagaaaccggugugccggcgcagauauuacgaagagggauggcuugccaccggcaaugggcggggaguggucggcgugacauucacguccucucauugucgcagagaucggagcacaccccagcgcauuaacuuuaaucugagagggcacaacuccgaaguugugcucguccgguggaaugagccuuaucaaaagcuggcgaccugcgacgcugauggaggcaucuucguguggauucaguacgagggccgcuggucuguugaacuugugaacgacagaggggcccaggucagcgauuuuaccuggucccaugacggaacacaggcccugaucagcuaucgggauggcuucgugcucguggggucugucuccggacaacgccacuggagcucugagauuaaucuggaaucccagaucaccuguggcaucuggacacccgacgaucagcagguucuguuugggaccgcugacggacaagugauugugauggauugccauggcagaaugcucgcccacguccugcuucacgagagcgacggcgugcuggggaugucuuggaacuacccuaucuuccucguugaggauuccagcgaauccgacacggacucugaugacuaugcucccccucaggauggaccggccgcguaccccauuccugugcagaauaucaaaccccugcuuaccgucagcuuuacauccggcgacauuagccugaugaacaauuacgaugaccucucuccuaccgugauccgguccgggcugaaggagguuguggcccagugguguacacaaggagaucugcucgcugucgccggcauggaacgccagacccagcugggggagcuucccaacggaccgcugcucaagagcgcuauggugaaauucuauaaugucagaggcgaacauauuuuuacgcuggacacacuugugcaacggccuaucaucucuauuugcuggggccacagagauagccgccugcucauggccuccgggcccgcgcuguacguugugcgggucgagcauagagugucuagccugcagcuccugugucagcaggccaucgcuuccacccuucgcgaggacaaggauguuagcaaacugacacucccuccccggcugugcucuuaucuuuccaccgccuucauucccaccaucaagccuccgauucccgacccuaacaauaugagagacuuugugagcuaccccucugcuggaaacgaacgccugcacuguacaaugaaacggacggaggaugacccugaagucggcgggcccugcuauacccucuaccuggaguaucugggaggccucgugccgauccugaaggggagacgcaucuccaaacuucggccugaguucgugauuauggaucccagaacagacagcaagccugaugaaaucuacggcaacucccugauuucuaccguuaucgacagcugcaauuguuccgauucuagcgacauugagcucuccgaugacugggccgccaagaaaagccccaagaucucucgcgcuuccaaaagcccuaagcugccccggaucucuauugaagcgagaaaauccccgaagcugccucgggccgcucaagagcuuagccgcucucccagacucccccugcggaagccuagcgucggauccccgagccugacaagacgcgaauuucccuucgaggauaucacccagcacaacuaccucgcccaggugacgucuaauauuuggggcacaaaauucaagaucguggggcuggccgcuuuucuuccuaccaaccugggagccgucauuuauaaaaccucccuccugcaucugcagccccggcaaaugacaaucuaccuuccugaagugagaaagauuagcauggacuauaucaaucuccccguuuucaacccuaauguguuuuccgaggaugaggacgaccugcccggcgaugcggucuggaccgacuga

SEQ ID NO: 77459 - RNA, 639 nt, Artificial Sequence
  derived and/or modified sequence opt5 from TUSC1__Homo_sapiens__NP_001004125
augggccccauguggagaaugcgcgggggagccacccggagaggcagcugcugugggggagacggcgcugccgaugggcggggaccuggccgcuccggcagagcgcgcgggggaggcucuccgagcgggggaggcgggggagugggcuggcggggcagagcugacggggcccggcagcaacuggaggaacgcuucgccgaucucgcugccucccaccuggaggcuaucagagcccgggacgaaugggaucgccagaacgcgagacuucggcaggagaaugcccgccugagacucgaaaaccggagacugaagcgcgagaaucggucucuuuuuagacaggcucugcgccuccccggagagggcgggaacggaacgccugccgaagcucggagaguccccgaggaagccagcacaaaucgccgggcgagagacuccggccgcgaggaugagccugggucuccccgggcccugagagcucgccuggaaaaacucgaggccauguaccggagagcucugcuucaacugcaucucgaacagcggggaccucgcccgagcggcgacaaggaggaacagccccugcaggagccugauuccggccuuagaagccgggacucugagcccuccgggccuuggcuguga

SEQ ID NO: 77460 - RNA, 333 nt, Artificial Sequence
  derived and/or modified sequence opt5 from TUSC2__Homo_sapiens__NP_009206
augggcgccagcggguccaaggcuagaggacuguggcccuucgccucugcggcuggcgggggaggcagcgaggccgccggggcugaacaggcccucgugagaccucgcggcagagcugucccgcccuuuguuuucacccggcgcggauccauguuuuacgacgaggauggcgaccuggcccacgaguucuaugaagaaacaaucgugacgaaaaacgggcaaaagagagcgaaacuucggcgcgugcauaagaaucugauuccucagggaaucgucaaacucgaucacccccggauucauguggacuuuccuguuauccuguacgagguguga

SEQ ID NO: 77461 - RNA, 1047 nt, Artificial Sequence
  derived and/or modified sequence opt5 from TUSC3__Homo_sapiens__NP_006756
augggcgccagaggggcucccagccggcgcagacaggccggacggcgccugagauaccucccuaccggcuccuucccguuucugcuucugcuccugcuucugugcauccaacucgggggaggccagaagaaaaaggagaaccugcuggcggaaaaaguggagcagcucauggaauggucuagccggcgcuccauuuucagaaugaauggggacaaguuucggaaauucaucaaggcucccccucgcaacuauucuaugauugucauguuuacagcccugcagccccaaagacaguguagcguuugccggcaggccaaugaggaauaccagauccuugcuaacuccuggcgcuauucuagcgccuucuguaauaagcuguuuuucuccaugguggauuacgacgagggaacggauguguuucaacagcucaacaugaauagcgcuccuaccuucaugcacuuucccccuaaaggcagaccgaagcgggccgacacauucgaucugcagcgcauuggcuuugcggccgagcagcuugcuaaauggaucgccgacagaaccgauguccauauccggguguucagacccccuaacuauucugggacaauugcucuggcccuccugguuucccuggugggaggccuccuguaccuucgccggaauaaccuggaguucaucuauaauaagaccgggugggcgauggucagccucugcauuguguuugccaugacaucuggacaaauguggaaccacaucagagggcccccuuacgcucauaaaaauccccacaacggccagguuuccuacauucauggaagcucucaggcccaauucguggcugaaucccacaucauucugguccuuaaugccgccaucaccaugggcauggugcugcucaacgaagcugcgacgagcaagggcgacguggggaagcgccggaucauuugucuggucggacugggccucguuguguuuuucuuuuccuuccugcuuucuaucuuuagaagcaaauaucacggguacccguauuccgaucuggacuucgaguga

SEQ ID NO: 77462 - RNA, 534 nt, Artificial Sequence
  derived and/or modified sequence opt5 from TUSC5__Homo_sapiens__NP_758955
auggcccaccccgugcagagcgaguucccuuccgcucaagaaccgggcucugccgcguuucuggaccuccccgagauggaaauccugcuuaccaaggcugagaacaaagaugacaagacacugaaucucagcaaaacgcuguccgggccucuugaucuggaacagaacucucagggacuccccuucaaggccauuagcgagggccaucuggaggccccucugcccagauccccuucucgggcuagcucccgcagagccagcucuaucgcuaccacauccuacgcccaggaccaagaagcgccgcgggauuaucucauucuggccgucguugcuugcuuuugucccguguggccucuuaaucugaucccccucauuaucagcaucaugucucgcuccagcaugcagcaggggaacguggacggagccagacggcugggccgccuugcuagacugcucucuauuacccugaucauuauggggaucgucauuaucaugguggccguuacagugaauuucaccguccagaaaaaguga

SEQ ID NO: 77463 - RNA, 2739 nt, Artificial Sequence
  derived and/or modified sequence opt5 from TUT1__Homo_sapiens__NP_073741
augagccugcccaucggcuccgccgagguggcuucugaaagagucgagcucuggcggagcggguuccgcugguggcagagaugccuguguuuuugccgguaccgcagaguugccauggcggcuguggacuccgauguggaaucucuuccucggggaggcuuccgcuguugccugugucacgucaccacagccaacagaccgagccucgacgcccaucuugggggacggaagcaccgccaucugguggagcugagagcugcccggaaagcucaaggccuccgcuccguuuuugugucuggguuccccagagaugucgacagcgcccagcuguccgaauauuuucuggcguucggaccuguggccagcguugugauggauaaggacaaaggcgucuuugcuauuguggagaugggcgaugugggggcccgggaggcuguccucucucagucccagcacagccugggaggccaucgccuuagaguucggcccagagaacaaaaggaguuccagucuccugccuccaaaagccccaagggggcggccccugacucucaccagcuggcuaaggcccucgcugaagccgccgaugugggagcucagaugaucaaacuggugggccuucgcgagcuguccgaggcggaacggcaacucagaagccuggucguggcccugaugcaggagguuuuuacggaguucuuuccggggugcgugguccaccccuucggauccucuauuaauagcuuugacgugcauggcugugaucucgaccuguuccuugaucugggcgaccucgaggaaccucagcccguuccuaaggcucccgaguccccgagccuggacucugcccuugccuccccucuggauccccaggcucucgccugcaccccugcgagcccucccgacucucaacccccggcuagcccccaggauuccgaggcccuggacuucgaaacaccuucuagcucccuggcuccccagaccccugauagcgcccucgccucugagacacuggcuagcccccaaucccuuccgccugccucuccccugcucgaagaccgcgaggaaggggaucugggaaaagcguccgagcuugccgagaccccuaaggaagagaaagcugaaggcgccgcuaugcuggagcucguggggagcauccugcggggauguguccccggcguguacagaguccagacagugccuuccgcccgccggcccguugugaaguuuugccacagaccgucugggcugcauggagacgucagccucuccaaccgccuggcgcuucacaauucucgguuccugagccucuguuccgaacuggauggcagagugcgcccucugguuuauacccuucggugcugggcccagggcagagggcucagcggaucuggcccccugcuguccaacuacgcucucacgcugcuugugauuuauuuucugcagacccgggaucccccuguccucccgacagugagccaacugacccagaaggccggggagggagaacagguggaaguugacggcugggacugcucuuucccccgcgacgcuuccagacuggagccuagcaucaaugucgaaccccuuucuagccuccuggcccaguuuuucuccugugugagcugcugggaucugcgggggucucuccugucccuuagagagggccaagcccugccuguggcuggaggccuccccagcaaccugugggaggggcugcgccuuggaccucucaaucugcaggaccccuuugaucugucccacaacgucgcggccaaugugacaucucggguugcuggcagacuccagaacuguugccgcgccgccgcuaauuacuguagaagccugcaguaucaacggcgcuccucuagagggcgggacuggggacuucugccgcuccugcagccuagcucccccucuagccugcuuuccgccaccccuaucccccucccgcuggcgccuuucacgcagcugacagcugcccucgugcaggucuuucgcgaagcccugggcugccauauugagcaagcuaccaaaagaacacggagcgaagggggcggaaccggcgagucuucccaagggggaaccagcaagcgccuuaaaguggauggccagaagaacuguugcgaagaggggaaagaggaacagcagggaugugccggcgacgggggcgaggauagaguugaagagauggugaucgaagucggagagauggugcaggacugggcgaugcagucucccggccaaccuggggaucugccccucacaacgggaaagcacggcgcucccggggaggaaggacagccuucccaugccgcccuggcugagcggggcccgaaagggcacgaagccgcucaggaguggagccagggcgaagccggaaagggcgcgucucugcccuccagcgccuccuggcgcugcgcucuuuggcauagaguuuggcaagggcggagacgcgcccggagacgccugcagcagcagaccaaggagggagcuggcgggggagccggcacacgggccggcuggcucgcuaccgaggcgcaagugacacaggaacugaaagggcucagcggaggcgaggaaagaccugagaccgagccccugcuuucuuucgucgccagcguguccccugcugaccgcaugcugacggugacaccccuccaggauccucaagggcuguuuccggaccugcaccacuuccuucaggucuuucugccccaggccauucggcaucucaaguga

SEQ ID NO: 77464 - RNA, 618 nt, Artificial Sequence
  derived and/or modified sequence opt5 from TVP23B__Homo_sapiens__NP_057162
augcugcagcaagacagcaacgaugacaccgaggaugugucccucuucgacgccgaagaggaaacaacgaauagaccccggaaggcuaaaauccgccacccugucgccagcuuuuuccaucuguuuuucagaguuucugcgauuaucguguaccuucugugcggccuccuguccucuagcuuuauuaccuguauggugacaaucauucuucugcucuccugcgauuucugggcugucaagaacgugaccgggcggcugaugguuggacugcgcugguggaaucacaucgacgaggauggcaaaucucauuggguguuugaaagcagaaaggaguccagccaggagaacaaaacagucucugaagccgagucccggaucuucuggcucgggcugauugccuguccggugcuuuggguuaucuuugcuuucagcgcccuguuuucuuuccgcgugaaguggcucgcugucgugauuaugggagugguccugcagggcgccaaucuuuauggguacaucagaugcaagguucggucccgcaaacaccugaccagcauggcgacaucuuauuuuggaaagcaguuccucagacaaaacaccggcgacgaucagacguccuga

SEQ ID NO: 77465 - RNA, 1074 nt, Artificial Sequence
  derived and/or modified sequence opt5 from TWF1__Homo_sapiens__NP_001229326
augagccaccagaccggcauccaagccuccgaggacgugaaggaaauuuucgcuagagcccggaacgggaaauaccgccugcucaagaucucuauugagaaugaacagcuggucaucggaagcuauucccagcccucugauagcugggacaaagauuacgacuccuuuguucuuccucugcucgaggauaagcagccgugcuauauucuguucagacuugacucucaaaacgcgcagggcuacgaauggaucuuuaucgcuuggagccccgaucauucccacgugcggcagaaaaugcuguaugccgccacacgcgcuacgcucaagaaggaguucgggggaggccauauuaaagacgagguguuugggaccgucaaggaagaugugagccugcacggauacaaaaaguaucugcucucucaguccagcccugcuccccugacagccgccgaggaggaacuuagacaaaucaaaauuaaugagucuccugaagaccauaucggcguucagaccgaugugggcgucgacacaaagcaccagacccugcaggggguggcguuccccauuucccgggaggccuuucaagcucucgaaaagcugaacaaucgccagcuuaacuacguucagcuggagaucgauauuaaaaaugaaaucaucauucucgccaacacaaccaauacggagcugaaggaccugccuaaaagaaucccgaaggacagcgcucgguaccacuucuuucucuauaaacauucucacgagggagauuaccuggaauccauuguguucaucuauagcaugcccggcuacaccuguuccauucgcgagagaaugcuuuauucuagcugcaagucccggcugcucgaaaucgucgagcgccaacugcagauggacgugaucagaaaaauugaaaucgauaacggggacgagcuuacagccgauuuucuguacgaggaagugcauccuaagcagcacgcgcacaagcagagcuucgccaaacccaagggaccugcuggcaaacgggggauucgcagacucauccggggacccgccgagaccgaagcuacaaccgacuga

SEQ ID NO: 77466 - RNA, 609 nt, Artificial Sequence
  derived and/or modified sequence opt5 from TWIST1__Homo_sapiens__XP_011513798
augaugcaggacgugagcuccucucccgucagcccugccgaugacucccugucuaacagcgaggaggaaccggauagacaacagcccccuuccggcaagcgcgggggacggaaaagacggucuagccgcagauccgcuggcgggggagccggccccgggggagcggcuggcggcgggguuggaggcggggacgaaccuggaagccccgcccagggcaagcgggggaaaaagucugccggaugcggcggcgggggaggcgcugggggaggcgggggauccagcucuggcggcggguccccucagagcuacgaggaacuccaaacccagcgcgugauggccaaugugagagagcggcagcgcacacagucucugaacgaggcuuucgccgcgcuuagaaaaaucauuccgacgcugcccuccgauaagcucagcaagauccaaacccugaaacuugccgcucgguauauugacuuucuguaccagguccuccaguccgaugaacuggacucuaagauggccagcuguuccuauguggcucacgagcgccugagcuacgccuucucuguuuggagaauggaaggagcgugguccaugagcgccucucauuga

SEQ ID NO: 77467 - RNA, 483 nt, Artificial Sequence
  derived and/or modified sequence opt5 from TWIST2__Homo_sapiens__NP_001258822
auggaggaaggcagcuccucucccgugagcccugucgacucccuggggaccucugaggaggaacucgaaagacagccgaagcgguucggacgcaaaagacgguacagcaagaaauccucugaggauggcagccccacaccugggaagcgcggcaaaaagggaucccccagcgcccaaucuuuugaggaacugcagucccagagaauccuugcuaacguucgggagcgccagagaacgcaaagccugaaugaagccuucgcggcucuccggaagauuaucccuacccugcccucugacaaacuuuccaagauucagacacugaaacucgccgcccgcuauaucgauuuucuguaccaggugcugcagagcgacgagauggauaacaagaugaccucuugcuccuauguggcucacgagagacucagcuacgccuucuccgucuggcggauggaaggggcuuggucuaugagcgccucccauuga

SEQ ID NO: 77468 - RNA, 672 nt, Artificial Sequence
  derived and/or modified sequence opt5 from TWSG1__Homo_sapiens__NP_065699
augaagcugcacuacguggccguccucacccuggcuauccuuauguuccugacauggcuccccgagagccuguccugcaacaaagcccuuugugcgucugacguuagcaagugccugauucaggaacucugucaaugcagaccuggcgaggggaauuguuccugcuguaaagaaugcaugcugugucugggagcucucugggaugagugcugugacugcgugggcaugugcaacccgcggaauuauucugauacgcccccuaccagcaaguccacaguggaggaacugcaugagcccaucccuucucuuuuucgcgcccugaccgaaggggacacacagcucaacuggaauauugucagcuuccccguggccgaggaacugucccaccaugagaaccuuguuagcuuucuggagaccgugaaucagccucaccaucagaacgucucugugccguccaauaacguucacgcucccuacagcucugauaaagaacacauguguacaguggucuauuucgacgauugcauguccauccaucaauguaagauuagcugcgagucuaugggagccuccaaguacagaugguuucacaaugcuuguugcgaauguaucggcccugagugcaucgacuaugggagcaaaaccgugaaguguaugaacugcauguucuga

SEQ ID NO: 77469 - RNA, 1584 nt, Artificial Sequence
  derived and/or modified sequence opt5 from TXK__Homo_sapiens__NP_003319
augauccugagcuccuacaacaccauucagucuguguucugcuguugcuguugcuguagcguccaaaagagacagaugcggacacagaucucccucucuacggacgaggaacugcccgagaaauauacccagcgcagacggccuuggcuuagccaacuguccaauaagaaacagucuaacacaggccgcguucagccgagcaagagaaaaccccucccuccccugccucccuccgaaguggccgaggaaaagauucaggugaaggcucuuuacgauuuucugccucgggagccgugcaaucucgcccugcgcagagcggaggaauaucugauccucgagaaauacaacccccacugguggaaggcucgggaccgccuggggaaugaaggacuuauuccuagcaacuaugucaccgagaauaaaaucacaaaccuggagaucuacgaaugguaucauagaaauauuacccggaaccaagccgagcaccuccugcgccaggaaucuaaggagggcgccuucaucgugagagauucccggcaucuugggagcuacacaauuucuguuuuuaugggagcucgcagauccaccgaagccgcuaucaaacacuaccagauuaagaagaaugacagcggccagugguauguggccgagcggcaugcguuccaaucuauccccgagcugauuugguaccaccagcacaacgccgcugggcucaugacgagacugcgcuauccugucggacugaugggcuccugucuccccgccaccgcuggcuuuagcuacgaaaaaugggagaucgauccguccgaacuggccuucaucaaggagauugggucuggacaguuuggcgugguucaucuuggggaauggcggagccacauccaaguggcgauuaaagccaucaaugagggauccaugagcgaggaagacuucauugaggaagcuaaggucaugaugaaacugucucauuccaagcucgugcagcuguauggcgugugcauccagagaaaaccucuuuacaucgucacagaguuuauggaaaacgggugucugcucaauuaucugcgcgagaacaagggaaagcugcggaaagagaugcuccugagcguuugccaggauauuugugaaggcauggaguaccuugaaagaaacggcuacauccaccgcgaccuggccgcucggaauugccucgugucuagcacaugcauugugaagaucuccgauuucgggaugaccagauauguccuggacgaugaguacgugucuagcuuuggagccaaauuccccauuaagugguccccucccgagguuuuucuuuucaacaaauauagcucuaaguccgacguguggagcuucggcguccugaugugggaaguguuuaccgaggggaagaugcccuucgaaaauaaaucuaaccuccaaguuguggaggccaucuccgaaggauuucgccuguaccggccucaccuggcuccgaugagcaucuaugaggucauguacuccuguuggcaugagaagcccgaaggcagaccuacguucgcggagcuccugcgcgccgugacagaaauugcugagaccugguga

SEQ ID NO: 77470 - RNA, 1191 nt, Artificial Sequence
  derived and/or modified sequence opt5 from TXLNG__Homo_sapiens__NP_001162154
auggccaccagaguggaggaagcugcccggggccgcgggggaggcgcggaggaagcuacagaggccgggagaggaggccggcgcagaagcccccggcagaagcuggaagagucccgcucuguccaaaaacagaugaagauccuccagaaaaagcaggcccaaauuguuaaagagaaggugcaccuucagagcgaacauuccaaggcuauccuugccagaucuaaacuggagagccucugccgggaacugcagcgccacaacaagacgcuuaaagaggagaauaugcagcaagcuagagaagaggaagaacggcgcaaggaagccaccgcgcauuuccagauuacacugaacgagauccaggcccagcucgagcaacacgacauucauaaugcuaaacugagacaggaaaacaucgagcugggggaaaagcucaagaaacugaucgagcaguacgcccuucgggaggagcacauugauaagguguuuaaacacaaggagcugcaacagcagcucgucgacgcuaaacugcagcaaaccacacagcuuaucaaggaagccgaugagaaacaucagcgcgaaagagaguuccugcucaaggaagcgaccgagucccggcacaaguaugagcagaugaaacaacaggaagugcagcugaagcagcaacugucucucuacauggacaaauuugaggaguuccagacaaccauggccaagagcaaugagcuguuuacgaccuucagacaggagauggaaaagaugacaaagaagauuaaaaagcuggagaaagaaaccaucauuuggcgcacaaagugggagaacaauaacaaagcucugcuccagauggccgaagagaagaccguucgggauaaggaguauaaagcucugcaaaucaaacuugaaagacuggagaaacucugucgcgcccugcagacggaacggaaugagcugaacgaaaagguggagguccucaaagaacagguguccauuaaggccgcuaucaaggcggccaauagagaccuggcuacaccuguuaugcaaccgugcaccgcccuugauagccauaaagaacugaacacaucuuccaagcgcgcccucggagcucaccuggaggccgaacccaaaagccagcggucugcggugcagaagccucccuccaccggcagcgcuccugccaucgagucugucgacuga

SEQ ID NO: 77471 - RNA, 594 nt, Artificial Sequence
  derived and/or modified sequence opt5 from TXN2__Homo_sapiens__XP_005261565
auguacgugcccccuagaggcagcgacgaucggcgcgcccuggacagacaagggggacucggcugcgcuucccugcggucucacugucgcgagauggcccagagacuucugcuccggcgcuuccuggcgagcgucaucuccagaaagccgucucaggggcaguggcccccucuuaccagccgggcucugcagacaccccaaugcuccccuggaggccucacgguuacccccaacccugcccgcacaauuuauaccacaagaaucucucugaccacauuuaauauucaggaugggccggacuuccaggaucggguggugaacagcgaaacccccgucgugguugacuuucaugcccagugguguggaccuugcaaaauccugggcccccgccucgagaagaugguggcuaaacaacacggcaaggucgugauggccaaaguugauauugacgaucauacggaccuggcuaucgaauacgagguguccgccgucccuaccgugcuugcgaugaagaauggggauguggucgacaaguucguuggaaucaaagaugaagaccagcuggaggccuuucucaagaaacugauuggcuga

SEQ ID NO: 77472 - RNA, 1083 nt, Artificial Sequence
  derived and/or modified sequence opt5 from TXNDC15__Homo_sapiens__NP_078991
auggugcccgccgcuggcagacggccuccgcgcgucaugagacugcucgggugguggcagguucugcuuugggugcugggacuccccgugcggggcgucgagguggccgaagagagcgggcgccugugguccgaggaacaaccugcgcacccccuucagguuggagcuguguaccugggcgaagaggagcuccugcaugacccuauggggcaggauagagccgccgaagaggcuaacgccguccugggacucgacacccagggcgaucacauggugaugcugucuguuauccccggcgaagcugaggacaaggugagcuccgagccuucuggggucacaugcggagccggcggggcggaagauagccgguguaaugugcgcgagucccuuuucucucuggacggagccggcgcucauuuuccggauagagaagaggaauauuacacggagcccgagguggccgaaagcgacgcugccccuaccgaggauuccaacaauacagaaagccucaaaucucccaaggucaacugcgaggaacggaauauuaccgggcuggagaacuucacacuuaaaauccugaauaugucccaagaccucauggauuuucugaacccuaauggaagcgacuguacccugguucucuucuauacacccuggugccgcuuuucugcgucccuggccccgcacuucaacagccuuccuagagcuuuucccgcccugcauuuccucgcucuggaugccucucagcacuccagccuuuccacccgguuuggcacgguggccgugccuaauauucuccuguuccagggcgcuaagcccauggcgcgcuuuaaccacaccgacagaacacuggagacccugaaaaucuucauuuuuaaucagacagggaucgaagccaagaagaacgucgugguuacccaagcugaccagaucggaccccucccuucuacgcugauuaaaagcguggauuggcuucuggucuucucccucuucuuucugaucagcuucauuauguacgccacaauccggaccgagucuauucgcuggcuuaucccgggccaggaacaggagcauguggaauga

SEQ ID NO: 77473 - RNA, 2478 nt, Artificial Sequence
  derived and/or modified sequence opt5 from TXNDC16__Homo_sapiens__NP_065835
auguucagcggcuuuaacguguucagagucgggaucuccuuuguuauuaugugcaucuucuacaugcccaccgucaauucucugccugagcucagcccgcagaaguauuuuuccacacugcaacccggaaaagccucucuugcuuacuucugucaggccgacagcccucggacguccguguuucuggaggagcucaacgaagcggugcgcccccugcaggauuauggcauuucuguggcuaagguuaauugcgugaaagaggaaaucagcagauacugugggaaggagaaagaccuuaugaaggccuaucuguucaagggaaacauucuccugcgggaguuuccuaccgauacacuguucgacgucaaugccaucguggcucacguucucuuugcccugcuuuucuccgaagugaaauacaucaccaaccuggaggaucuccagaauauugaaaacgcucugaagggcaaagccaauaucauuuuuagcuauguccgcgcgaucgggauucccgagcauagagccgugauggaggcugccuucguguacggaacaaccuaccaauucguccuuacaaccgaaaucgcucugcucgagucuauuggcuccgaagacguugaguaugcccaccuguacuuuuuccauugcaagcuggugcucgaucugacgcagcagugucggcgcacccuuauggaacagccucugacaacccucaacauccaccuguuuaucaaaacaaugaaggcgccgcuucugaccgagguggccgaggacccccaacaggucagcacggugcaucuccagcugggccugccucucguuuucauugugucucagcaagcuacauaugaagccgauagacggaccgcugagugggucgccuggcgccugcuugggaaggccggagugcugcuccugcuuagagacucccuggaaguuaauaucccccaggaugcuaacguggucuuuaaacgggcggaggaaggcgugccugucgaguuccucgugcugcacgacguugaucugauuaucagccacguggagaauaacaugcauauugaagagauccaggaagacgaggacaaugauauggaagggcccgacaucgauguccaagacgaugagguggccgagacaguuuuucgcgacagaaagcggaaacucccgcuggaacuuaccguggagcugaccgaagagacauucaacgcuacggucauggccucugauuccauugugcucuuuuacgccggauggcaggcugugagcauggccuuccugcaguccuauaucgacguugcggucaagcugaaaggcaccucuacaaugcuucucacccgcauuaacugcgcugauuggagcgacguguguacaaagcagaaugugaccgaguuuccuaucauuaaaauguacaagaagggggaaaaccccgucuccuaugccggaaugcugggcacggaggaucugcucaaauucauccaacugaauagaaucagcuacccugugaacauuacaucuauccaggaagccgaggaauaccuuuccggcgagcuguauaaggaccucauucuguacagcucuguuagcgugcuggggcucuuuucccccaccaugaaaaccgcuaaggaggacuucucugaagccggaaauuaucuuaaaggcuacgucaucacagggauuuauagcgaggaagaugugcugcugcucuccaccaaguacgcugccagccugcccgcgcuucugcucgcccggcacacagagggaaagaucgaaucuauuccucuggcuuccacgcaugcccaggacaucguucagaucauuaccgaugcucugcuugagauguucccggagaucacaguggaaaaccuccccagcuauuuuagacugcaaaaaccucugcucauucuguucucugacggcaccgucaauccccaguacaagaaagccauccuuacacuggugaagcagaaauaccucgauuccuuuaccccuugcuggcugaaccugaagaauacgcccguugggcgcggcauucuucgggcguauuucgacccgcucccuccccugccucugcucgugcuggucaaccuucacagcggaggccagguguuugccuuccccuccgaucaagcuaucaucgaggaaaaucuggugcucuggcugaagaaacuggaggccgggcuugaaaaccacauuaccauccugccugcucaggaguggaagcccccgcucccugccuacgacuuucugucuaugauugaugccgcuacaagccagagaggaacccgcaaaguccccaaguguaugaaagagacagacguucaggaaaaugauaaggagcaacaugaagacaaguccgcggugcggaaagagcccaucgagacccucagaauuaagcacuggaaccgcucuaauugguucaaagaagccgaaaagagcuuucggagagauaaagaacugggcugcuccaaggugaacuga

SEQ ID NO: 77474 - RNA, 372 nt, Artificial Sequence
  derived and/or modified sequence opt5 from TXNDC17__Homo_sapiens__NP_116120
auggccagauacgaggaagugagcgucuccggcuucgaggaauuucaccgggcuguugagcagcauaacgggaagaccaucuucgccuauuuuacaggaucuaaagacgcgggcggaaagagcuggugccccgauugugugcaagcugaaccugugguccgcgaggggcugaaacacauuuccgagggcugcguguucaucuacugucagguuggggaaaagccguauuggaaagaccccaauaacgauuuuagaaagaaucucaaggugacggccgucccuacccugcuuaaauacggaacaccccagaagcugguggagucugaaugccuccaggccaaccugguugagaugcuuuucagcgaggacuga

SEQ ID NO: 77475 - RNA, 975 nt, Artificial Sequence
  derived and/or modified sequence opt5 from TXNDC5__Homo_sapiens__NP_001139021
auggaggacgccaagguguacgucgcuaaaguugauugcaccgcccacagcgacguguguuccgcgcagggcgugagaggguaucccacacugaaacucuucaagccuggacaagaagcugucaaguaccagggcccgcgggauuuucagacgcuggagaacuggaugcuucagacccugaaugaagaacccgugacaccugaacccgagguugagccucccucugccccugaacucaaacaagggcuguaugagcuuagcgccuccaacuucgaacugcauguggcucagggagaccacuuuaucaaguucuuugccccguggugcggccauuguaaggcucucgcccccaccugggagcagcuggcgcuggggcucgagcacucugaaacagucaaaauuggaaagguggauugcacccagcauuacgagcuguguagcggcaaucaaguucgcggcuauccuacacuucugugguucagagacgggaaaaagguggaucaguacaaaggaaagcgggaccucgaaucccugcgcgaguaugucgaaucucagcuucagagaaccgagacgggcgccaccgagacagugacccccagcgaagcuccugugcuggccgcugagcccgaagccgauaaggggacaguccucgcgcugaccgagaacaauuuugacgauacgaucgccgaaggaauuacauucaucaaauuuuacgcuccguggugcggccacuguaagacccuggccccuacaugggaggagcucuccaaaaaggaguuccccgggcuggcuggaguuaaaauugccgagguggacugcaccgccgaacggaacaucuguagcaaguacucugugcgcggcuauccuacccuucugcucuuuagaggcgggaaaaaggucuccgagcacagcggaggccgggaucuggacucucuucaucgcuucgugcugucccaagcuaaggacgaacucuga

SEQ ID NO: 77476 - RNA, 258 nt, Artificial Sequence
  derived and/or modified sequence opt5 from TXN__Homo_sapiens__NP_001231867
auggugaagcagaucgagagcaaaaccgccuuccaagaagcucuggacgccgcgggcgauaagcucgucguuguggacuuuuccgcuacauggugcgggcccuguaaaaugauuaagccuuucuuucacgauguggccucugagugcgaagucaaauguaugccgacguuccaguuuuucaagaagggacagaaagugggcgaguuuagcggggccaacaaggaaaaacuggaggcuaccaucaaugagcuuguuuga

SEQ ID NO: 77477 - RNA, 870 nt, Artificial Sequence
  derived and/or modified sequence opt5 from TXNL1__Homo_sapiens__NP_004777
auggugggcgucaagcccguugggagcgacccugauuuccagccggagcuguccggagccggcucuagacucgcuguggugaaauuuaccaugcgggggugcggacccugucugcgcaucgccccugcguucagcuccaugucuaacaaguacccccaagcugucuuucuugaaguggacguucaccagugccagggcacagccgccacgaauaacauuagcgcuaccccuacauuccuguuuuucagaaauaaagugcggaucgaucaguaucaaggggccgacgcugucggacucgaggaaaagauuaaacagcaucuggagaacgaucccggcuccaaugaagacaccgauaucccuaagggcuacauggaccuuaugccguuuauuaacaaggccgggugugagugccugaaugagucugaugaacacggauucgacaacugucuccgcaaagauacaaccuuucuggagagcgacugcgaugaacagcugcucaucacaguggcguucaaucagcccguuaagcuguauuccaugaaauuucaaggcccugacaacgggcagggacccaaguacgugaaaaucuucauuaaucuuccuagaagcauggacuuugaggaggccgaacggucugagcccacccaggcucuggaacucacggaggaugacaucaaggaagauggcauugucccgcugcgcuaugugaaguuccagaacgucaauuccgugaccaucuucguucaaagcaaccagggggaggaggaaacaaccagaauuucuuacuuuacauucaucggaaccccugugcaggccacgaauaugaacgacuuuaaacggguggucggcaagaaaggcgagucccauuga

SEQ ID NO: 77478 - RNA, 1017 nt, Artificial Sequence
  derived and/or modified sequence opt5 from TXNRD2__Homo_sapiens__NP_001269441
auggccgcuauggccguggcgcugagaggccucgggggacgguuccgcuggagaacccaggcugucgccggcgggguucggggagccgcucgcggcgccgcugccgggcaaagagacuacgaucugcuuguggugggaggcggcagcgggggacuggcgugcgccaaggaggcugcccagcucggccggaaagucgcugugguugacuauguggaacccuccccucaggggacacgcuggggacugggcgggacgugugucaacgugggaugcaucccgaagaaacuuaugcaccaggccgcgcugcucggcggccugauucaagaugcccccaauuacgggugggagguugcucagccugugccccaugacuggagaaagauggccgaagcuguccagaaccacgugaaaucucugaauuggggacaucgggugcagcuccaagaucgcaaggucaaguauuuuaacaucaaagccagcuucguugacgagcacaccguguguggcguggccaaagggggaaaggaaauucugcuuuccgcugaucauaucauuaucgcgacaggcgggagaccucgguaccccacccacaucgagggagcccuggaguauggcauuacaucugacgauaucuuuuggcucaaggaaagcccuggcaaaacccuggucgugggggcuuccuacguugcccuugagugcgccggauuccugacaggcauugggcucgacaccacgaucaugaugcgcucuauuccgcugagaggauuugaucagcagaugagcuccauggugaucgaacacauggcuagccauggcacccgguuccugcgcgggugugcccccucuagaguccggagacucccugacggccagcugcaagugacaugggaggauuccaccacaggaaaggaggacaccggcacguuugacacaguucuuugggcgauugcucccugcaucagcgccugucugccuaccacaguggggcacgccggaaagaaucagcgccgggauuga

SEQ ID NO: 77479 - RNA, 402 nt, Artificial Sequence
  derived and/or modified sequence opt5 from TXNRD3NB__Homo_sapiens__NP_001034872
augagagaccugagcgagcggcgccucggccagcccgaacugaaggccgagcaacagaugccucuugaaccggugagagcucggcuguccgucgggcucgccugcuguugcucucacaccacagcggaggcuagcucccuggaacauggagauaaaguuuucggccagggguuucccucuccucuugaggagaucaagcgccugcucaaaauuagcagagcccugcaggcccgguccgugcccucuacgcaagaaaaggcuaaaugucugagcggagagccuggccagcccgaagggaagggacaggagaccuacccuggcccgggcaagguggaggggaaagccgaacccgcuaugcgcaaggacgaugucugcccuggaaugaaauguaucuccggcuga

SEQ ID NO: 77480 - RNA, 3564 nt, Artificial Sequence
  derived and/or modified sequence opt5 from TYK2__Homo_sapiens__XP_011526547
augccccugagacacuggggcauggcccgggggagcaagccugugggagacggcgcucagccgauggccgcgaugggagggcucaaaguccugcuucauugggcuggccccgggggaggcgagccuuggguuaccuucuccgaaucuagccugacagccgaggaagugugcauccacauugcccauaaggugggcaucacgcccccuuguuuuaaccucuucgcucuguuugaugcccaagcucaggucuggcuucccccuaaucacauucuggagaucccgcgcgacgccucccucaugcuguacuucagaauuagauuuuauuuccgcaacuggcaugggaugaaucccagagaaccugcgguguaccggugcggacccccuggcaccgaggccucuagcgaucagacagcucaggggaugcaacugcucgaccccgccuccuuugaguaucuguucgaacagggaaaacacgaguuuguuaacgauguggcuucucuuugggaacugagcaccgaggaggaaauccaccauuucaagaaugagucccucggcauggccuuucugcaccuuugucaucuggcgcuccgccacgggaucccgcuggaagaggucgccaaaaagaccagcuucaaggacugcauuccuagaucuuuucggcgccacaucagacagcauuccgcucugacacggcuccgccugagaaacguguuccggcgcuuccuuagagauuuucagcccggacggcugagccaacagaugguuauggugaaauaccucgccacacuggaaagacuugcuccucgcuucggcaccgagcggguccccgugugucaccugagacuccuggcccaggccgagggcgaacccugcuauauucgcgacucugggguggcuccuacggauccgggacccgaguccgcggccggcccucccacccaugaaguccugguuacagggaccggaggcauccagugguggccuguggaggaagaggugaauaaggaggaagggagcucuggauccagcggccggaacccccaagccucccucuuuggcaaaaaggccaaagcccacaaggcugucgggcagccggccgacagaccucgcgagccccugugggcguacuucugugauuuucgggacauuacacaugugguucuuaaggaacacugcgugucuauccacagacaggauaauaaaugucuggagcucagccugccuucccgcgcugccgcccuuagcuucgucucucugguggacggauauuuucggcucaccgcugacuccagccauuaccugugccacgaaguugcucccccuagacuggugaugucuauucgcgauggcauccaugggccccuccuggagccguucguccaagcuaaacuucggccugaggacggacuguaccucauccacuggagcacgucccaccccuauagacugauucugacaguggcccagcggucucaggcgcccgauggcaugcagagccuucgccucagaaaguuuccuaucgaacaacaggacggggccuucguccuggagggcuggggacgguccuuuccgagcgugagagaacugggcgcugcccuccaggggugucugcuucgcgcuggagaugacugcuucucucugcggagaugcugucucccccagccuggcgagaccuccaaccugauuaucaugcgcggggccagagcgagcccccggacacugaaucuuucucaacucuccuuucaucgcguugaucagaaggagauuacccagcugagccaccugggacagggcaccagaacaaacguguacgaagggcggcuccgcgucgagggcuccggagacccugaagagggcaaaauggaugacgaagauccccuggugccugggagagaccggggacaagagcuucgcguugugcugaagguccucgaccccucucaucacgauaucgcccuggcuuucuaugagacggccagccugaugucccaggugucucauacccaccuugcuuucgugcacggcguuugcgucagagggccggaaaauaucauggugacagaguacguggaacauggaccucucgacgucuggcugcggcgcgagagaggccacgugcccauggccuggaaaaugguuguggcccagcagcuggcuagcgcgcucuccuaucuggaaaacaagaaucuuguccaugggaacguguguggccggaacauucugcucgccagacugggacuggcugagggcaccagcccuuuuaucaaacuuucugaucccgggguuggacucggcgcccugucccgcgaggaacggguggagcggauuccguggcuggccccugaaugccuccccgggggagcuaauagccugucuacagccauggacaaguggggcuucggggcgacccuucuggagaucuguuuugauggcgaagcuccucuccaaucccgcagccccucugagaaggagcacuucuaccagcggcagcauagacugcccgaaccuagcugcccgcaacuggccacgcuuacaucccagugucugaccuaugagcccacccagcgcccuagcuuucggacaauucucagagaccugacccgccuccagccccacaaccuggccgauguccuuacagugaauccugacucucccgcuuccgauccuacgguuuuccacaaacgguaccugaagaaaaucagagaccucggagaaggccauuuugggaaggugagccuguacugcuaugauccgaccaacgacggaacaggcgagauggucgccgugaaggcgcugaaagcugauugugggccccaacaccgguccggauggaagcaggagaucgacauucuucgcacccuguaccaugaacacaucauuaaauauaagggcugcugugaggaccagggcgaaaaaucucuccagcuggugauggaguacgucccucucgggagccugagagauuaucuuccccggcacuccaucggacuggcccaacuccugcuguucgcccagcagauuugcgaaggcauggcuuaccuucaugcccagcacuauauccaucgcgaccuggcugccagaaauguucuccuggauaacgaccggcucgugaagauuggggauuuuggacuggcgaaggccgugccugagggccacgaguacuacagaguccgcgaagacggggauucucccguguucugguaugcuccggagugccuuaaagaauacaaguuuuauuacgccagcgacguuugguccuucggagugacacuguaugagcugcucacccauugugauucuagccaauccccucccacgaaauuucuggaacuuaucggcaucgcucagggccagaugaccguccugcggcucacagagcugcucgagagaggggaacgccugccccggccugacaagugccccugugagguguaccaccuuaugaaaaauugcugggaaaccgaggccagcuucagaccuacauucgaaaaccugauuccgauccugaagaccguucacgagaaguaucaaggacaggcccccucuguguuuuccgucuguuga

SEQ ID NO: 77481 - RNA, 1449 nt, Artificial Sequence
  derived and/or modified sequence opt5 from TYMP__Homo_sapiens__NP_001107227
auggccgcucugaugacccccggcacaggggccccuccggcgcccggagacuucagcggcgaggggucccagggacucccugaucccucuccugaacccaagcaacugccugagcuuaucagaaugaaacgggacggcgggcgccugagcgaagcugauauuagaggauuuguggccgccgucguuaacggcuccgcucagggcgcccagaucggggcuaugcucauggccauucggcugcgcggaauggaccuugaggaaacgucugugcugacccaggcgcucgcccaaagcggccagcagcuggaguggccggaggcuuggagacagcaacugguggauaagcacuccacagggggagucggcgacaaagugucucucguucuggcccccgcucuugccgcgugcggguguaaggugccuaugaucagcggacggggccugggccauaccgggggaacacucgauaaacuggaauccauucccggcuucaaugucauccagagcccugagcagaugcaagugcuucuggaccaggccgggugcuguaucguuggacagucugaacagcucgugcccgcugauggcauucuguacgccgcucgcgacgucaccgccacaguggauucccugccgcucaucaccgccagcauucugucuaagaagcugguggaggggcuguccgcucucgucguugacgugaaauuuggaggcgcggccguguucccuaaccaagagcaggcuagagaacuggccaagacgcuugucggcgugggggccagccugggacuccggguugcugccgcgcugaccgcuauggauaaaccccugggccgcugcguggggcacgcccucgaggucgaagaggcccugcuuuguauggacggagcuggcccucccgaccugagagaucucgugacaacccuugggggcgcccuucuguggcucucuggacaugcuggcacacaggcccagggggcggcccggguugcugccgcucuggacgauggauccgcccugggccgcuuugaaagaaugcucgcggcccaagggguggaccccggacuggcucgggcccuuugcagcggcuccccugcugagcgcagacagcugcucccgcgggccagagagcaggaggaacugcuggcccccgcugaugggaccgucgaacuugugcgcgcgcucccucuggcccugguccuccacgagcugggcgcuggacggucuagagccggcgaaccccuucgccugggggugggagccgagcuccugguugacgugggccagcggcugagacgcgggacgccuuggcuucggguccauagagauggacccgcucucagcggcccgcaaucccgcgcccugcaggaggcgcuggugcucagcgaccgggcuccuuucgccgcccccucuccuuuugcugaacugguucuucccccucagcaguga

SEQ ID NO: 77482 - RNA, 942 nt, Artificial Sequence
  derived and/or modified sequence opt5 from TYMS__Homo_sapiens__NP_001062
augcccguggccggcagcgagcugccuagacggccgcugcccccugcugcccaggaacgcgacgcggagcccagaccuccccacggggaacuccaauaccuuggacagauccagcauauucugcggugcggcguccgcaaggaugacagaaccgggacaggaacgcucuccguuuucggcaugcaggcucgguauucucugcgcgaugaguuuccucuucugaccacaaaaagaguguucuggaagggggugcucgaagaacugcugugguuuaucaaaggaagcaccaacgccaaggagcucuccucuaaaggcgucaagauuugggacgccaauggcagccgggauuuccuggacucccuuggguuuucuacacgcgaagagggagaucugggcccgguguacggguuccaauggagacacuuuggagcugaauaucgggacauggagagcgauuacuccggccaggggguugaccagcuccagcgcgugaucgauaccauuaagacaaaccccgacgauagacggaucaucaugugugccuggaauccucgcgaccugccccuuauggcucugccucccugccaugcccucugucaauucuaugucgugaacagcgagcugucuugccagcuguaccagagauccggagacaugggccucggcguuccguuuaauauugcgagcuaugcccugcuuaccuacaugaucgcucacauuacggggcugaaaccuggagauuucauccauacccucggcgacgcccacauuuaccugaaccacaucgaaccccuuaagauucagcugcaacgggagccuagacccuuucccaaacuccgcauccugcggaagguggagaaaaucgaugacuucaaggcugaggauuuucagauugaaggguauaauccucauccgacaaucaagauggagauggccgucuga

SEQ ID NO: 77483 - RNA, 1590 nt, Artificial Sequence
  derived and/or modified sequence opt5 from TYR__Homo_sapiens__NP_000363
augcugcucgccgugcuguacugccuucuguggagcuuccagaccuccgcuggccacuuucccagagccugugucucuagcaagaaccucauggagaaagaaugcuguccuccgugguccggggaccggucucccugcggacaacugagcggccgcggguccugucagaauauccuucugucuaacgcgccucucggaccccaguucccuuuuacaggcguugaugacagagagagcuggcccuccguguucuauaaucggacgugccaguguagcgggaacuuuaugggauucaauugcggcaacuguaaguuuggcuucugggggccuaauugcaccgaacgcagacugcuggugcggcgcaacauuuuugaucucucugcuccggagaaagacaaguucuuugccuaccugacacuugccaaacauaccaucuccagcgauuaugucauucccaucggaacauacggccaaaugaagaaugggucuaccccuauguucaacgacauuaauaucuaugaucuguuuguguggaugcacuacuauguuuccauggacgcucuccugggaggcagcgaaaucuggagagauauugacuucgcccaugaggcucccgccuuccuuccuuggcaccggcuguuucuccugcgcugggagcaggaaauccagaagcugacaggggaugagaacuucaccauucccuacugggacuggagagaugcggaaaaaugugacaucugcacggacgaguacaugggaggccagcauccgaccaauccuaaccuccugucucccgccuccuuuuucagcuccuggcaaauugugugcucucggcuugaggaauauaauagccaccagucccuguguaacggcacaccugaggggccccuccgcagaaaccccggaaaucacgauaagagccggaccccucgccugccgucuuccgcugacgucgaauuuugccuuagccugacacaguacgagucuggcagcauggauaaagccgcuaacuucuccuuuagaaauacccucgaaggguucgccucuccccugacgggaaucgcggacgccagccaguccagcaugcauaacgcucugcacauuuauaugaauggcacaaugucucaagugcagggguccgccaacgauccuaucuuucuccugcaucacgcuuucguugacagcaucuuugagcaguggcuucggagacaccgcccccugcaagagguguacccugaagccaaugcccccauuggacauaaccgggagucuuauauggucccguucaucccucucuacagaaauggcgacuuuuucauuuccagcaaggaucugggcuaugauuacuccuaccuucaggacucugaucccgacagcuuccaggacuauaucaaauccuaccuggaacaggcuucucgcauuuggagcuggcuccugggggcggccauggugggagcugugcugaccgcccuccuggccggccuugucucccugcucugucggcacaagagaaagcaacugccugaggaaaaacagccccugcuuauggagaaggaggauuaucauagccucuaccagucucaccuguga

SEQ ID NO: 77484 - RNA, 2673 nt, Artificial Sequence
  derived and/or modified sequence opt5 from TYRO3__Homo_sapiens__NP_006284
auggcccugagacggagcaugggccgccccgggcucccuccgcugccccuuccucccccucccagacugggacuccugcuugcugcccuggcgucccuccugcugccugagucugcugccgccggccucaagcugaugggggcuccggugaaacuuaccgucagccagggacaacccguuaagcugaacugcuccguggaaggcauggaggaaccugacauccagugggugaaagauggggccgucgugcagaaucucgaccagcuguacauucccguuucugagcaacacuggaucggauuccuuagccugaaguccguggaacggucugaugcuggccgcuauuggugucaggucgaggacggcggggagacagaaauuagccagccuguguggcucacgguugagggagugcccuuuuucaccgucgaaccgaaagaucuggccgugccucccaacgcgccuuuucagcuguccugcgaggccgugggcccgcccgagccugucacaaucguuugguggagagggaccacaaagauuggaggcccggcucccagcccuucugugcucaaugugaccggggucacacaauccaccauguucagcugugaagcccauaaccugaagggacuugcuucuucccggacggccaccgugcaucugcaggcgcuccccgccgcuccuuuuaauaucacaguuaccaaacugucuagcuccaacgccagcguggcuuggaugcccggcgccgacggccgcgcccuucugcaguccugcacaguccaggugacccaagcucccgggggaugggagguucucgcgguggucgugccugugcccccuuucacgugucugcugagagaucucguccccgccacaaauuacucucugcggguucgcugcgcuaacgcccuuggcccuagccccuaugccgacugggugccguuucagaccaaggggcuggcuccugccuccgcgccccagaaucuccacgcuaucagaacagauagcggacugauucuugaaugggaggaagucauccccgaggccccucuggagggcccgcucgggcccuacaaacugucuugggugcaagacaacggaacccaggaugaacugaccguugagggcacacgggccaaucucacgggcugggacccucagaaggaucugauugugcgcgucuguguguccaacgcuguggggugcggacccuggagccagccucuuguugucucuagccacgacagagccggccaacaggggcccccucauucccggaccucuugggugcccgugguccugggagugcucacagcucugguuaccgccgcggcccuggcucuuauccuccugcgcaaaagacggaaggaaacaagauucggccaggccuuugacagcgugauggcucgcggggagccggccguccacuuccgggcggccagauccuuuaaucgcgaacggccugagagaauugaggcuacccuggauagccucggcaucucugacgaacugaaggagaaacuugaagaugugcugauucccgagcagcaauucacgcucggacgcaugcugggcaagggggaauuuggauccguucgggaggcccagcugaaacaggaggacggcagcuucgugaaggucgcugugaaaaugcuuaaggccgauaucaucgccucuuccgacauugaagaguuccucagagaagcugcguguaugaaagaguuugaucacccucauguugccaagcuggugggggucagccugcgcucccgggcuaagggaagacuccccaucccgauggugauucugccuuucaugaaacacggcgaccuucaugccuuucugcucgccucucgcaucggggagaaccccuucaaucugccucugcagacacuuauucgguuuaugguggauaucgcuugcggcauggaauaucucagcuccagaaacuucauccaccgggaccuggccgcgcgcaacuguaugcuggcugaggauaugaccgucugcguugccgacuuuggacucucuagaaagauuuacagcggcgacuauuaccggcaagggugcgccuccaaacugcccgugaaguggcuugcucuggaaagccucgccgauaaucuguacaccgugcagucugacgucugggcguucggagugacaaugugggagaucaugaccagaggccagacacccuaugcugggauugaaaacgccgagaucuacaauuaucugauuggaggcaaccgccuuaaacagccuccggaguguauggaagauguuuacgaccucauguaucaaugcugguccgccgaucccaagcagcggccuagcuuuacgugucugagaauggagcuggaaaauauccucgggcagcugucugugcuuuccgcuagccaagacccccuguacaucaacauugagcgcgccgaggaaccuaccgcuggcggaucucucgagcugcccggcagagaucagccuuauagcggggccggagacggcuccgggaugggagcggucggcgggacaccgagcgauugccgguacauccugacccccggcggacuugccgaacagccuggccaggcugagcaccaacccgaaucuccucugaaugagacacagcgccuccugcuccugcagcaggggcuucugccccauuccagcuguuga

SEQ ID NO: 77485 - RNA, 309 nt, Artificial Sequence
  derived and/or modified sequence opt5 from TYROBP__Homo_sapiens__NP_001166985
augggcgggcuggagcccugcagcagacuccugcuucugccucuccugcuugccguguccgacuguucuugcagcaccgucuccccgggaguucuggcuggcaucgugaugggggaucucgugcugacaguccugauugcccucgcgguguacuuccugggacggcuuguuccccgcggcagaggggcugccgaagccgcuacgcggaagcagcgcaucaccgagacagaaucuccuuaucaagagcugcagggacagagaagcgacguguacuccgaucucaacacccagcggcccuauuacaaauga

SEQ ID NO: 77486 - RNA, 1614 nt, Artificial Sequence
  derived and/or modified sequence opt5 from TYRP1__Homo_sapiens__NP_000541
augagcgcccccaagcugcucucccugggcugcaucuucuuuccucuucuccuguuccagcaagcuagagcccaguuuccgcggcagugugcgaccguggaggcucugcgcucugggaugugcugucccgaccuuagcccugucuccggacccggcacagauagaugcgggucuagcuccggacggggccgcugugaagccguuacggccgacucuagaccucacagcccccaguacccucaugaugggcgggacgaucgcgagguguggccgcugagauucuuuaaccggaccugccacuguaauggaaacuucuccggccauaauugcggcacaugucgccccggguggagaggagcugccugcgaccaacgggugcucauuguccgcagaaaccugcuggaucucagcaaagaagagaagaaucacuuugugcgggcucuggacauggccaaacgcaccacacauccucuuuucguuaucgcgaccagacggucugaagagauucugggccccgaugggaacacaccucaguuugagaauaucuccauuuauaacuacuucguguggacccacuauuacagcgucaagaaaacguuucucggagugggccaggaaucuuucggggagguugacuuuucccacgaaggacccgccuuccugaccuggcauagauaucaccuucugcgccucgagaaggauaugcaggagaugcugcaagaaccgagcuucucucugccuuacuggaauuuugcuacaggcaagaacgugugugacaucugcaccgaugaccucaugggcucccggagcaauuucgacuccacacugaucucucccaacagcgucuuuucccaguggagaguggugugcgauagccuugaggacuaugauacccuggggacgcucuguaauucuacagaagacggaccuauucgccggaaccccgccggcaaugucgcuagacccaugguucagcgccugccugagccgcaggauguggcccaaugccuugaaguggggcuguucgacacacccccuuuuuacuccaacagcaccaacucuuuccggaauaccgucgagggauacagcgaucccaccggcaaauaugacccugcggugagaucccuccauaaccuggcccaccuguuucucaaugggacaggaggccagacgcaccugucucccaacgauccgaucuucguucuucugcauaccuuuacagacgcuguguucgaugaguggcuccgccgguacaaugccgacauuagcaccuuuccucuggaaaacgcucccaucggccacaauagacaguauaacauggucccuuucuggcccccugugacaaauaccgagauguuuguuacggcccccgacaaccuuggguacacauaugaaauucaauggccgucccgcgaguucagcgugccugaaaucauugccaucgcugucgugggagcgcugcuccuggucgcccugaucuucggcaccgcuucuuaccucauucgggccagacgguccauggaugaggccaaucagccccugcuuaccgaccaguaucaguguuacgcugaggaauacgagaagcugcaaaaccccaaucagagcgugguuuga

SEQ ID NO: 77487 - RNA, 1197 nt, Artificial Sequence
  derived and/or modified sequence opt5 from TYSND1__Homo_sapiens__NP_001035363
augagacggcaguggggcagcgccaugcgcgcugccgagcaagcggggugcaugguguccgcuucuagagccggacagcccgaagccggcccuuggagcuguuccggggucauccugucucggagcccgggacucguucugugccacggcgggauuuucgugcccuuucuucgcgcuggauccgaggugcugaccgccgcuggcgccgucuuccucccuggcgacucuuguagagaugaccugcggcuucaugugcagugggcgcccacagccgcugggccuggaggcggggccgaacgcggaagacccggccugugcacgccucagugugcuagccucgagccggggcccccugcccccucccggggacgcccucugcaacccagacugccggcggaacuccugcuucugcucagcugcccugccuuuugggcucacuucgcccggcuguuuggcgaugaggcugccgagcaguggcgcuucucuuccgccgcuagagacgaugaaguuagcgaggacgaagaggcggaucagcuucgggcccugggcugguuugcucuccugggggugcgccugggacaggaggaagucgaggaagagagaggccccgccauggccgugucuccucucggggcuguucccaagggagcgccccugcuuguguguggcuccccuuucggggccuuuugcccggacaucuuccugaacacccucagcuguggaguccugucuaauguggcuggcccccuucugcucacagaugcccggugccugccuggcaccgaagggggaggcguguuuacagccagacccgcuggggcccuggucgcucucguuguggccccucuguguuggaaagcgggagagugggugggcuucacccuucugugcgccgcugcuccccucuuucgcgccgcccgggacgcgcugcauagacuuccgcacuccacagccgcucuggccgcucuccugccucccgaggucggggugccuuggggccugccccuccgcgauagcggaccucugugggccgccgcugcgguucuuguggaaugcggcaccgucuggggguccggaguggccguugcuccccggcugguggucacguguagacaugugucuccgcgcgaggccgcccggguccucgugagaagcaccacaccuaagcacaaccaccaacagcaucccggccaguga

SEQ ID NO: 77488 - RNA, 1833 nt, Artificial Sequence
  derived and/or modified sequence opt5 from TYW1B__Homo_sapiens__XP_011514532
auggaccccagcgccgauaccugggaccuguccucuccucucaucagccuguggauuaacagauucuacaucuaucuuggcuuugcuguguccauuucucuguggaucugcguccagauuguuaucgagaugcaaggguucgccacagugcucgcggaagcugugacgagccuggaucuuccggucgccaucauuaaucugaaggaguacgaccccgaugaccaccucaucgaagaggugaccuccaaaaacguuuguguguuucuggucgccacauauaccgauggacugccuacagaaucugcugagugguucugcaaguggcucgaggaagccagcauugacuuucgguucggcaaaaccuaccugaaggggaugcgcgaugcuguguuuggacuuggcaauuccgccuaugcgagccauuucaacaaaguugggaagaauguggacaaguggcuguggaugcucggaguccacagagugaugucucggggcgagggcgauugugacguggucaaauccaagcaugggagcaucgaagccaacuuucgcgcuuggaaaacaaaguucauuucucagcugcaggcccuucagaaaggagagagaaagaaguccugcggcgggcacuguaaaaagggaaaaugcgagagccaucaacacggcucugaagaacgggaagaggggucccaggaacaggaugagcugcaccaucgcgacaccaaggaggaggagcccuuugaaagcuccucugaggaagaguucggaggcgaggaccaccagagccucaauuccaucguugauguggaagaccugggcaaaauuauggaucaugugaagaaagagaagagagaaaaggagcaacaggaagagaaaagcgggcuguuucggaacaugggacgcaaugaggacggcgaaagacgggcuaugaucacgccugcccuccgcgaggcgcugaccaagcaggucgaugcccccagagaacggucucuucugcagacacacauccucuggaacgagucccaccgcuguauggagaccacaccuagccuggcuugcgccaauaaauguguguucugcugguggcaucacaacaauccgguugggaccgaauggcuuuggaagauggaccaacccgagaugauucugaaagaagcuaucgagaaccaucagaauaugauuaagcaguucaagggagugccuggcgucaaagccgaaagauuugaggaggggaugacggugaagcacugugcccucucucugguuggagaacccaucauguacccugagauuaaccgguuccugaaacuccugcaucaaugcaagaucagcuccuuucuugugacaaacgcucaguuccccgcggaaaucagaaaucuggagccggucacccagcucuaugugucugucgaugccagcacaaaagacucccugaagaagauugaucgcccucuuuuuaaagacuucuggcagcaauuucuggauagccucaaggcucuggccgugaaacagcagcggaccguuuacagacugaugcucgugaaggccuggaacgucgacgaacugcaggcuuacgcccaacuugugucucugggcaaucccgacuucaucgagguuaaaggcgugaccuauugccgcgaguccagcgcgucuucccucacaauggcucacgucccuuggcacgaagagguggugcaguuuguucgggaacuggucgaucugauucccgaguacgaaaucgccugugagcaugagcacagcaacugccuucucauugcccauagaaaggaccuggggcgccugccccgggcugaagaugagggacacguguccuga

SEQ ID NO: 77489 - RNA, 504 nt, Artificial Sequence
  derived and/or modified sequence opt5 from U2AF1__Homo_sapiens__NP_001020375
augcaggagcacuacgacgaguucuuugaagaaguguucaccgagauggaagagaaguauggcgaggucgaagagaugaacguuugcgauaaucugggggaccaucucgugggaaacguguacgucaaauuuagacgggaagaggaugccgagaaggcugugaucgaccugaauaaccgcugguucaauggccaacccauucacgccgaacuuagcccuguuacagauuuuagagaggcguguugccggcaguaugaaaugggggaguguacgcgcggaggcuucugcaacuuuaugcaucugaaaccgaucuccagagaacuccggcgcgagcuguacgggagacggcgcaagaaacacagaucucggagccgcuccagagagcggcgcucuagaagccgggacagaggacgcggcggcgggggaggcgggggaggcgggggaggcggccgggaaagagaucgccggagaucccgcgaccgggagagaucugggcgcuucuga

SEQ ID NO: 77490 - RNA, 1416 nt, Artificial Sequence
  derived and/or modified sequence opt5 from U2AF2__Homo_sapiens__NP_001012496
augagcgacuucgaugaguuugaaagacagcugaacgagaauaagcaagaacgggacaaagagaaccgccacagaaagcggucccauucucgcagcagaucccgggaucgcaaaagacggucucgcagcagagaccggcgcaauagagaucagcgguccgccucucgcgacagacggagacgcagcaagccccucacccggggcgcuaaagaagaacacgggggacugaucagauccccucgccaugagaagaagaaaaaggugcggaaauacugggaugucccgcccccuggcuucgaacacauuacacccaugcaguauaaggccaugcaggcggcugggcaaaucccugccacggcccuucugcccaccaugacaccugacggacucgcuguuaccccgacacccgugccuguggucggcagccagaugaccagacaggcccgccggcuguacguggggaacauucccuuuggaaucacagaggaagcuaugauggauuucuuuaaugcccagaugagacuuggcggccugacccaagcgccugggaaccccguucucgccgugcagauuaaucaggacaaaaacuucgcuuuucuggaguuccgcucugucgaugagacgacccaggccauggcuuuugacggaaucaucuuccaaggccagucccugaagauucggagaccgcaugauuaucagccucuccccgggaugagcgaaaauccuucuguguacguucccggaguggucuccacaguggugcccgacagcgcccacaagcuguuuaucggcgggcuuccuaacuaucugaaugacgaucaagucaaagagcuccugaccucuuucggaccgcuuaaggcguuuaaccugguuaaagacuccgccacaggccucagcaagggcuacgcuuucugcgaauauguggauauuaaugugaccgaccaggccaucgcugggcugaacggaaugcagcugggcgauaaaaagcuccugguccagcgcgccuccgugggggccaaaaaugcuacgcuuucuacaauuaaccaaacccccguuacacuccaggugccuggacugaugagcucccagguccagaugggcgggcaccccaccgaggugcugugucuuaugaacaugguucugccugaggagcuccuggacgaugaggaauacgaggaaaucguggaggacguccgggaugaaugcagcaaguacggacuggugaagucuauugagauccccagaccggucgacggcguggagguuccuggcugugggaaaaucuucguggaauuuaccuccgucuucgauugccaaaaggcgaugcagggacucacaggccggaaauuugccaaucgcgugguugugacgaaguauugugaccccgacagcuaccauagacgggauuucugguga

SEQ ID NO: 77491 - RNA, 4212 nt, Artificial Sequence
  derived and/or modified sequence opt5 from UACA__Homo_sapiens__NP_001008225
augaugaacugcugguucagcuguacccccaagaauagacacgccgcugacuggaacaaauacgaugaccggcugaugaaggccgcggagcgcggcgauguggaaaaagucacauccauccucgcuaagaaagggguuaauccuggaaagcuggacguggagggcagaucuguguuucaugucgugacgagcaaggggaaccuugaaugccugaaugccauucucauccacggaguugauauuaccacauccgacaccgccggccggaacgcucugcaucuugccgcuaaauaugggcacgcccugugucuccagaagcugcugcaauacaauugcccgacagagcaugcggaucuccagggacgcaccgcccugcacgacgcugccauggcugauugucccucuagcauccagcuucugugcgaccacggcgccuccgugaacgcgaaagaugucgacggcagaacaccucucgugcuggccacccagaugucucggcccacgauuugucaacuucugaucgaucgcggggcugacguuaauagcagagacaagcagaaccggaccgcccucaugcugggaugcgaauauggcugucgcgaugcuguggagguccugaucaaaaauggggccgacauuucccuccuggaugcccuuggacaugacagcucuuacuaugcuagaaucggcgauaaccuggacauucucacacugcuuaagaccgcguccgagaauacaaacaaggggcgggaacuguggaaaaagggaccuagccuccagcagcgcaaucugacccacaugcaagaugaggugaacgugaaaucucaucagagagaacaccagaacauccaggaccuggagauugagaaugaagaucucaaggagcggcugcgcaaaauccaacaggaacagcggauucuucuggacaaggucaacggccuccaacugcagcuuaaugaggaaguuaugguggccgaugaccuggaguccgagagagaaaaacucaagagccugcuggcugccaaggagaaacagcacgaagagucucucagaacgaucgaagcccugaagaaccgcuucaaauacuuugaguccgaccaucuuggcagcgggucccacuucucuaaucggaaggaggauaugcugcucaaacagggacaaauguauauggcugacagccagugcacaucccccggcaucccugcccauaugcagagcagaucuaugcugcgcccgcuggaacuuucccuccccagccagaccucuuacagcgagaacgaaauucugaagaaggagcuggaagcgaugcggacauuuugugaguccgcuaaacaagauagacucaagcugcagaaugagcuugcccacaaaguggccgaaugcaaggcucuggcccucgagugcgaacgcgucaaagaggacucugaugagcagaucaagcagcuggaagacgcucugaaggaugugcaaaaacggauguacgagagcgaagggaagguuaaacagaugcagacccauuuccuugcccucaaggagcaccugaccuccgaagcggccagcggaaaccacagacugacagaggagcucaaagaccagcugaaggaucuuaaggugaaauaugaaggcgcuucugccgaggucgggaagcugcgcaaucaaauuaaacagaacgaaaugaucguggaggaauuuaagcgggacgagggaaaacucauugaggaaaauaagagacugcagaaagagcuguccaugugugaaauggagcgcgaaaagaagggccggaaaguuacggagauggagggccaagcuaaggaacuuagcgccaaacucgcgcugucuaucccugccgagaaguucgaaaacaugaaauccagccuguccaaugaggugaacgagaaggcuaagaaacucgucgaaauggagagagaacaugagaagucucugagcgaaauccggcagcuuaaacgcgagcuggagaaugugaaggccaaacucgcucagcacgucaagcccgaagaacaugaacaggugaaguccagacuggagcaaaaaucuggggaacugggaaagaaaauuaccgagcuuacacucaagaaccagacccugcagaaagagaucgaaaagguuuaccuggauaacaagcuccugaaagagcaggcccacaaucuuacaauugaaaugaagaaccacuaugugccucugaaagucagcgaggacaugaagaaaucccaugaugccaucauugacgaccucaaucggaagcugcuggaugugacccaaaaauacacggaaaagaaacuugagauggagaaacugcuccuggaaaacgacagccucucuaaggauguuuccagacuggagacaguguuugugcccccggaaaaacacgagaaggagaucaucgcucuuaaaagcaauauugucgaacugaagaagcagcucucugagcugaaaaagaaaugcggcgaagaccaggagaagauccaugcgcugaccuccgaaaacaccaaucuuaaaaagaugaugagcaaccaguaugugccuguuaagacacacgaggaggucaaaaugacccugaaugauacacucgccaagacgaaccgcgaacugcucgacgugaaaaagaaauucgaggauauuaaucaagaauuugugaagaucaaggacaaaaacgagauucugaagcggaaucuugaaaacacccagaaucagaucaaagcugaguacauuucucuggccgagcaugaagccaagaugagcucccucagccaaucuaugagaaaaguccaggauuccaacgcugagauccuggccaacuaucgcaaggggcaggaagagaucgugacacugcacgcggaaauuaaggcucagaaaaaggagcuugacaccauccaagaguguauuaaaguuaaguacgcccccaucgugagcuucgaagagugcgaaagaaaauuuaaggccacagagaaagagcugaaggaucagcucuccgaacagacccagaaguacucugucagcgaggaagaggugaaaaagaauaaacaagaaaacgacaagcugaaaaaggagauuuucacgcuccagaaggaucugcgggacaaaaccguucuuaucgagaagucccacgaaauggagcgcgcucugucuagaaaaacagacgaacugaauaagcagcucaaagaucugagccagaaguauaccgaggugaagaacgucaaagaaaaacuuguggaggagaaugccaagcaaacauccgaaauccuggcgguucagaaccuccugcagaagcagcaugugccucucgagcaagucgaagcucugaaaaagucucuuaauggaaccauugagaaccugaaggaggagcugaaaagcaugcagcgguguuacgagaaggaacagcaaacggugacaaaacuccaccagcugcuugagaaucagaagaacuccagcgugccccuggccgaacaucuccagaucaaagaggccuucgagaaggaagucggcauuaucaaggcuucucugcgcgagaaggaagaggaaucccaaaauaagauggaggagguuagcaaacuccagucugaagugcagaacaccaagcaggcccugaaaaagcuggagacaagagaaguggucgaccuuuccaaauauaaggcuaccaagagcgaucuggagacccaaauuucuucccucaaugaaaaacuggccaaccuuaaucggaaguacgaggaggugugcgaagagguucugcacgcgaaaaagaaagaaaucagcgccaaggacgagaaggaacuccugcauuuuuccaucgagcaggagauuaaagaucagaaggaacgcugugacaaaagccucacaacgaucaccgagcugcagagacggauucaagaaucugcuaagcagaucgaggccaaagauaacaagauuacagagcuucugaacgacguggaacgccugaagcaggcucucaaugggcugagccaacuuaccuauacauccggcaaccccaccaaaagacagucucagcugaucgauacgcuccagcaccaagucaagagccuggagcagcagcuggccgacgccgaucggcagcaccaagaagugaucgcuauuuacagaacacaucuccuuuccgcggcccagggacacauggacgaggacguucaggaagcucugcugcagaucauucaaaugcgccagggccucgugugcuga

SEQ ID NO: 77492 - RNA, 1518 nt, Artificial Sequence
  derived and/or modified sequence opt5 from UAP1__Homo_sapiens__NP_003106
augaacaucaaugaccugaagcucacccugagcaaagccggccaggagcaccuucugagauucuggaacgaacucgaggaagcucaacagguggagcuguacgccgaacuucaggcgaugaauuuugaggagcugaacuucuuuuuccagaaggcuauugaaggguuuaaucaauccucucaucagaaaaacgucgaugcccggauggagcccguuccucgcgaagugcucggaagcgccacaagagaccaggaucagcugcaggcuugggaguccgagggccuguuccaaaucucucagaauaagguggccguccuccugcuugcugggggacagggcacgcggcuggggguggccuauccgaaaggaauguacgacguuggccuccccagccgcaagacccuguuucaaauucaggcggaaagaauccuuaagcugcagcaaguggccgagaaauauuacggcaacaagugcauuaucccuugguauaucaugacauccgggcggaccauggaaucuacaaaagaguucuuuaccaagcacaaauacuucggacucaagaaggaaaaugucaucuuuuuccagcagggcaugcugcccgcuaugagcuuugaugggaaaauuauucuggaggagaagaacaaaguguccauggccccugacggaaauggcgggcucuaucgcgcucuggccgcgcagaacaucguugaagauauggagcaaagaggaauuuggagcauccauguguacugugucgacaauauucuugugaagguggccgauccccgguucaucggcuucugcauccagaaaggcgcugacuguggggccaaggucguugagaaaacaaacccuaccgaaccggugggaguggucugccgcguggauggcguuuaccagguggucgaauauucugagauuucccuggcuacggcccagaagagaagcucugacgggcggcuccuguuuaaugccggaaacaucgcuaaccacuucuuuaccgugcccuuccuucgcgauguugugaaugucuacgagccucaacugcagcaucacguggcgcagaagaaaauucccuaugucgacacacagggccaacucaucaagccugacaaacccaacgggauuaagauggaaaaauuuguguucgauaucuuucaguucgccaagaaguuuguuguguacgagguccugagagaagacgaguucuccccgcugaaaaaugcugauagccagaacggaaaggacaauccuaccacagcccggcacgcccucaugucucugcaucacuguugggugcuuaacgcuggcggccauuuuaucgaugaaaaugggucccgccugcccgccauuccuagacucaaagacgcgaacgauguucccauccagugcgagauuagcccccugaucuccuaugcuggagagggccuugaaucuuacguggccgacaaggaguuccacgccccucugauuaucgaugaaaaugggguccacgagcucgugaaaaacggaaucuga

SEQ ID NO: 77493 - RNA, 3261 nt, Artificial Sequence
  derived and/or modified sequence opt5 from UBA1__Homo_sapiens__XP_011542255
augcugacccucgagaaccugcaguucggcgacagcggguccaugcuuugcgugaucuaccaccuggauaaucccgucggaaagaugucuagcuccccucucucuaaaaagagacggguuagcggcccggaccccaaaccuggguccaacuguucucccgcccaaagcgugcuguccgaagugccuagcguccccacaaauggaauggcuaagaacggcucugaggccgauauugacgaagggcuuuauucccgccagcuguacgugcucggacaugaggcgaugaaaagacugcagacgagcucuguucugguguccggccuccggggccugggggucgaaaucgcuaagaauauuauccuuggaggcgugaaggccguuacccugcacgaucaggggacagcccaaugggcugaccucagcucucaguuuuaucugcgcgaggaggauauugggaaaaacagagccgaagugucccagccucggcuugcugagcugaauagcuacgucccggugaccgccuauacaggcccccucguggaagacuuccuguccggguuucaggucguugugcugaccaacacaccucucgaggaucaacugcgcgugggagaguucugccauaauagaggcaucaagcucgucguggcggacacccggggccuguuugggcagcuuuucugugauuuuggagaagagaugauccugacggacucuaacggcgaacagccccuuagcgccaugguuuccauggugaccaaagauaauccuggggucgugacaugccuggacgaggcucgccacggauucgaaagcggcgacuuuguuucuuucuccgaggugcaggggauggucgagcucaacggaaaucaacccauggaaauuaaggugcugggcccguacaccuuuagcaucugugauacaucuaacuucagcgacuauauuagaggcgggaucgucucccaggugaaaguuccuaagaagauuucuuuuaaaagccugguggccucccucgcugagcccgauuucgucgugaccgacuucgccaaguuuagccggccugcgcagcugcauaucggauuccaagcccuucaccaguuuugcgcucagcacggccgcccucccagaccccggaaugaagaggaugccgcugaacugguugcccucgcccaggcugugaacgcgcgcgcccugccggcuguccaacagaacaaucuugacgaggaucugauuagaaaacucgccuacguggccgcuggggaccuggcccccaucaacgcguucaucggaggccuggcugcccaggaggugaugaaggccuguucugggaaauuuaugccuauuaugcaguggcucuacuucgaugcucuggaaugccuucccgaggacaaggaaguucugacggaggauaaaugucuccaacggcagaauagauaugacggccaggucgccguguuuggauccgaccugcaggaaaagcugggcaagcaaaaauacuuccuugugggggcuggagccaucggcugcgagcuccugaagaacuuugcgaugauugggcugggauguggcgaagggggcgagaucauugucacagauauggacaccaucgagaaaagcaaucucaaccgccaguuccuguuucggccuugggaugugacaaaacuuaagucugacaccgccgcugccgcuguuagacagaugaauccccauauccgcgugaccucccaccagaaccgggucggaccggauacagaaagaauuuaugacgaugacuucuuucaaaaucuggauggcguggccaacgcgcucgacaauguugaugcccgcauguacauggaccggagaugcguguauuaccgcaagccucugcuggagagcgggacgcuuggaaccaagggcaacguccaggugguuauccccuuccucacagaguccuauucuagcucccaggauccucccgaaaaaucuauuccuaucugcacccugaagaauuuccccaacgcuauugagcauacacugcaaugggcccgggacgaauuugagggacucuucaaacagccggcugaaaaugugaaccaguaccugaccgacccuaaguuugucgagagaacgcuucgccuggccggaacacagccccucgaggugcuggaagccgugcaacggagccugguccuucagagaccccagaccugggcugauuguguuaccugggcgugccaccacuggcauacacaguacuccaacaauauccggcaacuccugcacaacuucccuccggaccagcugaccagcucuggcgcccccuuuugguccgggccuaaacgcuguccccauccucucacauucgaugugaauaacccccugcaccuugacuaugugauggcugccgccaaucuguuugcucagacguacggccucaccggaagccaggauagagccgcggucgcuacauuccugcaaucugugcagguuccugaguuuacccccaaguccggcgugaagauccaugucagcgaccaggaacugcaaucugccaacgccagcguggaugacucccggcuugaggaacucaaagcuacacugccgagcccugauaagcugcccggguucaaaauguauccuauugacuuugagaaggaugacgauucuaauuuccacauggacuuuaucguugccgcguccaaccucagagcugagaauuacgacauucccagcgccgaucgccacaaauccaagcugaucgccggaaagauuaucccggcuauugccaccacgaccgcugccguggucggccuugugugccuggaacucuauaaaguugugcaggggcaucggcagcuggacucuuacaagaacggauuccugaaucuugcgcugccuuucuuuggcuucagcgagccccucgccgcuccuagacaccaguauuacaaccaagaauggacacugugggaucgcuuugagguccaggggcuccagcccaauggcgaagagaugacccugaaacaguuccuugacuacuuuaagacagagcauaaacuggaaaucaccaugcucucccaaggagugucuaugcuguauagcuucuuuaugcccgccgcuaagcugaaagagagacuugaucagccuaugacggaaaucgugucccgggucucuaagcgcaagcugggcagacacguucgggcccucgugcuggagcucuguugcaacgacgagagcggggaagauguggaggucccguacgugcgcuauacaauuagauga

SEQ ID NO: 77494 - RNA, 1923 nt, Artificial Sequence
  derived and/or modified sequence opt5 from UBA2__Homo_sapiens__NP_005490
auggcccugagcagaggccucccccgggagcuggcugaagccguggcgggaggacgcguccuuguugugggcgcugggggaaucggcugcgagcugcucaagaaccuggugcuuaccggguucucccacauugaccugaucgaucucgacacaauugaugucucuaaucugaacagacaguuucuguuccagaaaaagcaugugggacggagcaaagcccagguugccaaggaauccgugcuccaguuuuacccuaaagcuaauaucgucgccuaucacgacucuauuaugaacccggauuacaauguggaguucuuucgccaguucauccugguuaugaacgcucuugacaauagagccgcgcggaaccaugugaaucgcaugugucuggccgcugaugucccccucaucgaaagcggcacggccggcuaucuggggcaagugaccacaauuaagaagggagugaccgagugcuacgagugucacccuaaacccacacagagaaccuuuccuggcugcacaauccggaacacccccuccgaaccuauucauuguaucgucugggcuaaguaucuuuucaaucagcuguuuggggaggaagacgccgaucaggagguuucuccggaccgcgcggaucccgaggccgcuugggaaccuacggaggccgaagcuagagcccgggccagcaacgaggacggagauauuaaacgcaucuccaccaaggaaugggcuaaaagcacaggcuacgaccccgugaaacucuucaccaagcuguuuaaggacgauauuagauaucugcucacaauggacaagcuguggcggaaacgcaagccucccgugccgcuugauugggcggagguccaaucucagggggaggaaaccaaugccuccgaccagcagaacgagccucaacugggacucaaagaucaacaggugcuggacguuaagagcuacgcuagacuuuucucuaaauccaucgaaacgcugcgggugcaccucgccgagaagggcgauggcgccgaacugaucugggacaaggaugaccccagcgcuauggauuuugucacaucugccgcgaaucugagaaugcacauuuucuccaugaacaugaaaagccgcuucgacaucaaguccauggcugggaacauuaucccugccauugccaccacaaaugcugugaucgccggacucaucguucuggagggccuuaaaauucugucugggaagaucgaccaaugccggaccauuuuucucaacaaacagcccaaucccagaaagaagcugcuugugccuugugcucuggauccgcccaacccuaauugcuacgucugugccagcaaacccgaggugaccguccgccucaacgugcauaagguuacagugcugacgcugcaggacaaaaucgucaaggaaaaauucgcgaugguggccccugauguucagauugaggacggaaagggcaccauccucaucuccagcgaagagggggaaacagaggcuaauaaccacaagaaacugucugaguuugggauucggaauggcuccagacuucaagccgaugacuuccugcaggauuauacccuccugaucaacauucugcauagcgaagaccuuggcaaggauguggaguuugaagucgugggggacgcucccgagaaagugggaccgaagcaggccgaggaugcggccaaaucuaucacaaauggcagcgacgauggggcucagccuuccaccucuacggcccaagaacaggacgacguucucauugucgauagcgacgaggaagauuccagcaacaaugcugacgugucugaggaagaacgcucccggaagagaaagcuggaugagaaagaaaaccugagcgccaagcgcucucggaucgagcagaaagaggagcucgacgaugugauugcccuggacuga

SEQ ID NO: 77495 - RNA, 1392 nt, Artificial Sequence
  derived and/or modified sequence opt5 from UBA3__Homo_sapiens__NP_003959
auggccgacggcgaggaacccgagaagaaaagacggcgcaucgaagaacugcucgcugaaaagauggccguggaugggggaugcggcgacaccggggauugggagggaagauggaaccacgucaaaaaguuccuggagcggagcggcccuuuuacacauccggacuucgaacccuccacggagucucuucaguuucugcucgauaccuguaaaguucuggugauuggggcgggaggccuuggcugcgaacugcucaagaaucuggcucugagcggguuccgccaaauccacgugauugacauggauacaaucgacgucuccaaccucaauagacaguuucuguuccggccuaaggauauuggacgccccaaagccgagguggccgcugaguuucuuaacgacagaguuccuaauuguaacguggucccccauuucaauaagauccaggauuuuaacgacaccuucuaccggcaguuucacaucauugugugcggccuggauucuaucauugcccgcagauggaucaaugggaugcucauuagccugcuuaacuaugaagacggaguucuggacccuuccucuaucgugccgcucauugauggcgggacagagggauucaaaggcaaugcucgggucauccugcccggcaugaccgccuguaucgaaugcacacuggagcucuacccuccccaagugaacuuuccuauguguaccauugcgagcaugccccgccugccggaacauugcaucgaguaugugagaaugcuucaguggccuaaggagcagcccuucggggaaggagucccucuggacggcgaugaccccgagcacauucaguggaucuuccaaaaaucccucgaacgggccagccaguacaauauucgcgggguuacguauagacugacccagggaguggugaagcggaucauccccgcugucgccucuacaaacgcugugauugccgcgguuugugccaccgagguguuuaagaucgcuacauccgccuacauuccucuuaauaacuaucuggucuucaacgauguggacggccucuacaccuacacguuugaagcugagagaaaagagaauugcccggccuguagccagcugccccaaaacauccaguucucuccuuccgccaagcugcaggaaguucucgauuaucugacaaauagcgcuucucuucaaaugaaaucccccgcgauuaccgccacacuggaggggaagaaccgcacccucuaccugcagagcgugaccuccaucgaggagcggacaagaccuaaucuuucuaaaacgcugaaggaacucggacuggucgacggccaggagcuggcuguggccgaugucaccacaccccagaccgugcucuuuaaacugcacuucacaagcuga

SEQ ID NO: 77496 - RNA, 3039 nt, Artificial Sequence
  derived and/or modified sequence opt5 from UBA7__Homo_sapiens__NP_003326
auggacgcccuggaugcuagcaagcuccuggacgaggaacuuuacuccagacagcuguaugugcucggcucucccgccaugcaacggauccagggggcgcgcguccugguuagcggacuucagggccugggggcugagguggccaaaaaccucgugcugaugggagucggcucccugacccuccacgauccucauccgacaugcuggucugaccuggccgcucaguuccuucugagcgaacaagaucucgagagaucccgggccgaggcuucucaggagcugcuugcccagcugaaucgcgcggugcagguugugguccacacgggggacauuaccgaggaucuccugcuggacuuucaagugguugugcucacagccgcuaagcuggaagaacagcuuaaagucggaacccugugucauaagcacggcgugugcuuccucgccgcugauacaagaggccugguggggcagcuguuuugugacuucggagaagauuuuaccguccaggaccccacagaggccgagccucuuaccgcggccauccaacauauuagccagggcucccccgggauccucacgcugcggaaaggagcuaacacccacuacuuccgcgauggcgaccugguuacauuuagcgggauugaaggaaugguggagcucaaugacugcgauccuagaucuauccacgugcgggaagacggcucccuggagaucggcgauaccacaaccuucagccgcuaucuuagagggggagccauuacggaagucaagcggcccaagacagugcgccauaaaucucuggacaccgcucuccugcagccucacguuguggcccaauccagccaggagguccaucacgcccacugucuucaucaggcuuuuugcgcgcugcacaaguuccagcaucuccacggcagaccgccccaaccuugggaucccguggacgccgagacaguuguggggcuggcucgggaucuggaaccucucaaacgcaccgaggaagaaccccuggaggagccgcuugacgaggcccuggucagaaccguggcccucucuuccgcuggaguccugagcccuaugguggccaugcugggcgcgguugcugcccaggaagugcuuaaggccaucucccggaaauuuaugccccucgaucaguggcuguacuucgacgcucuggauugucucccugaggacggggaacugcuucccucucccgaggacugcgcccugagaggaagccgcuaugauggccagauugcugucuuuggcgccggguuccaagaaaagcuccggagacagcauuaccugcuggugggagcgggcgccaucgggugugagcuucucaagguuuucgcucuggugggacugggcgccgggaacuccggcggacucacagucguggacauggaucacauugagcgcagcaaucugucucggcaguuucuuuucagaucccaggacgugggccgcccuaaagcugaaguugccgcggccgcugcccgggggcugaacccggaucuccaagucaucccccugacguauccucuggaccccaccacagagcacauuuacggagauaacuuuuucagcagaguggacggcguggcugccgcccuugauucuuuucaggcucgccgguacgucgcggccagaugcacccauuaucucaagccucugcuggaagcugggacaagcggaaccuggggcuccgccacgguguucaugccccacguuacagaggccuaccgcgcuccggccucugcggcugccagcgaggacgccccuuaucccguguguaccguccgguacuuuccuuccaccgcugaacauacacuccagugggccagacacgaguucgaggaacuguuucggcuuagcgcggaaaccaucaaucaccaucagcaagcucacacaucucuggccgauauggacgagccccagacgcucacccugcugaaaccugugcuugggguucuccgcgugagaccccagaauuggcaagauugcgucgccugggcucugggccauuggaagcugugcuuccacuauggaaucaaacagcuccugcggcauuuuccgccuaacaaggugcuugaggacggcacacccuucugguccgggcccaaacaguguccucagccgcuggaauuugacaccaaucaagauacacaccuccuguacguucuggccgcugccaaccuuuaugcgcagaugcacggacugcccggcagccaggacuggaccgcccucagagagcugcucaagcugcuuccucagcccgauccucaacagauggcucccauuuucgccucuaaucuggaacucgcuuccgccagcgccgaguucgggccugaacagcagaaggagcugaacaaagcucuggaggugugguccgucggacccccgcuuaagccucugauguuugaaaaagacgaugacucuaauuuccauguggauuuuguggucgcggccgcuagccuccgcugccaaaacuacggcauucccccuguuaaccgggcccaguccaagagaaucguggggcagaucauucccgccaucgcuacgaccacagccgcgguggcuggccugcucggacuggagcuuuacaaagucgugucuggcccgcgcccuagaagcgccuuccggcacuccuaucugcaucucgccgaaaauuaccugauccgcuauaugcccuuugcuccugccauucaaaccuuccaccaucugaaguggacaagcugggacagacuuaagguucccgcggggcagcccgagcggacccuggaaucucuccuggcucaccuccaggagcagcacggacugcgcgugagaauccuucugcauggcuccgcccugcucuacgccgcuggguggagcccugagaaacaagcccagcaucugccgcuucgggucacggaacuggugcagcagcucacaggacaagcucccgccccuggccagcgcguucuggugcucgagcugucuugugaaggggaugacgaggauaccgcguuucccccucuucacuaugagcuguga

SEQ ID NO: 77497 - RNA, 1218 nt, Artificial Sequence
  derived and/or modified sequence opt5 from UBAC1__Homo_sapiens__NP_057256
auguucgugcaggaggaaaagaucuuugccggcaaaguccugagacuccacauuugcgcuagcgacggggccgaguggcuggaagaggcgaccgaagauacauccguugagaaacuuaaagagcggugucugaagcauugcgcucacggaucucucgaagaccccaaaagcaucacgcaucacaagcugauucaugccgccuccgagcgcgugcuuucugaugcuagaaccauccuggaagagaacauucaagaccaggaugugcuccugcugaucaagaaacgggccccuagcccgcuccccaagauggcugacgucuccgccgaggaaaagaagaaacaggaucagaaggcgccugacaaggaggccauccugcgcgcuacagccaaucuucccucuuacaacauggauagagcugccgugcaaaccaauaugcgggacuuccagacagaacugcgcaaaauucucguuagccugaucgagguggcgcagaaacuucuggcccucaacccugaugcugucgaacuguuuaagaaggccaaugcuaugcuggacgaggaugaggacgaaagaguggacgaggccgcccuccggcagcugaccgaaaugggcuuccccgagaaccgcgcuacaaaagcgcuucaacugaaucacauguccguuccucaggccauggaauggcucauugagcacgcugaggauccgaccaucgacacgccccugccugggcaggcucccccugaagccgagggagccaccgccgcggcuagcgaagccgccgcuggcgccucugcuacagaugaggaagccagagacgagcuuaccgagauuuuuaagaaaauccggcgcaagagagaguuccgggcggaugcccgcgcugugauuucccugauggagaugggguuugacgaaaaggaggucaucgaugcccucagagugaacaauaaccagcaaaaugcugccugugaguggcugcugggagaccggaaacccagcccggaagaacucgauaagggcaucgacccugauucuccccuguuccaggcgauucuugacaacccugugguccagcugggccucacaaaucccaaaacccugcuugccuuugaagacaugcuggagaacccccucaauuccacgcaauggaugaacgauccugaaacagggccgguuaugcugcagaucagcagaauuuuccagacccugaaccgcacauga

SEQ ID NO: 77498 - RNA, 1035 nt, Artificial Sequence
  derived and/or modified sequence opt5 from UBAC2__Homo_sapiens__NP_001137544
auguucaccagcacaggcuccucugggcuguacaaggcuccccucagcaaaucccugcuucuggugccuucugcccucagccugcuucuggcccuccugcugccgcacugccagaagcucuuugucuaugaccugcaugcgguuaaaaacgauuuccaaaucuggagacuuauuuguggacggaucauuugccuggaccucaaggauacguuuuguuccucucugcuuaucuacaauuuccgcauuuuugagagacgguauggcagccgcaaauucgcuuccuuucugcucgggagcugggugcugucugcccuguucgacuuucuccugaucgaagccaugcaguacuucuuuggaaucaccgcugccuccaaccuucccagcggcuuccuggcuccuguguuugcccucuucguccccuucuauugcucuauuccuagagugcagguugcgcagauccuggggccccuuuccauuacaaauaagacccugaucuacauucucggacugcaacuguuuacaagcggcucuuauaucuggauuguggccaucuccggccucaugagcgggcuguguuacgauuccaagauguuccagguccaccaggugcuuugcaucccuucuuggauggcuaaauuuuucagcuggacccuggagccgaucuuuuccagcucugaacccacauccgaggcccggauuggaaugggcgcuacccucgacauucagcgccaacagagaauggaacugcuugaucggcagcugauguucagccaguuugcccaagggcgcagacagcggcagcaacagggaggcaugaucaacuggaaucgccucuucccuccccugagacagcggcagaacguuaauuaccaagggggacgccagucugagccugcggcucccccgcuggaggugagcgaggaacaggucgccagacucauggaaaugggcuuuucccggggcgacgcccuggaggcucuuagagccucuaacaaugaucugaacguggccacgaauuuccuccugcagcauuga

SEQ ID NO: 77499 - RNA, 1701 nt, Artificial Sequence
  derived and/or modified sequence opt5 from UBAP1__Homo_sapiens__NP_001164672
augagcggcgccgugagagggcggcgcagagaggucggacugcagcacggcgggugcggaaccggcgggggauacggcgacggccucgcucgguccgggcaaucuuggcgcugguggagaagccugucccuuggagccguuggcucuagcgcggggacagaacccggacggccugcuggcgccuccacguuccgccugcucagacggcgccagcagagacauucugggaccuuuagcuaucuggaugacgugccguucaagacaggagauaaauuuaagacccccgccaaagugggccuuccuaucggcuucucccugcccgacugucuccaggucgugcgggagguucaauacgauuuuagccuggaaaagaaaacaauugagugggcugaagagaucaagaagauugaggaagccgagcgcgaagcugagugcaaaaucgccgaggcggaagccaaggugaacucuaaauccgggccugagggagacagcaagaugucuuucuccaaaacccacagcacagcuaccaugcccccuccgauuaaucccauccuggccucucuccagcauaacuccauccugacgccuaccagagucagcuccucugcuacaaagcagaaggugcuuagcccuccccacauuaaagccgauuuuaaucuggcggacuucgaaugugaggaagaucccuuugacaaccucgagcugaagaccaucgaugagaaagaagaacuucggaauauucugguuggcacaaccgggccgaucauggcccagcuccuggacaacaaucugccucgcggaggcuccgggagcgugcuccaagaugaagagguccuggcuucucuugaaagagccacgcuggacuucaagccccuccauaaaccuaacggauuuauuacacugccccagcuuggcaauugcgagaagaugucccugagcucuaaagugagccugcccccuaucccggcuguguccaacauuaagucucucagcuuccccaagcuggacuccgaugacagcaaucagaaaaccgccaagcucgccucuacauuucacuccaccagcugucugcggaacggcaccuuccaaaauucucuuaaaccuuccacacaaagcuccgcuucugagcugaacgggcaccauacgcucggacugagcgcgcuuaaucuggauuccggcaccgaaaugcccgcccucacaucuagccagaugccuucccugagcguccugucuguuugcaccgaggaauccucucccccgaacacagggccuaccgugacgcccccuaacuucagcgugucccagguccccaauaugccuagcuguccccaggcuuauucugagcuccagaugcugagcccguccgaaagacagugcguggagacaguugugaacaugggauacagcuaugaguguguccuucgcgccaugaagaaaaagggcgaaaauaucgagcagauccuggacuaccucuuugcccacgggcaacugugcgaaaagggcuucgauccucugcuuguggaggaggcucucgaaaugcaucaguguucugaggagaaaaugauggaguuucugcagcugauguccaaguucaaagaaaugggauuugagcucaaggacauuaaagagguucugcuucugcacaacaaugaucaggacaacgcccucgaagaucugauggcgcgggcuggcgccagcuga

SEQ ID NO: 77500 - RNA, 2559 nt, Artificial Sequence
  derived and/or modified sequence opt5 from UBAP2__Homo_sapiens__NP_001269458
auggacagcaagggccuggggagaauccucuggaaauccggacagcaaaagaccggccugaaaauuaucgaucuuguggcccugcuccagaagcccgucccucacucucaggcuagcgaggccaacuccuucgaaacaucucagcaacagggguuuggacaggcgcugguuuucacgaauagccagcauaacaaucaaauggcuccgggcaccggguccucuacagccgugaacagcugcuccccucagagccuuucuuccgugcugggaagcggcuuuggcgagcucgccccucccaaaauggcuaauauuaccucuucccagauccuggaccagcugaaggccccuagccucgggcaauucacaaccacacccucuacccagcagaacuccacgagccacccuaccacaaccacauccugggaucugaagccgcccaccucucaaagcuccguccuuagccaucuggacuuuaaaucucagccugaacccuccccugugcucagccagcugucucagcggcaacagcaccagagccaggcuguuacggugcccccgccuggacuugaguccuuccccucucaagccaagcugcgcgaaagcacaccuggcgauucccccagcaccgucaauaaacuccugcagcugcccucuacaaccauugagaacaucuccgugagcguucaucagccucagccgaagcacaucaaacucgcgaagagacggauucccccugccucuaagauccccgcuuccgccguggagaugccugggagcgcugacgucaccggacugaaugugcaauuuggcgcccuugaguucggguccgaacccucucugagcgaauuuggauccgcgccgucuagcgagaacuccaaucagauuccuaucagccucuacucuaaaucccugagcgagccccuuaacacaucucuguccaugacgagcgccgugcaaaauucuaccuauacaaccagcgucauuacauccuguagccucaccucuuccagccugaacuccgcuucuccuguugccaugagcuccucuuacgaucagagcuccgugcacaaucgcauccccuaucagucuccugugagcuccagcgaaucugcucccggcacgauuaugaacggccaugggggaggcagaucccagcagacacuggacaccccgaagaccacagggccucccagcgcccuccccucugucuccagccugccuucuaccacauccugcacggcccuucugccgagcaccucccaacacacaggagaucucaccagcucuccccugagccagcuuuccucuagccuguccucucaucagagcucccucucugcucacgcggcccugagcuccagcacaucucacacccaugcuuccguggagagcgccucuucccaccagagcuccgccacguucucuaccgcugccacaagcguuuccagcucugcguccagcggcgugucucugagcuccucuaugaacaccgcuaauagccucugucuugggggaacacccgccuccgccucuagcuccagcucucgggcugccccucuggucaccuccggcaaagcuccucccaaccugccucaaggcgugcccccgcuccugcauaaucaguaccugguugggccuggaggccuucuccccgccuauccuaucuacggguaugacgaacugcagaugcugcagagccgccuccccguggauuacuacggaaucccguuugcggccccuacggcucuggccuccagagacggcucucuugcuaacaaucccuauccuggggaugucacaaaguucggccggggagacagcgccucccccgcgcccgccaccacacccgcucaaccgcagcagucucagagccaaacccaccauaccgcccagcagcccuuugugaacccugcucugcccccuggcuacuccuauacagggcuccccuacuauacgggaaugccuagcgccuuccaauacggcccgaccauguucgugcccccugccucugcuaaacagcacggggucaaucuguccacacccaccccucccuuucagcaggcgagcggauauggccaacacggguacucuacaggcuacgacgaucugacccagggaacggccgcuggcgacuauuccaaagggggauacgccggcagcucucaggccccgaacaagagcgcuggguccggaccuggcaaggggguuucugugagcuccagcacaaccggccuucccgauaugaccggauccgucuauaauaagacacagaccuucgacaaacaaggcuuucaugccgggacacccccucccuucucucucccuagcgugcugggauccacgggcccgcuggcgucuggggcugcccccggauacgccccucccccuuuucuccacauucugcccgcucaucagcagccgcacagccagcuucugcaccaucaccucccucaagaugcccaguccggcucugggcagcgcagccagcccuccagccugcaaccuaagucucaggcguccaaacccgcuuauggcaacagcccuuacuggaccaauuga

SEQ ID NO: 77501 - RNA, 1872 nt, Artificial Sequence
  derived and/or modified sequence opt5 from UBASH3A__Homo_sapiens__NP_001001895
auggccgcuggcgagacccagcuguacgccaaggugagcaacaaacucaaguccagaucuagccccucccugcuugaaccccugcucgcgaugggguucccgguccacacagcucugaaagcccuugccgcuacgggacggaagaccgccgaggaagcucuggccuggcuccaugaccacugcaaugaucccucucuggacgauccuaucccccaagaguaugcgcuguuucucuguccuacaggcccccugcuugaaaaacugcaggaguucuggcgcgagagcaagagacagugcgccaagaaccgggcucaugaaguuuuuccucacgugacccucugugacuucuuuacaugcgaggaucagaaaguggaaugucuguacgaggcccuuaagcgcgcuggggacagacugcucggauccuucccgaccgccgucccccuggcgcugcauucuagcauuuccuaucucggcuuuuucgugagcgggucuccugccgauguuauccgggaguuugcuaugacauucgccaccgaggcuucccugcuugccgacugcagcgugaaacccuguacgaagcaacugcaccucacccuggcccacaaauuuuacccucaucaccagcgcacacuugagcagcuggcuagagcgauuccccucggacauucuugccaguggaccgccgcucuguauucccgggauaugcgcuucguccacuaccaaacacugagagcccucuuucaguauaagccgcagaauguggacgaacugacccuuagcccuggcgauuacaucuucguugaccccacgcagcaagaugaggccucugaaggcugggugauugggaucucccagcggacaggaugucgcggcuuccugccugagaacuacaccgacagagcuagcgaguccgacacaugggucaagcaccggauguauaccuuuucucucgccaccgaucugaauagccgcaaagacggggaagcguccagcagaugcucuggagaguuccuuccccagacagcucggucccugagcucucuccaagcccugcaggccacgguggcuagaaagagcgugcuggucguucgccauggcgaacggguggaucagaucuuugggaaagccuggcuccagcaauguuccacccccgacggaaaguacuauagaccugaucugaacuucccgugcucucuuccccgccggagcagaggcauuaaagacuuugagaaugauccuccccuguccagcugcggcaucuuccagucucgcauugcuggggacgcccuccuggauuccggaauccggauuagcucuguguuugcguccccugcccugagauguguccagacagcuaaacuuauccucgaagaacugaagcuggagaagaagauuaaaauccgcguggaacccggcaucuucgaguggaccaagugggaagccgggaaaacaaccccgacgcucaugagccuggaggaacuuaaggaggcuaacuuuaauauugacacagauuaccggccugccuucccccuguccgcgcucaugccugccgagucuuaucaggaauacauggacagaugcaccgcuagcaugguucaaaucgugaacaccuguccccaggacacaggagucauucugaucgugucccacggcucuacccuggauagcugcacacgcccucuucucgggcugcccccgcgggaguguggagacuuugcccagcugguuagaaaaauuccuucccucggcaugugcuucugugaagagaauaaggaggaaggcaagugggagcuggugaacccucccgucaaaacgcuuacccauggggcuaaugccgccuuuaacuggcggaauuggaucagcggaaacuga

SEQ ID NO: 77502 - RNA, 1950 nt, Artificial Sequence
  derived and/or modified sequence opt5 from UBASH3B__Homo_sapiens__NP_116262
auggcccaguacggccaccccagcccucuggggauggcugccagagaggaacucuauuccaaggugaccccgcggcgcaacagacaacagcggcccggaacaaucaaacauggcucugcgcuggacguccuucugagcaugggguucccucgcgcuagagcccagaaggcccucgcuuccacgggaggccggucuguucaggccgcuugcgacuggcuguuuagccacgugggggaccccuuccuugaugacccucugccccgcgaguacgugcucuaucugagaccuaccggaccgcuggcccaaaaacucuccgauuuuuggcagcagucuaagcagauuuguggcaaaaauaaggcgcauaacaucuucccccacauuacacugugccaauuuuucaugugugaagacagcaaggucgaugcccuuggcgaggcucugcagaccacagugucccgguggaaaugcaaguuuagcgccccucucccccuggaacuuuacaccucuuccaauuucaucgggcuguuuguuaaagaggacagcgcugaggugcucaagaaauucgccgcggauuuugccgcugaagccgcuucuaagacagagguccauguggaaccucacaagaaacagcugcacguuacccuggccuaucauuuccaggccucccaccuccccacgcuggagaaacuugcucaaaacauugacgugaagcugggaugugauugggucgcgaccaucuuuagccgcgacaucagauucgccaaucaugagacacuccaggugauuuacccguauaccccucagaacgaugacgaacuggagcuugugcccggcgacuucaucuuuaugucuccuauggaacaaacauccaccagcgagggguggauuuacggaacgucccugacaaccggcugcucugggcuccugcccgaaaauuacaucacaaaggcugaugaguguagcaccuggauuuuccacggauccuauagcauccugaacaccucuuccagcaauucucucacauuuggcgacggcguccuggagcggcgccccuacgaagaucaggggcuuggagagacgaccccucugacaauuaucugccagccgaugcagccccucagaguuaacagccaaccuggcccccagaaacggugucuguucgugugccgccacggggaaagaauggacguggucuuuggaaaguauuggcuuucccaguguuucgaugccaaaggccgguacaucagaaccaaucugaacaugccucauucucucccccagcgcagcgggggauuucgggacuaugagaaggaugccccgauuacaguguucggcugcaugcaagcuagacugguuggcgaagcccugcucgaguccaauaccaucauugaccacguguacugcagcccuucucugcgcuguguccagacggcgcauaacauccuuaaggggcugcagcaggagaaucaccucaaaauucggguggaacccggacuguuugaguggacaaaguggguugcuggcuccacccugccugccuggauucccccuagcgaacuugccgcugccaaccucucuguggauaccacauauagaccccauaucccgaucuccaaacuggucgugagcgaguccuacgacaccuacaucucucgcagcuuccaagucacaaaggaaauuaucuccgagugcaaaucuaaggggaacaauauucugaucguggcucacgccagcucccucgaggcguguacgugccagcugcagggacuuagcccucagaacucuaaggauuuuguucaaauggugcggaaaauccccuaucugggcuucuguuccugcgaggaacucggggaaaccggcauuuggcagcugacagaucccccuauccugccgcuuacccacggacccacaggcggguuuaauuggagagagacccuccugcaggaguga

SEQ ID NO: 77503 - RNA, 690 nt, Artificial Sequence
  derived and/or modified sequence opt5 from UBB__Homo_sapiens__NP_001268647
augcagaucuucgugaagacccugacaggcaaaacgauuacccucgaggucgaacccagcgacacaaucgagaacguuaaggccaaaauucaagauaaggaagggaucccuccggaccagcagagacugauuuuugcuggaaaacagcuugaggauggccggacccuguccgacuacaauauccaaaaggaaucuacacuccaccuggugcuucgccugagagggggaaugcagaucuucgugaagacccucacaggcaaaaccauuacgcuggaggucgagcccagcgauaccaucgaaaacgugaaggccaaaauucaggacaaggaggggaucccucccgaucagcaacggcugauuuuugcgggaaaacagcucgaagacggccgcacacuguccgauuauaauauccagaaggagucuacccuucaucugguucucagacugcggggcgggaugcagauuuucgugaagacacuuaccggaaaaacgaucacacuggaggucgaaccuagcgacaccaucgagaacgugaaggcuaaaauucaagauaaggaaggcauucccccugaccagcagcgccucaucuuugccgggaaacaacuggaggauggaagaacacuguccgacuacaauauccagaaggaaucuacccuccaccugguucuucggcugcgcggcgggugcuga

SEQ ID NO: 77504 - RNA, 2058 nt, Artificial Sequence
  derived and/or modified sequence opt5 from UBC__Homo_sapiens__NP_066289
augcagaucuucgugaagacccugacaggcaaaacgauuacccucgaggucgaacccagcgacacaaucgagaacguuaaggccaaaauucaagauaaggaagggaucccuccggaccagcagagacugauuuuugcuggaaaacagcuugaggauggccggacccuguccgacuacaauauccaaaaggaaucuacacuccaccuggugcuucgccugagagggggaaugcagaucuucgugaagacccucacaggcaaaaccauuacgcuggaggucgagcccagcgauaccaucgaaaacgugaaggccaaaauucaggacaaggaggggaucccucccgaucagcaacggcugauuuuugcgggaaaacagcucgaagacggccgcacacuguccgauuauaauauccagaaggagucuacccuucaucugguucucagacugcggggcgggaugcagauuuucgugaagacacuuaccggaaaaacgaucacacuggaggucgaaccuagcgacaccaucgagaacgugaaggcuaaaauucaagauaaggaaggcauucccccugaccagcagcgccucaucuuugccgggaaacaacuggaggauggaagaacacuguccgacuacaauauccagaaggaaucuacccuccaccugguucuucggcugcgcggcgggaugcagauuuucgugaaaacccucacaggaaagacgaucacccuggaggucgagccgagcgacacaaucgaaaacgugaaggccaaaauucaggauaaggagggcauucccccugaccaacagagacuuaucuuugcuggcaaacagcuggaagaugggcggacccucuccgacuauaauauccagaaggagagcacacugcaucuggugcuccgccugagaggaggcaugcaaauuuucgucaaaacccuuacggggaagacaaucacccuggaaguugagcccucugauaccaucgagaacgugaaggccaaaauucaggacaaggaaggaaucccucccgaucagcagcggcucauuuuugcuggcaaacaacuggaggacgggcgcacacuuuccgauuacaauauccagaaggaaagcacccugcaccucgugcugagacugcggggaggcaugcagauuuucgucaaaacacucacgggcaagaccaucacacuggagguggaaccgucugacaccauugagaacguuaaggccaaaauccaggauaaggaggggaucccucccgaccaacagagacuuauuuuugcgggaaaacagcuggaagacggccgcacacucuccgauuauaauauccaaaaggagagcacccugcaucuggugcuucggcucagagggggaaugcagauuuucgucaaaacgcugaccggcaagacaaucacccuggaaguggagccuucugacacaauugagaacguuaaggccaaaauccaggauaaggaagggaucccucccgaccagcaacgccucauuuuugcuggcaaacagcuggaggauggacggacccuuuccgacuacaauauccagaaggaaagcacgcugcaccucgugcugagacugcgcggcgggaugcagauuuucgucaaaacacuuaccggaaagacaaucacccucgagguggaacccuccgauaccauugagaacgucaaagccaagauccaagacaaggagggcaucccgcccgaucagcagcggcugauuuucgcugggaaacagcuggaagacggaagaacacucucugauuauaauauccaaaaggagagcacgcugcaccuugugcugcgccuccggggcgggaugcagauuuuuguuaaaacccugacaggcaagaccaucacacuggaaguggagccuuccgacaccauugaaaacgucaaagccaagauccaggauaaggagggaaucccucccgaccaacagagacuuauuuucgcgggcaaacagcucgaggacgggcgcacgcugagcgauuacaacauccagaaggaaucuacacugcaucucgugcugcggcuuagaggaggcguuuga

SEQ ID NO: 77505 - RNA, 498 nt, Artificial Sequence
  derived and/or modified sequence opt5 from UBD__Homo_sapiens__NP_006389
auggcccccaacgcuagcugccuguguguccacgucagauccgaggaaugggaccucaugaccuucgaugccaauccuuacgacucuguuaagaaaaucaaggagcaugugcggagcaaaacaaaggugccgguccaggaucaagugcugcuucugggcuccaaaauucucaagccccgcagaucucugagcuccuaugggaucgacaaggagaaaacgauucaccuuacccugaagguugugaaaccuucugaugaagaacucccccuguuucuggucgagagcggagacgaggcgaagcggcaucuccuccaggugcgcagauccagcucuguugcucaggugaaagccaugaucgaaacaaagaccggcauuaucccugagacacagaucgugaccugcaacgggaagcggcuugaagauggaaaaaugauggccgacuacggcauucgcaaggggaaucugcuguuccuggcuuguuauugcaucggaggcuga

SEQ ID NO: 77506 - RNA, 360 nt, Artificial Sequence
  derived and/or modified sequence opt5 from UBE2A__Homo_sapiens__NP_001269090
augguguggaacgccgucaucuucggccccgaggggaccccuuuugaagacggaacauucaagcugacgauugaguuuaccgaagaguacccgaauaaacccccuacaguuagauucgugagcaagauguuucaccccaacguguaugcugauggcuccaucugccucgacauucugcagaaucgguggucuccuaccuacgaugucagcuccauccuuacaucuauucaaagccugcucgacgaacccaacccuaauuccccggccaacucucaggcggcucagcuguaucaggagaauaaacgcgaguacgaaaagagagugagcgccaucguugagcaauccuggcgggauuguuga

SEQ ID NO: 77507 - RNA, 459 nt, Artificial Sequence
  derived and/or modified sequence opt5 from UBE2B__Homo_sapiens__NP_003328
augagcacccccgccagacggcgccugaugagagacuucaagcggcuccaggaggauccuccggugggcgucuccggggcucccucugaaaacaauaucaugcaauggaacgccguuauuuuuggaccugagggcacacccuucgaagacgggacguuuaaacuggugaucgaguucagcgaagaguacccuaauaagcccccuaccgugcgcuuucuuuccaaaauguuccacccgaacgucuaugcggauggaucuauuugccuggacauccuccagaauagauggagccccacauacgauguguccucuauucugaccagcauccagucccuucuggacgagccuaaccccaauagcccugcuaacucucaggccgcccaacucuaucaggaaaauaagcgggaguacgaaaaacgcguuuccgcuaucguggagcagagcuggaacgauucuuga

SEQ ID NO: 77508 - RNA, 240 nt, Artificial Sequence
  derived and/or modified sequence opt5 from UBE2C__Homo_sapiens__NP_001268671
auggccagccagaacagagaccccgcugccaccuccguggcggcugcccggaagggcgccgagccuucugggggagcugcccgcggcccggucgggaaaagacugcaacaggaacucaugacacugaugaugagcggagauaagggcaucuccgcuuuccccgagucugacaaucuuuuuaaauggguugggacgauucacggagccgcgggcaccaacccuacacugaucgugcccuga

SEQ ID NO: 77509 - RNA, 444 nt, Artificial Sequence
  derived and/or modified sequence opt5 from UBE2D1__Homo_sapiens__NP_003329
auggcccugaagagaauccagaaagagcucagcgaccugcaacgggaucccccugcucacugcuccgccggcccggugggggacgaucuuuuccauuggcaggcgaccauuaugggacccccugacucugcuuaccagggcggggucuuuuuccugacaguucacuuucccacggauuauccuuucaagcccccuaaaaucgccuuuaccacaaagauuuaccauccgaacaucaauagcaacggauccauuugucucgacauccugcgcucucaguggagccccgcccuuaccguguccaaagugcugcucucuaucugcagccugcugugugauccuaaucccgacgauccucucguccccgacauugcucaaaucuauaaguccgauaaggaaaaauacaacagacacgcccgggaguggacacagaaguaugcuauguga

SEQ ID NO: 77510 - RNA, 444 nt, Artificial Sequence
  derived and/or modified sequence opt5 from UBE2D2__Homo_sapiens__NP_003330
auggcccugaagagaauccacaaagagcucaacgaccuggcucgggaucccccugcccagugcagcgcgggcccggugggggacgauauguuccauuggcaagcuaccauuaugggacccaaugacuccccuuaccagggcggggucuuuuuccuuacaauccacuuucccacggauuauccuuucaagcccccuaaaguugccuuuaccacacgcauuuaccauccgaacaucaauucuaacggaagcauuugucuggacauccucagaucccaguggucucccgcccugaccaucagcaaggugcuucuguccauuugcucucuccugugugauccuaaucccgacgauccucuggugcccgaaaucgcucggauuuauaaaacagaccgcgagaaguacaacagaaucgcccgggaauggacccagaaguaugcuauguga

SEQ ID NO: 77511 - RNA, 444 nt, Artificial Sequence
  derived and/or modified sequence opt5 from UBE2D3__Homo_sapiens__NP_003331
auggcccugaagagaaucaacaaagagcucagcgaccuggcucgggaucccccugcccagugcuccgcgggcccggugggggacgauauguuccacuggcaagcuaccauuaugggacccaaugacucuccuuaccagggcggggucuuuuuccuuacaauccauuuucccacggauuauccuuucaagcccccuaaaguugccuuuaccacacgcauuuaccacccgaacaucaauagcaacggauccauuugucuggacauccucagaucucaguggagccccgcccugaccaucuccaaggugcuucugucuauuugcagccuccugugugauccuaaucccgacgauccucuggugcccgaaaucgcucggauuuauaaaacagaccgcgauaaguacaacagaaucucccgggaguggacccagaaguaugccauguga

SEQ ID NO: 77512 - RNA, 483 nt, Artificial Sequence
  derived and/or modified sequence opt5 from UBE2E1__Homo_sapiens__NP_001189405
augaaggaggugggcagaccccgggaaguccgcgggagaccuggaaaaagccggauccagaaggagcuggccgacauuacccucgauccgcccccuaacugcuccgcuggccccaaaggggacaauaucuacgaauggcgcucuacaauucugggaccucccggcagcguuuaugaagggggaguguucuuucuugauaucacguucaccccugaguacccguuuaagcccccuaaagugacauucagaacccggauuuaucacuguaacaucaauucccaaggcgucaucugccuggacauucucaaggauaacuggucucccgcccugacaaucagcaaggugcuucuguccauuuguucucuccugaccgacugcaauccugcggauccccugguuggcagcaucgcuacacaguacaugaccaaccgcgccgagcaugacagaauggcccggcaguggacgaaacgcuaugcuaccuga

SEQ ID NO: 77513 - RNA, 606 nt, Artificial Sequence
  derived and/or modified sequence opt5 from UBE2E2__Homo_sapiens__NP_689866
augagcaccgaggcccagagaguggacgauucccccucuacaagcggcggguccucugacggagaucaacgggaaagcguccagcaggagccugaacgcgagcagguucaaccgaagaaaaaggaaggcaaaaucuccucuaagacggcugccaaacugagcaccuccgcgaagcggauucagaaggagcucgcugagaucacacuggaucccccucccaacugcagcgccgggccuaaaggagacaauauuuacgaauggagaucuaccauccuugggcccccuggcuccguguaugagggaggcguguucuuucuggacauuacauucagcccggauuaccccuuuaagccucccaaagucaccuuccgcacaagaaucuaucacuguaacaucaauucucagggcgugauuugccucgacauccugaaggauaacugguccccugcccuuaccauuagcaaaguucugcucucuaucuguucccugcugacggacugcaaucccgcugauccgcucguggggagcauugccacccaguacaugacaaaccgggcugaacaugaccgcauggccagacaauggaccaagcgguaugcgacauga

SEQ ID NO: 77514 - RNA, 624 nt, Artificial Sequence
  derived and/or modified sequence opt5 from UBE2E3__Homo_sapiens__NP_006348
augagcuccgacagacagcggucugaugacgagagccccuccaccucuagcggcuccucugaugccgaccaacgcgauccugcugccccggaacccgaggaacaggaggaaagaaagccuagcgcgacacagcagaaaaagaacacgaaacuguccagcaagaccacagcuaaacucucuaccuccgccaagcggauccaaaaggagcuggccgagauuacacuugaucccccucccaauugcagcgcugggccuaaaggagacaacaucuacgaauggcgcucuaccauucugggcccgcccggguccguguaugagggaggcgucuucuuucucgacaucacauucagcucugauuacccuuuuaagcccccuaaaguuaccuucagaacgcggauuuaucacuguaauaucaacucccagggggugaucugccuggacauucuuaaggauaauuggagccccgcccugaccaucuccaaagugcuccugucuauuuguagccugcucacagacugcaacccggcugauccucuggucggauccaucgccacccaguaccuuacaaaucgcgcggaacaugacagaauugcccggcaguggaccaagcgcuaugcuacguga

SEQ ID NO: 77515 - RNA, 513 nt, Artificial Sequence
  derived and/or modified sequence opt5 from UBE2G1__Homo_sapiens__NP_003333
augaccgagcugcagagcgcccuccugcuuagacggcaacuggcugaacucaacaagaaucccguggagggcuucuccgccgggcugaucgacgauaacgaccuuuaccgcugggaaguccugauuaucggaccuccggauacacucuaugagggcgggguuuuuaaagcgcaccugacguuccccaaggacuacccucugagacccccuaaaaugaaguuuauuaccgaaaucuggcaucccaauguggauaaaaacggagacgugugcauuucuauccuccacgagccuggcgaggauaaguauggguacgaaaagccggaggaacgguggcugcccauccauacagucgagaccauuaugaucagcgugauuuccaugcuugcugacccuaauggagauucucccgccaacguugacgccgcuaaagaguggcgcgaagauagaaauggcgaguucaagcggaaaguggcccgcugugucagaaagagccaggaaacagcuuuugaguga

SEQ ID NO: 77516 - RNA, 498 nt, Artificial Sequence
  derived and/or modified sequence opt5 from UBE2G2__Homo_sapiens__NP_003334
auggccggcaccgcucugaagagacucauggccgaguacaaacagcugacacuuaaucccccugaagggaucguggcgggaccgaugaacgaggaaaacuucuuugagugggaagcucugauuaugggccccgaggacacgugcuucgaguuuggggucuucccugccauccucagcuuuccccuggauuauccucuuucucccccuaagaugcgguucaccugugaaauguuucacccgaauauuuaccccgacggacgcguuugcaucuccauucugcaugccccuggcgaugaccccaugggguaugagagcuccgcugaaagauggucuccugugcagagcguggagaaaauccuccuguccgucgugucuaugcuggccgagcccaacgaugaaagcggagcuaauguugacgccuccaagauguggcgggaugaccgcgagcaguucuacaaaaucgcgaagcagauugugcaaaagagccucggccuguga

SEQ ID NO: 77517 - RNA, 552 nt, Artificial Sequence
  derived and/or modified sequence opt5 from UBE2H__Homo_sapiens__NP_003335
augagcucccccucuccuggcaagagacggauggacaccgauguggucaaacugaucgagagcaagcacgaaguuacaauucucgggggacugaacgaguucguggugaaauuuuacggcccgcaggggacgcccuaugaaggaggcgucuggaaggugcgcguugaccuuccugauaaauaccccuucaaguccccuucuaucggguuuaugaauaagauuuuccaucccaacaucgacgaggccagcggaaccgugugccuggaugucauuaaucaaacauggaccgcucucuaugaccugacaaacaucuuugaauccuuccuuccucagcugcucgccuacccgaaucccaucgauccucugaacggcgacgcggcugccauguaucugcacagacccgaggaguacaaacagaagauuaaagaauauauccagaaguacgccaccgaggaagcucucaaagagcaagaggaaggcacaggggauucuagcuccgagagcucuauguccgacuuuagcgaagaugaggcccaggacauggaacuguga

SEQ ID NO: 77518 - RNA, 477 nt, Artificial Sequence
  derived and/or modified sequence opt5 from UBE2I__Homo_sapiens__NP_003336
augagcggcaucgcccuguccagacucgcucaggagcggaaggccuggcgcaaagaccaccccuucggguuuguggcggucccuaccaagaacccggauggaacaaugaaucugaugaacugggaaugcgcuauucccggcaaaaaggggacgccuugggagggaggccuuuucaaacugagaaugcucuuuaaggacgauuaccccucuagcccucccaaguguaaauucgaaccuccgcuguuucaucccaauguuuauccuuccgggaccgugugccuuucuauccuggaggaagacaaggauuggcggcccgccauuacaaucaaacaaauucuccugggaauccaggagcugcucaacgagccuaauauccaggaccccgcccaggcugaagccuacaccauuuauugucaaaaccgcguggaguacgaaaagagaguccgggcucaggccaaaaaguucgcgccgagcuga

SEQ ID NO: 77519 - RNA, 957 nt, Artificial Sequence
  derived and/or modified sequence opt5 from UBE2J1__Homo_sapiens__NP_057105
auggagaccagauacaaccucaagagccccgccgugaaacggcucaugaaggaagcugccgagcugaaagacccuacagaucacuaucaugcgcagccgcuugaagacaaucuguucgaguggcacuuuacgguccgcggacccccugauuccgacuucgaugggggaguuuaccauggcagaaucgugcugcccccugaauaucccaugaagccuccgucuauuauccugcuuaccgcuaacgggcgguuugaggugggcaaaaagauuugccugagcaucuccggccaccaucccgagacauggcaaccuucuuggagcauucgcaccgcccuccuggccaucaucggguucaugcccacaaagggagaaggcgcuauuggcucccuggacuacaccccugaggaaagacgggcccucgcuaaaaagucucaggauuuuuguugcgagggguguggaagcgccaugaaagacguccugcuuccccugaaguccggcagcgauucuucccaggcggaccaggaggccaaagaacucgcucgccaaaucagcuucaaggccgagguuaauucuuccgggaagacaauuagcgaaucugaucugaaccacuccuuuagccuuaccgaccugcaggaugacaucccgacgaccuuccagggagcuacagccuccaccucuuauggccuccagaauagcuccgcggccagcuuucaccaaccuacacagcccguggcuaaaaacaccucuauguccccuagacagcggcgcgcccagcaacagagccagagacggcugucuacgagccccgacgugauucaagggcaucagccccgcgauaaucacacagaccauggaggcuccgcuguccugaucgugauucucacccuggcccuugccgcucugaucuucagacggaucuaccucgcgaacgaguauauuuuugauuucgaacuguga

SEQ ID NO: 77520 - RNA, 474 nt, Artificial Sequence
  derived and/or modified sequence opt5 from UBE2K__Homo_sapiens__NP_001104582
auggccaacaucgcugugcagagaauuaagcgggaguucaaagaaguccucaagagcgaggaaaccuccaaaaaucaaaucaagguugaccugguggaugagaacuuuacagaacugcgcggcgagauugccgggcccccugacacgccguacgagggaggcagauaucagcuugaaaucaaaauucccgagaccuacccuuucaaucccccuaaggugcgguuuaucacaaagaucuggcaccccaacauuucuagcgucaccggggcgaucugccuggauauucucaaagaccagugggcugccgccaugacacugcgcaccgugcuucugucccuccaggcucugcuggccgcugccgaaccugaugacccgcaagaugcgguuguggccaaucagaacgcugucaucguggcccucucuagcaaguccugggacguugagacagcuaccgagcugcuucugucuaauuga

SEQ ID NO: 77521 - RNA, 639 nt, Artificial Sequence
  derived and/or modified sequence opt5 from UBE2L3__Homo_sapiens__NP_001243284
augcaaguggccgcuggcacaagaggggacacacggcugcaggaggucgcccuccugccccagcuuuucgaucugcucguucugggacagcgcagagcgcggcuucugcgccaggugccuagcgcucucgccggcaaggaccuggcccaacugcaggcuggggccacgcucgcuggauacagacgggcccacggcccggaggaacuggaagagauccgcaaaugcgggaugaagaacuuuagaaauauucagguggaugaagcgaaccuucugaccuggcagggacucaucguccccgacaauccucccuaugauaaaggcgccuuccggauugagaucaacuuuccugcugaguaccccuucaagccuccgaaaauuacauuuaagaccaagaucuaucaucccaauaucgacgaaaaaggccaagugugucugccuguuauuuccgccgagaacuggaagcccgcuacaaaaaccgaucaggugauccagucucuuauugcccuggucaaugacccucagcccgaacacccgcuccgcgcggaucuggccgaggaguacagcaaggacagaaagaaauucugcaagaacgcugaagaguuuaccaaaaaguauggggaaaaacggccuguggauuga

SEQ ID NO: 77522 - RNA, 462 nt, Artificial Sequence
  derived and/or modified sequence opt5 from UBE2L6__Homo_sapiens__NP_004214
augauggccagcaugagaguggucaaggagcuggaagaccuccagaaaaagcccccuccguaccugcggaaccuuuccucugaugacgcuaauguucugguguggcacgcccuccugcuucccgaucaaccucccuaucaucugaaagcguucaaccuccgcaucagcuuuccucccgaguacccuuucaagccgcccaugauuaaauuuaccacaaagaucuaucacccuaauguggacgaaaacggccagauuugccugcccaucauuuccucugagaauuggaagccuuguacgaaaaccugccagguccuggaagcucucaacgugcugguuaauagacccaacauccgggagccgcuucgcauggaucuggccgaccuccugacacagaauccugagcuuuucagaaagaacgccgaagaguuuacccugcgguucgggguggaucgccccagcuga

SEQ ID NO: 77523 - RNA, 552 nt, Artificial Sequence
  derived and/or modified sequence opt5 from UBE2M__Homo_sapiens__NP_003960
augaucaagcuguucagccucaaacagcaaaagaaagaggaagaguccgccggcgggaccaagggaucuagcaaaaaggcuuccgccgcgcagcugcggauucagaaggacaucaacgaacuuaaucugcccaaaacaugcgauauuucuuuuagcgacccugaugaccuccugaacuucaaacuugugaucuguccggaugagggcuuuuacaaguccgggaaguucgucuuuucuuucaaaguuggacagggcuauccccacgacccucccaaggugaagugcgaaacgaugguguaccauccuaauauugaucuggaggggaacgucugucucaauauccugagagaggacuggaaacccgugcugaccaucaacagcauuaucuauggacuccaauaccuguuucuugaaccuaauccggaggauccccugaacaaggaagcugccgagguucuccagaauaaccgcagacuguucgagcagaaugugcagcgguccaugcgcggcggcuauauugggagcacauacuuugaaagaugccuuaaauga

SEQ ID NO: 77524 - RNA, 459 nt, Artificial Sequence
  derived and/or modified sequence opt5 from UBE2N__Homo_sapiens__NP_003339
auggccggccugcccagacggaucauuaaggagacccagcgccuccuggcugaaccugugccggggaucaaagccgagcccgacgaaagcaacgcgagauacuuccacgucguuauugcuggaccucaagauucccccuuugagggcgggacauucaaacuugaacuguuucucccugaggaguaucccauggccgccccuaaggugcgguucaugacgaagaucuaccauccgaauguggacaaacugggacgcauuugccuugauauccugaaggacaaguggucucccgcucuccagaucagaaccguccugcugagcauucaggcccuccuguccgcuccuaaccccgaugacccucuugccaaugauguggcggaacaguggaaaacaaacgaggcccaagcuaucgaaaccgcccgggcuuggacacgccuguaugccaugaauaacauuuga

SEQ ID NO: 77525 - RNA, 1080 nt, Artificial Sequence
  derived and/or modified sequence opt5 from UBE2Q2__Homo_sapiens__NP_001138807
augagaauggacagccugaccgaggaaaagcucgagugccggcugugguguugccuuuccgaucccucuccuccgggccuggccgcucgcuguugcgugcucgaaagaagcaucguccccucccugcggcaggagucuuacccuagcuccucucccauuugguucguugacagcgaagauccuaaccuuaccuccgugcuggagcgccucgaggacacgaaaaauaacaaucugcugagacaacagcucaaguggcugaucugugaacuuugcagccuguauaaccuccccaaacaccuggauguggagaugcuugaccagccucugccgaccgggcagaauggaacaaccgaagaggucacaucugaggaagaggaagaggaagaggagauggccgaagauauugaggaccucgaucauuacgaaaugaaggaggaggaacccaucuccggcaaaaagagcgaggacgaagggauugagaaggaaaaccuggcgauccuggagaaaauccggaagacccaacgccaggaucaccucaauggagcugugucuggcuccguucaggccagcgacagacugaugaaagaacuucgggauauuuaucgcucucaguccuacaagacagggaucuauagcguggagcugauuaacgacucccucuacgacuggcaugucaaacugcaaaagguggauccugacucuccccuucacagcgaucugcagauccucaaggagaaagaaggaauugaguauauccugcugaauuuuuccuucaaggacaacuuuccuuucgaucccccguuuguuagagugguccucccugugcugagcggcggcuacgugcuugggggaggcgcccuguguauggaacuccugaccaaacagggguggucuuccgcuuacagcauugagucugucaucaugcagaucaaugccacgcuuguuaagggaaaagcucgggugcaauucggcgccaacaagaaucaguauaaccuggcgcgcgcccagcaaagcuacaauuccauugugcagauccaugagaaaaacgggugguauacacccccuaaggaagacggauga

SEQ ID NO: 77526 - RNA, 486 nt, Artificial Sequence
  derived and/or modified sequence opt5 from UBE2QL1__Homo_sapiens__NP_001138633
augaaggagcugcaggacaucgccagacucagcgaucgguucauuuccguggaacuggucgacgagucucuuuuugauuggaacguuaaacugcaccaaguggacaaggauagcgugcucuggcaggacaugaaagaaaccaauacagaguucauccugcuuaaccugacguuucccgauaauuucccuuuuuccccgcccuucaugcgcguccucucuccuagacuggaaaacggcuacgugcuggacgggggagcuauuugcauggagcuccugacaccccggggcuggagcuccgccuauaccguugaggcggugaugcgccaguuugcugccucucuugucaaggggcagggaagaaucugucggaaagccggcaagagcaagaaauccuucagccgcaaggaagcugaggccaccuuuaaaucucuggugaagacacaugaaaaauacggguggguuaccccucccguguccgauggauga

SEQ ID NO: 77527 - RNA, 717 nt, Artificial Sequence
  derived and/or modified sequence opt5 from UBE2R2__Homo_sapiens__NP_060281
auggcccagcaacagaugaccagcucccagaaggcucugaugcucgagcugaaaucucuucaggaggaacccguggaaggcuucagaaucacacuggucgacgagagcgaucucuacaacugggaaguugccauuuuugggccuccgaauacgcuguaugagggaggcuacuucaaggcgcacaucaaauuucccauugacuauccuuacucucccccuaccuuccgguuucuuacaaagauguggcaucccaacaucuaugagaauggggaugugugcauuuccauccugcacccuccgguggacgauccccaaagcggagaacucccuuccgagcgcuggaaccccacccagaaugucagaacaauccugcugucugugauuagccuccugaacgaaccuaauaccuucucccccgcuaacguugacgccagcgugauguuucggaaauggcgcgauucuaagggcaaggacaaagaguacgccgagaucauuagaaagcaggucuccgcuacaaaagccgaagcugagaaggauggggugaaaguuccgaccacgcuugccgaauauuguaucaagaccaaggugccuagcaaugacaacucuuccgaucugcucuacgacgaucuguacgacgacgauauugacgaugaggacgaagaggaggaagaugcggacugcuaugaugacgaugacagcggaaaugaggaaucuuga

SEQ ID NO: 77528 - RNA, 669 nt, Artificial Sequence
  derived and/or modified sequence opt5 from UBE2S__Homo_sapiens__NP_055316
augaacagcaauguggagaaccugcccccucacaucauuagacucgucuacaaggaaguuaccacacugacggccgacccgcccgauggcaucaaaguguucccuaaugaggaagaccuuaccgaucuccaggugacaauugaggggcccgaaggaaccccuuaugcuggcgggcuguuucggaugaagcugcuucugggaaaagacuuccccgccuccccuccgaagggcuacuuucucacaaaaaucuuccaucccaacgucggggcgaauggagagauuugcgugaacguucugaagcgcgauuggaccgcugagcugggcaucagacacgugcuccugacaaucaagugucuucugauucauccuaaucccgaaucugcccucaacgaggaagccggccggcugcuucuggagaauuaugaggaauacgcugcccgcgcuagacuccugaccgagauccacgggggagccggcgggccuagcggacgggcggaagccggccgcgcucuggccuccgggacggaggcuucuagcaccgaccccggagccccgggcggcccugggggagcggaaggccccauggccaaaaagcaugcuggggagagagauaaaaagcucgccgcuaaaaagaagacagacaaaaagcgggcccugcgcagacuuuga

SEQ ID NO: 77529 - RNA, 594 nt, Artificial Sequence
  derived and/or modified sequence opt5 from UBE2T__Homo_sapiens__NP_054895
augcagagagccagccggcugaagcgcgagcuccacaugcuggcuaccgaacccccuccgggcaucacaugcuggcaagacaaagaucagauggacgaucuuagagcccagauucucgggggagcgaacacgcccuacgagaagggcguguucaaacucgaagucaucauuccugagcgguaucccuuugaaccuccccagauccgcuuccugaccccuauuuaccauccgaauaucgacuccgcugggagaaucugucuugauguucugaagcugcccccuaaaggagccuggcggcccucucugaacauugccacagugcugaccagcauccaacuccugauguccgagccuaaucccgacgauccgcuuauggcugacauuucuagcgaguuuaaguauaacaagccugccuuccugaaaaaugcucgccaguggacagaaaagcacgccagacagaaacagaaggcggaugaggaagagaugcucgacaaccugcccgaggccggcgauucccgggugcauaauucuacccaaaaacgcaaggcuagccagcuugucgggaucgaaaagaaauuucacccugacguguga

SEQ ID NO: 77530 - RNA, 954 nt, Artificial Sequence
  derived and/or modified sequence opt5 from UBE2U__Homo_sapiens__XP_011539067
augcacggcagagccuaccugcuccugcaucgggacuucugcgaucuuaaggagaacaauuauaaagggaucaccgcuaagcccgugagcgaagacaugauggagugggaagucgagauugaaggacugcagaacuccguuuggcaaggccucguguuucagcugacaauccacuucacgucugaguacaauuaugccccuccgguggucaaauuuauuaccauccccuuccauccuaacguggauccccacacagggcagccuuguauugacuuucuugauaaucccgagaaguggaacaccaauuacacacugagcuccauccuccuggcgcugcagguuaugcucucuaacccugugcuggaaaauccggucaaccuugaggcugcccgcauccuggugaaagacgaaagccucuauagaaccauucugcggcuuuucaaucgcccccugcaaaugaaggaugacucccaggagcucccuaaggaucccagaaaaugcauccggccuauuaagacaaccucuuuuagcgacuacuaucagacguggucccgcaucgccaccagcaaagcuacagaguacuacagaacaccccugcugaagguuccgaacuucauuggacaguauuacaaauggaagaagauggaucuccaacaucagaaagaauggaaucugaaguauucugugaucaaauguuggcuugcccggaagcgcaugccucacgaggucacccacuccauggaagagauuaaacugugccccacccucaacgaaaucuuucuggagagcccuacggcuaucaauucuauuacagacaucuacgagaccgaagaggaaggcuggaaguccgauacaagccuuuaugagaacgacaccgacgaacccagagaggaggaaguggaggaucugauuucuuggaccaacacacucaauacgaacaccuccgaagacuga

SEQ ID NO: 77531 - RNA, 444 nt, Artificial Sequence
  derived and/or modified sequence opt5 from UBE2V1__Homo_sapiens__NP_001027459
auggccgcuaccacaggcagcggggugaagguccccagaaacuuccggcugcucgaggaacuggaggaaggacagaaaggcguuggggacggaacgguguccuggggccuugaggaugacgaagauaugacccugacacgcuggaccgggaugaucauuggaccuccgagaacaaucuacgagaaucggauuuauucucucaagaucgagugcggccccaaauacccugaagcgcccccuuuugugcgcuucgucaccaagauuaacaugaauggcgugaacagcuccaaugggguuguggaccccagagccaucucuguccuggcuaaauggcaaaacagcuauuccaucaaggugguucuucaggagcugcggcgccucaugaugucuaaggaaaauaugaaacugccucagccgcccgagggacaguguuacagcaacuga

SEQ ID NO: 77532 - RNA, 438 nt, Artificial Sequence
  derived and/or modified sequence opt5 from UBE2V2__Homo_sapiens__NP_003341
auggccgugagcaccggcgucaagguucccagaaacuuccggcugcucgaggaacuggaggaagggcagaaaggagugggcgacgggacaguguccuggggacuugaggaugacgaagauaugacgcugacccgcuggacaggcaugaucauugggccuccgagaaccaauuacgagaaccggaucuauucucucaaggucgagugcggacccaaauacccugaagcucccccuagcgugcgcuuuguuacaaagauuaauaugaacggcaucaauaacuccucuggcaugguggacgccagaagcauucccguccuggcgaaauggcaaaauuccuauucuaucaaggugguucuucaggagcugcggcgccucaugaugagcaaggaaaacaugaaacugccucagccgcccgaggggcagaccuacaauaacuga

SEQ ID NO: 77533 - RNA, 1065 nt, Artificial Sequence
  derived and/or modified sequence opt5 from UBE2Z__Homo_sapiens__NP_075567
auggccgagagccccaccgaagaggcugccacagcgggcgcuggggccgccggaccuggcgcuuccucuguggccggggucguuggagugagcggcuccgggggaggcuucggcccgcccuuucugccugacgugugggcugccgcggccgcugccgggggagcuggcgggcccggaucuggccucgccccucugcccgggcuuccuccgagcgcggccgcucacggagccgcucugcucucccauugggaucccacgcugucuagcgacugggauggcgaaagaaccgccccucagugccuucugcggaucaagcgcgacauuauguccaucuacaaagagcccccucccggcauguucgucgugccggauacaguugacaugaccaagauucacgcccucaucacagggccuuuugauacccccuaugaaggaggcuucuuucuguucguguuuagauguccucccgacuaccccauucauccuccgcgggucaaacugaugacaaccgggaacaauacggugcgcuucaaccccaauuuuuauagaaacggaaagguuugccucagcauccugggcaccuggacagggccugcuuggucucccgcgcaauccaucagcucugugcuuauuuccauccagagccugaugaccgagaauccuuaccacaacgagcccggauucgaacaggagcggcauccgggcgauucuaaaaauuauaacgaauguauucgccacgagacaaucagagucgccgugugcgacaugauggagggcaaguguccuugccccgaaccucuccgcggggugauggagaaguccuuucuggaauacuaugauuucuacgaggucgcuuguaaagaccggcuucaucugcagggacaaaccaugcaggaucccuuuggcgaaaagagagggcacuucgacuaccagagccuccugaugcggcugggacucauucgccagaaaguucuggagagacuucacaaugagaacgccgaaauggacuccgauucuagcuccagcggcacggagacagaccugcaugggucucuccggguguga

SEQ ID NO: 77534 - RNA, 2559 nt, Artificial Sequence
  derived and/or modified sequence opt5 from UBE3A__Homo_sapiens__XP_005268328
augaagagagccgcugccaaacaccugaucgagcgguacuaucaucagcucaccgaaggcugcgggaacgaggcguguacaaaugaauuuugcgcuagcugucccacguuucugcgcauggacaacaaugccgccgcuauuaaggcccuugagcuguacaaaaucaacgcuaagcucugcgauccucacccguccaaaaagggagccucuagcgcguaucuggaaaauuccaagggcgcccccaacaauucuuguagcgagauuaaaaugaacaagaaaggggcuagaaucgacuucaaggaugugaccuaccuuacagaggaaaaagucuaugagauucuggaacucugccgggagcgcgaggacuacuccccucugaucagaguuaucggacggguguuuucuagcgccgaagcucuggugcaauccuuccgcaaggucaagcagcauaccaaagaggaacucaagagccugcaggccaaagaugaggacaaggaugaagacgagaaagagaaggcggccuguucugcugccgcuauggaagaggauuccgaagccucuagcuccagaauuggcgacagcucucagggggauaauaaccuucaaaaacugggacccgacgauguguccguugacaucgacgccauucggcgcguguauacaagacuccugagcaaugagaagaucgaaaccgcuuuucuuaacgcgcuggucuaccucuccccuaauguggagugcgaucugacauaccacaacguuuauucucgggaccccaauuaccugaaccucuucauuaucgugauggagaaccgcaaucugcauagcccugaauaucuugagauggcccugccgcucuuuuguaaggcuauguccaaacugccccuugccgcccagggcaagcugauuagacucuggagcaaauacaacgcugaucagauccggcgcaugauggaaaccuuccagcaacugaucacguauaaggucauuucuaaugaguuuaacuccagaaaucuggugaacgacgaugacgccaucguggcggcuagcaaaugccucaagauggucuacuaugccaauguugugggcggggaaguggauaccaaccacaaugaggaggacgaugaagaaccuauucccgaaucuagcgagcugacacuucaggagcugcucggagaggagcggagaaacaagaaaggcccucgcgucgacccccuggaaaccgagcuuggggugaagacacuggauugucggaaaccgcucaucccuuucgaagaguuuauuaaugagccccugaacgaaguucuggagauggacaaggacuacaccuucuuuaaaguggaaacggagaauaaguucuccuucaugacaugcccuuuuauccucaacgccgucaccaagaaucugggacuuuacuaugauaacagaauccgcauguacucugaacggagaauuacagugcuguauagccucguucagggccagcaacugaaccccuaccugcgccuuaaagugcggagagaccacaucauugaugacgcucucguccgccuggagaugaucgccauggagaaucccgcugaucugaagaaacagcucuauguggaguucgaaggggaacagggagucgacgagggcggcguguccaaggaauuuuuccaacugguuguggaggagauuuuuaacccugauaucgggauguucaccuacgacgaaagcaccaaacuuuucugguucaauccgucuuccuuugagacagaaggacaguucacgcugaucggcauuguccucgggcuggccaucuauaacaauugcauucuggaugugcauuuucccaugguuguguaccggaaacuuaugggaaagaagggcaccuucagagaccucggggauagccacccuguccuguaccagucucugaaggaccuccuggaguaugagggaaacguggaagaugacaugaugaucacauuucagauuucccaaaccgaccuuuucggcaaucccaugauguacgaucugaaagagaacggcgacaagaucccuauuacaaaugaaaaccgcaaagaguucgugaaucucuauagcgauuacauccugaacaaguccguugaaaaacaguuuaaggcguuccggagaggguuucauauggucaccaaugagucuccccugaaguaucuuuuccggccggaggaaaucgagcuccugauuuguggaagccgcaaccuggacuuucaggcccucgaagagacgacagaauacgauggcggguauaccagagacuccgugcugauccgggaguucugggagauugugcacucuuuuaccgaugaacagaaaagacuuuuccugcaauuuacaaccggaacagaccgcgcuccugucggcgggcucggcaagcugaaaaugaucauugccaagaauggacccgauacggagcggcugccuaccagccacacaugcuucaacgugcuucuccugcccgaauacuccagcaaagagaagcugaaggaaagacuccugaaagcuaucaccuacgccaagggcuuugggaugcuuuga

SEQ ID NO: 77535 - RNA, 735 nt, Artificial Sequence
  derived and/or modified sequence opt5 from UBE3B__Homo_sapiens__NP_001257380
auguucacccugagccagacauccagagccugguuuaucgaccgggcucgccaagccagagaggaacggcucgugcagaaggagcgcgaaagagcggcugucguuauucaggcccacgugcggucuuuccugugccgcagcagacuucagcgggauauccgcagagagauugacgacuuuuucaaagccgaugaucccgaauccacgaagcggucugcucuguguaucuuuaaaauugcccgcaagcuccuguuccuuuuuagaaucaaagaggacaacgagcgguucgaaaagcugugccgcagcauccucuccucuauggaugcugagaaugaaccuaaggugugguacgucagccuggccuguuccaaagaccugacccuccuguggauucaacagaucaagaacauucuuugguauugcugugauuuucugaaacagcucaagccggagauccugcaggacagcagacuuauuacacuguaccucaccaugcuggugacauucaccgauacaucuaccuggaaaauccugcggggcaagggggagucccucagacccgcgaugaaucauauuugcgccaacaucaugggacaccugaaucaacauggcuuuuauagcguucuucaguguugcgacgggcuguucccugaucucgugucuuacgcuccccacaacaauccuguccgcugguccgugggacggagcugguaugacuggcagcugucuagauga

SEQ ID NO: 77536 - RNA, 3252 nt, Artificial Sequence
  derived and/or modified sequence opt5 from UBE3C__Homo_sapiens__NP_055486
auguucagcuuugagggcgacuucaagaccagacccaaagugucccucgggggagccucucggaaggaagagaaagcuagccuccugcaccgcacacaggaagagagacggaagcgcgaagaggagagacggcgccuuaaaaacgccaucauuauccaauccuuuauuagaggcuaccgggaucgcaagcagcaguauucuauccagagaagcgcguucgaccggugcgcuacgcugucccaaucugggggagccuuuccuauugccaauggcccgaaccucacccugcuuguccgccagcugcuguucuuuuacaagcagaaugaagauagcaaaagacugaucuggcuguaucagaaccucaucaagcauuccagccuguucguuaaacaacuugacgggucugagcggcugacaugucucuuucagauuaagcgccugaugucccuuugcuguagacugcuccagaauugcaacgaugacagccugaauguggcucugcccaugcggaugcucgaaguguucucuuccgagaacaccuaccugccuguccuucaggaugccagcuaugugguuucugugaucgagcaaauucugcacuacaugauccauaauggauauuacagaucccucuaccugcuuauuaacagcaaacugcccuccucuaucgaauauagcgaccucucccgcgucccuauugcuaagauccugcuggagaaugugcucaagccccugcacuuuacauacaacagcuguccugaaggcgcccggcagcagguuuucaccgcguuuacagaggaguuccuugccgcuccguucaccgaucaaaucuuucauuucauuauccccgcccuggcugacgcccagacgguguuuccuuaugagcccuuccucaaugcgcugcuucugauugagucuagaugcucccgcaaaagcggcggggccccuuggcucuuuuacuucguccugaccgugggagaaaacuaucugggcgcucucucugaggaagggcugcuuguguaccugcggguccuccagacauuucugagccagcugcccguuuccccggccucugcuagcugucacgauuccgccagcgacucugaggaagaguccgaggaagccgauaagccuagcucucccgaggacggaagacuuuccgugagcuauaucaccgaagagugccucaaaaagcuggacacaaaacaacagaccaauacgcugcucaaccugguguggcgcgauuccgcuucugaagaggucuucacaaccauggcgagcgugugucacacacuuaugguucagcaucggaugauggugccuaaggucagacugcucuacucccuggccuuuaacgcucgcuuccugcggcaccuuugguuucucauuucuagcauguccaccagaaugaucaccggcagcauggugccccugcugcagguuaucucucgcgggucccccaugagcuucgaggacucuucccggauuaucccucucuuuuaccuguucagcucucuuuucagccauucccugauuagcauccacgauaaugaauuuuucggagacccgauugagguggucggccaaagacagucuuccaugaugcccuuuacacucgaagaacugaucaugcugagccggugccuucgcgaugccugucucggcaucauuaaacuggccuauccugagacgaagcccgaagugagagaggaauacaucaccgcuuuccaguccauuggggucacaaccucuagcgagaugcagcaaugcauccagauggaacagaagcgguggauucagcuguuuaaagugaucacaaaccucguuaagaugcugaaauccagagacacccgccggaauuucugcccucccaaccacuggcuuucugagcaagaggauauuaaggccgacaaagugacgcagcuguaugucccggcgagcagacauguguggcgcuuuagacggaugggacgcaucggcccucuccaguccacacuggauguugggcuggaaucucccccucuuagcguguccgaggaaagacaacucgcuguccugaccgagcugcccuucguggugccuuuugaggaacggguuaagaucuuccagcgccucauuuacgccgacaagcaggagguccagggagauggccccuuucuggacgggaucaaugugaccauuagacggaacuauaucuacgaagacgccuaugauaaacuuagcccggagaaugaaccugaccugaagaaacgcauuagagugcaccuccugaacgcucauggacuggaugaggccggcaucgacggcgggggaaucuuccgggaauuucuuaaugagcugcucaagucuggcuucaaccccaaucaaggguucuuuaaaacaaccaacgagggacugcucuaccccaauccugcugcccagaugcuggucggcgauuccuucgcgcgccacuacuauuuucuugggagaaugcugggcaaggcccucuacgaaaacaugcugguggagcugccguucgcuggauuuuuccuuagcaagcugcucggcacaucugccgacguugauauucaucaccuggcuucccucgaccccgaaguguauaaaaaucugcuuuuucucaagagcuacgaggaugacgucgaggaacuggggcugaacuucacggugguuaacaaugaucugggagaggcccagguggucgaacuuaaauuuggcgggaaggacaucccugugaccucugcgaaccggauugccuauauccaccugguugcugauuacagacucaaucgccagauucggcaacauugucuggccuucagacagggacucgcuaacguggucucccuggaguggcuucgcauguuugaccagcaggaaauccaagugcugaucagcggcgcccaggugcccauuucccuggaggaccucaagagcuucacaaauuauucugggggcuacagcgccgaucacccugucaucaaaguuuucuggcgggugguggagggauuuaccgacgaagagaagagaaaacugcuuaaguucgucacauccugcucucggcccccucugcucggcuuuaaagaacuguaccccgcuuucuguauucauaacgggggaagcgaucucgagcgccugccgaccgcguccacgugcaugaaucuucugaagcugccugaauuuuaugacgagacccuccugagaucuaaacuucuguacgccaucgagugugcugccggcuucgaacucagcuga

SEQ ID NO: 77537 - RNA, 3201 nt, Artificial Sequence
  derived and/or modified sequence opt5 from UBE4A__Homo_sapiens__NP_001191006
augaccgaccaggagaacaauaacaauaucagcuccaaccccuucgccgcucuguuuggcucucucgccgaugcgaagcaauucgcugccauucagaaagaacagcugaagcagcaaagcgacgagcuuccugccuccccggaugacucugauaauagcguguccgaaucucuggacgaguuugauuacagcgucgcugaaaucucccggagcuucagaucucagcaggagauuugcgagcagcucaacaucaaucacaugauucaacgcaucuuucugaucacacuugacaacuccgaucccagccugaaaucugggaauggcauuccuuccagauguguuuaucucgaagagauggccguggaacuggaggaccaggauuggcuggacaugagcaacguggagcaggcucucuucgcccggcugcuucugcaggaucccggaaaucaccucaucaacaugacgucuuccaccacacugaaucuuagcgcggaccgcgacgccggggaaagacacauuuucugcuaccuguauuccuguuuccaacgggcuaaggaggaaaucaccaaagucccugagaaccuccugcccuuugccgugcagugccgcaaucugacaguuucuaacaccagaacagugcuccugaccccugaaauuuacgucgaucagaacauccaugagcaacuuguggaccugaugcucgaggcuauucagggagcccacuucgaagauguuacggaguuucuggaagaggugaucgaagcgcuuauccuggacgaggagguccggaccuucccggaagugaugauucccguguuugauauccuccugggccgcauuaaggaccuggagcucugucagauccugcuuuaugccuaccuggauauucuccuguauuucacaagacagaaggacauggcuaaagucuucguugaauacauccaaccuaaggaucccaccaaugggcagauguaccagaaaacacuucugggagugauccucagcauuuccugccugcugaagaccccuggcguggucgagaaccauggcuauuuucucaaucccagccggucuuccccgcaggaaaucaaagugcaagaggccaacauucaccaguucauggcucaguuucacgagaagaucuaccagaugcugaagaaucuucugcaacucagcccugaaacgaaacauuguauucugucuuggcuggggaacugccuucacgccaaugccggacgcacaaagaucugggcuaaccagaugcccgagaucuucuuucagauguaugcgagcgacgccuucuuucucaaucugggcgcugcccugcucaaacugugucagccuuucugcaagcccagauccucucggcuucugaccuuuaaccccacauacugugcccucaaagaacugaaugaugaggagcgcaagauuaaaaacguucauaugagagggcuggacaaggaaaccugccuuaucccugcugugcaagagccgaaguucccccagaauuauaaccucgucaccgaaaaucuggcccugacagaguacacgcucuaucugggauuucaccggcuucacgaccagauggugaaaauuaaccaaaaccugcauagacuccagguugcguggcgcgaugcucagcagagcuccagcccugccgccgacaaucugcgggaacaauucgagagacugaugaccaucuaccuuucuacaaagaccgcuaugacagagccccagaugcuccagaacugccugaaucuucagguguccauggccguccuccuggugcaacuugcuauuggcaacgaagggagccagccuaucgagcugaccuuuccccucccggauggauacucuucccuggccuaugucccugaauuuuucgcggacaaucugggcgauuuucuuauuuuccuccgccgguuugccgacgauauccuggagacgagcgcugacucccuggaacacgugcuccauuucaucacaauuuuuaccggcucuaucgagagaaugaaaaacccccaucugcgcgccaagcuggcugagguucuggaagccgugaugccucaccucgaucagacccccaauccucuggucagcuccguguuccaccggaaaagaguuuucuguaacuuccaguacgcgccccaacuggccgaggcucuuauuaagguguuugucgacaucgaauuuacaggggauccgcaccaguuugagcagaaguucaauuaucgccggccuauguaccccauucugagauauauguggggaaccgacacauaccgcgaaucuaucaaagaucucgccgacuaugcuagcaagaaccuggaggccaugaaucccccucucuuucugcgguuccuuaaccugcucaugaaugacgccaucuuccugcuggaugaggcuauucaauaccuuuccaaaaucaagauucagcagaucgaaaaagacagaggcgagugggauagccugacgccggaagcgcggcgcgagaaggaggccgggcuccagauguuuggacaacuggcuagauuccauaacauuaugucuaaugaaaccaucggcacacucgccuuucugaccuccgagaucaagagccuuuucgugcaccccuuucuggccgaacggauuaucucuaugcucaacuacuuccugcagcaucugguggggccuaaaaugggagcucuuaagguuaaagacuuuuccgaguucgauuuuaagccccagcagcuggucagcgacauuugcacaaucuaucucaaccugggcgaugaagagaauuucugugccaccgugccuaaagacggcagaucuuacagccccacgcucuuugcgcaaaccgugcgcguccugaagaagauuaacaaaccugggaauaugaucauggcuuucuccaaccuugccgagcggaucaagagccuggccgaucugcagcagcaggaagaggaaacauaugcugacgccugcgaugaguuccucgaccccauuaugucuacccugaugugugauccggugguucuuccuuccagcagagugacagucgaccgcuccaccaucgcgagacaucugcucucugaccaaacggaucccuuuaaucggagcccucugacaauggaccagauucgccccaacaccgaacucaaagagaagauccagagauggcuggcugagcggaaacagcaaaaggaacagcuugaguga

SEQ ID NO: 77538 - RNA, 3519 nt, Artificial Sequence
  derived and/or modified sequence opt5 from UBE4B__Homo_sapiens__XP_011538792
auggaggaacugagcgccgacgagaucagacggcgcagacucgcucggcuggccggcgggcagaccucccaacccacaacgccucuuaccucuccgcagcgcgaaaaucccccuggacccccuauugcggcuagcgcccccggcccuucccagucucuggggcucaacgugcacaacaugacaccggccaccagccccaucggagcuuccggcgucgcccauagaucucagagcuccgaggggguuagcucucuguccagcucuccuuccaauagccuugaaacacaaucucagucccugagccggucccagucuauggauauugacggagugagcugcgagaaguccaugagccagguggaugucgacucuggcaucgagaacauggaaguggaugagaaugaccgcagagaaaaacggucccucagcgauaaggagcccucuagcggcccugagguuuccgaagaacaagcucugcagcugguguguaaaauuuuccgcgucucuuggaaggacagagaucgggacgugaucuuucucagcucccugagcgcccaguucaaacagaaccccaaggaaguuuuuagcgauuucaaggaccuuaucgggcaaauucugauggaggugcucaugauguccacccagacacgcgaugaaaauccguuugcgagccugaccgccacgucucagccuaucgcugccgcugccagaucccccgaccggaaccuucugcucaauaccggaagcaacccuggcacaucccccauguucugcucugucgcgagcuuuggggccuccucucugagcucccuguacgagagcucucccgcuccuaccccguccuucuggagcucugugcccgugaugggaccuucccucgccagccccucucgcgcugccagccaacuggccgucccuuccacaccccuuagcccgcacucugcugcguccggcaccgccgcugggagccagccuuccucucccagauaucggccuuacacgguuacacaucccugggccagcuccggagugucuauucugagcuccucuccuucucccccggcccucgcuuccagcccucaggccgugcccgcgucuuccagcagacagcgccccucuuccaccggcccuccgcugcccccugcuagccccucugccacaucccggagaccuagcucccuucgcaucagccccucuauguaugacaauccuuuuagcuuccuguuucucgcccuguccggcgauucuagcgacgaggaagaugaggaagaggacgaugacgauggggacggagaugacgaaggcgggggaggcggggaugacuucuccuguguccaauuuggaucuagccugggcgcuuccggcggggccucuaacugggacagcuacuccgaucacuucaccauugagaccugcaaagagacagacaugcucaauuaucugaucgaauguuucgaucgggugggaauugaggaaaagaaagcucccaagaugugcagccagccggccguuucucagcuucuguccaacaucagaagccaguguaucucucauacggcgcucgugcugcaaggcucccuuacccagccucgcagccugcagcagcccuccuuucucgucccuuacaugcugugccggaaucugcccuauggguucauucaagagcucgugagaacaacccaccaggacgaagagguuuuuaaacagaucuucauuccgauccugcagggacuugcccuggcugccaaggaguguucucucgauagcgacuacuuuaaguacccucugauggcucugggcgaacuuugcgagacaaaauucgggaagacccaccccguguguaaccucgucgccucccugcgccuguggcucccuaaaagccugucucccggcugcggacgggaacuucaaagacuguccuaucucggcgcguuuuucagcuuuucuguguucgccgaggaugacgucaaggugguugagaaauacuuuagcgggcccgcuauuacgcuggaaaacacacgcguggucucccagucucugcagcauuaucuugagcucggacggcaagaacuguucaagauccugcacagcauccuccugaauggcgagaccagagaagccgcucuuuccuacauggccgccgugguuaacgcuaauaugaaaaaggcgcagaugcagaccgaugaccggcuggugucuacagauggguuuaugcucaacuuccuguggguccugcagcaacuuagcaccaagauuaaacucgagacaguggacccuacguauaucuuccauccgcgcugcagaauuacccugcccaaugaugagacacgggugaacgccaccauggaagacguuaaugacuggcugacagagcucuacggagaucagccucccuuuuccgaaccuaaguuccccaccgaguguuucuuccugacgcuucacgcucaccaucugagcauccucccuucuugcagacgcuauauucggagacugcgcgccaucagagaacugaaccggaccgucgaggaccuuaaaaauaacgagucccaguggaaggauagcccgcucgccacacgccacagagaaaugcugaaacgguguaagacccagcugaagaaacucgugcgcugcaaggcuugugccgacgcgggccugcuugaugaguccuuucugagacggugccucaauuucuacgggcugcugauccaacuucugcuccgcauucuggaccccgcuuacccugauaucacacucccccugaacucugacgugccuaaagucuuugccgcccuucccgaauuuuauguggaggauguugcugaauuucuguucuuuauugugcaguacagcccgcaggcccucuaugagccuuguacccaggacaucgucauguuccuggugguuaugcugugcaaucaaaacuacauuagaaaucccuaucuuguggcgaagcuggucgaggugauguuuaugacgaaccccgcuguucagccucggacacagaaauucuucgaaaugaucgagaaccauccccucuccaccaagcugcucgugccuucucugaugaaguuuuacacagaugucgaacacaccggcgccaccagcgaguucuaugacaaauuuacaauucgcuaccauaucuccacgaucuucaagagccuuuggcaaaauauugcccaccacggaaccuuuauggaggaguucaacucuggcaaacaguuugugagauacaucaauaugcugauuaacgauacaaccuuccuccuggacgagucccuggaaagccuuaagcggauccaugaggugcaggaagagaugaaaaauaaggagcagugggaccaacugccgagagaucagcagcaggcucgccaaucucagcucgcccaggacgaacgggucuccagaagcuaucuggcucucgccacagagaccguugauauguuucacauucugacgaaacaggugcaaaagcccuuccuucgcccucaugaacugucuuacuaucccgugaucagcuga

SEQ ID NO: 77539 - RNA, 540 nt, Artificial Sequence
  derived and/or modified sequence opt5 from UBIAD1__Homo_sapiens__XP_011539606
auggccgcuagccaggugcugggcgagaagaucaacauucucuccggggaaaccgucaaagccggagacagagauccccugggcaaugacugcccugagcaagaucggcuuccgcagcgcucuuggagacagaagugugcgagcuacguucuggcucuccggcccugguccuucucugccagccugacaccuguggcccuuggguccgcucuggccuaucgcucucacggagugcucgaccccagacugcuggucggcugcgcuguggccguucucgcggugcauggggccggaaaccuggucaauacguacuaugauuuuagcaaaggcaucgaccacaagaaauccgaugaccggacccuuguggaucgcauucuggaaccucaggacguugugagauucggcgucuuucucuacacacuggggugugugugcgcugccugucuuuauuaccugagcccccucaagcuggagcaucuggcucucaucuauuucggaggccugucuggguccuuucuuuacaccggagugcugauuuga

SEQ ID NO: 77540 - RNA, 354 nt, Artificial Sequence
  derived and/or modified sequence opt5 from UBL3__Homo_sapiens__NP_009037
augagcuccaacgugcccgccgacaugaucaaucugagacucauucuggucucuggcaagaccaaagaguuccuuuuuagcccuaacgauuccgcuucugacaucgccaagcacguuuacgauaauuggccgauggacugggaagaggaacaggugagcucccccaacauucugcggcucaucuaucaagggcgcuuccugcauggaaaugugacacuuggcgcgcugaaacucccuuuugggaagacgaccgucaugcaccugguggcuagagagacacugcccgaaccuaacucucagggacagcggaaucgcgagaaaaccggcgagagcaacugcuguguuauucucuga

SEQ ID NO: 77541 - RNA, 474 nt, Artificial Sequence
  derived and/or modified sequence opt5 from UBL4A__Homo_sapiens__NP_055050
augcagcugaccgugaaggcccuccaaggcagagagugcagccugcagguccccgaagacgagcuuguuuccacacugaaacagcucgugucugaaaagcugaacgugccuguccggcagcaacgccuucuguucaaagggaaggcucucgccgauggaaaaagacugagcgacuacuccaucggccccaauucuaagcugaaccucgugguuaagccgcuggagaaagugcuucuggaagagggggaggcgcagcggcucgcugauagcccucccccucaggucuggcagcugauuuccaaggugcuugcccgccacuuuucugccgcugacgccagcagaguucuggaacaacuccagcgggauuaugagcgcucccugagcagacugacgcucgacgauaucgaacggcuggcuucucgcuuccuucaucccgaggugaccgagacaauggaaaaaggauuuuccaaguga

SEQ ID NO: 77542 - RNA, 222 nt, Artificial Sequence
  derived and/or modified sequence opt5 from UBL5__Homo_sapiens__NP_001041706
augaucgagguggucugcaacgacagacugggcaagaaaguucgggugaaguguaauaccgaugacacaauuggggaucucaaaaagcugaucgccgcucagacgggaacccgcuggaacaaaauugugcuuaagaagugguacacaaucuucaaagaccacgucagccugggcgauuaugaaauucaugacgggaugaaucucgagcuguacuaucaauga

SEQ ID NO: 77543 - RNA, 1143 nt, Artificial Sequence
  derived and/or modified sequence opt5 from UBL7__Homo_sapiens__NP_001273669
augagccuguccgacuggcaccucgccgugaagcuggcugaucagccccuuaccccuaaaucuauccugagacucccggagacagaacugggcgaguacagccuugggggauauuccauuucuuuccugaagcaacucaucgccggcaaacugcaggaaagcguccccgacccugagcugauugaucucaucuacugcgggcggaagcugaaagacgaucagacgcuugacuuuuauggcauucagcccggauccaccguucaugugcugcgcaagucuuggccugaacccgaucaaaagccugagccgguggacaaagucgcggcuaugagagaguuccgggugcuccacacagcccugcauagcuccagcucuuaccgcgaagccguuuuuaagaugcuuuccaacaaagagagccuggaucagaucaucguggcuacccccgggcucucuuccgacccuauugcccugggaguccugcaggauaaggaccucuucagcguguuugcugaucccaauaugcuggacacacuuguuccugcccaccccgcgcuggugaacgccaucguccucgugcugcauucuguggcuggcuccgccccgaugccuggcaccgacagcuccucuagaagcaugcccuccagcucuuaucgggauaugccugggggauuccuuuuugaaggccuguccgacgaugaggacgauuuccaccccaauacacgcagcacccccucuagcuccacgccuucuagcagaccggcuucccucggguacagcggagccgcgggcccccggccuauuacccagucugagcuggccacagcucuggcccucgcuuccacccccgaauccucuucccacacaccuacccccgggacgcaaggacauagcuccggcacaucuccgaugagcuccggcguccagucugggaccccuaucacaaacgaccuguuuagccaggcccuucagcacgcccugcaagcuagcggacagcccagccuccagucucaauggcagccucagcugcagcaacuucgcgauaugggcauucaggacgaugagcugucccucagagcgcugcaggccaccgggggagacauccaggcugcccuggaacucauuuucgccggcggggcucccuga

SEQ ID NO: 77544 - RNA, 957 nt, Artificial Sequence
  derived and/or modified sequence opt5 from UBLCP1__Homo_sapiens__NP_659486
auggcccugcccaucauugugaaguggggcgggcaggaguacagcgucaccacacucuccgaagacgauacgguucuggaccuuaaacaauuccugaagacccucacaggagugcugccugagagacagaaacuucugggccucaaggugaaagggaagccggcugaaaacgaugucaagcugggagcccugaaacucaagcccaauaccaaaaucaugaugaugggcacacgggaggaaucucuggaggacgugcuugggccucccccugauaacgacgauguugugaaugacuuugauauugaggacgaagucguggagguugaaaaccgcgaggagaaucugcucaagaucagcagacgggugaaagaauauaaggucgagauucugaaucccccucgcgaaggaaagaaacuucuggugcucgauguggacuacacccuguucgaucacagauccugcgcggagacaggcgucgaacugaugcggccguaucuccaugaguuucugaccucugcuuacgaggacuaugacaucguuaucuggagcgccacgaacaugaaguggauugaagccaaaaugaaggagcuuggcguguccaccaacgcuaauuacaaaaucacauucaugcuggauucugccgcuaugauuaccgugcacacaccccgcagagggcucaucgacgucaagccucugggagugauuuggggcaaauuuagcgaguucuauuccaagaagaacaccaucauguuugaugacauugggcggaauuuccuuaugaacccccagaauggacugaaaauccgcccuuuuaugaaggcccaucucaacagagauaaagacaaggaacugcugaaacucacgcaguaccugaaggaaaucgcgaaacuugaugacuuccuggaucucaaucacaaguacugggagcgguaucugagcaagaaacaaggccaguga

SEQ ID NO: 77545 - RNA, 3405 nt, Artificial Sequence
  derived and/or modified sequence opt5 from UBN1__Homo_sapiens__NP_001072982
augagcgagccccacagagugcaguucaccucccugccuggcucucucaacccggccuuucugaagaaaagccggaaggaagaggcuggggccggagaacaacaucaggacugcgagcccgcggcugccgccguccgcaucacacuuacgcuguucgaaccugaucacaaaagaugucccgaguuuuucuacccugagcucguuaagaauauucggggcaaagugaaggggcugcagcccggagacaagaaaaaggaucuuuccgacccuuuuaacgaugaagagaaagaacgccauaagguggaggcucuggccagaaaauucgaggaaaaguauggcgggaagaaacggcgcaaggacagaauccaggaucucauugacaugggauacggcuaugaugagucugacagcuuuaucgauaauuccgaggcuuacgacgaacuggucccggccucucugaccacaaaauauggcggguucuacauuaacagcggaacccuccaauuucggcaggcguccgaaagcgaggaugacuucaucaaggagaaaaagaaaaagucucccaagaaacgcaagcugaaagaaggcggggagaagaucaaaaagaagaaaaaggacgauacauaugacaaagaaaagaaauccaaaaagagcaaguuuucuaaggccggauucaccgcucuuaaugccuccaaagagaagaaaaagaagaaauacagcggcgcucugucugugaaggaaaugcucaaaaaguuucagaaagagaaggaggcccagaaaaagagagaagaggaacacaagccuguugcggugcccuccgccgaggcucaagggcugcgggaacuugagggagccagcgauccucugcucucccuguucggcucuacaagcgacaacgaucugcuccaggcugccaccgccauggacucccugacggaucuugaccuggagcaucuccugagcgaaucucccgagggcuccccguuccgcgauauggacgaugggagcgacucucuuggagucggccuggaccaggaauuuagacagccuagcucccuccccgaggggcugccugcuccccuggagaaacgggugaaggaacucgcgcaagccgcucgcgccgccgagggagaaucuagacagaaauucuuuacccaggauauuaauggcauccugcuugacauugaggcucaaacacgggaacugagcucccagguuagaagcgggguguacgccuaucucgcgucuuuccugcccugcuccaaggaugcccuucugaaacgcgcccggaagcuccaccuguacgagcagggaggcagacugaaggagccucuccagaaacugaaggaagccaucggccgcgcuaugccggagcaaauggccaaauaucaggacgaaugucaggcucacacccaggccaaggucgcgaaaaugcuugaggaagagaaggauaaggagcaacgggacagaauuugcagcgaugaagaggaagacgaggaaaaagggggacgccggaucaugggccccagaaagaaauuucaguggaacgaugagauucgcgagcugcucugucagguggugaagaucaaacuggaaucucaggaccuggagcggaauaacaaggcccaggcuugggaagauugcgucaagggguuccuugacgccgagguuaaaccucucuggcccaagggauggaugcaagcuagaacacuguuuaaagagucccgccggggccaugggcaccugaccagcauccucgccaagaaaaaggugauggcgccuuccaaaauuaaggugaaggaaucuagcacgaaacccgauaagaaagucuccgugccgucuggccagaucggaggcccuauugcccugcccagcgaccaucagacagggggacuuuccaucggcgcuagcucuagagagcugccuucccaagccagcgggggacucgcuaaucccccucccguuaaccuggaagacucucuggaugaggaccuuauucggaauccggccuccagcguggaagccgucucuaaggagcucgcugcgcugaacagccgcgccgcuggcaauuccgaguucacccugccugcccccagcaaagcccccgcugaaaagguugggggcgugcucuguacagaggaaaagagaaacuuugccaaaccuucuccguccgcgcccccucccgcuagcucccugcagucuccucuuaacuuccuggccgagcaggcccucgcucugggacaaagcucccaggaaaagaaacccgagucuagcggcuacaaggagcuguccugccaggccccucuuaauaaagggcuccccgaagugcaccagucuaaggcgaagcaccauagccugccgcggaccucccacggaccucaagucgcugugcccgucccuggcccccaggugaaaguuuuucaugccgggacccagcagcaaaagaacuucacaccgccuagccccuuugccaauaaacugcagggaccuaaggcuucucccacgcagugucacagaucccuccugcagcuugugaaaaccgccgcuaagggccaaggguuccaucccagcgccccugcgacaucuggcggacuguccgccagcagcuccagcucccacaagaccccggcuagcucuagcuccgcccucucucaccccgcuaaaccucauagcgucuccucugccggcagcuccuauaagaacaaucccuucgccucuagcaucuccaaacacggggugagcucuggauccucuucuuccggcgggacaccuguucagagcuccgugucuggaagccugguccccggcauccagccuccguccguggggcaagcuaccagccgccccgugccuucuuccgcgggcaagaaaaugcccguuagccagaagcugacgcuugucgccccucccggaggcccgaacggggauucuagcggaggcacacaggggguggcuaagcuccugaccuccccuucucugaaacccagcgccguguccucugucaccagcuccacaagccucucuaagggagccuccggcaccgugcugcuugcuggcagcucccugauggccucucccuacaaaagcuccucuccuaagcucagcggggcgauguccagcaauucucugggaauuaucacacccguuccuauuccggugcauguccuguccuuuagcgcugacucuuccgccaaagccggcgugagcaaggaugcuaucguuacggggcccgccccuggaucuuuccaccacggccuugggcauagccugcucgcgggacugcacuccucucccccucaugcugcuccccucccgcacgccgcugugccuacccauauuccccagagccugccuggcgccucccaacuucacggcaaagggcccgcugucccucggaagcuguga

SEQ ID NO: 77546 - RNA, 1539 nt, Artificial Sequence
  derived and/or modified sequence opt5 from UBOX5__Homo_sapiens__NP_001254513
auggugaucaaccugugccucccccaguuccgcccucggauucacuguaauaagaucagcgccgacggcuacgaggucgaaaaccugauuuccgaggaucuuaccaaacgcucucauggguuuagaacagaauauuucaucaagccgcccguuuacgugacggugagcuuuccuuucaaugucgagauuugccggaucaacaucgaccugaccgcuggaggcgggcaaaaugugacaggacucgaaauguauaccuccgccucuagcucccgcguuucuuggaacacaccccaguguagaacccugggcccugcggagcccagcgugccugauaaagaggcuuuuacacuugucgggaaggugcugcucaaaaaucagucccagguuguguucagccaccggggauuuaaggcccgcccgcccuucggcgccauggaagcuacccugccuucucccgccgucguggcucaagagcuguggaacaagggcgcccucucccugagccauguggcgcaccuuagaauuugcaucacgcaugucaccgggggaggcauuccuuguaucaaacggcuggaaguuugggggcagcccgccaagacaugcucucaggaggugauugacuccauccuccuggugaccagcgagaaucuuccgcaggaugucgcucugcaagccccugcucuccccauggaaucugacugugauccuggagaccagcccgagucccagcaggcccccagcucccugcaaaaacuggcggaaauuauccaggaugugccugaggaauuucucgacccgaucacacuggagauuaugcccugcccuaugcuucugcccucuggcaagguuaucgaucagagcacccucgagaaauguaaccgcuccgaagccacgugggggagagugccuagcgaccccuucacaggagucgcuuuuaccccgcacucucaaccucugccccacccuucccuuaaggcccggauugaucauuuccugcuccagcacagcauccccggcugccaucugcugggccgcgcucagacagcccucgccgugauuccuucuagcaucguucugcccucccagaagagaaaaaucgagcaagcugaacacgugccggacucuaauuuuggggucaacgcgagcuguuucuccgccaccagcccucuugugcugcccaccacaucugagcacacggcuaagaaaaugaaggccaccaaugaacccucccucacacauauggacugcagcaccggaccucugucucacgagcagaaacuuucccagagccuggagauugcccucgcuuccacacugggcucuaugccgagcuucaccgcccggcugacgcgcgggcagcuccaacaucugggaacaagaggcuccaacaccucuuggcggcccgggaccggaagcgcgugggaacacccuggccccagaaugugccuucugcagaaguccaucuuuagccuccugcagaaaggcgcuggggucccugccgcccugagacccccucccgugccgacacuuccuggauga

SEQ ID NO: 77547 - RNA, 1515 nt, Artificial Sequence
  derived and/or modified sequence opt5 from UBP1__Homo_sapiens__NP_001121632
auggccugggugcugaagauggacgaggucaucgaaagcggacucguucacgauuucgacgcuucccugucugggauuggacaggagcuuggcgccggggcguacagcauguccgaugugcuggcucuccccaucuuuaaacaagaagacucuagccugccucuugauggagagaccgaacauccgcccuuccaguaugugaugugcgccgccacauccccugcugucaagcugcacgacgagacgcucaccuaccugaaccagggccagucuuaugagauuagaaugcuggauaaucggaaaaugggggacaugcccgaaaucaacggaaagcucgugaaaagcauuauccgcguuguguuucaugauagacggcugcaauacacagagcaccagcagcuugaaggcuggaaguggaaucgcccuggcgacagacugcucgaucuggacauccccauguccgucgggauuaucgauacccggacaaacccuagccagcuuaaugccguggaguuccugugggacccggcuaagcgcaccucugccuuuauucaaguucauuguaucuccacagaguucacccccagaaaacacggaggcgaaaagggggugccuuuucggauucaggucgacacguucaaacagaacgagaauggagaauauaccgaucaccuccauagcgcgucuugccagaucaagguguuuaaacccaagggcgccgaccgcaagcaaaagacagauagagagaagauggaaaaacggaccgcucacgagaaggagaaauaccagccuuccuaugacacaaccauucugacggaauguagccccuggccggaugccccuacagcuuacgugaacaauucucccuccccugcccccaccuucacaagcccccagcaaucuaccugcuccgucccugacagcaacuccagcucuccgaaucaucagggggauggagcgucccagaccagcggcgagcagauccaacccucugccacaauccaggaaacgcagcaguggcugcucaagaaccgcuuuagcuccuacaccagacuguucucuaauuuuagcggcgcugaccuucugaaacucacaaaggaggaucugguucaaauuuguggggccgcugacggaauccggcuuuauaacucccugaaaagccgcucugugagaccucggcucaccauuuacgugugcagagaacagcccuccagcacaguccugcagggccagcaacaggccgccucuuccgcuagcgagaauggguccggagcgccuuauguguaccacgccaucuaucuggaggaaaugauugcuucugagguugcccgcaaacucgcccugguguucaacaucccccuucaccagaucaaccaggucuaccggcaaggcccgaccgggauucauauccuggugagcgaucagaugguucagaauuuccaagacgaauccuguuuucucuucucuacggugaaggcugagagcuccgacggcauucacaucauucugaaauga

SEQ ID NO: 77548 - RNA, 1770 nt, Artificial Sequence
  derived and/or modified sequence opt5 from UBQLN1__Homo_sapiens__NP_038466
auggccgagagcggcgaauccgggggacccccuggcucucaggacagcgcugccggggcggagggagcuggcgccccggccgcugccgcuuccgccgaacccaagaucaugaaagugaccgucaagacaccuaaagagaaggaagaguucgcgguucccgagaacucuagcgugcaacaguuuaaagaagagauuuccaagagauucaagucucacacggaucagcuggugcucaucuuugccgggaaaauucugaaggaccaggauacccuuagccaacauggaauccacgacggccugacaguccaucucgugauuaaaacccagaaucggccucaggaucacuccgcucagcaaacaaacaccgccggcagcaauguuacaaccucuuccacgcccaacagcaauucuaccuccgggagcgcuacaucuaacccuuucggacugggcgggcuuggaggccuggccgggcucuccagccugggacugaauaccacaaacuuuuccgaacuccagucucagaugcagcgccaacugcuuagcaauccggagaugauggugcagaucauggagaaccccuucguccaguccaugcugagcaauccugaccucaugagacaacugaucauggcgaacccccagaugcagcagcuuauucaacggaauccugaaaucucucauaugcugaacaaucccgauauuaugcgccagacccucgagcuggccagaaacccggcuaugaugcaggaaaugaugcggaaccaggaccgcgcccuguccaaucucgagagcaucccuggcggcuacaacgcucugagacggauguauacggauauucaagaacccaugcuuucugccgcccaggagcaguuugggggaaauccuuucgcuagccugguguccaacacaucuagcggcgaggggucccagcccagccgcaccgaaaauagagacccccucccuaacccgugggcgccccaaacaucucaguccagcucugccuccagcggaaccgcuuccaccguuggcgggacaacgggaucuaccgccagcggcacauccggccagucuaccacagccccuaaucuggugcccggggucggagcuagcauguuuaacaccccuggcaugcagucccuucugcaacagaucacggagaauccccagcucaugcaaaacaugcugagcgccccguacaugcggucuaugaugcagucccugagccagaauccugaucucgcggcucagaugaugcugaacaauccccuuuucgccgggaacccucaacugcaggaacagaugcgccagcaacuccccacauuucugcagcagaugcagaauccugacacccuuucugccauguccaaccccagagcuaugcaagcccugcuccagauucagcaaggacugcagacccuggcuacagaggccccgggccucaucccuggguucacccccggccugggagcgcuuggcagcacagggggaucuagcggcacgaacggguccaaugccacccccagcgaaaacacaucuccuaccgcuggaacaaccgagccgggccaccagcaguuuauccaacagaugcugcaggcccucgcuggggugaauccccagcugcaaaacccugaggugcgguuccagcagcagcuggaacaacuuuccgccaugggcuuccucaaucgcgaggcgaaccugcaggcccugauugcuacgggaggcgauaucaaugccgcuauugaaagacuccuggggagccagcccuccuga

SEQ ID NO: 77549 - RNA, 1875 nt, Artificial Sequence
  derived and/or modified sequence opt5 from UBQLN2__Homo_sapiens__NP_038472
auggccgagaacggcgaaagcuccgggcccccuagaccgucucggggacccgcugccgcgcagggcagcgcugccgccccugcugagcccaagaucauuaaagugaccgucaagacaccuaaagaaaaggaggaguucgccguucccgaaaauuccucugugcaacaguuuaaagaggcuaucagcaagcgcuucaagucccagacggaccagcuggugcucauuuuugccgggaaaauccugaaggaucaagacacccuuauucagcacggaauccaugauggccugacaguccaccucgugaucaaaucucagaacagaccucaggggcaaagcacccagccguccaaugcggccggaacaaacaccacaagcgcuucuacgccccgguccaauagcaccccuauuucuaccaacuccaaucccuucggccugggcagccuugggggacuggccggccucucuucccuggggcugagcuccacaaacuuuucugaacuccagagccagaugcaacagcagcugauggcuuccccugagaugaugauccaaauuauggaaaaucccuucguucagagcaugcuuucuaacccggaccugaugcgccagcucaucauggccaauccucagaugcaacagcugauucagagaaaccccgagaucucccaucuucugaauaacccugauauuaugcggcagacccucgagaucgcgcgcaaucccgccaugaugcaagaaaugaugagaaaccaggaccuggcucugagcaaccucgagucuauccccggaggcuacaaugcccugcggcgcauguauacagauauucaggaaccuaugcuuaacgcugcccaggagcaauuugggggaaauccguucgccagcgugggcuccucuagcuccagcggcgaagggacccagcccucuagaacggagaaccgggacccucugcccaauccuugggcucccccgccugcgacacaguccagcgccaccacaucuaccaccacauccacgggaagcggcuccgggaacucuagcuccaaugcuaccggaaacacagucgccgccgcuaauuacguggccucuaucuuuagcacccccggcaugcagucccuccugcaacagauuacagagaacccucagcuuauccaaaauaugcugagcgcgcccuauaugcgcucuaugaugcagucccucagccagaacccugaucuggcugcccagaugaugcucaauucuccccuguucaccgccaacccgcaacugcaggaacagaugagaccucagcuucccgcuuuucugcaacagaugcagaaucccgacacgcucuccgccaugagcaacccucgggcuaugcaggcccugaugcaaauucagcaggggcuucaaacacuggcgaccgaggccccgggacucauccccucuuucaccccuggcguuggcguggggguccugggaacagcuaucggccccguggggccugugacccccauuggaccuaucggccccauugucccguuuacaccuaucgggcccauuggcccuaucggacccacgggcccggccgcuccucccgggagcaccggauccggcgggccuacaggacccaccguuagcucugccgcgcccuccgaaacaaccagcccuacguccgagucuggcccgaaccagcaguucauccagcaaauggugcaggcccuggcuggggccaaugcuccccagcucccuaaccccgaagugcgcuuccagcaacagcuggagcagcuuaaugccaugggcuuucugaacagagaggccaaucuccaggcucugauugcgaccggaggcgauaucaacgccgcuauugaacggcugcuugggagccaaccuuccuga

SEQ ID NO: 77550 - RNA, 1428 nt, Artificial Sequence
  derived and/or modified sequence opt5 from UBQLNL__Homo_sapiens__NP_659490
auguggcacgccaucagcagaaccucccggaugucucagagcggcugccccuccgggcugcucgcugacaagaacauuucuagcuccgccacacgcgugaucgucaaaacggcgggaaaucaaaaggauuucaugguugcugacgauauuucugugagacaguuuaaagagaugcugcuugcccauuuccagugucagauggaccaacuggugcucgucuuuaugggcugccugcuuaaggaucacgacacccugagccagcgggggaucauggauggacauacaauuuaccucgugaucaaauccaagcagggcagccgcucucuggcccacuccuucagagaccugccuaccaacgauccgugucaucgggaccgcaauacaaaggggaacagcucuagaguucaccagcccaccggaaugaaucaagcuccuguggaacucgcccacuuugucggcuccgaugcucccaaagugcauacacagaaccuggagguuagccacccugaaugcaaggcccagaugcuugagaaucccucuauccagcggcugcucuccaacauggaguucauguggcaauuuauuagcgaacaucuggacacccagcagcuuaugcaacagaauccugaggugucccgccugcuccuggauaacucugaaauccugcuccagacgcuggagcuugcgagaaaucuggccaugauucaggaaaucaugcaaauucagcagccgagccagaaccucgaguauccccugaauccucaacccuaccuuggccuggagaccaugccugggggaaacaaugcucucggccagaacuaugccgacaucaacgaccagaugcugaauagcaugcaggaucccuucgggggaaacccguuuacagcucugcucgccggccaaguccuggaacaggugcagagcucuccucccccucccccucccucccaggagcaacaggaccagcuuacccaacacccggcgacacgggugauuuacaauagcucugggggauucagcuccaacaccucugccaaugauacgcugaacaaagucaaucacacaagcaaggcuaacaccgccaugaucuccacaaaaggccagagccauaucugugcuacccgccagcccgccuggauuccugcccuccccucuaucgaacugacccagcaacuucaggaggaauauaaggacgcuacaguuucccuguccucuuccagacagacgcucaagggcgaucugcagcugagcgacgagcaauccucuagccagauuaccgggggaaugaugcagcuccugaugaauaacccuuaccuugcggcccagaucaugcuguuuacauccaugccccaacucucugagcaguggcggcagcaacugccgaccuuccugcagcagacacagauuagcgaucuucucuccgcuuga

SEQ ID NO: 77551 - RNA, 5250 nt, Artificial Sequence
  derived and/or modified sequence opt5 from UBR1__Homo_sapiens__NP_777576
auggcugacgaggaagcuggcgggaccgagagaauggaaaucagcgcugagcugccccagacaccucagcggcuugcgagcuggugggaucagcaagucgacuucuacacggcuuuucugcaccaucuugcccagcuggucccggaaauuuauuucgccgagauggaucccgaccucgagaagcaagaagagucuguucagaugagcaucuuuaccccucuggaaugguaccuuuucggagaggaucccgacauuugccuggagaaacucaagcacuccggcgcuuuucagcugugugggcgcguguucaaaucuggagaaacaaccuauagcugcagagauugugccaucgacccuacaugcgugcuguguauggauugcuuucaggacuccguccauaagaaccaccgguacaaaaugcauaccucuacaggcgggggauucugugauugcggcgacaccgaggcuuggaagacgggccccuuuugugugaaucacgaaccugggcgcgccggaaccauuaaggagaacagcagaugcccgcucaaugaagagguuaucgugcaagcgcggaaaaucuuccccuccgucauuaaguaugugguugagaugacaaucugggaagaggaaaaagagcugccucccgaacuucagauucgcgagaagaacgagagauacuauugugugcuguuuaaugaugaacaccauagcuacgaccacgucaucuacucucuccagcgggcccuggacugcgagcuugcugaagcccagcugcauaccacagcuauugauaaagagggccgcagagccgugaaggcgggggccuaugcugccugccaagaagcuaaggaggacaucaaaucccacagcgagaacgugucucagcacccucuccaugucgaaguucugcacuccgagauuauggcccaucagaaguucgcccugcggcucggaagcuggaugaauaaaaucaugucuuacuccagcgauuuucgccaaaucuucugucaggcuugccugagagaggaacccgacuccgagaacccgugucuuauuucucggcugaugcucugggaugcgaagcuguauaaaggcgcccgcaagauccuucacgaacugauuuucagcuccuuuuucauggagauggaauacaaaaagcucuuugcuauggaguucgugaaguauuacaaacagcugcagaaggaauauaucagcgacgaucaugacagaucuauuuccaucaccgcccugagcgugcaaauguuuacggucccuacacucgcccggcaccugaucgaggagcagaaugugauuucuguuaucaccgaaacacuucuggaggugcuccccgaauaccuggauagaaacaauaaauucaacuuucagggguacagccaggacaaacuuggacgcgucuaugcugugauuugcgaucugaaauacauccucauuuccaagccuaccaucuggaccgagcggcugagaaugcaauuccuggaaggcuuucgcucuuuccucaagauccugacauguaugcagggcauggaggagauucggagacagguugggcagcacaucgaaguggaccccgacugggaggccgcgauugcuauccaaaugcagcuuaaaaauauucugcucauguuucaggaauggugcgccugugaugaggaacugcugcuugucgccuauaaggagugccauaaagcugugaugcgcuguagcacguccuucaucuccucuagcaagaccgucgugcagagcugcggacacucucucgagacaaaauccuaccggguuagcgaagaccugguguccauucaucugccccucucuagaacccuggccggccuucacguccgccugagccggcucggggcuguguccagacugcacgaguuuguuucuuucgaagauuuccaaguggagguccugguggaguauccucuucgcugucucgugcugguugcccaggucguggcggaaauguggcggagaaacggacugagccucaucucccagguguuuuacuaucaagacgucaagugccgggaggaaauguacgauaaggacaucauuaugcugcagaucggcgccagccuuauggauccgaauaaauuccugcuccuggugcugcagcgcuacgagcuugcugaagccuuuaacaagacaauuucuaccaaagaccaggaucucaucaagcaauauaacacgcugauugaggagaugcugcagguucucaucuacaucgugggggaaagauauguccccggagugggcaauguuacaaaagaggaagugaccaugcgggagauuauccaucugcuuugcauugaaccuaugccccacuccgcuaucgccaagaaccugccugagaaugagaacaaugaaaccggccucgagaacgucauuaauaagguggcgacauucaaaaagcccgggguuagcggacauggcguguacgaacugaaagacgagucucugaaggauuuuaacauguauuucuaccacuauuccaaaacccagcauagcaaggccgaacacaugcagaaaaagagacgcaagcaagagaauaaagacgaggcccuuccgccucccccucccccugaauuuugucccgccuucucuaaggucaucaaccuccugaauugcgauaucaugauguacauucugcggacaguguuugagagagcuaucgacacggacagcaaccucuggaccgaagggaugcugcagauggccuuccacauucuugcccugggacuccuggaggagaaacagcagcugcaaaaggcuccggaagaggaagugacauuugauuucuaccauaaagcgucccgccuuggcagcucugccaugaauauccagaugcugcucgagaagcugaaggggauuccucagcucgaaggccaaaaagacaugaucaccuggauccugcagauguuugauacagucaagagacuucgggagaaauccugucugauuguugcuaccacgagcggauccgagucuaucaagaacgacgaaauuacccacgauaaagagaaggccgaacgcaagagaaaagccgaggcugcccggcuccaucgccagaagaucauggcgcagaugagcgcucugcagaagaauuucauugaaacacacaagcugauguaugacaacaccuccgagaugcccggcaaagaggauucuaucauggaagaggaaagcacacccgccguguccgacuacucuagaauugcccuugggccuaagcggggaccgagcgugaccgagaaggaaguccugacgugcauccucugucaggaggagcaggaagugaaaaucgagaacaaugcuaugguucuguccgccugcgugcaaaagagcacagcgcucacccaacaucgcggcaaacccauugaacugucuggggaggcucuugauccucuguucauggaccccgaucucgccuauggaacauacaccggcuccugugggcacgucaugcacgccgugugcuggcagaaguauuuugaggcuguucagcugagcucucagcaaagaauccauguggaccuguucgaucuugaauccggcgaguaccuguguccucucugcaaaagccuguguaacaccgucauucccaucauuccucuccagccccagaagaucaauucugaaaacgccgacgcucuggcccagcuucugacacuggcgcgguggauccaaacggugcucgcccgcauuuccggauauaauaucagacacgcuaaaggcgagaacccgauuccuaucuuuuucaaucaggggaugggagacagcacccuggaauuucauuccauucuuagcuucggcguugagucuagcaucaaguacuccaacucuaucaaggagauggugauucuguuugccacaaccaucuaccggauugggcucaaagugcccccugaugaaagagacccccgcgugccgaugcugacauggucuaccugcgcuuucacgauccaggccauugagaaucuccugggagaugaaggcaagccucuuuuuggggcccugcaaaaccggcagcacaauggccugaaagcucucaugcaguucgcgguggcccagagaaucacaugcccccaaguccugauucagaagcaccuuguucgccugcucuccguggugcugccuaacaucaaauccgaggacacccccugucuccugagcaucgaucuuuuucauguccuggugggagcuguucuggccuuccccucccucuauugggacgauccuguggaccugcagccgucuagcgucuccagcucuuacaaucaccuuuaucuguuccaucucauuaccauggcccacaugcugcagauccuccugacaguggauaccggccuuccccuggcucaaguucaggaagacuccgaggaggcccauagcgcgucuuccuuuuucgcugaaauuagccaguacacauccgggucuaucggaugcgauauuccuggcugguaucugugggugagccucaagaacgggaucacgcccuaccugcggugugccgcccucuuuuuccacuaucugcucggagucaccccucccgaggaacugcacacaaauuccgcugagggcgaauacagcgcccugugcucuuaccucucccuuccuaccaaccuguuucuccuguuccaggaguauugggacacagugagaccgcugcuucaacgcuggugugcggaccccgcucugcucaacugccugaagcagaaaaauaccgucgugcgguacccuagaaagcgcaacagccugaucgagcuccccgaugacuauucuugucuucugaaucaggccagccauuuucggugcccuagauccgccgaugacgaacggaaacaccccguucugugucucuucugcggggcuauucuguguucucaaaacaucugcugccaggagauugugaauggcgaagaggucggagccuguaucuuucaugcccuucacugcggcgccgggguguguauuuuccugaagauccgcgagugcagaguugugcucgucgaaggaaaagcgcggggcugugccuacccggcuccuuaucuggaugaguacggggaaacggaccccggacugaagcgcggcaacccccuccaccuuagcagagagcgguauagaaagcugcaucugguguggcagcagcacugcaucauugaagagaucgcccgcucccaagagaccaaucagaugcucuuuggcuucaacuggcagcugcuuuga

SEQ ID NO: 77552 - RNA, 5667 nt, Artificial Sequence
  derived and/or modified sequence opt5 from UBR3__Homo_sapiens__NP_742067
auggccgcugccgcggcugccgccgugggcgggcagcagcccagccagccugagcugccggcucccggacucgcccuggacaaggcugccaccgcggcccaccuuaaagcugcccugucccggccugacaaccgggcuggcgccgaagaacugcaggcgcugcuugaacgcguccugucugccgagcggccccucgcugccgcugccgggggagaagacgccgcugcggccggcgggggaggcggcccuggggcugccgaggaggaagcccuggaguggugcaagugucugcucgcuggaggcgggggauacgaugaguucugcgccgcgguucgggcuuaugaccccgccgcccuguguggccuuguguggacagcuaauuuuguggccuaccgcugcagaacgugugggaucagcccuugcaugucccugugugcugagugcuuccaucagggagaucacaccggccacgacuuuaacauguuccggucucaagccggcggggcgugugauugcggagacagcaaugucaugcgcgaguccggcuuuuguaaaagacaccagauuaagucuagcuccaacaucccgugcgugcccaaagaucuccugaugaugagcgaguucguucuuccucgguuuauuuucugccugauccaguaucuccgcgagggguacaaugaacccgccgcugacggaccuucugagaaggaucugaacaaggugcugcagcuccuggaaccccaaauuuccuuucuugaggaccugacaaaaaugggcggggccaugagaagcguccucacccaggugcugacaaaucagcagaacuauaaggaucuuaccucuggacugggcgagaaugcuuguguuaaaaagucccaugaaaaauaccucaucgcccugaaaagcucuggccugacauauccggaggacaagcucguguacgggguccaagaaccuuccgcgggaaccagcucccuggccgugcagggcuucaucggggcuacgggaacccuuggccagguggacucuagcgaugaggacgaucaagacgggucccagggccugggaaaacggaagcgcgucaaacucagcucuggcacaaaggaucaguccauuauggacguucugaaacacaagagcuuucuugaagaacuccucuucuggaccaucaaauacgaguuuccccagaagauggugacauuccugcugaacaugcucccugaucaagaauauaagguggccuucaccaaaacguuuguccagcacuacgcuuucauuaugaagacacugaaaaagucucaugagagcgacaccauguccaauagaaucgugcacauuucuguucagcuuuuuagcaacgaagaacuggccagacaggugacagaagagugccaacuccuggauaucauggucaccgugcugcuuuauaugauggaguccugucucauuaaaagcgaacugcaggacgaggaaaauucucugcauguuguggucaacugcggggaggcccuccugaagaauaacaccuacuggccccuuguguccgauuucaucaacauccugagccaccagucugucgcuaagcgcuuucucgaggaccacggacugcuggugacauggaugaauuucguuuccuuuuuccagggcaugaaccuuaauaaaagagaacucaacgagcauguggaauuugagagccaaacguauuacgcggccuucgcugccgaacuggaggccugugcucagcccaugugggggcugcucucccacugcaagguccgggagacccaggaauauacaagaaaugugguucgcuacugucuggaggcccuucaggacugguuugaugcgauuaacuucguggacgaaccugcuccgaaucaagucaccuuucaucugccccuccaccgguacuaugccauguuccugucuaaagccgugaagugccaggagcuggaucuugacagcgugcucccugaucaggaaaugcugaugaaacugaugauccauccccuccaaauucaggcuucccuggccgagauccacucuaacauguggguuagaaauggacuucagauuaagggccaggcgaugacauacguccaaagccacuucuguaacuccaugaucgacccugauaucuaucugcuccaggugugcgcuagccgccuggaccccgauuacuuuauuucuuccguguucgagcgguuuaaggucguggaccugcuuaccauggccagccagcaucagaauacgguucucgaugccgaacacgagagaucuaugcuggaaggggcucugacauuccucgugauccugcuuucccugcgccuccaucugggcaugagcgacgaugagauucugcgggccgaaauggucgcucaacuuuguaugaacgacagaacccacucuagccugcucgaccugaucccggagaauccuaaccccaaauccggaauuaucccuggcagcuauucuuuugaguccgugcucagcgccguugcggauuucaaggcccccguguuugaaccugggggauccaugcagcagggcauguacacccccaaagcugaggucugggaccaggaguucgauccggugaugguuauccugcgcacaguguaucggagagacguccaaucugccauggaucgcuacaccgcuuuucuuaagcagagcgggaaauucccuggaaaucccuggcccccuuacaagaagcggacaucccugcacccgucuuauaaaggccucaugagacugcugcauugcaagacgcuucacauugugcuguuuacccuccuguacaaaauccucauggaccaucagaaccugagcgagcacgugcuuugcaugguccuguaucucauugagcuggggcuggaaaacuccgccgaggaagagucugaugaagaggccagcguuggcggacccgagcggugucaugacuccugguucccuggcagcaaucuugugucuaacaugcgccacuuuaucaauuacgugagaguccgggugcccgaaacagcuccugagguuaagagagauucccccgcgagcaccucuuccgacaaccuggggagccuccaaaauucuggaacagcccagguguucucccuggucgcugaacgccggaaaaaguuccaggagauuaucaacagaagcuccagcgaagccaaucaggugguucgcccuaaaaccucuagcaagugguccgcccccggcucugcuccgcaacucacgaccgccauucuggagaucaaggagagcauccuuucccugcugauuaaacuccaccauaagcugucugggaaacagaacagcuauuacccucccuggcuugaugacaucgaaauucugauccagccugagauucccaaguauucccacggagauggcaucacagcgguggaaagaauccuccugaaagcugccucucagagccggaugaauaagcgcauuaucgaggaaauuugcagaaaggucaccccgccugugcccccuaaaaagguuacagccgcugagaaaaagacccucgacaaagaggaacggcgccaaaaggccagagagcggcagcagaagcugcuugcggaauuugcuucccgccaaaagagcuucauggagacggccauggacguggauucucccgagaacgacauccccauggaaauuacaaccgccgagccucaggucuccgaagcuguguacgauugugugaucugcgggcagagcggcccgucuuccgaggacagacccacaggacuggucguucugcuccaggccagcuccgugcugggccagugucgggauaauguggaaccuaagaaacuucccaucucugaggaggaacaaauuuacccuugggauaccugcgcugccguccaugaugugcgccugagccuccugcagagauauuuuaaggacuccagcugucuccuggcgguuucuaucgggugggagggaggcguguacguccagaccugcgggcacacacuucauauugauugucacaaauccuauauggaaagccugcggaacgaccaagugcugcagggauucucuguugauaagggcgaguuuacgugcccccucuguagacaguucgccaauagcgugcugccuugcuacccgggcuccaacgucgaaaauaaccccuggcagcgcccuucuaacaagagcauccaagaccuuauuaaagagguggaggaacugcaggggcggcccggagcuuuuccuuccgagaccaaucucucuaaggaaauggagagcgucaugaaagacaucaagaacacaacccagaaaaaguauagagauuacuccaaaacacccggcagcccggacaaugauuuccuguuuauguauucuguggcccgcaccaaccucgaacuggagcuuauccacagagggggaaaucugugcuccggcggggcuagcacggccggaaagagauccugucugaaccaacucuuccauguucuggcccuucacaugcgccuguacucuauugacagcgaguacaauccuuggcggaagcucacacaacuggaagagaugaacccccagcugggcuaugaggaacagcagcccgaggugccuauccucuaccaugaugucaccucccuucugcugauucaaauccucaugaugccccagccucugagaaaagaccacuuuaccugcauugugaagguucuuuucacacugcucuauacccaggcucuggcggcccugucugugaaauguagcgaagaggaucgcuccgcuuggaagcacgccggcgcccucaaaaagagcacaugcgacgcugaaaagucuuacgagguccuucuguccuucgugaucagcgaacuguuuaaagggaagcucuaucaugaggagggaacgcaagaaugugccauggugaauccgauugcguggucucccgaguccauggaaaaaugccugcaggauuucugucuuccuuuucugcggaucaccagccuccugcagcaccaucuguucggcgaggaccuccccucuugccaggaagaggaggaauuuagcguucuugcuuccugucuggggcugcucccuacauucuaccaaaccgagcaccccuuuaucucugccagcugccuggauuggccggucccugccuucgacauuaucacacagugguguuuugaaauuaaguccuucaccgagagacaugcugaacagggaaaagcccuucugauccaggagagcaaguggaagcucccccaucugcugcaacucccugagaacuauaauacgauuuuucaguacuaccaccggaaaaccugcuccgugugcacaaaggugcccaaagauccugcggucugucuugugugcggcaccuucguuugucugaaggggcugugcuguaaacagcagucuuauugcgaaugugugcuccauagccaaaacugcggagccggcacaggcaucuuucugcuuaucaaugcuuccgucauuaucauuauccgcgggcacagauucugucuguggggaucuguguaccucgacgcccauggcgaggaagaccgggaucugcgcagagggaagccccuguauauuugcaaggagcgguacaaaguucucgagcagcaguggaucagccacaccuucgaccacaucaacaagagauggggaccgcauuauaauggccuuuga

SEQ ID NO: 77553 - RNA, 15705 nt, Artificial Sequence
  derived and/or modified sequence opt5 from UBR4__Homo_sapiens__XP_011539410
auggcuaccagcggcggggaagaagcugcugcggcugcccccgccccuggcacacccgcuacgggcgccgacaccacacccgggugggaaguggcugucagaccucugcucuccgccucuuacagcgcguucgaaaugaaggaacugccccagcuuguugccuccgugaucgaaucugaaagcgagauucugcaccaugaaaaacaguaugagccuuuuuacuccucuuucguggcucucagcacccacuauaucacaaccgucugcucccugauuccccggaaccagcuucagagcguggccgcugccuguaagguucugaucgaauuuucucuccugagacuggagaauccugaugaggcgugcgccgugucccagaaacaucucauucugcuuaucaagggacuguguacaggcugcagcagacucgaccggaccgaaaucauuacguucaccgcuaugaugaaaucugccaagcugccgcaaacagucaagacccuuuccgauguggaggaccagaaagaacuggcuagccccguuucuccugagcuccgccagaaggaagugcagaugaacuuucugaaucaacugacauccgucuucaaccccagaaccguggccagccagccuaucuccacgcagacacucguggagggggagaaugaugaacagucuagcaccgaccaagccuccgcuauuaaaacaaagaacgucuuuaucgcgcagaauguugccagccugcaggagcuuggaggcucugaaaaacugcuccgggugugucugaaccuucccuacuuccugcgcuauauuaauagauuucaagaugcugugcucgccaacuccuucuuuaucaugccggccaccgucgcugacgccaccgcggugcggaauggcuuccacagccugguuauugaugugacaauggcucuggacacgcucucucugccuguccuugagccccugaacccuagccgccuccaggaugugaccguucugucccuuucuugccuguacgccggggugagcgucgccacauguauggcuauccuccaugugggauccgcccagcaggucagaaccggcagcacaucuuccaaggaagacgauuaugagagcgacgcugccaccaucgugcaaaagugccuggagauuuacgacaugaucgggcaggcgauuucuuccagccggcgcgccggaggcgaacacuaccagaauuuucagcugcucggggcuuggugucugcuuaacucccuguuccucauccugaaucugucucccacggcccuugcugauaaaggaaaggagaaagacccccucgccgcgcugagaguucgggauauucugagccgcacaaaggaaggcgugggcuccccuaaacucgggccgggaaagggccaccaaggguucggaguccugucugugauccuugccaaccaugcuaucaaacugcucaccagccuguuucaggaccugcagguugaggcccuucacaagggcugggaaaccgaugggcccccugcugcccucuccauuauggcccagagcacaucuauccaaagaauccagcggcugaucgacuccgugccccugaugaaccuccugcuuacccugcucagcacaucuuauagaaaggcuugcguccugcagcgccagcggaaaggauccaugagcucugaugcgagcgccuccacggacagcaauaccuacuaugaggaugacuucucuuccacagaggaagauagcucccaagacgacgauucugagccuauucugggccagugguuugaagagaccaucagccccuccaaggagaaagcugccccgccucccccucccccucccccgccucuugaaucuagccccagagugaagucccccucuaaacaggccccuggcgagaaggggaacauccucgcuagccgcaaggacccggaacuguuccugggacucgccuccaauauucugaacuuuaucacaagcucuaugcuuaauucccggaacaauuucauuagaaacuaccugagcgugucucucuccgagcaucacauggcgacccuggcuagcaucauuaaagaaguugauaaggacggccugaaagggucuuccgaugaggaguuugccgccgcucuuuaucacuucaaucauagccucgucacguccgaccugcaaagccccaaccugcagaauacccuccugcagcagcuuggaguggccccuuuuucugaaggccccuggccucuguacauccacccccaaagccucuccgugcugucucgccugcuucugauuuggcagcauaaggcgagcgcucagggggauccugacguccccgagugucucaaagugugggaucgguuccuguccacaaugaagcagaacgcccuccaaggcguugugccgucugaaaccgaggaccugaaugucgaacaccuucagaugcugcuccugaucuuucauaacuucacagagaccggaagacgcgccauccugagccuuuuugugcagauuauccaggagcuguccguuaauauggaugcucaaaugcgguucgugccucucauucuggccagacuccugcuuaucuucgacuaucugcuccaccaguacucuaaggcucccgucuaccuguuugaacaggugcaacacaaccugcuuagcccucccuucggcugggccuccgggagccaggauucuaacucccgccgggcgacgacaccgcuguaucauggauuuaaagagguugaagagaauuggagcaagcacuucucuuccgacgccgugccucaucccagauuuuacugcguccucagcccugaggcuagcgaggacgaucugaaccggcucgacucuguggccugcgaugugcuguucagcaaacuugucaaguaugacgagcuguacgcugcccugaccgcccuccuggcugcgggcucccagcuugauacaguucgcagaaaagaaaauaagaacgugaccgcccuggaggcuugugcccuccaguauuacuuucugauucucuggcggauccuggggauccuuccgcccagcaagaccuauauuaaucaacugucuaugaacuccccugaaaugagcgagugcgacauccugcacacacucagauggucuagccgccugcggauuuccucuuacgugaauuggaucaaagaucaccuuauuaagcagggaaugaaagccgagcaugcuagcucccugcucgaacuggccucuacgaccaaguguagcuccgucaaauacgacguggagaucguugaagaguauuucgcgagacagaucagcucuuuuugcuccauugauuguacaaccauccuccagcugcacgaaauuccgagccuucaauccaucuacacacuggacgcugccauuucuaaggugcaggucagccuggaugagcauuucuccaaaauggccgcugagaccgacccccacaagucuagcgaaaucacgaagaaccuccugccugccacacuucagcugaucgauaccuaugcguccuuuacccgcgcuuaccuccugcagaauuucaacgaggaaggcacaaccgagaaacccagcaaggaaaaacuccaaggguuugccgccgugcuggcuauuggaucuuccagaugcaaggccaauacacuuggaccuacgcugguucagaaccugcccagcucugugcagaccgucugugaguccuggaauaacaucaauacaaacgaguucccuaacauuggcagcuggcggaaugcuuucgccaacgacaccaucccgucugaaagcuauauuuccgcggugcaggccgcucaucucgggacacugugcucucaaagccuuccccuggccgcuucccucaaacacacccugcugagccucguucgccuuacgggagaccugaucgugugguccgaugagaugaauccuccccaggucauuagaacccugcucccucugcuucuggaaucuagcacagaguccguggccgaaaucucuagcaacucccucgagcggauccugggccccgccgagucugacgaauuucuggcucgcguguacgagaagcucauuaccggguguuauaauauccuugcgaaccacgccgauccgaauagcggacuggacgaauccauucuggaggagugccuccaguaccuggaaaagcaacuugagagcucucaggcuagaaaagccauggaagaguucuuuuccgauagcggcgaacugguccagaucaugauggccacagcuaacgagaaucucucugccaaguucuguaaccggguucugaaauuuuucaccaagcuguuucagcucacagagaaauccccuaaucccagccuucugcaucugugcgggucucucgcgcaacuggcuugcguggaacccgugcgccuucaggccuggcugaccagaaugacgacauccccucccaaggacagcgaucagcucgacgucauucaggagaaccggcaacugcugcagcuccuuaccaccuacaucgugcgcgaaaauucccagguuggcgagggagugugugccguccugcugggcacacucaccccuauggcuacggaaaugcuggccaacggggauggaacaggcuucccggagcuuauggugguuauggcgacccuggccagcgcugggcagggagccggccaccuccaacugcauaaugcugccguggacuggcugucuagaugcaagaaauaucucagccagaagaacgucguggagaaacuuaacgcuaaugucaugcacgggaagcaugugaugauccuggaauguacaugccacauuauguccuaccuggccgauguuaccaacgcgcucucucagagcaauggccaaggacccucccaccugucuguggacggcgaggaacgggccaucgaggucgacagcgauuggguggaagaacuugcuguugaggaagaggacucccaggccgaagauucugacgaggauagccuguguaacaaacucugcacauuuaccauuacgcagaaggaguucaugaaucagcauugguaucacugucauaccugcaagaugguggacggggucggaguguguacagugugcgcuaaaguuugucacaaggaucacgaaaucuccuacgccaaauauggcagcuuuuucugcgacugcggggccaaggaggauggaucuugucuggcucuggucaaaagaaccccuuccagcggcaugucuuccacaaugaaggaaagcgcguuccaauccgagccccgcauuucugaaagccucgugcggcaugccuccaccagcucuccugcugacaaagccaaggugacgaucuccgauggcaaggucgccgacgaggagaaacccaagaaaagcucucuuugcagaacaguggaagggugucgcgaggaacugcagaaccaggcuaauuuuagcuucgccccgcugguucucgauaugcugaacuuucuuauggacgcgauccagaccaauuuccaacaggccuccgcugugggaucuagcucccgggcccagcaggcucugucugagcuccacacagucgaaaaggccguggagaugaccgaccaacugaugguuccuacccugggcagccaggagggggcguuugaaaacgugagaaugaauuacuccggagaucagggccagacaauucgccaacucaucagcgcccauguccuucggagaguggcuaugugcguucugucuagcccccacgggcgccggcagcaucuggccgugagccacgagaaaggaaagauuacgguccuccagcuguccgcccuucugaagcaagccgacucuagcaaaagaaagcucacccugacacggcuggcuuccgccccugugcccuucaccgugcucucucuuacaggcaacccuuguaaagaagauuaucuggcggucugcggccugaaggacugucacguucucaccuuuagcuccagcgggucuguguccgaucaucuggugcuucacccccagcuggccacgggaaauuucaucauuaaagcugucuggcucccgggcagccagacagagcuggccaucgugaccgcugacuuuguuaagauuuacgaucugugcguggacgcccucucuccuaccuucuacuuucuucugcccuccagcaagauccgcgaugucacauuccuguuuaacgaagaggggaaaaauaucauugugaucaugucuuccgccggauauauuuacacccagcucauggaggaagcgagcucugcucaacagggccccuucuauguuacaaacgugcuggagaucaaucaugaagaccuuaagcaggauagcaacucccaggucgccgggggaggcgugagcgucuacuauucccacgugcugcaaaugcuguucuuuucuuacugucagggcaaguccuucgcugccacgauuuccagaaccacacuggagguucugcagcucuuuccuaucaacaucaagucuuucguggugugcagcuccaaugggggaucuaaaaccagcccggcccugugucagugguccgaggucaugaaccaccccggccuuguuugcugcgugcaacagacaaccggggugccucuggucgugaugguuaagcccgacacguuucucauucaggaaaucaagacccugccugcuaaagccaagauucaagauaugguggcgauccggcauacagccuguaaugagcagcagcgcaccacaaugauucuucugugcgaagacggaagccucagaaucuauauggcuaacgucgagaauaccucuuacuggcugcagcccucccugcaaccuagcucugugaucuccauuaugaaaccgguccggaagagaaaaacagccacgaucaccacacgcaccagcucucaggugaccuuccccauugacuuuuucgaacacaaccagcagcucacagauguugaguuuggcgggaaugaccugcuucaaguguacaacgcucagcagaucaagcaucggcucaauuccacgggaauguaugucgccaacaccaagccuggcggcuucacaauugagaucagcaauaacaauucuaccauggugaugacagggaugcgcauucagaucggaacccaagcgaucgaacgcgcccccuccuacauugagaucuuuggccggacgaugcagcucaaccugagcagaagccgcugguucgauuuuccuuucacacgggaagaggcccuucaggccgacaaaaagcugaaucucuucauuggggcuuccguugaucccgccggagugaccaugaucgacgcugucaaaauuuauggcaagaccaaagaacaauuuggguggccggaugagccucccgaggaguuccccucugccagcguguccaacaucuguccuucuaaccugaaucagagcaacggaacaggcgacuccgauucugcggcccccaccacaaccagcggcacggugcuggaguccagcgaaacagagucucucaccaagcuggacagacuuguugucuccagccuggaagcucucgagucuugcuuugccguggggccuaucauugagaaagaacgcaauaagaacgcugcccaggagcuggccacacuucugcucucccugccggcgcccgcuagcgugcagcaacaguccaagucucugcucgccagccugcacaccuccagaucugccuaccauagccacaaagaucaggcccuucuguccaaggccguccagugucucaauacgagcucuaaagaaggaaaggaccuggacccugagguuuuccaacggcuugugaucaccgcucgcuccauugccaucaugagacccaacaaucuggugcacuuuacagagagcaaacucccucagauggaaaccgauugcuucuuuccccggugugcgugcuggucucugggcauugucgggauccugaucggagccccgcucgagacaccuagccccgaaggcauggacgaggggaaggaaccucagaagcagcuggagggagauuguugcuccuucauuacccaacuugugaaccauuuuuggaaacugcacgcuucuaagcccaaaaaugccuuccucgcuccugccugucugcccggccuuacacauaucgaggcgaccguuaacgcccugguggacauuauccacggcuauugcacgugcgaacucgauuguauuaauacagcuagcaagaucuacaugcagaugcugcugugcccggacccugccgucuccuuuagcuguaaacaggcucucauucgcgugcugagaccccggaacaagagacgccacguuacccuucccucuuccccucggagcaauaccccgaugggggauaaggacgaugacgaugacgaugacgccgacgagaaaaugcaguccucuggaauccccaacggcgggcauaucagacaagaaagccaggagcaguccgaaguggaucacggagacuucgagauggucucugagagcauggugcuggaaacagcugagaaugugaacaacggcaauccuagcccccuggaagcccugcuugcgggggccgagggauuuccucccaugcuggauauuccucccgacgcugaugacgaaaccauggucgagcucgccaucgcccugucucugcaacaggaucagcagggcagcuccagcucugcucucggccugcaaucccuugggcugagcggacaggccccgucuuccagcucucucgacgcgggcacacugagcgauacgaccgcuuccgcccuuguuacacugagcgccccugcuuccgacgaugaggggucuaccgccgcuacagacggaagcacccuccgcacgucccccgccgaccauggcgggucugugggcagcgaauccggaggcucugcgguggauagcgucgccggggagcacuccgugagcggacggucuuccgcuuauggcgacgccaccgcugaagggcauccugccggacccggcagcguuucuuccagcacaggggcgauuucuaccacaaccggccaccaggagggagauggcuccgagggggaaggagagggcgaaacggagggggacgugcacacaagcaacagacugcauaugguccggcugaugcuucuggaacgccuccugcagacccucccgcaacugagaaaugugggaggcguucgggccaucccuuacaugcaagugauucuuaugcugacaaccgaucuggacggggaggaugagaaggacaaaggcgcucucgauaaccugcuuucucagcugaucgccgaacucggaauggacaagaaagaugucuccaagaagaaugagcgcagcgcucugaacgaagugcaccucguugugaugagacugcuguccgucuucaugagccggaccaaaucuggcagcaaguccucuaucugcgagagcuccucucuuauuagcuccgccacagccgcugcgcugcucagcucuggggccguggacuacugucugcauguccuuaaaucccugcucgaauauuggaagucccagcaaaaugaugaggagcccguggcuacgucucagcugcucaaaccccacaccacauccagcccucccgacaugucuccuuucuuucugcgccaguacguuaagggacaugccgccgacguguucgaggcuuauacccaacugcuuacagagaugguccugagacucccguaccagaucaaaaagauuaccgauacgaacucccggauucccccucccguguuugaccacagcugguucuauuuucuguccgaauaccuuaugauucagcagacaccuuucgugcgcagacaaguucggaagcugcuccuguuuaucugcggcucuaaagagaaguauagacagcugcgcgaucuccacacccuggacagccaugugcgggggaucaagaaacuucuggaagaacagggaauuuuccucagagccuccgucgugaccgcgagcucuggcuccgcucugcaguacgauacacuuaucagccugauggagcaccucaaagccugugccgaaauugcugcccaacgcaccaucaauuggcagaaauuuugcauuaaggacgauucuguucuguacuuccugcuccaggugagcuuucuggucgacgagggcgugucccccguccuucugcagcuccugucuugugcucuuugcgggagcaaagugcuggccgcgcucgccgcuuccagcggaucuuccagcgccucuuccagcuccgcuccuguugccgcgucuagcggccaagccacaacgcaguccaagucuagcaccaaaaaguccaaaaaggaagagaaggagaaagaaaaggauggggagacaagcggaucucaggaagaccagcuguguaccgcucuggugaaccaacucaauaaauucgccgauaaggagacacugauccaguuucuucggugcuuccugcucgaauccaacuccucuuccgucagauggcaggcucauugccugacccuucacauuuaucgcaauagcucuaaaucccaacaggagcugcuccuggaccugauguggagcaucuggccggagcuccccgccuacggccggaaggccgcucaguucguggaucugcuuggguauuuuagccugaagacgccucagaccgagaaaaagcucaaagaguacucccaaaaggcgguugaaauccugagaacacagaaccacauucuuaccaaucaucccaacucuaacaucuauaauacacugagcggacucguggaguucgacggcuacuaucuggaauccgacccuugucuggucugcaacaaucccgaggugccguuuuguuacauuaaacucucuagcaucaagguggauacccgcuacacaaccacgcagcagguugucaaacugauuggcucccacacaaucucuaaggugaccgugaagaucggggaccuuaaacggaccaagauggucagaacaauuaaccuguauuacaauaaccgcacggugcaagccaucguugagcucaaaaauaagccugcucgguggcauaaagccaagaaggugcagcugacccccggacagacagaagucaaaauugaucuuccccugccuaucguggccagcaaccucaugauugaguucgcugacuuuuaugaaaauuaccaggccuccaccgagacacugcaaugccccagauguucugcgagcguuccugcuaacccgggcgugugcgggaauuguggagaaaacgucuaucagugccacaagugucgcuccaucaauuacgaugagaaagaccccuuccugugcaacgccuguggcuuuugcaaguaugccagauucgauuuuaugcucuacgcuaaaccuuguugcgccguggaccccaucgagaaugaagaggaucggaagaaggcuguuagcaacauuaacacccugcuugacaaagccgaucgcguguaccaucagcugauggggcacagaccucaacucgaaaaucugcugugcaaggucaacgaggcggcccccgagaaaccgcaggacgacucuggaacagcuggcggcaucuccagcaccucugccuccgugaaucgguauauucuccagcuugcucaggaauacuguggggauugcaagaacagcuucgacgagcugucuaaaaucauucaaaagguguuugccuccagaaaggaacugcucgaguaugaucugcagcagcgggaagcggccacgaaaagcucccgcaccagcguccagccuacauucaccgcuucucaauacagagcccuuagcguucugggauguggccacacauccucuaccaagugcuaugggugugcuagcgccgugacggagcauugcaucacacuccugcgggcccuggcuaccaaucccgcgcuucgccacauccucgugucccagggacugauuagagagcuguuugacuacaaccuccggcgcggcgccgcugccaugagagaagagguccggcagcugaugugucuucugacacgcgauaauccugaagccacccagcaaaugaacgaccucaucauugggaaagugucuacggcucugaagggacauugggccaaucccgaucuggcgagcucccuucaguaugagaugcuccugcugaccgacucuaucagcaaagaagauuccugcugggagcucagacugcggugugcucuuagccuguuccucauggccguuaacauuaagacaccgguggucguggagaauaucacccugaugugccugcgcauucuucagaagcucaucaaaccucccgcccccacaucuaagaaaaacaaggacguuccuguggaagcucugaccacagucaaacccuacuguaaugagauccacgcccaagcucagcuguggcucaagagagauccuaaagccuccuacgacgcguggaagaagugccugccgauucggggcaucgauggcaacgggaaagcccccagcaagucugaacuucgccaccuguaucucaccgagaaauacguguggagauggaagcaguuccugucccggagaggaaaacgcacgagcccucuggaccuuaagcucggccauaauaacuggcugcggcagguccuguuuacacccgcuacccaagccgcuagacaggccgcgugcaccauuguggaagcccucgcuacaaucccuucccgcaagcagcagguucuggaccuucugaccucuuaucucgaugagcugagcauugccggggagugugcugccgaauaccuggcgcuuuaucaaaaacucaucacauccgcccacuggaagguguaccuggcugcccggggaguccugcccuaugugggcaaccucaucacgaaagagauugcuagacugcuugcccuggaagaggccacccucagcacagaccugcagcagggguacgcucugaagucucuuaccggacuccuguccagcuucguugagguggaaucuaucaaacgccauuuuaagucccggcuggucggcacagugcucaauggcuaccugugccuuagaaagcuggugguucagcgcaccaaacucauugaugagacgcaagacaugcugcuggaaaugcuugaggauaugaccacagggaccgaaagcgagacaaaggccuucauggcggucuguaucgagaccgcuaaacgguauaaccucgacgauuacagaacgccuguguuuauuuucgaacgccugugcucuaucaucuauccggaggaaaaugaggugacagaauuuuucgucacccuggagaaggacccccagcaggaggauuuucuccagggacggaugccuggcaaccccuacagcuccaaugaaccugggauuggaccccugaugagagacaucaaaaacaagauuugucaagauugcgaccuuguggcccugcucgaggaugacucuggcauggaacugcugguuaauaacaagaucauuagccuugaccucccgguggccgaggucuauaaaaaggugugguguacaaccaaugaaggggagccuaugcggaucguuuacagaaugcgcggacugcugggcgaugcuaccgaggaguucauugagucccucgacagcacaacggaugaagaggaggacgaagaggaaguguauaaaauggccggcgucauggcgcagugcgggggacuggaguguaugcuuaaccggcuggcuggcaucagagauuuuaagcaggggcgccaccuccugaccgugcugcuuaaacucuucucuuacugcgugaagguuaaagucaauagacaacagcuggugaagcuggaaaugaacacacucaaugugaugcugggaacccuuaaccuggcccucgucgccgagcaggaguccaaggacagcggcggggcugccguugcugaacaggugcuguccaucauggagauuauccuggaugaaucuaaugccgagccccuuagcgaagacaaaggaaaccuccugcugacaggcgauaaggaccaacucgugaugcugcuugaucagauuaacuccaccuuuguccggucuaaucccagcgugcugcagggccuccugcgcaucauuccuuaccuguccuucggggagguugagaaaaugcagauccuuguggaaagauucaagcccuauuguaacuuugacaaauacgacgaggaucauagcggagacgauaaggucuuccucgacugcuuuugcaagaucgcggccggcauuaaaaauaacucuaaugggcaccaacugaaggaucugauccuccagaaaggaauuacgcagaacgcucuggacuauaugaagaaacacaucccuuccgccaagaaucuugaugcugacauuuggaagaaauuccugagccggccggcccuccccuuuauccugcgccugcuuagaggccuggcgauccagcauccugggacacaagugcucauuggcaccgauucuauccccaaccugcacaagcucgaacagguuuccagcgacgagggaauuggcacccuggccgaaaaucuucuggaggcucuccgggagcauccugaugugaacaaaaagaucgacgccgcucgcagagaaacacgggccgagaaaaagcgcauggccauggcuaugagacagaaggcccuggggacccugggaaugacaacgaaugaaaaaggccaagucgugaccaagacagcgcuucugaaacagauggaggagcucauugaagaacccgggcugaccuguugcaucugucgggaaggauacaaguuccagccgacaaaagugcucggcauuuauaccuuuacgaagcgcgucgcucuggaggaaauggagaacaaaccuagaaagcagcaaggguacucuaccguuucccacuucaauaucgugcauuaugauugccaccuugccgccgugcggcuggcuagaggccgcgaggaaugggagagcgccgcgcuccagaacgcuaauacaaaguguaacggacugcugcccgucuggggcccucacguucccgaaucugccuuugcuaccugccuugcucggcauaacacauaccugcaggaguguaccgggcagagagaaccuacauaccaacucaauauccacgacauuaaacuccucuuccugcgcuuugccauggagcagagcuucuccgcugacaccggaggcgggggacgggagagcaacauccaucuuauucccuauaucauucacacggugcuguacgugcugaauacaaccagagccaccucccgcgaagagaagaaccuccagggcuuccuggaacagccgaaagagaagugggucgaaucugcguuugagguggaugggcccuauuacuucacaguucuugcccugcacauccucccucccgagcaauggcgggcuacgagaguggaaauccugcgccggcuccuggucaccagccaggccagagcuguggccccuggcggagcgacacggcuuaccgacaaagccguuaaggauuauuccgcuuaccgcucuagccugcuguuuugggcccucguggaccugauuuacaauauguucaagaaagucccgacauccaacaccgagggcggguggucuugcagccuugcugaauauaucagacauaaugauaugcccauuuacgaggccgccgacaaggcucugaaaacauuucaggaggaguucaugccuguggagaccuuuuccgaguuccucgaugucgccggacugcucagcgagaucacggaccccgaaucuuuucugaaggaucuucugaacuccgugccuuga

SEQ ID NO: 77554 - RNA, 8397 nt, Artificial Sequence
  derived and/or modified sequence opt5 from UBR5__Homo_sapiens__NP_001269802
augaccagcauccacuucgugguccauccccugccuggcaccgaggaccagcucaacgaucgccugcgggaaguuuccgagaaacuuaauaaguacaaccucaauucucacccuccccucaacgugcuggaacaagccacgauuaagcagugcguggucgggcccaaucaugcugccuuucuucuggaggacgggcgcguguguagaaucggcuucagcguucagcccgaucggcucgaacuggggaaaccugacaacaaugauggauccaagcugaacucuaauagcggcgcggggcgcaccuccagacccggacggacaucugacagcccuugguuucucuccggcagcgagacccugggccgccuugcugggaacacacugggaucuagaugguccagcggcgucgggggcucuggcgggggauccagcggccggucuuccgccggcgcccgcgauagcagacggcagacccgcgugauuagaacagggcgggaccgcggauccggccuccuggggucucaaccgcagcccgugaucccugcuagcguuauucccgaggaacuuaucucccaggcccaggugguccugcaaggaaaaagcagaucugugaucauucgggagcuccagagaaccaaucuggaugugaaccuggcugucaauaaccuccugucccgcgacgaugaagacggcgaugacggggacgauacggccagcgagucuuaucuuccuggagaggaccugaugagccuccuggaugcggacauccacuccgcccaucccucuguuauuaucgaugcugacgccauguucagcgaagauauuuccuacuuuggcuauccgagcuuccggagaucuucccuuagccgccugggcucuagccgggugcuccugcugccucucgagagagacagcgaacugcuucgcgagcgggaauccgugcugagacuccgcgagcggagauggcuggauggggcuucuuuugacaaugagcgcggaagcaccuccaaggaaggcgagcccaaccuugauaagaaaaacacaccuguccagucucccgugagccugggggaagaccuccagugguggcccgacaaggauggaaccaaauucaucugcauuggcgcccuguacuccgagcugcucgcgguuagcucuaagggggaacuguaucaauggaaaugguccgagagcgagccuuaccggaaugcccagaacccgucucuucaccaccccagagcuacauuucugggccucaccaaugaaaagaucgugcugcuguccgccaacagcauccgggcuacggucgccacagagaauaacaagguggccaccuggguugacgaaacacuuucuagcguggcuuccaaacucgagcauaccgcgcagaccuauagcgaacugcaaggagagcgcauugucucucugcacuguugcgcccucuacacaugugcucagcuggaaaauagccuuuacugguggggcguggucccuuucagccagagaaagaaaaugcuggaaaaggcccgggccaaaaacaagaaacccaaguccucugcugggaucagcuccaugccuaauauuacggugggaacccagguuugccucagaaacaauccccuguaucaugccggcgcgguggcuuuuucuaucagcgccgggauuccgaaggucggagugcugauggaguccguuuggaacaugaaugauucuugucgcuuccaacuucggagcccugaaucccucaaaaacauggagaaggccagcaaaacaaccgaggcuaagcccgaaucuaaacaggagccugugaagacagaaaugggacccccucccuccccggccucuaccugcuccgacgcuuccagcaucgccucuuccgcgagcaugccuuacaagagacgcagauccacgcccgcccccaaagaggaagagaaggucaaugaggaacaguggagccugcgggaggugguguuuguugaagaugucaaaaacgugccuguggggaagguccugaaaguggacggcgcuuauguugccgugaaguucccgggaacaucuagcaacaccaauugucagaacuccucuggccccgaugcugacccuagcucccuccugcaagauugccgccuucugagaaucgacgagcuccaggucgugaagaccgggggaacacccaaaguuccugauuguuuccagcggacccccaagaaacugugcauuccugaaaagacagagauccuggccgugaaugucgacucuaaaggcgugcacgcgguucuuaagacggggaacugggugcgcuacugcauuuuugaucucgccaccggaaaggcugagcaggaaaauaacuuccccacaagcuccaucgccuuucugggccaaaaugagagaaacgucgcuauuuucaccgccgggcaggaaucuccgaucauccugcgggacggcaauggaacaauuuauccuauggccaaagacuguaugggcgggauccgcgaucccgacuggcucgaucugccucccauuagcucccuuggaaugggcgugcacagccugaucaaccucccggcuaauucuaccauuaagaaaaaggcggccgugaucauuauggcugucgagaaacagacgcugaugcagcauauccugagaugcgacuacgaagccugucggcaauaucuuaugaaccucgagcaggccguugugcuggagcagaaucugcaaaugcuccagaccuuuaucucccaccgcugcgaugggaacagaaauauucugcaugcuugugugagcgucugcuucccuacaucuaacaaggaaaccaaagaggaagaggaggccgaacgguccgagagaaacacauuugcggaacgccuuagcgcuguggaggccaucgccaaugcuauuuccguugugucuagcaacggacccggcaaucgggccggguccuccucuagcagaagccugcgccuccgggaaaugaugagacgcucucugcgggcggcuggccugggaagacacgaggccggcgccagcuccucugaccaucaggauccugucuccccgcccaucgcuccuccguccugggugcccgacccucccgccauggauccugacggggauauugacuucauccuugcucccgccguuggaucucugaccacggcggccacaggcaccgggcagggaccuagcacauccaccaucccgggccccagcaccgagccuucuguggucgaauccaaggaucgcaaggcuaacgcccacuuuauucucaaacugcucugugacagcgugguucugcaacccuaccuucgggagcugcucuccgcuaaggacgccagaggcaugacaccuuucaugucugccgugagcgggcgggcuuaccccgcggccaucacgauucuggaaaccgcucagaaaaucgccaaggccgagauuuccucuagcgaaaaagaggaggaugucuuuaugggaauggugugcccguccggcacaaauccugacgauagcccccuguaugugcuuuguugcaacgacaccuguucuuucacauggaccggggcugaacacaucaaucaggauaucuuugagugccgcacgugcggacugcucgaaucccuguguugcuguacagagugcgccagagucugucauaagggccacgacugcaagcucaaacggaccagccccaccgcguacugugauugcugggaaaaguguaaaugcaagacacugauugcugggcagaaaucugcccgccuugaccugcucuauagacugcugaccgccacaaaccuuguuacgcugccuaauucccggggagagcaucuccugcuguuccuggugcaaaccguggcuagacagacagucgagcacugucaguacagacccccucggaucagagaagaucgcaaccggaagaccgccagcccggaggacucugauaugcccgaccacgaccuugaaccucccagauucgcgcagcuggcucuggagcgcgugcuccaagauuggaaugcccucaagagcaugauuauguuuggcucccaggagaacaaagacccucuuucugccagcucccggaucggccaucugcuccccgaggaacagguuuaucugaaucaacagagcgggacaauuagacucgauugcuucacccacugccugaucgugaaguguacggcugacauccuucugcuggauacccuccugggaacacuugucaaagaacugcagaacaaguacaccccgggccgcagagaggaagccauugcugugacaaugcgguuucuccgcuccguugccagaguguucgucauccugucuguggagauggcgagcuccaaaaagaagaauaacuuuauuccucagcccaucgggaaaugcaagcgggucuuccaagcccuccugccuuaugcuguggaggaacuuuguaacguugccgagucucugauugugcccguccgcaugggaaucgcuagaccuaccgcccccuuuacacuggccagcaccuccauugacgcuaugcagggcucugaggaacuguucagcguggaaccgcugccuccccggcccuccagcgaucagucuuccuccucuagccagagccaaucuuccuacaucaucagaaauccucagcagcgccggauuagccagucccaaccgguuagagggcgcgacgaggagcaggaugacaucgugagcgcggaugucgaagagguggaagugguugagggagucgccggcgaagaggaccaucacgaugagcaggaggagcacggcgaagagaacgcugaggccgaagggcagcacgacgagcacgacgaagauggaucugacauggagcuugaucugcucgccgcugccgaaacggagagcgacuccgagucuaaucauagcaaccaagauaaugcguccggccggagaucuguggugacagcugccaccgccgggagcgaagcuggagccuccucuguccccgcguuuuucagcgaggacgauucccagagcaacgacucuuccgauagcgacucuuccagcucccagucugaugacauugaacaagagaccuuuaugcuggaugaaccucucgagcggacaaccaauagcucccacgccaacggcgcugcccaggcuccccgcagcaugcagugggccgugagaaauacgcagcaucaacgggcugccucuacagcgccuuccagcaccucuacacccgccgcuagcuccgccgggcugaucuacauugacccuucuaaccuucgcagaagcggaaccaucuccacaucugcugccgccgcugcggccgcucuggaggccagcaaugccuccagcuaucugaccucugcuuccagccucgcccgggcguacuccaucguuauucgccagaucucugaccugaugggccuuauuccgaaauauaaccaccugguguacagccagauccccgccgcugucaagcucacguaucaggaugccgugaaucugcaaaacuacguugaagagaaacugauuccuaccuggaauuggaugguguccaucauggacucuacagaagcucagcucagauauggcagcgcccuugcguccgccggggaucccggacauccuaaccacccccugcacgcuagccaaaauucugcccggcgcgagagaaugaccgcucgggaagaggccucccugagaacacucgagggccgccggagagcuacccugcuuagcgcccgccaggggaugaugucugcgcggggagacuuccugaacuacgcccucucccugaugagaagccauaacgaugaacacucugacguccugccggugcucgauguuugcucccuuaagcauguggcuuacgucuuucaagcccugaucuauuggauuaaagcuaugaaucagcagacgacacuggacaccccucaacucgagcgcaagcggacaagagaacugcuugagcugggcaucgauaacgaggacagcgaacacgagaaugaugacgacaccaaccagucugccacccucaaugauaaggacgaugacagccugcccgccgaaacagggcagaaccaccccuucuuccgccgguccgauagcaugacguuucugggauguauuccucccaauccuuucgaggugccgcucgcggaagcuaucccccuugccgaccagccucaucugcugcaacccaacgcuagaaaagaggaucucuuuggccgcccuucccagggccuguacucuagcuccgccucuagcgggaagugccuuauggaggugaccgucgaccggaauugucuggaaguucuccccacaaaaauguccuaugccgcuaaccugaagaaugugaugaacaugcagaauagacagaaaaaggagggagaggaacagccggugcugccugaagagaccgagucuagcaagcccggcccuuccgcccacgaucucgcggcccagcuuaaaagcucucugcuggcugaaauugggcucacagaguccgaaggacccccucugaccagcuuccgcccccagugcucuuuuaugggcauggucaucucccaugacaugcuucuggggagauggcggcucagccuggagcuguucggacgcguguuuauggaagauguuggcgccgagccgggcucuauucucacggagcuugggggauucgaagugaaggaguccaaauuuagacgggaaauggagaagcugagaaaccagcaaagccgggaccugucucucgaggucgaucgcgacagagaccugcuuauccagcagacaaugcggcagcugaauaaccacuucggccgcagaugugcuaccaccccuauggccgugcaucggguuaaagugacauuuaaggaugaacccggggagggauccggcgucgcgcgcagcuucuacaccgccaucgcucaagccuuccucagcaacgaaaagcugcccaaucuggagugcauucagaacgcuaauaaagggacacacacgucccucaugcagagacuucggaaccgcggagaaagagaccgggagcgcgagagagaacgggagaugcgcagaucuagcggccugcgggccggcuccagacgcgaucgggacagagauuuucgccggcaacugucuaucgacaccagaccuuuccgcccggcuagcgaagggaaucccuccgaugacccugagccccucccugcccaccggcaggcgcugggagaaagacuuuauccccgcgugcaggccaugcagccugcuuuugccucuaagauuacaggcaugcugcucgagcugagccccgcucaacugcuccuucugcuggccuccgaggauagccuccgggccagagucgacgaagcgauggagcugaucauugcucaugggcgcgaaaacggagccgauucuauccuugaccugggccucguggacuccagcgagaaaguucaggaaaaucggaagagacacgggucuucccggagcgugguggauauggaccuggaugacaccgaugacggcgaugacaacgccccgcuguucuaccagccuggaaaaagaggcuuuuauacaccccgcccugggaagaauaccgaggcucggcucaacuguuucagaaauaucggacgcauucuuggccugugccugcuccagaacgagcugugccccaucacgcuuaauagacaugucauuaagguucugcucgggcggaaagugaacuggcacgauuuugccuucuuugacccggugauguacgaaucccugcgccaacugauccucgcuucucagagcuccgaugccgacgcggucuucucugccauggaucuugcuuuugccauugaccuguguaaggaggaaggaggcggacagguggagcugaucccuaauggcguuaacauccccgugacaccccagaacgucuacgaguaugugagaaaauacgcugaacaccggaugcucgucguggccgagcaaccucugcaugcgaugcgcaagggacuucuggacguucuccccaaaaauagccuggaagaucugacagccgaggacuucagacuccuggugaacggcugcggggaagucaaugugcagaugcuuauuuccuuuaccagcuucaacgaugagucuggagagaaugcugaaaagcugcuccaguucaagcggugguuuugguccaucguugagaaaaugagcaugacagaacgccaagaccugguguauuucuggaccucuagcccuucccuuccggccucugaggaaggcuuucagcccaugccuagcauuacaaucagacccccugaugaccagcaucugcccacggcuaacaccuguauuucccggcucuacgucccucuguauagcucuaagcagauccugaaacaaaagcuccugcuugccauuaaaacaaagaauuucggguuuguguga

SEQ ID NO: 77555 - RNA, 1278 nt, Artificial Sequence
  derived and/or modified sequence opt5 from UBR7__Homo_sapiens__NP_786924
auggccggcgcugagggggccgcgggaagacagagcgaacuggagcccguggucucccucguugacgugcuggaagaggaugaagaacuugagaacgaggcuugcgccgugcugggcgggucugacagcgagaaguguuccuacucucaaggaagcgucaaacggcaggcccucuaugcuugcuccaccuguacaccugaaggcgaggagccggccgggaucugccuggcuuguucuuacgaaugccacggaagccauaaacuuuucgagcuguauacgaagcgcaauuuuagaugugauugcggcaacuccaaguucaaaaaucucgaauguaagcugcugcccgacaaggccaaagugaacagcggcaauaaguacaacgauaacuuuuucgggcucuauugcauuuguaaacggccuuaccccgacccugaggaugaaauccccgacgagaugauucagugcguugugugcgaggauugguuucacggacgccaucugggcgcgaucccuccggaaucuggggacuuccaggagauggucugucaagccugcaugaagagauguuccuuucuuugggcuuaugccgcucagcuggccgugaccaaaauuagcacagaagaugacggacucguucggaauaucgauggcaucggggaccaggaggugauuaagcccgaaaauggagagcaccaggacucuacccugaaggaggaugucccugaacaaggcaaagacgaugugcgcgaggugaaggucgaacagaacuccgagcccugcgcgggcucuagcuccgaaagcgaccuucagacaguuuucaaaaaugagucccugaacgccgagucuaagagcggguguaaacuccaggaacugaaggcuaaacaacugaucaagaaggauaccgccacauacuggccucucaauuggagauccaaacugugcaccugucaggacugcaugaagauguacggagaucuugacgugcuguuucucacggaugaguaugacaccgugcuggcuuacgaaaacaaaggcaagauugcccaggccacagaucggagcgacccccuuauggacacccugucuuccaugaaucgcguccaacagguggagcucaucugugaguauaacgaucugaaaacagaacugaaggacuaccucaagagauucgcugaugaggggaccguugugaaacgggaagacauucagcaguuuuucgaggaauuucaaagcaagaaacgcagacgggucgauggaaugcaguauuacugcucuuga

SEQ ID NO: 77556 - RNA, 705 nt, Artificial Sequence
  derived and/or modified sequence opt5 from UBTD2__Homo_sapiens__NP_689490
augggcgggugcgugggagcccagcacgacagcuccggcucucugaacgagaauagcgaagggaccggagucgcucucggcagaaaccaaccccugaagaaagagaagccuaaauggaaguccgauuacccgaugacagacgggcagcuucggucuaaacgcgaugaguucugggacacggcccccgcguuugagggaagaaaggaaaucugggaugcucugaaggccgccgcucaugccuucgagagcaaugaccacgagcucgcucaggccauuaucgauggcgcgaacauuacccugccucauggcgcccuuacagaauguuaugacgagcuggggaaucgguaccagcuccccguuuauugccuggcuccucccaucaacaugauugaagagaaauccgauaucgagacccuggacaucccugaaccgcccccuaauucuggauacgagugucaacuccgccugagacuuagcacaggcaaggaucugaaacucguggugcgguccaccgacacagucuuucacaugaagcgcagacugcaugccgcugaagggguggagcccggaagccagcggugguucuuuucuggccgcccucuuaccgauaaaaugaaguucgaagaacugaagauucccaaagacuauguugugcaggucaucgugucccagccgguucaaaacccuacgcccguggagaauuga

SEQ ID NO: 77557 - RNA, 2184 nt, Artificial Sequence
  derived and/or modified sequence opt5 from UBTF__Homo_sapiens__NP_001070151
augaacggcgaggccgacugccccaccgaucuggaaauggcugccccuaaggggcaggacagauggagccaagaggauaugcucacacugcuugaauguaugaaaaauaaccugccguccaaugacucuagcaaguucaaaacgaccgagucccacauggauugggaaaagguggcguuuaaagacuucucuggagauaugugcaagcucaagugggucgagaucagcaacgagguucggaaauuucgcacacugaccgaacuuauucuggacgcucaggagcaugugaagaaucccuacaaaggcaagaaacucaagaagcacccugauuuccccaaaaagccucugacacccuauuuuagauucuuuauggaaaaacgggccaaguacgccaaacugcauccugagauguccaaccucgaccugaccaagauccuuucuaaaaaguauaaggagcugccggaaaagaagaaaaugaaguacauucaggauuuccagcgcgagaaacaagaauuugagagaaaucucgcucgguuccgcgaagaccaccccgaucugauccagaacgccaaaaagagcgacauuccugagaaacccaagacaccucagcagcuuugguauacccaugagaaaaagguguaccugaaagucagacccgacgaaaucaugcgggauuauauccaaaagcacccggagcucaauauuuccgaagaggggaucaccaagagcacgcugacaaaagcugaacgccagcugaaggacaaauuugauggaagaccuaccaagcccccucccaacucuuacucccucuacugugccgagcugauggcgaauaugaaagacgugcccagcacagagcggaugguucuuugcucucagcaguggaagcugcucucccaaaaggaaaaagaugccuaucacaagaaaugugaccagaagaaaaaggauuacgagguggaacugcuucgcuuccuggagagccucccugaagaggagcagcaaagaguccugggcgaagagaaaaugcugaacauuaauaagaagcaggcuaccucuccggccuccaaaaagcccgcucaggaagggggaaaaggcggcagcgagaagccuaaacggcccguguccgccauguuuaucuucucugaggaaaagcgcagacagcuccaagaggaacggccugagcugagcgaauccgagcuuacgagacugcucgcgcgcauguggaacgaccugagcgagaagaaaaaggccaaauauaaggcucgggaagccgcucuuaaagcccagucugagagaaagcccgggggagaacgcgaggaacggggcaagcugccggaguccccuaaaagagccgaggaaauuuggcagcagagcguuaucggggauuaccucgcucgcuucaagaaugaccgggugaaagcgcugaaggccauggagaugacauggaacaacauggagaaaaaggaaaagcugauguggauuaaaaaggcugccgaagaucagaaaagauaugagcgcgagcucucugaaaugcgggcucccccugccgccaccaauagcuccaagaaaaugaaguuucaaggagagcccaaaaagccucccaugaacggcuaccagaaguucucucaggaacugcuuagcaauggggagcugaaccaucucccgcugaaagagagaauggucgaaaucggaucccgcuggcaacggaucagccagucucagaaggagcacuauaaaaagcuggcggaggaacagcaaaaacaguacaaggugcaucuugaccucugggugaagucccugagcccucaggacagagcugccuacaaagaauauauuucuaauaagcggaaauccaugacaaagcugcgcggccccaaccccaaaagcuccagaaccacccuccaaucuaagagcgaguccgaggaagaugacgaggaagaugaggacgaugaagacgaggaugaggaagaggaagacgaugagaauggcgacucuagcgaagaugggggagacuccagcgagucuuccagcgaggaugaaucugaggacggcgacgaaaacgaggaggaugacgaagaugaggacgaugacgaagaugacgaugaggacgaagauaaugaguccgaggggagcucuagcuccucuagcuccagcggagacuccucugauagcgacuccaacuga

SEQ ID NO: 77558 - RNA, 894 nt, Artificial Sequence
  derived and/or modified sequence opt5 from UBXN1__Homo_sapiens__NP_001273006
auggccgagcugaccgcucucgaaagccugaucgagaugggcuuccccagagggcgggccgaaaaggcgcuugcucugacaggaaaccagggcauugaggccgccauggacuggcucauggaacacgaggaugacccugauguggacgagccgcuggaaacgccccuugggcauauccugggacgcgagccuaccuccucugaacaaggcgggcucgagggaagcggcuccgcugccggcgaggggaaacccgcucugucugaagaggaaagacaggagcagacaaagcggaugcuggaacucgucgcccagaaacaacgcgagagagaggaacgggaggaacgcgaggcgcuggaaagagagcggcagcgcagacggcagggacaggagcuuagcgccgcucgccaaagacugcaggaagaugagaugcggcgcgccgcugaagagagacggagagaaaaggccgaggagcucgcggcccgccagcggguuagagagaaaauugaacgcgacaaggcugaacgggccaagaaauacggcggguccgugggaucucagccucccccuguggcuccggagcccggcccuguccccagcuccccuagccaagagcccccgaccaagagagaauaugaucagugccgcauccaggugcggcugccugacgggacaucucuuacccaaacauuuagagcccgcgagcagcuggccgcuguucggcucuacguggaacugcacagaggagaggaacugggcggcgggcaggaucccguccagcuccuguccggauucccucgccgggcguuuagcgaggccgacauggagagaccccuucaagaacugggccucgugcccucugcuguucugauuguggccaaaaaguguccuuccuga

SEQ ID NO: 77559 - RNA, 780 nt, Artificial Sequence
  derived and/or modified sequence opt5 from UBXN2A__Homo_sapiens__NP_859064
augaaggacguggauaaccugaaaagcaucaaggaggaaugggucugcgagaccggcuccgacaaucagccccucgggaacaaucaacagucuaacugugaauacuucguugauagccuguuugaggaagcccagaaaguguccucuaagugcgugagcccugcugagcagaaaaagcaagucgacgugaauauuaaacuuuggaagaacggauucacaguuaaugaugacuuuagauccuauucugauggcgccagccagcaguuccugaacuccaucaagaaaggggagcucccgagcgaacugcagggaauuuuugacaaggaggaaguggaugucaaaguggaggacaagaagaaugagaucugucuuucuacgaaacccguuuuccaaccuuuuuccggccaggggcaccggcugggaagcgcgacccccaagauugugucuaaagcuaagaacaucgaagucgagaauaaaaacaaucucuccgccgugccucugaacaaucuggaacccaucacaaacauucagaucuggcucgccaacggcaagcgcauugugcagaaauucaauaucacccauagagucagccacauuaaggauuuuaucgagaaguaccaaggcucucagcgguccccuccguucagccuggcuacagcccuucccguucugcgccuccuggacgaaacccuuacacuggaggaggcugaucuccagaacgccgugauuauccaaagacugcagaaaaccgcguccuuucgggaacugucugagcauuga

SEQ ID NO: 77560 - RNA, 996 nt, Artificial Sequence
  derived and/or modified sequence opt5 from UBXN2B__Homo_sapiens__NP_001071087
auggccgagggcgggggacccgaaccuggcgagcaggaaagacggagcuccgggccgagacccccuucugcuagagaccugcaacucgcccuggcggagcuuuacgaagaugaggugaagugcaaaagcuccaagucuaaccggcccaaagcuaccgucuucaagagcccucgcacacccccucagagauuuuauuccucugagcacgaauacagcggacugaauaucguucggccguccacgggcaaaauugugaacgaacucuucaaggaggcccgcgagcauggggccgugccccugaaugaggcuaccagagccagcggagacgauaagucuaaauccuuuacaggcggcggguaucggcuuggaagcucuuucuguaagcgcuccgaauacaucuauggcgagaaccagcugcaggacguccaaauucuccugaaacuguggagcaauggguuuucucucgaugacggagaacugagaccuuacaacgagcccaccaaugcucaguuccuugaauccgugaagcggggcgagaucccucuggagcuccagcgccugguucacgggggacaggugaaccuugauauggaagaccaucaagaucaggaguauauuaaacccagacugcgguuuaaggccuucagcggcgaaggccagaagcucgggucccugacaccggagaucgucucuaccccuagcucccccgaagaggaggacaaaagcauccugaaugcggugguucucauugaugacucugugccuacaaccaagauccagauucgccuggccgauggauccagacuuauccaacgguuuaacagcacgcaccgcauucuggacguccgcaauuucaucgugcagucucggcccgaauuugcugcccucgacuucauucuggugaccagcuuucccaacaaagagcuuacagaugaaucccugacccuccuggaggcugacauccugaauacaguccuccugcagcaacuuaaguga

SEQ ID NO: 77561 - RNA, 1527 nt, Artificial Sequence
  derived and/or modified sequence opt5 from UBXN4__Homo_sapiens__NP_055422
augcugugguuccagggcgccauccccgcugccauugcgaccgcuaagagaagcggggccguguuugucguuuucguggccggagacgaugagcaauccacacagauggcugccucuugggaagacgauaaagugacggaggcuagcuccaacucuuuugucgccaucaagauugacaccaaaagcgaagcgugccuccaguucucccagaucuacccugugguuugugugccgucuagcuuuuucauuggcgauuccgggaucccccuggaggucaucgccggaagcgugucugcugacgaacuuguuacacggauucacaaggugcgccaaaugcaucugcucaaauccgagaccagcgucgccaauggcucucaguccgagagcucuguguccacaccuagcgcuuccuuugaacccaacaauaccugcgagaacucucagagcagaaaugccgaacugugugagaucccucccacauccgauaccaagagcgacacggcgaccgggggagagucugccggccacgcuacauccagccaggaaccuucuggcugcagcgaucaacggccggccgaggaccuuaacauucgcguggaaagacugaccaagaaacucgaggaacggcgcgaggagaagagaaaagaagaggaacagcgggagaucaagaaagaaauugagcgcagaaagacagggaaggagaugcuggauuauaaacggaagcaggaagaggaacugaccaaacgcaugcucgaggaaagaaaucgggagaaggcugaggaccgcgccgccagagaacggaucaaacagcaaauugcucuggauagagcggagcgcgccgcucgguucgccaagacgaaagaagaggucgaggccgcuaaggccgcggcccuucuggcuaagcaggccgaaauggagguuaaaagagaauccuacgcucgcgagcggucuacaguggccagaauccaguuucgccuccccgacggaagcuccuucaccaaccaauuuccuagcgacgcuccccuggaagaggcccggcaguucgcggcccagacagugggcaauaccuaugggaacuuuucucuugcuaccauguucccuagacgcgaguucacaaaggaagauuacaaaaagaaacugcucgaccuggagcuggcccccuccgcuagcgucgugcuccugccggccggacggccuacggcgucuaucguucauuccagcuccggcgauauuuggacccuucuggggacagugcucuaucccuuucuggccaucuggagacuuauuucuaauuuccuguuuagcaacccuccucccacccagacauccguccgcgugaccucuagcgaacccccgaaucccgcuuccagcucuaaguccgagaagcgggaaccuguuagaaaacgggugcucgagaagcgcggagacgauuucaaaaaggagggcaaaaucuacagacugcggacgcaagacgauggcgaagacgagaacaauacauggaacgggaacagcacccagcagauguga

SEQ ID NO: 77562 - RNA, 672 nt, Artificial Sequence
  derived and/or modified sequence opt5 from UCHL1__Homo_sapiens__NP_004172
augcagcugaagcccauggagaucaacccugaaaugcucaauaaagugcugagcagacuuggcgucgccgggcaauggcgguucguugacgugcugggacucgaggaagagucccugggcucugugccggcucccgccugcgcgcuucugcuccuguuuccucugaccgcucagcacgaaaacuuccgcaagaaacagauugaggagcucaaggggcaggaagucagccccaaaguguacuuuaugaagcaaacaaucggaaauuccuguggcacgauugggcugauccaugccguugccaacaaucaggauaaacuuggauucgaggacggcucugugcugaagcaguuucucagcgaaaccgagaagauguccccugaggauagagcuaaaugcuucgaaaagaacgaggccauucaggcugcccacgacgcggucgcccaagaaggccagugucggguggaugacaaaguuaauuuucauuucauccuguuuaacaauguggaugggcaccuuuaugagcuggacggacgcaugcccuucccugucaaccauggcgcuucuagcgaagauacacuccugaaggacgccgcuaaggugugcagagaguuuaccgagcgggaacagggggaggugcgcuucuccgccgucgcgcuguguaaagccgcuuga

SEQ ID NO: 77563 - RNA, 693 nt, Artificial Sequence
  derived and/or modified sequence opt5 from UCHL3__Homo_sapiens__NP_005993
auggagggccagagauggcugccccucgaagccaacccugaggugaccaaucaauuccugaagcagcuugggcugcacccgaacuggcaguuugucgacguuuacggaauggaucccgaacuccugagcauggugccucggcccgugugcgcuguccuucuccuguucccuaucacagagaaauaugaaguguuucgcacggaggaggaagagaagauuaaaucccagggccaagacguuaccucuagcguguacuucaugaagcagacaaucuccaaugccugugggaccauuggacugauccaugcgauugcuaacaauaaagauaagaugcacuuugaaucuggcagcacacugaagaaauuccucgaggaguccgucucuaugagccccgaagagagagcccgguaucuggaaaacuacgacgccauccgcgugacccaugagacauccgcucacgaagggcagaccgaggccccuagcaucgaugagaagguugaccuucauuuuauugcucuggugcacgucgauggacaccucuaugaacuggacggcagaaaaccguuccccaucaaucauggcgagacgucugaugaaacccuucuggaggacgccauugaagugugcaagaaauuuauggagcgggauccugacgagcuccgcuucaacgcgaucgcccuguccgcugccuga

SEQ ID NO: 77564 - RNA, 987 nt, Artificial Sequence
  derived and/or modified sequence opt5 from UCHL5__Homo_sapiens__NP_001186190
augaccggcaacgccggggaguggugccugauggaaagcgaccccggaguguucacagagcucaucaagggcuuuggguguagaggagcucaggucgaagagauuuggucccuggaaccugagaauuucgagaaacuuaagccgguucacggccugaucuuucucuucaaauggcaacccggggaggaaccugccggaucuguggugcaggauagccggcuggacacgauuuucuucgcgaagcaggucaucaacaaugcuugcgccacccaggccauuguguccguucuucugaacuguacacaucaagaugugcaccucggcgaaacccugucugaguuuaaagaguucagccaguccuuugacgcugccaugaagggccuggcucucucuaauagcgaugucauccgccaggugcauaacuccuucgccagacagcaaauguuugaauuugacacaaagaccagcgcgaaagaggaagaugccuuucacuucguuucuuacgugcccgucaaugggcggcuguaugagcuugacggacugcgcgaaggcccuaucgaucucggggcuugcaaccaggacgauuggauuuccgccgugagacccgugaucgagaagcggauucagaaauacagcgagggagaaauccgcuucaaucugauggcuauugucucugacagaaagaugaucuaugagcagaaaauugccgaacuucaacggcagcuggcggaggaaccuauggauacagaccagggcaacuccaugcucagcgccauccaaucugagguugcuaagaaucagaugcugaucgaggaagaggugcagaagcugaaacgcuacaagauugaaaacaucagacggaaacauaauuaucucccguuuauuauggagcugcuuaagacccuggccgaacaccagcaacucaucccccugguggagaaagcuaaggagaaacagaacgccaagaaggcccaggaaacgaaauga

SEQ ID NO: 77565 - RNA, 606 nt, Artificial Sequence
  derived and/or modified sequence opt5 from UCK1__Homo_sapiens__NP_001129426
auggccagcgcuggcggggaggacugcgaaucccccgccccugaggcggauagaccgcaccagcggcccuuccugaucggagugucuggcgggaccgcuagcggaaaguccacagucugugagaaaauuauggaacuccugggccaaaacgaaguugagcagcgccagagaaagguggugauccuuucucaggaccgguuuuacaaaguccugacggccgagcaaaaggccaaagcucucaaggggcaguauaauuucgaucauccugacgccuuugauaacgaccugaugcaccgcacccuuaagaauauuguggaaggaaaaacaguugaggugcccaccuacgauuucgucacacauagcagacugccugaaaccacagugguuuaucccgcugacgugguccucuuugagggcauccugguguucuacucccaggagauucgggauauguuucaucugcgccucuucguggacaccgauucugacgucagacugagccggcgcgauaaggaaguuugcagaugugaccacccugcccgguccggccaguaugggugccaccaaccggaccgcgcggcccaccccggacauagcgagugguga

SEQ ID NO: 77566 - RNA, 786 nt, Artificial Sequence
  derived and/or modified sequence opt5 from UCK2__Homo_sapiens__NP_036606
auggccggcgacagcgagcagacccugcaaaaccaccagcagcccaaugggggagaaccuuuccucaucggcguguccgggggaacagcuucuggcaagagcuccgucugcgccaaaauuguucagcugcuugggcaaaacgagguggauuacagacagaaacagguggucauccugucucaggacagcuuuuaucgggugcucacguccgaacaaaaggcgaaggcucugaaaggacaguucaauuuugaucauccggacgccuucgauaacgagcuuauucugaagacccucaaggaaaucacagagggcaaaaccguucagauucccguguacgacuuugucucucacagccgcaaggaggaaacagugaccguuuauccugccgaugugguccuguucgagggcauccuggcuuuuuacucccaggaagugagagaccucuuccaaaugaaacuguuuguggauacagacgccgauacccggcuuagccgcagaguccugcgggacaucucugagcgcgggagagaucucgagcagauucugucccaguauaucacguucguuaagcccgcuuuugaagaguucugucuuccuaccaaaaaguacgccgacgugauuaucccccggggagcggacaaucugguggccauuaaccucaucguccaacauauucaggauauccugaauggcgggccuagcaagcgccagacaaacggaugccugaauggcuauaccccgucuagaaaacggcaggcuuccgaaucuagcucccgcccccacuga

SEQ ID NO: 77567 - RNA, 1602 nt, Artificial Sequence
  derived and/or modified sequence opt5 from UCKL1__Homo_sapiens__NP_001180308
augagcucucccccugccuacccgggcaucagaauuuccgggugccgggcucugggagccgagggcagcuccaacgcggaaucucucgaccgccugcuucccccuguggggaccggaagaagcccccggaagcgcacaacgucccaguguaaaucugagccuccccugcucagaaccagcaagcggacaaucuauaccgcuggccgcccuccgugguacaaugaacacgggacacaauccaaagaggccuucgccauuggacugggcggcgggagcgcuucuggaaagaccacagucgccagaaugaucauugaagcucuugauguucccuggguggugcugcucuccauggacagcuuuuauaaaguccugaccgagcagcagcaggagcaagccgcgcauaacaauuucaacuuugaucacccugacgccuucgauuuugaccugaucaucucuacgcucaagaagcugaaacagggcaaguccgugaaaguucccauuuacgauuucaccacacauagccggaagaaagacuggaagacccuuuauggggcuaaugugaucauuuuugaaggaaucauggccuucgcugauaagacacugcucgagcugcuugacaugaaaauuuuugucgauaccgacucugauauccgccuggugagacggcuccgcagagacauuuccgaacggggccgcgacaucgaggggguuaucaagcaguacaacaaauucgugaagccuagcuuugaucaguauauucaacccacgaugagacuggccgacaucgucgugccgcggggauccggcaauacaguggcgauugaucugaucguccagcacguucauucucagcucgaggaaagagagcugagcgugcgcgccgcucuugccuccgcucaccagugccacccucugccccggacccucagcgugcugaaaucuacaccucaagucagaggcaugcauaccauuauccgcgacaaggaaaccucccgggaugaguucaucuuuuacagcaaaagacuuaugcgccugcucauugaacacgcccugucuuuccugcccuuccaggacugugugguucagacaccccaagggcaggauuacgccggaaagugcuaugcuggcaagcagaucacgggggugagcauucuccgggcgggagagaccauggagccugcccugagagcugucuguaaagacgugcgcaucggcacaauucuuauccagaccaaccaacugacaggggaaccggagcuccauuaccugcggcuucccaaggauaucuccgacgaucacguuauucugauggacugcaccgugucuacgggagccgccgcuaugauggccgucagagugcuccuggaccacgaugucccugaagacaaaaucuuucugcucagccugcuuauggcggagaugggcgugcauuccguugcuuaugccuucccccgcgugcggauuaucacaaccgccgucgauaagagagugaaugaccuguuucggauuaucccuggcauugggaacuucggagaucgcuacuuuggcaccgacgcuguucccgaugggagcgacgaagaggagguggccuauacaggauga

SEQ ID NO: 77568 - RNA, 417 nt, Artificial Sequence
  derived and/or modified sequence opt5 from UCMA__Homo_sapiens__NP_660357
augaccuggagacaggccgugcugcucagcugcuucuccgcugucguucugcuuucuaugcugcgggagggcacaagcguguccguggggacgaugcaaauggccggagaagaggcgucugaagacgcuaagcagaaaaucuuuaugcaggagagcgaugccuccaacuuccucaagcgcagaggcaaacggucucccaagagccgcgacgaagucaauguggagaacagacagaaacugcggguugaugagcuucgcagagaauacuaugaggaacaacggaaugaguuugagaacuucguggaggaacagaaugacgaacaggaggaacgcuccagagaggccgucgagcaguggcggcaauggcacuacgaugggcugcauccuagcuaucucuacaaccgccaccauaccuga

SEQ ID NO: 77569 - RNA, 339 nt, Artificial Sequence
  derived and/or modified sequence opt5 from UCN2__Homo_sapiens__NP_149976
augaccagaugcgcccugcuccugcuuauggugcugaugcucggccggguccugguugugcccgugacaccuaucccgacguuccagcuucgcccccaaaacagcccucagaccacacccagaccugcugccuccgagucucccagcgcggcuccuaccuggccgugggccgcccagucccacuguucucccacacggcauccugggagccgcauuguccugucccucgacgugcccaucggacugcugcagauucuccuggaacaagcuagagcccgggcugcccgcgagcaggcgaccacaaaugccagaauccuugcucggguuggccacugcuga

SEQ ID NO: 77570 - RNA, 486 nt, Artificial Sequence
  derived and/or modified sequence opt5 from UCN3__Homo_sapiens__NP_444277
augcugaugcccgugcacuuccuccugcuucugcuccugcuucugggcgggccuagaaccggacucccgcauaaguuuuacaaagccaagcccaucuucagcugccugaacacagcucuguccgaggccgaaaaaggccagugggaggacgcgucucuccugagcaagcgguccuuucacuaucuucgcucuagagaugcuagcuccggggaagaggaagagggaaaagagaagaagacguucccuauuucuggcgcccgcgggggagcccggggcaccagauaccgguaugucagccaagcucagccccgcggcaaaccuagacaggacacagccaagagcccccaucggaccaaauuuacacugucccucgauguuccuaccaauaucaugaaccugcuuuucaauauugcuaaggccaaaaaccugcgcgcgcaggccgcugccaaugcucaccucauggcccaaaucgggagaaagaaguga

SEQ ID NO: 77571 - RNA, 375 nt, Artificial Sequence
  derived and/or modified sequence opt5 from UCN__Homo_sapiens__NP_003344
augagacaggccggccgggcugcccugcucgcggcucugcuucugcucgugcaacugugccccgggagcucccagcgcucuccugaggccgccggaguccaggacccgagccuuagauggucccccggcgcucggaaccaagggggaggcgcccgcgcucugcuccugcugcucgccgaaagauucccucggcgcgcggggcccggaagacugggccuuggcaccgccggggagcggccucgcagagauaaucccucucugagcaucgaccucacauuucaccuucugcggacgcugcucgaacuggcucgcacccagucccagagagagcgggccgaacagaaccgcauuaucuucgauucuguuggaaaguga

SEQ ID NO: 77572 - RNA, 924 nt, Artificial Sequence
  derived and/or modified sequence opt5 from UCP1__Homo_sapiens__NP_068605
augggcgggcugaccgccagcgacgugcaccccacacucggaguccagcuguucuccgcuggcaucgccgcgugccuugcugauguuauuacguuuccucuggacaccgccaaggugagacuccaagugcagggggaguguccgacaucuagcgucauccgguacaaaggagugcugggcaccauuacagccguugugaagaccgaagggcgcaugaaacuuuauuccggacugcccgcuggccuccagagacagaucucuagcgccucccugcggauuggccuguacgauacaguccaagaguuccucaccgcugggaaggaaacggccccuucucugggaagcaaaauccuugcgggccugaccacagggggaguggccguuuuuaucggccagcccaccgagguggucaaggugcgccuccaggcucagucccaucugcacgggauuaagccuagauauacaggaaccuacaacgccuaucggaucauugcuacgacagaaggccuuaccggccuguggaaagggacaacccccaaucucaugcgcagcgugaucauuaacugcaccgagcuggucacauacgaccugaugaaggaggccuucguuaaaaauaacauccucgcggaugacgugccuugucaucuggugucugcccuuauugcuggauuuugcgccacggcuauguccagcccggucgaugugguuaagaccagauucaucaauucucccccuggccaauauaaauccgugcccaacugugccaugaaggucuuuacaaaugaagggccuaccgccuucuuuaagggacuggugcccagcuuccuccggcugggcucuuggaacguuaucauguuugugugcuucgagcagcuuaaacgcgaacuguccaagagcagacagacaauggacugugcuaccuga

SEQ ID NO: 77573 - RNA, 930 nt, Artificial Sequence
  derived and/or modified sequence opt5 from UCP2__Homo_sapiens__NP_003346
auggugggcuucaaggccaccgacguucccccuacagcuacggucaaauuucugggggccggaaccgcggcuugcaucgccgaucucauuacauucccgcuggacaccgccaaggugagacuucagauccaaggcgagagccaggggcccgugcgggcuacagccuccgcucaguaccgcggagucaugggcaccauucugacaauggugagaaccgaagggccucggucucucuauaacggacugguugccggccuucagcgccaaaugagcuuugcguccgugagaaucggccuguacgauucugucaaacaguucuauacgaaggggagcgagcacgccuccauuggaucucggcuccuggcuggcagcaccacaggggcccuggcuguggccguugcgcagcccaccgacguggucaaagugcgcuuucaggcccaagcuagagccggaggcgggcggcgcuaccaguccacagugaaugcuuauaagaccaucgccagagaagagggauuccggggccucuggaagggcacgagcccuaacgucgcccgcaaugcuaucguuaacugugcggaacuggugacauacgaucuuauuaaagacgcccugcucaaggcuaaucugaugaccgaugaccuucccugccauuuuacaucugccuucggggccggauuuuguaccaccgugaucgcuuccccugucgaugugguuaaaacaagauauaugaacagcgcccugggccaguacucuuccgcggggcacugcgcucucacgaugcugcagaaggagggaccgcgggccuucuacaaaggcuuuaugcccagcuuccugcgccucgggucuuggaauguggucauguuugugaccuaugagcaacugaagagagcccuuauggcugccuguacaucccgggaagcuccuuucuga

SEQ ID NO: 77574 - RNA, 939 nt, Artificial Sequence
  derived and/or modified sequence opt5 from UCP3__Homo_sapiens__NP_003347
auggugggccugaagcccagcgacgucccuccgaccauggccguuaaauuccucggggcuggaacagccgcgugcuuugcugaucuggugacguucccccuugacaccgccaaggugagacugcagauccaaggcgagaaccaggccguccagacagcucggcucgugcaguaccgcgggguucugggaaccauucuuacaauggugagaaccgaaggcccuuguucccccuauaaugggcuggucgccggacuccaacggcagaugucuuuugcuagcauccgcauuggccuguacgauuccgugaaacagguuuauacaccuaagggcgccgacaacucuagccugaccacgagaauccucgcggggugcaccacaggagccauggcugugaccugugcccagcccacagaugucgugaaagugcgguuccaggcuuccauucaccugggcccuucucgcagcgacagaaaguacuccgggaccauggaugccuaucggacgaucgcgcgcgaggaaggagucagaggccuuuggaaggggacacugccgaauaucaugcggaacgccauuguuaauugcgcugagguggugaccuacgacauccucaaagaaaagcugcuugauuaucaucugcucacagacaacuuucccugucacuucgucagcgccuuuggagcuggcuucugcgccaccgugguugccucuccuguggaugucgugaaaacccgcuacaugaacuccccucccggccaauacuuuagcccccuggacuguaugauuaagaugguugcucaggaggggccgacagcguucuauaaaggauuuacgccuucuuuccugagacucggcuccuggaauguggucauguuugugaccuacgagcagcugaagcgggcccuuaugaagguccaaaugcugcgcgaaagccccuucuga

SEQ ID NO: 77575 - RNA, 1416 nt, Artificial Sequence
  derived and/or modified sequence opt5 from UEVLD__Homo_sapiens__NP_001035787
auggaguucgacugcgaaggccugagacggcuccuggggaaguacaaauuucgcgaucuuaccguggaggaacugagaaacgucaauguuuucuuuccccacuucaaguauagcauggacacauacguguuuaaagauuccucucagaaggaccuccugaacuucacgggaaccaucccugugauguaucaaggcaauacauacaacauuccgauccgguuuuggauucuugauagccaucccuucgccccucccaucuguuuucugaaaccuaccgcuaauauggggauucucgucggaaagcacguggacgcccagggccgcaucuaucugcccuaccugcagaacuggucccauccuaagucuguuaucguggggcucauuaaagagaugaucgcgaaguuccaggaggaacugccgauguauagccuuuccucuagcgaugaggcuagacaagucgaccugcucgccuacauugccaaaaucacagaaggaguguccgauaccaauagcaagucuugggcuaaccacgagaauaaaacaguuaacaagauuaccguggucggcggcggggaacugggaaucgccugcacgcuugcuauuuccgccaagggcaucgcggaccggcuggugcuccuggaucugagcgaggggaccaaaggagccacaauggaccucgagaucuuuaaucugcccaacguggaaauuucuaaggaucuuuccgcuagcgcccauucuaaagucguuaucuucaccgucaauucccugggcagcucccagucuuaccucgacguggugcagagcaacguggacauguuucgcgcucugguuccugcccuugggcacuauucccagcacagcgugcugcucgucgcgucucaacccguggagauuaugacauacguuaccuggaagcuguccacguucccugccaauagagugaucggaauuggcuguaaccuggauagccagcggcuccaguauaucaucacaaacguccugaaagcucagaccucuggcaaggaagugugggucauuggggagcaaggagaagacaaagugcuuacauggagcggccaggaggagguugugucccauaccucucagguccaacugagcaaucgcgccauggaacuccugagagugaaggggcagcgguccuggagcguuggacuuucuguggcugauauggucgacuccaucgugaacaauaagaaaaaggugcacagcguuucugcccuggccaaaggcuacuaugauauuaacuccgaggucuuccucagccugcccugcauccuggggaccaauggaguguccgaagugauuaagacaacgcucaaagaggacaccgucacagaaaagcugcagucuagcgcuuccucuauccauagccuucagcaacagcugaagcucuga

SEQ ID NO: 77576 - RNA, 801 nt, Artificial Sequence
  derived and/or modified sequence opt5 from UFD1L__Homo_sapiens__NP_001030324
auguucagcuuuaacauguucgaccaccccaucccuagaguguuucagaaucgguucuccacccaauaccgcugcuuuucugucagcaugcuggccggcccgaacgauagauccgacguugagaaagggggaaaaauuaucaugcccccuucugcucucgaucagcugagccggcuuaauauuacauaucccaugcuguucaagcucacgaacaaaaauuccgaccgcaugacccauuguggcgugcuggaauuuguggccgaugaggggaucugcuaccuuccucacuggaugaugcagaaccugcuccuggaagagggaggccugguccagguggaaucuguuaaucuccaaguggcgacauauagcaaguuccagccccaguccccugacuuucuggauauuaccaacccgaaagcuguccuugagaaugcccugagaaacuucgccugucucacaaccggggacgugaucgcuaucaauuacaacgagaagauuuaugaacugcggguuauggagacaaagcccgauaaagccgugagcaucauugaaugcgacaugaaugucgauuuugacgcuccucuuggauacaaggagcccgagcgccaggugcaacaugaagagucuaccgaaggcgaggccgaucacuccggcuaugcgggggaacugggauucagagccuuuagcggcucugggaaccggcucgacggaaagaagaaaggcguggagccuucccccagcccgaucaagccuggggacauuaagcgcggaauccccaauuacgaguucaaacugggcuga

SEQ ID NO: 77577 - RNA, 2385 nt, Artificial Sequence
  derived and/or modified sequence opt5 from UFL1__Homo_sapiens__NP_056138
auggccgacgcuugggaggaaaucagacggcuggccgcggauuuccagcgcgcucaauuugccgaggccacccagagacucagcgaacggaacugcauugagaucgugaauaagcugauugcucagaaacagcuugaagucguucacacacuggacggcaaggaguacaucacgcccgcccaaauuuccaaagagaugcgcgaugaacuccaugugagagggggacgggugaacaucgucgaccugcaacaggugaucaauguugaucuuauucacaucgagaaccgcauuggcgacaucauuaagucugaaaaacaugugcagcugguccucgggcaacugaucgaugagaauuaucuggacagacucgcugaggaagugaacgauaagcugcaggagagcggacagguuaccauuuccgaacuuuguaagacauacgaccugccuggcaauuuccucacccaggcccugacacaacggcuugggcgcaucaucucuggacacauugaucuggacaacagaggcgugaucuuuaccgaggcguucgucgcccggcauaaagcucgcauuagaggccucuuuagcgccaucacacggccgaccgcugugaauagccugauuucuaaguauggguuccaggaacagcugcucuacagcgugcuggaggagcuugucaacuccggacgccugagaggcacgguugucgggggacggcaagauaaagccguguuugugcccgacaucuauagcagaacccagucuacauggguggacuccuucuuucgccagaauggcuaccucgaguucgaugcgcugagccggcuugggaucccugacgccguuucuuauauuaagaaaagauacaagaccacacagcugcucuuucugaaggcugccugcgugggacaaggccuggucgaucagguggaggcuuccguugaagaggccaucagcucuggcaccuggguggacauugcuccccuccugccuacgucccuuagcgucgaagaugcugcgauccugcuccaacaggugaugcgcgccuucuccaaacaggcuucuacagucguguuuagcgacaccguuguggucuccgagaaguucauuaacgauuguacagagcuguuccgggaacuuaugcaccagaaagccgagaaggaaaugaaaaauaaccccgugcaccugaucaccgaggaagaccucaagcagaucagcacccuggagucuguuuccacaagcaaaaaggauaagaaagacgagagacgccggaaggccacggaagggucuggaagcaugagaggcgggggaggcgggaaugcucgcgaguacaaaauuaagaaagugaagaagaaaggacggaaggaugacgacuccgaugacgaaucucagagcucccauaccggcaaaaagaaaccugagaucagcuuuauguuccaggaugagauugaagacuuucugagaaagcacauccaggaugccccggaggaguucauuucugaacucgcggaauaucugaucaagccccuuaacaaaacauaccuggaggucgugcgcuccguguuuaugagcucuaccacauccgcuagcggcaccgggcggaagagaacgauuaaagaccuccaggaggaaguuuccaaccuguauaauaacauccggcuguucgagaagggaaugaaauuuuucgccgaugacacacaggccgcucuuaccaagcaucuccugaagucugucugcaccgauaucacaaaucugauuuuuaacuuccucgccagcgaccugaugauggcuguggaugacccugccgcgaucaccuccgaaauucgcaaaaagauccuuucuaaacugagcgaggaaacaaagguggcccucacgaaacugcacaauucccugaacgaaaagagcauugaggauuuuaucucuugucuugacuccgcugccgaggcuugcgacaucauggucaaaagaggcgauaagaagcgggaaagacaaauucucuuccagcaccgccaggcccuggcggaacaacugaaagugaccgaggaccccgcccucauccugcaucuuacaagcguucugcucuuucaguucucuacccacuccaugcugcaugcuccugggcggugugugccccagauuaucgccuuccugaauagcaagauuccggaagaucagcacgcccuucucgucaaauaccaaggacuggugguuaagcagcuggugucucagagcaaaaagacaggccagggggacuauccucucaacaaugagcuggauaaggagcaagaagacgucgccuccaccacgagaaaagagcuucaggaacuguccucuuccaucaaggaucucgugcugaaaagccgcaaguccucuguuaccgaggaguga

SEQ ID NO: 77578 - RNA, 312 nt, Artificial Sequence
  derived and/or modified sequence opt5 from UFM1__Homo_sapiens__NP_001273633
augaucagagccuuccccaccacaacgccucggagccugcaccucuuuaccuccucuacauuccuggcucgcgcccuuccgggcgcguuucccaccggggcuugcgaggaaagacugagcgugccugaguccacacccuucaccgccguccucaaguuugccgcugaagaguucaaaguuccugccgcuacaucugccauuaucaccaacgacggaauuggcaucaaucccgcgcagacggccgggaacguguuucugaagcauggaagcgaacuucggauuaucccucgcgauagagugggcuccuguuga

SEQ ID NO: 77579 - RNA, 1185 nt, Artificial Sequence
  derived and/or modified sequence opt5 from UGCG__Homo_sapiens__NP_003349
auggcccugcucgaccuggcucuugagggcauggccguguucggguuuguccuguuccucguucuguggcuuaugcacuuuauggcgaucauuuacaccagacugcaucucaacaagaaagcuacagauaagcagcccuauagcaaacugccuggagugucccugcucaagccgcugaaaggcguggaccccaaucuuaucaacaaucuggaaacguucuuugagcucgauuacccuaaguaugaaguccugcuuugcgugcaagaccacgaugaccccgccauugauguuuguaagaaacugcucgggaaguacccuaacguggacgcccggcuguucaucggaggcaaaaaggucgggauuaaucccaaaaucaacaaucugaugccuggauaugagguggcuaaguacgaucucaucuggauuugcgacucuggcauccgcguuauuccggauacccugacagacauggugaaccagaugaccgaaaaggucggccuugugcaugggcugcccuauguggccgauagacagggauuugcugccacacucgagcaggucuacuucggcaccagccacccucgguacuauaucuccgcgaauguuacaggguuuaaaugugugaccggaaugucuugccugaugcgcaaggacgugcuugaccaagccggcgggcugauugcuuucgcccaguacaucgcugaggauuauuuuauggccaaagcgauugccgacagaggauggcgguucgcuaugagcacgcaggucgccaugcagaacuccggcucuuacagcaucucccaauuucagagccgcaugaucagauggaccaagcuccggauuaauaugcugcccgcuacaaucauuugugaaccuaucucugagugcuucguggccucccugauuaucggcugggccgcucaucacguuuuccgcugggauaucaugguguuuuucaugugucacugccucgcgugguuuauuuucgacuauauccagcugagagggguccagggaggcacccuuuguuuuagcaaacuggauuacgccguggcuugguucauucgggaaucuaugacaaucuauauuuuucucuccgcccugugggaccccaccaucagcuggcgcacggggagauaccggcuucgcugcggaggcacagccgaggagauccuggauguuuga

SEQ ID NO: 77580 - RNA, 1284 nt, Artificial Sequence
  derived and/or modified sequence opt5 from UGDH__Homo_sapiens__NP_001171629
auguucgagaucaagaaaauuugcuguaucggcgccggguacgugggaggcccuaccugcagcgucauugcucacaugugucccgaaaucagaguuacagugguggacgucaacgagucccggauuaaugccuggaacucuccgacgcugcccaucuaugaaccugggcucaaggaggugguugaaagcugccgcggcaaaaaucuguuuuucuccaccaacaucgaugacgcgauuaaggaggcugaucuuguguuuaucucuguccugagcaaucccgaguuccucgccgaaggaacagccauuaaagaccugaagaacccugauagagugcuuaucgggggagacgagacccccgaaggccagcgggcuguucaagcccugugugcuguguacgagcauugggucccucgcgagaagauucucacaaccaauacaugguccucugaacugagcaaacuggccgcgaacgccuuucucgcucagagaaucuccagcauuaauucuaucuccgcccugugcgaggcuaccggcgccgauguggaagagguggcgacggccaucgggauggaccagcggauuggaaacaaguuccuuaaagcuagcgucggcuuugggggaucuuguuuccagaaggauguucugaaucucguguaucugugcgaagcccuuaaccugccggagguggcucgcuacuggcaacaggucaucgacaugaaugauuaucagagacggcgcuuugccuccagaauuaucgacagccucuucaacaccgugacagauaaaaagauugccauccugggcuuugcuuucaagaaagacaccggggacacacgggagucuuccagcaucuacauuuccaaguaucugauggaugaaggagcgcaccuccauaucuacgaccccaaaguuccucgcgagcagauuguggucgaucugucucaccccggcgugagcgaagacgaucaaguuuccagacuugugaccaucagcaaggacccuuacgaggccugugauggcgcucaugccgucgugauuugcacggaaugggacauguuuaaagagcuggauuaugagcggauccacaagaaaaugcucaagcccgccuucaucuucgacgggcgcagaguccuggauggacuucacaaugaacugcagacaauuggcuuucagaucgagaccauugggaagaaagugucuuccaagcggaucccguacgcuccuagcggagaaauucccaaauucucucuccaggacccucccaacaagaaacccaagguuuga

SEQ ID NO: 77581 - RNA, 4668 nt, Artificial Sequence
  derived and/or modified sequence opt5 from UGGT1__Homo_sapiens__NP_064505
augggcugcaagggggacgccagcggagcuugugccgcgggcgcucugcccgugaccggggucugcuacaaaaugggaguucucguggugcugacaguccuuuggcuguucuccucugugaaggccgauagcaaagccaucacgaccucccucacaaccaagugguuuucuacaccucugcuucuggaggcuagcgaauuucucgccgaggacucccaggaaaaauuuuggaacuucguugaggcuucucaaaauauuggcagcuccgaucacgacgggaccgauuauagcuacuaucaugccauccuggaagcggccuuucaguuccugucuccgcuccagcagaaccuguuuaaguucugucuuucccugagaagcuacucugcuacaauucaagccuuucagcagaucgcugccgacgagcccccucccgagggaugcaauuccuucuuuagcgugcacggcaagaaaaccugugaaucugauacgcucgaggcgcugcuucugaccgccuccgaacggccuaagccccuccuguucaaaggcgaccaucgcuauccuagcuccaacccggagucucccgucgugauuuucuacagcgagaucggguccgaagaguucagcaauuuccacagacagcugaucucuaaguccaacgcuggaaaaauuaauuauguuuuucggcauuacaucuucaacccucgcaaggaacccguguaccucagcggcuauggggucgagcuggccauuaagucuacagaauacaaagcuaaggaugacacccaagugaaaggaacagaggugaauaccacggucaucggcgagaacgauccuauugacgaaguucagggguuucuuuucggaaagcugagagaucuccaccccgaccuggagggccagcuuaaagaacugcggaagcaccucguggagagcacaaaugaaauggccccgcugaaaguguggcagcugcaagaccucuccuuucagaccgccgcucgcauccuggcgucuccugucgagcuugcccuggugguuaugaaggaucucagccagaacuuccccacaaaggcuagagccauuaccaaaaccgccguguccagcgagcugcggacagaagucgaggaaaaucaaaaguauuuuaaaggcacgcuugggcugcagccuggagacucugcucucuucaucaacggccugcauauggaucuggacacccaggauaucuuuucccucuucgacgugcugcgcaaugaggccagaguuauggaagggcuucaccggcugggaauugagggccucagccugcauaacgugcugaaacuuaacauccagcccucugaggcggauuacgcugucgacauucgcucccccgccaucagcugggugaauaaccucgaagucgauuccagauauaauucuuggccuagcucccugcaagagcugcuccggccgacauuucccggggugauucgccagaucagaaagaaccugcacaauaugguuuucaucguggacccugcccacgaaaccacagcugagcuuaugaacaccgccgagauguuucugucuaaucauauuccccuccggaucggauucauuuucgucgugaacgauagcgaagacguugacggcaugcaggaugcuggcguggccguccugagagcguacaauuauguggcccaggagguggacgauuaccacgcuuuucaaacgcugacacauaucuacaacaagguucgcaccggggaaaaggucaaaguggagcacguggucuccgugcuugaaaagaaauauccuuacguugaggugaauagcauucucggaaucgacucugccuaugaucggaacagaaaggaggcucgcggcuacuaugaacagaccggggucggaccccugccggugguucuguucaauggcaugccuuuugagcgggaacagcucgaccccgaugagcuggaaacaaucaccaugcauaaaauucuugagacaacgaccuucuuucagagagccguguaccugggggagcucccucacgaccaagaugucguggaauauaucaugaaccagcccaauguugugccucgcauuaacucccggauccugacagcggagagagacuaccuggaucuuaccgccagcaacaauuucuuugucgacgauuacgcucgcuucacaauucucgacucucagggcaagaccgccgcuguggccaacuccaugaauuaucugacgaagaaaggaaugagcucuaaggaaaucuacgacgauagcuuuauucggcccgugaccuucuggaucgucggcgacuuugauuccccgagcgggagacagcugcucuaugacgccaucaaacaccaaaagucuuccaacaauguucgcauuagcaugaucaacaauccugcuaaagagauuuccuacgaaaacacacagaucucucgggcgauuugggccgcucugcagacccaaacaagcaaugccgccaagaacuucaucaccaagauggcuaaagagggagccgcggaggcucuugccgccggcgcugauaucgccgaauuuuccgucgggggaauggacuucucucuguucaaggagguguuugaaagcuccaaaauggauuucauucucucucaugcgguguauugcagagacgugcugaagcugaaaaagggccagcgggcuguuaucagcaaugggcgcauuaucggcccccuugaggauuccgagcucuuuaaccaggacgauuuccaucugcuggaaaauauuauccucaaaacgagcggacagaagaucaagucucacauucaacagcugagaguggaggaagacgucgccuccgaucuugugaugaaaguugacgcccugcucagcgcucagcccaagggcgacccucggaucgaguaccaguuuuucgaagauagacacucugccauuaaacugcgcccgaaggagggggagacauauuuugacguggucgcugugguugaucccgugacccgggaagcccaaagacuggcgccucuucugcucguccuggcccagcucaucaacaugaaucugcgcguguucaugaacugucaguccaaacuuagcgacaugccccugaagucuuuuuacagauacgugcucgagccugaaauuuccuucacaagcgauaacuccuuugcuaagggacccaucgccaaauuccuggacaugccucagagcccccuguucacccuuaaucugaacaccccggagucuuggauggucgaaagcguucggacaccuuaugaucucgacaauaucuaccuggaggagguggauuccguggucgcugccgaauaugagcucgaauaccugcuucuggagggccacugcuaugacauuacgaccgggcaacccccucgcggacuccaguuuacacugggcaccucugccaaccccgugaucguugauacaauugugauggcuaaucugggguacuuccagcuuaaggcgaacccgggcgccuggauccugagacuccggaaaggacgcagcgaagacauuuauagaaucuacucccaugacggcaccgauucuccucccgacgcugaugaggucgugauuguucugaauaacuuuaagagcaaaaucaucaaggugaagguccaaaagaaggccgacauggugaaugaggaucuccuguccgacgggacgucugaaaacgagagcggauucugggauuccuuuaaauggggcuucacagggcagaagaccgaagaggucaaacaggacaaggaugacauuaucaauauuuuuagcguggccucuggacaccuuuacgagcgguuccugcgcaucaugaugcuguccguucucaagaacaccaaaacaccugugaaguuuugguuccugaaaaauuaucuuagccccaccuuuaaggaguucauucccuacauggcuaacgaauauaauuuucaguacgaacugguccaauauaaauggccuagauggcuccaucagcagacagagaagcagcggaucaucuggggcuacaaaauucuguuccucgaugugcuguucccgcuuguuguggacaaguuucuguucgucgaugccgaccaaaucgugcgcacggaccugaaggaacucagagauuuuaaccuggacggggcgcccuauggcuacaccccuuucugugauucucggagagagauggacggauaccgcuuuuggaaauccggcuauugggcuagccaccuugccgggcggaaguaccauauuuccgcccuguaugugguugaucucaaaaaguucagaaaaaucgcugccggagaccgccugcggggccaguaccaggggcucucucaggaucccaacagccuguccaaucuugaccaagaucugccuaacaauaugauucaccagguccccaucaagagccugccucaggaguggcucuggugcgaaacauggugugacgaugcgucuaagaaaagagcuaagaccaucgaccugugcaacaauccgaugacaaaagagcccaaacuugaagccgccgugcgcauugugccugaguggcaggauuaugaccaagaaaucaaacagcugcagauucgguuucaaaaggagaaggagaccggagcucucuacaaagaaaagacgaaagagcccuccagagaaggcccucagaagcgcgaggaacuguga

SEQ ID NO: 77582 - RNA, 4551 nt, Artificial Sequence
  derived and/or modified sequence opt5 from UGGT2__Homo_sapiens__NP_064506
auggcccccgcuaaggccaccaacguggucagacugcuccugggcagcacagcgcuuuggcugucccagcucgggucuggaacgguugcugccagcaaauccgugaccgcccaccuggcugccaaguggccugagacaccgcuucugcucgaagccucugaguucauggcugaagagagcaaugaaaaauuuuggcaauuccuggagaccgugcaggagcuggcgaucuacaagcagacagaauccgacuauucuuacuauaaccucauucugaaaaaggccggccaguuucuugauaaucugcauaucaaccuccugaaguucgcuuuuagcauucgggccuacucccccgcuauccaaauguuccagcagauugccgcggacgagccucccccugaugggugcaaugccuuugucgugauccacaaaaagcauaccuguaaaaucaacgaaauuaagaaacuucugaagaaggcugccagccgcacaagacccuaucucuucaaaggagaccacaaguuuccuaccaauaaagagaaccugccgguugugauccuguacgcugagaugggcacgcggaccuucucugccuuucauaagguccucuccgaaaaagcccagaaugaggaaauucuguaugugcuucgccacuacauccaaaagcccagcucuagaaaaauguaccuguccggguauggaguugagcucgcuauuaagagcacagaauacaaggcgcuggaugacacccaggugaaaacagucaccaacacgacaguggaggaugagaccgaaacaaaugaggugcagggcuuccuuuuuggcaagcugaaagaaaucuauucugaccuccgggauaaccugaccgccuuccagaaguaccugauugaguccaauaaacaaaugaugccucucaaggucugggaacugcaggaccuuagcuuccaggcugccucccaaaucaugucugcccccguuuaugauagcaucaagcugaugaaagacauuucccagaacuuuccuaucaaggcucgcagccucaccagaauugccgugaaucagcacaugcgggaggagaucaaagaaaaccagaaggaucugcaagugcgcuucaaaauucagcccggggacgcgagacuuuuuaucaacggacugcgggucgacauggauguguacgacgcuuucucuauccucgauaugcugaagcuggagggcaagaugaugaaugggcuccgcaaccugggaauuaauggcgaagacauguccaaauuucuuaagcugaacagccauaucugggaguauacauacguucucgauauuagacacucuagcaucauguggauuaaugaccuggaaaacgaugaccuguacaucacguggccgaccuccugccagaaacuucucaagccuguguuccccgggucugucccuagcauccggcgcaauuuucauaaccuggugcuguucauugaucccgcccaggaguauacacucgacuuuaucaaacuggccgauguuuucuacucccacgaggugccccuuagaauuggauuugucuucauccugaauaccgacgacgaaguggauggcgcuaacgacgccggcgucgcucucuggcgggccuuuaauuauauugcggaggaguucgauaucagcgaagccuucauuucuaucgugcacauguaccaaaagguuaagaaagaccagaacauccugacaguggauaaugucaaguccgugcugcagaacaccuuuccucaugcuaauauuugggacauccuugggauucacagcaaauaugaugaggaaagaaaggccggagcuucuuucuacaaaaugacgggccucgggccgcugccccaggcccuguauaacggagagccuuuuaagcaugaagagaugaacaucaaagaacucaagauggcgguucugcaacgcaugauggacgccuccguguaccuucagcgggaggucuuccugggcacacucaaugauagaaccaacgcuauugacuuucugauggaucgcaauaacguggugccccggaucaauacccugauccuuagaacaaaccagcaguaccucaaucugauuagcaccuccguuacagccgacgucgaggauuucucuacguuuuucuuucuggacagccaagacaaguccgcugugaucgccaaaaacauguauuaccucacccaggaugacgaaucuauuaucagcgccgugacacuguggauuaucgcugauuucgacaagccuuccgggcgcaaacuucuguuuaaugcgcucaagcacaugaaaaccagcguccauucucggcugggaaucauuuauaaccccacauccaagaucaaugaggaaaacaccgccauuagcagaggcauccuggcugccuuccuuacgcagaagaauauguuucuccgcucuuuccugggccaacuggccaaagaggaaauugcuaccgccaucuacuccggggauaagaucaaaacauuccucauugagggaauggacaagaacgcguuugagaaaaaguauaauaccgugggcguuaacaucuuccggacacaccagcuguuuugucaggaugugcuuaagcugagaccgggggaaaugggaauugucagcaacggccgcuuccucgggccucuggacgaggauuuuuacgcugaagacuucuaucugcuugagaaaaucaccuuuucuaaucugggcgaaaagauuaaaggaaucguggagaacaugggcauuaaugccaacaauaugagcgauuucaucaugaagguugacgcccucauguccagcgugcccaaacgggcuucuagauacgaugucacguuucugcgggagaaccacuccgugaucaagacaaauccucaggaaaacgacauguucuuuaauguuauugccaucguggacccccucacccgcgaggcgcaaaagauggcucagcugcuugucgugcuggggaaaauuaucaacaugaagauuaaacucuucaugaauugcagaggacggcugagcgaagccccucuggaguccuucuacagauuugugcuugagcccgaacugaugucuggcgccaacgaugucagcucccucgggccgguugcuaaguuccuggacaucccugagucuccccuccugauccuuaauaugauuacacccgaaggauggcugguggagaccgugcauagcaacugugaucucgacaauauccaccugaaagauaccgaaaagacagucacggccgaguaugagcuggaauaccuucugcucgagggccagugcuuugacaaagugaccgaacagccuccgcgcgggcugcaauucacacucggcaccaagaacaagcccgcuguuguggauacaauugucauggcccaucacggauauuuucagcugaaagcgaacccuggcgccuggauccuucggcugcaccaggggaaguccgaggacauuuaccagaucgugggacaugaaggcaccgauucucaagcugaccuggaggauaucauuguugugcucaauagcuucaaauccaagauccugaaagucaaggugaagaaagagacggacaagauuaaagaagacauccuuacagaugaggacgaaaagaccaaagggcugugggauagcauuaagucuuuuaccguuucccuccacaaggagaacaaaaaggaaaaagacgugcugaauaucuucagcgucgccucuggacaucucuaugagagauuucugcgcauuaugaugcuuuccgugcugagaaacacaaagacccccgugaaauucuggcugcucaagaauuaccugagcccuacauuuaaggaggucaucccccacauggcuaaagaauauggcuuccgguacgagcuuguucaguaccgcuggccuagauggcugcggcagcaaacggaacgccagagaaucauuuggggguauaagauccucuuucuggauguccucuucccccuggccguggacaaaauuaucuucguggaugccgaccagauugugcggcaugaucuuaaggagcugcgcgacuuugaucuggacggcgcuccguacggauauaccccuuucugugauucuagacgggagauggacggcuaccgcuuuuggaaaacaggguauugggcgucccaccuccugagacggaaguaccacaucagcgcccuuuauguuguggaccugaagaaauucagacgcaucggagcuggcgaucggcucagaucccaguaccaagcccugagccaggaccccaacucucucagcaaucuggaucaggaccuuccuaacaauaugauuuaccaggucgccaucaagucccugccccaagauuggcuguggugcgaaaccuggugugacgaugagucuaaacagcgcgcuaagacaauugaccucugcaacaauccgaaaaccaaggaaagcaaacugaaggccgcggcucggaucgugccugaguggguugaauaugaugccgagauuagacagcuucuggaccaucucgagaacaagaaacaggauacgauccugacccacgacgaacuguga

SEQ ID NO: 77583 - RNA, 1527 nt, Artificial Sequence
  derived and/or modified sequence opt5 from UGP2__Homo_sapiens__NP_006750
augagcagauucgugcaggaccuguccaaggccaugucucaagauggcgcuagccaguuucaggaggucauccggcaggaacucgagcuguccguuaaaaaggaacuugagaaaauucugaccacagccucuagccacgaguucgaacauacgaagaaagaccucgauggguuucgcaagcuguuccacagauuucuucaagagaagggacccuccguggacuggggcaaaauccagcggcccccggaagauucuauucagcccuacgagaagaucaaagcgcgcgggcugccugacaacauuagcuccgugcucaauaagcuggucgugguuaaacugaacggaggccucgggaccagcaugggaugcaagggccccaagucucugaucggcgugagaaaugaaaacacauuccuugaucugaccguccagcaaaucgagcaucucaauaaaacauauaacaccgacgugccucugguucuuaugaacuccuuuaauacagaugaggacaccaagaaaauucugcagaaguacaaucacugucgggugaaaaucuauacguucaaccagagccgcuaccccagaauuaauaaggaaucucuccugccugucgcuaaagauguguccuauagcggggagaacaccgaagccugguacccgcccggacauggcgacaucuaugccucuuuuuacaauuccgggcugcucgauacauucauuggagagggcaaggaauacaucuuugugagcaacauugacaaucugggggcuaccgucgaccuuuauauccugaaccaccucaugaacccucccaauggaaagcggugcgaguucguuauggaggugacaaacaaaacccgcgccgaugugaagggcggcacgcugacacaguacgaagggaaacuuagacuggucgagaucgcucaagugccuaaggcccacguugacgaauuuaaauccgugucuaaguucaagauuuucaauaccaacaaucucuggaucagccuggcggccgucaaacggcugcaggagcagaacgcuauugauauggaaaucauugugaaugccaagacacucgacggaggccugaacguuauccaacuugagaccgcugugggggccgcgaucaaauccuuugagaauagccugggaauuaacgucccccgcucuagauuccucccggugaagaccacauccgaucugcuucuggucaugagcaaucucuauucucugaacgccggcagccugacgauguccgaaaaacgggaguuuccuaccgugccccucguuaagcuggggucuagcuucacaaaggugcaggacuaccuucgcagauuugaauccaucccugauaugcuggagcucgaccaucugaccgucagcggagaugugacauucggcaaaaauguuucucugaagggcaccgugauuaucauugcuaaccacggggaccggaucgauaucccucccggagccguccuugaaaauaaaauuguguccggcaaccucagaauccuggaccauuga

SEQ ID NO: 77584 - RNA, 1593 nt, Artificial Sequence
  derived and/or modified sequence opt5 from UGT1A10__Homo_sapiens__NP_061948
auggccagagcuggcuggaccagccccgugccucugugcgucugucuccugcuuacaugcggguucgccgaggcgggaaagcugcucguugugccgauggacggcucccacugguuuacgaugcagucuguggucgaaaaacugauccuucgggggcaugaggugguuguggucaugcccgaagugagcuggcaacuggagcgcucccucaacuguaccguuaagacauacucuaccagcuauacacuggaagaucagaauagagaguucaugguguuugcucacgcccaguggaaagcccaggcucaauccauuuucucucugcucaugagcuccagcucuggauuucuggaccuuuucuuuucccauugccggagccuguucaacgaucgcaagcucgucgaguaccugaaagaaucuuccuuugacgccguguuccuugauccuuuugacaccuguggccugaucguggcuaaguauuucagccuccccucugucguuuuuacaagagggauuuucugccaccaucuggaggaaggagcccaguguccugcgccccuguccuacgugccuaaugaucuccugggcuucagcgacgccaugaccuuuaaggagcggguguggaaccacaucguccaccuugaggaucaucuguucugccaguaucucuuucgcaaugcucuggaaauugccuccgagauccuucagacgccggugaccgcuuacgaccuguauucucacacaagcaucuggcuccugagaaccgauuucguucuggacuaccccaaaccugugaugcccaacaugauuuuuaucggcgggauuaauugucaucaaggaaagccucuccccauggaguucgaagccuacaucaacgcguccggcgaacacgggauugucguguuuagccugggaucuaugguuuccgagaucccggagaaaaaggccauggcuauugccgaugcucuuggcaaaaucccucagacagugcuguggcgguauaccgggacgcgccccagcaaucucgccaacaauacaauccuggucaaguggcuuccucagaacgaccugcucggacaccccaugaccagagccuucauuacacaugcuggcucucacggcguguacgaaagcaucugcaaugggguccccauggugaugaugccucuguuuggagaccagauggauaacgcgaagcggauggagaccaaaggcgccgggguuacccugaaugugcucgaaaugacauccgaggaccuggaaaacgcucuuaaggccgucauuaacgauaaaucuuauaaggagaauaucaugcgccugagcucccuccauaaagacagaccgguggagccccuggaucuggccguuuucuggguggaauuugucaugcggcacaagggagcuccucaucuucgccccgccgcgcacgaccucacgugguaccaauaucacagccuggaugugauuggcuuccugcucgcugugguucugaccgucgccuuuaucacauucaaauguugcgccuacggguauagaaagugccuuggaaagaaaggccgggugaagaaagcucauaagucuaaaacccacuga

SEQ ID NO: 77585 - RNA, 1602 nt, Artificial Sequence
  derived and/or modified sequence opt5 from UGT1A1__Homo_sapiens__NP_000454
auggccguggagagccagggcgggagaccccugguccucggacugcuucugugcguucucggcccuguggugucccacgcugggaagauccugcuuauuccggucgacggaucucauuggcugagcaugcucggcgccauccaacagcugcagcagcgggggcacgaaauugugguucuggcgcccgaugcuucccucuacauccgcgacggagccuucuauacccugaaaacauacccugugcccuuucaaagagaggaugucaaggaaucuuucgugagccuuggccauaacguuuuugagaaugacuccuuccugcagcgggugauuaaaacguauaagaaaaucaagaaggauucugccaugcuccugagcggcuguucccaccuucugcauaacaaagaacucauggcuagccuggccgagucuuccuuugacgucaugcugaccgauccuuuccuccccugcagcccuaucguggcucaguaccugucucuuccgacaguguuuuuccugcacgcccuccccuguucccuggaguuugaagcgacccagugcccuaaucccuucagcuaugucccucgcccccuuucuucccacagcgaccauaugacauuucugcaaagaguuaagaacaugcucauugccuucucccagaauuuucugugugaugugguguacucuccguaugcuacccuggccagcgaguuccuccagcgggaagucacagugcaggaccugcuuuccagcgcuucuguuuggcuguuccgcuccgauuuugugaaagacuacccuagacccaucaugccuaacauggucuucgugggaggaauuaauugccuccaccaaaacccccugagccaggaguuugaggccuacaucaaugcgucuggcgaacaugggauuguuguguucagccuuggauccauggucucugagauccccgaaaagaaagccauggcuauugccgaugcucugggcaagaucccucagaccgugcucuggcgguauacggggacccgcccgagcaaccuggccaauaacacaauccuggucaaguggcucccccaaaaugaccugcuuggacacccuaugaccagagccuuuauuacacacgcuggcucccauggcguguacgagagcaucuguaacgggguucccauggugaugaugccucuguucggagaccagauggauaaugcgaaacggauggaaaccaagggcgccggggucacgcucaacgugcuggagaugacaucugaggaccuggaaaacgcucuuaaagccguuauuaaugauaaguccuauaaagagaacaucaugcgccucagcucucugcacaaggacagacccguggaaccgcuggaucucgccgucuuuuggguggaguucgugaugcggcauaaaggagcuccucaucugcgccccgccgcgcacgaccuuaccugguaccaguaucacucccuggauguuauuggcuuucuccuggcugucgugcugacaguggccuucaucaccuuuaagugcugugccuacggguauagaaagugccuugggaaaaagggccgggucaaaaaggcucacaaaagcaagacccauuga

SEQ ID NO: 77586 - RNA, 1605 nt, Artificial Sequence
  derived and/or modified sequence opt5 from UGT1A3__Homo_sapiens__NP_061966
auggccaccggccuccaggugccccugccuuggcuggcuacagggcuucugcuccugcuuagcguccaaccgugggccgaguccggaaagguucugguggugcccaucgacggcucucacuggcucagcaugagagaaguccugcgggagcugcaugcgcgcgggcaccaggcugugguucucacgccugaagugaacaugcauauuaaagaggaaaauuucuuuacccugacaaccuacgccaucuccuggacacaggaugaguucgacagacacguccuuggacauacccagcuguauuuugagacagaacacuuccucaagaaauuuuuccggucuauggccaugcugaacaauaugagccuuguguaccaccgcuccugcguugagcugcuccauaacgaagcucugauuagacaccugaaugccaccucuuuugaugugguccucacggaccccgugaaccugugugcugccgugcuugcgaaguaucugagcaucccuaccgucuucuuucuccggaauauucccugcgaucuggacuucaaaggcacacaauguccuaacccguccagcuacaucccccgccuucugaccacaaauucugaucauaugaccuuuaugcagagaguuaagaacaugcucuauccucuggcccuguccuacaucugccacgcuuucagcgcccccuaugcuucucucgccuccgagcuguuucagcgggaggugagcguggucgacauucuuucucacgcguccguguggcuguuccgcggggauuucguuauggacuacccuagacccaucaugccgaauaugguguuuauuggaggcaucaacugugccaaucggaagccucucagccaggaauuugaggcuuacauuaacgccuccggcgaacaugggaucgucguguucucucugggaagcaugguuuccgagauucccgagaaaaaggcuauggccaucgccgaugcucuuggcaaaaucccucaaacggugcuguggcgcuauacagggaccagacccagcaaucucgcgaacaacacaauucuggucaaguggcugccccagaaugaccuccugggacacccuaugacccgggccuucaucacccaugcuggcucucacgggguguacgaauccauuugcaacggagucccgauggugaugaugccccuuuuuggcgaucagauggacaaugccaaacgcauggagacaaagggcgccgggguuacgcugaacgugcucgaaaugaccagcgaggaccuggaaaaugcucugaaggccgucaucaacgauaaaucuuauaaggagaauauuaugagacuuagcucccuccauaaagaccggccuguggaaccccuggaucuggcgguuuucuggguggaguuugucaugagacacaagggagcuccucaccuccgccccgccgcccaugaccugacaugguaccaguaucacucucuugaugugaucggcuuccugcucgcugugguucugaccgucgccuuuaucacauucaaauguugcgcuuacggguaucggaagugucugggcaaaaagggaagagugaagaaagcccauaagagcaaaacccacuga

SEQ ID NO: 77587 - RNA, 1605 nt, Artificial Sequence
  derived and/or modified sequence opt5 from UGT1A4__Homo_sapiens__NP_009051
auggccagaggccuucaggugccccucccucggcuggcuaccgggcuucugcuccugcuuagcguccaaccgugggccgaguccggaaagguucugguggugcccacagacggcucuccuuggcucagcaugcgcgaagcgcugagagagcugcacgcucgggggcaucaggccgucgugcucacgcccgaaguuaacaugcacaucaaagaggaaaaguucuuuacccugacagccuacgcugugccuuggacccagaaagaguucgaucgcgucacacuuggauauacccagggcuuuuucgagacagaacaucugcucaagagauacucccggucuauggccauuaugaauaacgugagccuggcucugcaccgcugcuguguugagcugcuccauaaugaagcccugaucagacaccugaacgcgaccuccuuugacgugguccucacggaucccgugaaucugugcggggccgugcuugcuaaauaucugucuauuccugccgucuucuuuuggcgguacaucccgugugaccucgauuucaagggaacccaaugccccaacccuagcuccuauauucccaagcugcuuacaaccaauagcgaccacaugacauuucugcagcgcguuaaaaacaugcucuacccucuggcucugucuuauaucugucauaccuucuccgcccccuacgcgagccucgccucugagcuguuucagagagagguguccguggucgaucuugugagcuacgcuucuguuuggcuguuccggggcgacuuugugauggauuauccgcgcccuaucaugcccaauauggucuucauuggcgggaucaacugcgccaauggaaagccucucucccaggaauuugaggcuuacauuaacgccagcggcgaacacgggaucgugguuuucucccugggaucuauggugagcgagauucccgagaaaaaggccauggcuaucgcggacgcccuuggcaaaauuccccaaacgguccuguggagauauacagggacccggccuuccaaucucgcuaacaauacaauccuggugaaguggcugccgcagaacgaucuccugggacaucccaugacccgcgccuucaucacccacgccggcagccacggcgucuacgaaucuauuuguaacggggugccuaugguuaugaugccccuuuuuggagaccagauggauaaugcuaagagaauggagacaaaaggcgccggggugacgcugaacguccucgaaaugaccuccgaggaccuggaaaaugcgcugaaggcugugaucaacgacaaaagcuauaaggagaauauuaugcggcuuucuagccuccauaaagauagaccuguugaaccccuggaccuggccguguucugggucgaguuugugaugcgccacaagggagccccgcaucuccggccugcugcccacgaucugacaugguaccaguaucauucccuugacgugaucggcuuccugcucgcuguuguccugaccguggccuuuauuacauucaaaugcugugcguacggguacagaaagugccugggaaagaaaggccgcgugaagaaagcccacaagucuaaaacccacuga

SEQ ID NO: 77588 - RNA, 1605 nt, Artificial Sequence
  derived and/or modified sequence opt5 from UGT1A5__Homo_sapiens__NP_061951
auggccaccggccuccaggugccccugccucaacuggcuacagggcuucugcuccugcuuagcguccagccgugggccgaauccggaaagguucugguggugcccacggacggcucucacuggcucagcaugagagaagcgcugcgggaucugcaugcucgcgggcaccaggucgugguucucacccuggaggugaacauguacaucaaagaagagaauuucuuuacacuuaccacauaugccauuuccuggacccaggacgaauuugauagacugcuccugggacauacacaaucuuucuucgagaccgagcaccuucugaugaaguuuagccggcgcauggccaucaugaacaauaugucccucauuauccauagaucuugcgucgaacugcugcacaacgaggcucucauucggcaucugcacgccacgagcuucgacgugguucuuaccgauccuuuucaccugugugcugccgugcucgcgaaauaccuguccauccccgccgucuucuuucuucgcaauaucccuugcgaccuggauuucaagggcacacagugucccaacccuagcucuuauauuccgagacuccugaccacaaauuccgaccauaugaccuuucugcagcgggugaaaaacaugcucuacccccuggcucuuagcuaucugugccacgccgugucugcuccuuacgccucccucgcgagcgaacuguuccagcgcgaggucucuguuguggaucuugugucccacgccagcgucuggcuguuuagaggggacuucgugauggauuauccccggccuaucaugcccaauaugguuuucauuggaggcaucaacugugcuaauggcaagccgcucucccaagaguuugaagccuacauuaacgcuucuggggagcauggaaucguggucuucagccugggcuccauggugagcgaaauuccugagaagaaagccauggccaucgcugacgcgcuggggaagaucccccagacgguucucuggcgcuacacaggaaccagaccuucuaaucuggccaacaauacaauucuugugaaauggcugccccagaacgaucuccugggccaccccaugacccgggcuuuuaucacccaugccgggucccacggagucuaugaaagcauuugcaacggcgugccuauggucaugaugccgcuguucggcgaccagauggacaaugccaagcgcauggagacaaaaggggcuggagugacgcuuaacguucucgagaugaccucugaagaucuggagaaugcccugaaggcggugaucaacgacaagagcuacaaagaaaauauuaugagacucuccucucugcauaaggaucggcccgucgagccucuugaccuggcuguguuuuggguugaguucgugaugagacacaaaggcgcuccccaccuccgcccugccgcccaugaucugacaugguaucaauaccacagccuggacgucaucggguuucuucucgccguggugcugaccguugcuuucaucacauuuaaguguugcgccuauggauaccggaaaugucugggcaagaaagggagagucaagaaggcgcauaaauccaagacccacuga

SEQ ID NO: 77589 - RNA, 1599 nt, Artificial Sequence
  derived and/or modified sequence opt5 from UGT1A6__Homo_sapiens__NP_001063
auggccugccugcuccggagcuuccagagaaucuccgcuggcguguuuuuccuggcccuuugggggauggucguuggagacaagcugcucguggugccccaagauggcucucacuggcugagcaugaaagacauugucgaggugcuuuccgaucgcgggcaugaaaucguuguggucgugccugagguuaaccugcuccugaaggaaucuaaauacuauaccagaaagauuuacccggugcccuaugaccaggaggaacugaaaaaucgguaccagagcuuuggaaacaaucacuucgcggagcgcuccuuucucacagcuccucagacggaguauagaaacaauaugaucgucauuggccuguacuucaucaacugucaaucucuucugcaggaucgggacacccucaauuucuucaaggaaagcaaguuugaugcccuguucacagaccccgcccuuccuugcggggugauccuggcugaguaucucggacugcccuccguguaccuguuucgcggcuucccuuguagccucgaacauaccuuuucuagauccccggaucccgucagcuacauuccucggugcuauacaaaauucucugaccacaugaccuucucccagcgcguugccaacuuucuggugaaucuucuggagcccuaccucuucuauugucuguuuagcaaguacgaggaacuugcuucugccgugcugaaaagagaugucgacaucauuacacucuaucagaagguguccguuuggcugcugcgguacgauuucgugcucgaguauccucgccccgucaugccgaacaugguguuuaucggcgggauuaauugcaaaaagagaaaggaccugagccaagaauuugaggcguacaucaacgccuccggagaacauggcauuguuguguuuucucuugggagcauggucuccgagaucccugagaaaaaggcuauggccaucgcugacgcccugggaaaaauuccccagaccgugcucuggcgguacacgggcacccgcccuagcaaucuggcgaacaauacaauccuugucaaguggcugccccagaacgaucuccuggggcaccccaugaccagagccuucauuacacacgcuggaucucauggcguguaugaauccaucuguaacggcguuccuauggugaugaugccgcuguuuggggaccagauggauaaugccaaacggauggagaccaagggagcuggcgucacgcucaacgugcuggaaaugacaagcgaggaccuugaaaaugcccugaaagccguuauuaacgauaagucuuacaaggagaauaucaugagacucagcucccugcacaaagaccgccccguggagccucuggaucuugcugucuucuggguggaauuugugaugcggcauaagggggcgccccaccucagaccugccgcucacgaccugaccugguaucaauaccauucucuggauguuaucggauuccuccuggccgucgugcuuacaguggccuuuauuaccuucaaaugcugugcuuauggcuaccgcaagugccuggggaaaaagggacgggucaagaaagcccacaagagcaaaacccauuga

SEQ ID NO: 77590 - RNA, 1593 nt, Artificial Sequence
  derived and/or modified sequence opt5 from UGT1A7__Homo_sapiens__NP_061950
auggccagagcuggcuggaccgggcugcucccccuguacgugugccuucugcucacauguggauucgccaaggcgggcaaacugcuugucguuccuauggacgggagccacugguuuacgaugcaguccgugguggagaagcugauccuccggggacaugaagucgugguugugaugccggaggucucuuggcaacugggccgcagccugaacugcaccgugaaaacauauuccaccucuuacacacucgaagaucaggacagagaguucaugguuuuugcugaugcccgguggaccgcuccccugcgcagcgccuucucccuucugacaucuagcuccaaugggauuuuugaccucuucuuuagcaacuguagaucucuguucaaugaucggaaacuuguggaauaucugaaggaguccugcuuugacgccgucuuccucgauccuuuugacgcuuguggacugaucguggccaaguacuucagccugcccucuguggucuuugcgcgcggcauuuucugccacuaucucgaggaaggcgcccaguguccugcuccccuguccuacguuccuagacuucugcucggguucagcgaugccaugaccuuuaaggagcggguguggaaccauaucaugcaccuggaggaacaucuuuucugcccguauuucuucaaaaaugugcuggagauugcuucugaaauccuccagacgcccgucaccgccuacgaccuguacucccacacaagcaucuggcugcuccgcaccgauuuugugcuggaguauccuaagcccguuaugccuaacaugauuuucaucggaggcauuaauugucaccaagggaaacccgugccgauggaauuugaggcguacaucaacgccuccggagaacauggcauugucguguucucucuugggagcaugguuuccgagaucccugagaagaaagcuauggccauugcugacgcccugggaaagaucccccagacagugcucuggagauauaccggcacgcggccuagcaaucuggccaacaauacaauccuugucaaguggcugccccagaacgaucuccugggccaccccaugacccgcgcuuuuauuacacaugcggggucucacggaguguacgaauccaucugcaauggcgucccuauggugaugaugccgcuguucggggaccagauggacaacgccaaaagaauggagaccaagggagcuggcguuacccucaaugugcuggaaaugacaagcgaggaucuugaaaacgcccugaaagccgucauuaacgacaagucuuauaaagagaauaucaugcggcucagcucccugcacaaggaucgccccguggagccucuggaccuugcuguguuuuggguugaauuugucaugagacauaaaggggcgccccaccuccggccugccgcucaugaucugacgugguaccaauaucacucucuggacgugauuggauuucuccuggccgugguucuuaccgucgccuucaucacauucaaguguugcgcuuacggcuacagaaagugccugggcaaaaaggggcgcgugaaaaaggcccauaaaagcaagacccacuga

SEQ ID NO: 77591 - RNA, 1593 nt, Artificial Sequence
  derived and/or modified sequence opt5 from UGT1A8__Homo_sapiens__NP_061949
auggccagaaccggcuggacaagccccaucccucugugcgugucccuccugcuuacguguggguucgcugaagccggaaagcugcucgucguuccgauggacggcucucacugguuuaccaugcagagcgugguggaaaaacugauucuucgggggcaugaggucgugguugugaugcccgaagucuccuggcaacugggaaagucucucaacugcacagugaaaaccuacagcacauccuauacccuggaggaucuggaccgcgaguucauggauuuugcggacgcucaguggaaggcccagguuagaucucucuucagccuguuucuuuccagcucuaauggcuucuuuaaccuguucuuuucccacugucggagccucuucaaugaucgcaaacugguggaauaccuuaaggagucuuccuuugacgccgucuuccuggauccuuuugacgcuugcgggcucaucguggccaaguauuucagccugcccucuguggucuucgcuagaggaauugccugucauuaccuggaagagggcgcgcagugcccugcuccccucuccuauguuccucggauccugcuuggcuuuagcgaugccaugacauucaaagaacgcgugagaaaccacauuaugcaucuggaggagcaccucuuuugucaauacuucuccaagaaugcccuggaaaucgcuucugagauccuucagaccccggugacggccuaugaccuguacagccacaccuccauuuggcuccugcggacagauuuuguccuggacuaccccaaaccugugaugcccaacaugaucuucauugggggaaucaauugccaucagggcaagccucuccccauggaauuugaggcguauauuaacgccagcggggaacacggaaucguuguguucucucugggcuccauggucagcgagauuccggagaaaaaggcuauggccaucgcugaugcccuugggaagaucccucagaccgugcuguggcgcuacacaggaaccagacccucuaaucucgccaacaauacgauucugguuaaauggcuuccucaaaacgaccugcucggccaucccaugacacgggcuuuuaucacccacgcgggcagccacgggguguaugaauccauuuguaauggaguccccauggugaugaugccucuguucggcgaccagauggauaacgccaagcgcauggagacaaaaggggcuggagucacccugaaugugcucgaaaugaccucugaggaccuggaaaacgcccuuaaggccguuaucaacgauaaaagcuacaaggagaauauuaugagacuguccagccuccauaaagaccggccgguggagccccuggaucuggcugucuuuuggguggaguucguuaugcgccacaagggcgccccucaucuuagacccgcggcucacgaccucacaugguaucaguaccauucucuggaugugaucggguuucugcucgccgucgugcugacgguggccuucaucaccuucaagugcugugcuuauggauaccggaaaugccuuggcaagaaaggcagaguuaagaaagcccacaaguccaagacacacuga

SEQ ID NO: 77592 - RNA, 1593 nt, Artificial Sequence
  derived and/or modified sequence opt5 from UGT1A9__Homo_sapiens__NP_066307
auggccugcaccggcuggacaagcccccugccucucugugugugccugcuucugacguguggguucgcugaggccggaaagcuccuggucguuccgauggacggcucccacugguuuaccaugagaucugugguggaaaaacuuauccugcgggggcaugaggucgugguugugaugcccgaagucagcuggcagcucggacgcucccugaacugcacagugaagaccuacucuacaagcuauacccuggaggaucucgacagagaguucaaagcguuugcucacgcccaauggaaggcccagguucgguccauuuacucucugcuuaugggcagcuauaaugauaucuucgaccuguuuuucuccaacugucgcagccucuuuaaagauaagaagcugguggaauaccuuaaagagucuuccuucgacgcugucuuucuggauccuuucgacaauugcgggcucauuguggccaaguauuuuagccugcccucuguggucuucgcuagaggaauccugugucauuaccucgaagagggcgcccagugcccugcgccccuguccuauguuccucggauucuucugggcuuuagcgaugccaugacauucaaagaacgcgugagaaaccacaucaugcaucucgaggagcaucugcuuugucaccgguucuuuaagaaugcucuggaaaucgccucugagauucuccagaccccggugacggaauacgaccuguacucccacaccagcaucuggcugcuccgcacagauuucguccuggacuaucccaaaccugugaugcccaacaugauuuuuaucgggggaauuaauugccaccaaggcaagccucuucccauggaguucgaggcuuacaucaacgccuccggggaacauggaauuguuguguuuucucugggcagcauggucuccgagaucccggaaaagaaagcgauggccaucgcugaugcccucgggaagauuccucagaccgugcuguggagauauacaggaacccggcccagcaaucuugcuaacaauacgauccugguuaaauggcucccucagaacgaccugcugggccaccccaugacacgcgccuucauuacccacgccggcucucaugggguguacgaguccaucuguaauggaguccccauggugaugaugccucucuuuggcgaccagauggauaacgcuaagagaauggaaacaaaaggggcgggagucacccugaaugugcuugagaugaccagcgaagaccuggagaacgcccucaaggcuguuauuaacgauaaaucuuauaaggagaauaucaugcggcugagcucccugcacaaggaccgcccgguggaaccccuugaucucgccgucuucuggguggaguuuguuaugagacauaaaggcgccccucaucugcggcccgcugcccacgaccugacaugguaccaauaucacucucucgaugugaucggguuccugcuugcggucgugcugacgguggcuuuuauuaccuucaagugcugcgccuacggauacagaaaaugucucggcaagaaaggccgcguuaagaaggcccacaaaagcaagacacauuga

SEQ ID NO: 77593 - RNA, 2082 nt, Artificial Sequence
  derived and/or modified sequence opt5 from UGT2A1__Homo_sapiens__NP_001239203
augcugaacaaucuccugcuuuucagccugcagaucucccucauuggcaccacacugggaggaaacgugcuuaucuggcccauggagggcucucacuggcugaaugucaagauuaucauugacgaacucaucaaaaaggagcauaacguuacggugcugguggccagcggggcucuguuuaucaccccuacauccaauccgucucucaccuucgaaauuuacaaaguccccuuuggaaaggagagaaucgaaggcgugauuaaagauuucguucugacauggcuugagaaccggccuagccccuccaccaucuggcgcuuuuaucaagagauggccaaggugauuaaggacuuccacauggucucucaggaaaucugcgauggggugcugaaaaaucagcagcucauggcgaagcugaaaaagagcaaauuugagguucuuguguccgacccugucuuccccuguggagauauuguggcucugaagcucggcaucccuuuuauguacagccugagauucucuccggccuccacaguggaaaagcauugcggcaaaguccccuauccucccagcuacguuccugccgugcugucugagcucaccgaccaaauguccuuuacggaucggauccgcaacuucauuagcuaucaccuucaggacuacauguuugagacccuuuggaagucuugggauuccuauuacagcaaagcucuggacgggucccauuggcucaauaucaagauuauccuggaagaacuuauucagagaaaccacaaugugacaguccuggccucuagcgcuacccucuucaucaacuccaaucccgauagcccggugaacuucgaaguuaucccugugucuuacaaaaaguccaauauugacagccugaucgagcacaugauuaugcuguggaucgaucaucggcccacaccucucaccauuugggccuuuuauaaagaacugggaaagcugcuggacacguucuuucagaucaacauccaacucugugacggcguccugaagaaccccaaacuuauggcgcgccugcagaaagggggauucgaugugcucguugccgaccccgugacaauuugcggcgaucuggucgcucugaaacucgggaucccuuuuauguacacccugagauucucuccggccagcacaguggagcggcacuguggaaagauucccgcuccugucuccuaugugcccgccgcgcuuucugagcugaccgaccagaugaccuuuggcgaacgcaucaaaaauacaauuagcuacucccuccaggauuauaucuuccaaagcuacuggggcgaguggaacucuuauuacuccaagauucuggggagaccuacgacccugugcgaaacaaugggaaaggccgagaucuggcuuauccggaccuacugggacuuugaguucccccgcccguaucucccuaauuuugaguucguuggcgggcugcauuguaaacccgcuaagccucugcccaaagugcucuggagauacaaggggaaaaagccugccacacugggcaacaauacccagcuuuuugauuggauuccccagaacgaccugcucgggcacccgaagacgaaggcuuucaucacacacggaggcaccaauggcauuuaugaggccaucuaccauggggucccuauggugggaguucccauguucgccgaucaacccgacaacauugcucacaugaaggcgaaaggcgccgcuguggaagucaaucugaacaccaugacaagcguggaucugcuuucugcccuccggaccgugaucaaugagccuuccuauaaggaaaacgccaugcgccugagcagaauccaucacgaccagccgguuaaaccccuggaccgggcugucuuuuggauugaguucgugaugagacauaagggggccaagcaccuccgcguggcggcucacgaucugacaugguuucaguaccauucccuugacgucaucggauuccugcucgugugcguuacgaccgccauuuuucuggugauccaguguugccuguucucuugucaaaaauuuggcaagauugggaaaaagaaaaagcgggaauga

SEQ ID NO: 77594 - RNA, 1611 nt, Artificial Sequence
  derived and/or modified sequence opt5 from UGT2A2__Homo_sapiens__NP_001099147
auggugagcaucagagacuucaccaugcccaagaaauuuguccagaugcugguuuucaaccucacacugacggagguggugcuuuccggcaauguccugauuuggccuaccgaugggucucacuggcucaacaucaagauuauccuggaggaacuuauucaacggaaucauaacgugacaguucuggccagcuccgcuacccucuuuaucaauucuaacccggacagccccgugaauuucgaagucaucccuguguccuacaaaaagucuaacauugauagccugaucgagcacaugauuaugcuguggaucgaccaucgccccacaccucucaccauuugggccuuuuauaaagaacugggaaagcugcuugauacauucuuucagaucaauauucagcucugcgacggcguucugaagaaccccaaacuuauggcgagacugcagaaagggggauucgaugugcucgucgcugacccugugaccaucuguggcgaucugguggcccugaagcucgggaucccguuuauguacacgcugcgguucucccccgccagcaccgucgagcgccacugcggaaagauuccugcucccguuucuuaugugccugccgcucuuuccgagcugacagaccaaaugaccuuuggcgaaagaaucaaaaauacaauuagcuacucucuccaggauuauaucuuccaguccuacuggggcgaguggaacagcuauuacucuaagauucuggggcggcccaccacgcuuugugaaacaaugggaaaggccgagaucuggcugauccgcaccuacugggacuuugaguucccgagaccuuaucuccccaauuucgaauuugugggcgggcugcauugcaaaccugcgaagccccugcccaaagagauggaagaguucauucaguccagcggaaagaacggcgucgugguguuuucccucgggucuaugguuaaaaaucugacagaagagaaggccaaccuuaucgcuagcgcccuggcucaaauuccucagaaaguccucuggcgguacaagggaaagaaaccggccacccugggcaacaauacccagcuuuucgauuggaucccccagaacgaccugcucggccacccuaagacaaaagcguuuauuacgcacgggggaaccaauggcaucuaugaggccaucuaccauggggugcccaugguuggagugccuauguucgcugaccaacccgauaacauugcccacaugaaggcuaaaggcgccgccgucgaagugaaucugaacacaaugaccuccgucgaccugcucagcgcucugcgcacagugaucaaugagccgucuuauaaggaaaacgcgaugagacuuucccggauucaucacgaucagccuguuaagccccuggaccgcgccguguuuuggaucgaguucgucaugagacacaaaggggcuaagcaucuccggguggccgcccacgaucugaccugguuucaguaccauagccuggacguuauuggauuccuucucgugugugucacgacagcuaucuuucuggugauucaaugcugucuguucucuugccagaaauuuggcaagaucggcaaaaagaagaaacgcgaauga

SEQ ID NO: 77595 - RNA, 1584 nt, Artificial Sequence
  derived and/or modified sequence opt5 from UGT2A3__Homo_sapiens__NP_079019
augagaagcgacaaguccgcccugguguuccuccugcuucagcuguuuugcgucggcuguggguucugcggaaaaguucucguguggcccugugauaugucucacuggcugaacgugaaggucauccuugaggaacugauugugcggggccaugagguuaccgugcucacacacagcaaaccuucccugaucgacuaccgcaagccgucugcucugaaauuugaagucgugcauaugccccaagauagaacggaggaaaaugagauuuucguugaccucgcccugaacgugcuuccugggcugagcaccuggcaguccgucaucaagcucaaugauuucuucguggagauucggggaacacugaagaugaugugcgaaucuuuuaucuauaaccagacccuuaugaaaaagcugcaggagacaaauuacgacgugaugcucaucgaucccgucauuccuuguggcgaccugauggcggaacugcucgcuguucccuucgugcugacccuucgcaucagcgucgggggaaacauggagagauccugcggcaaacugccugccccgcucagcuaugugcccgugccuaugacaggccugaccgaucggaugacguuucuugagcgcguuaaaaauucuaugcuguccgugcuuuuccacuuuuggauucaagacuacgauuaucauuucugggaagaguuuuacagcaaggcccuggggagacccaccacacugugugaaaccgucggaaaggcugagaucuggcucauucggacauauugggacuucgaauuuccucagcccuaccagccgaacuuugaguucgugggcgggcugcacugcaagccugccaaagcucuccccaaggagauggaaaauuuuguucagucuuccggagaggauggcaucguggucuucagccuggggucucucuuucaaaacgugaccgaagagaaagccaauauuaucgcguccgcccuggcucagaucccucagaagguccuuuggcgcuacaaaggaaagaaacccagcacgcugggcgccaacacaagacucuaugacuggauuccccagaaugaccugcugggccacccuaagaccaaggcuuucaucacacaugggggaaugaacggcauuuacgaagccaucuaucacggggugccgaugguuggagugcccauuuuuggcgaucaacucgacaauaucgcgcauaugaaagccaagggggcugccgucgagaucaacuucaaaaccaugaccuccgaggaucugcuucgggcucugcgcacagugauuacggacucuagcuacaaggaaaacgccaugagacucucccggauccaccacgaucagccuguuaaaccccuggaccgcgccguguuuuggauugaguucgucaugagacauaagggagcuaagcaucugcggagcgcggcccacgaucuuaccugguuucagcacuauucuaucgacgugauuggcuuccuccuggcuuguguggccacagccaucuuucuguucaccaaaugcuuccucuuuuccugucaaaaguucaauaaaacaagaaagaucgaaaaacgcgaguga

SEQ ID NO: 77596 - RNA, 1587 nt, Artificial Sequence
  derived and/or modified sequence opt5 from UGT2B10__Homo_sapiens__NP_001066
auggcccugaaguggaccacagugcuccugauccagcuuagcuucuacuuuuccucuggcagcugcgggaaaguccugguuugggcugccgaguauucccucuggaugaacaugaagacgauucugaaagaacuugugcaaagaggacacgaggugaccguccuggcgucuagcgcuuccauccucuucgaccccaaugauucuagcacacugaagcuggaaguguacccuaccucccucacaaaaaccgaguuugaaaacauuaucaugcagcugguuaagcggcuuagcgagauucagaaggacacauucuggcugccguuuucucaggagcaagaaauccucugggccaucaaugauauuauccgcaacuucuguaaagacguggucuccaauaagaaacugaugaagaaacuucaggagagcagauuugauauuguguucgccgacgcuuaucugcccugcggcgaacuccuggccgagcuguuuaacaucccuuucguuuacucucauuccuuuagccccggguauucuuucgagcggcacuccggaggcuuuauuuucccucccagcuacgugccugucgugauguccaagcucucugaucagaugaccuucauggaacgcgugaagaauaugcuguauguccuuuacuuugacuucugguuucagaucuucaacaugaaaaagugggaucaauuuuacagcgagguucuggggagaccgacgacccucuccgaaacaaugcggaaagcugacauuuggcugaugcgcaauagcuggaacuucaaguuuccccauccuuuccuucccaauguggauuuugugggaggccugcacuguaaaccugccaagccccucccgaaagagauggaagaguucguccagucuuccggcgagaacggggugguuguguuuagccugggaucuauggucagcaauaugaccgaagagagagcgaacgugaucgccacagcucuggccaagaucccucagaagguucucuggcgguucgacggcaauaaacccgaugcucuggggcuuaacacccgccuguauaaguggauuccucagaacgaccuccugggacaucccaaaacgagagccuuuaucacacacggcggggcgaauggaauuuacgaagccaucuaucacggcauucccauggugggcaucccucuuuucuucgaccaaccggauaacaucgcucauaugaaggccaaaggggcugccguccggguggacuuuaauaccauguccucuacagaucugcucaacgcccugaagaccgucauuaaugaccccagcuacaaggagaacaucaugaaacugucccgcauucagcacgaucagccugugaagccccucgacagagcuguuuucuggaucgaauuugugaugcggcauaaaggagcgaagcaccuucgcgucgccgcucacaaucuuaccugguuccaauaucauagccuggaugugauuggcuuucuccuggccugcguugccacagugcuguucaucaucacgaaauguugccuguuuuguuucuggaaguuugcuagaaaggggaaaaagggaaaacgggacuga

SEQ ID NO: 77597 - RNA, 1590 nt, Artificial Sequence
  derived and/or modified sequence opt5 from UGT2B11__Homo_sapiens__NP_001064
augacccugaaguggacaagcgugcuccugcuuauccaccuguccugcuacuucucuagcggcuccugugggaaaguccucguuugggccgcugaguauucucauuggaugaacaugaagacgauucugaaagaacuugugcagagaggacacgaggugaccguccuggccagcuccgcgucuauccucuuugaccccaaugaugcuagcacacugaaguucgaaguguacccuaccucccugacaaaaaccgaguuugaaaacauuaucaugcaacagguuaagcgguggagcgacauucgcaaggauucuuucuggcucuauuuuucccaggagcaggagauccugugggaacuuuacgacaucuucagaaauuuuugcaaagauguggucagcaacaagaaagugaugaagaaacugcaagagucucgguucgacauuguuuuugccgaugccguguucccguguggcgaacuccuggcugcccuucugaauauccgcuuugucuauucccucagauucacacccggguacaccauugagcggcauagcggaggccugaucuuuccucccucuuauauuccuaucgugauguccaagcugagcgaccagaugacguucauggagcgcgugaagaacaugauuuacguccucuacuucgauuuuugguuccagauguccgacaugaaaaagugggaucaguuuuauucugaaguucuggggagacccaccacacuuuucgagaccaugggaaaagcugacaucuggcugaugcggaauagcugguccuuucaauucccucacccguuucuccccaacguggauuucgugggcggcuuucauugcaagccugccaaaccccugccuaaggaaauggaggaguucguccagagcucuggggaaaauggagugguuguguuuucccuuggcagcgucaucucuaacaugacagcggagcgcgccaaugugauugcuaccgcccuggcuaaaaucccccagaagguucucuggagauucgacgggaacaagccggacgcccugggacugaauacgcggcucuacaaauggauuccucagaacgaucugcuuggccaccccaagacacgcgcguuuaucacccacgggggagccaauggcauuuaugaagcuaucuaccauggcaucccuaugguggggauuccccuguucuucgaccaacccgauaacaucgcccacaugaaagcuaagggagccgccgucagacucgacuuuaacacaaugagcuccaccgaucugcuuaaugcucugaaaaccgugauuaacgacccucucuauaaggagaauaucaugaagcugucucggauucagcaugaucagccggucaaaccccuggaccgcgcgguguucuggaucgaauuuguuaugccucacaagggcgccaaacaccucagaguggcugcccaugaucugacaugguuccaauaccacagccuugacgucaucggguuucugcucgccuguguggcuacgguuauuuucaucauuaccaaguuuugccuguucuguuuuuggaaauucgcccggaagggaaagaaaggcaagagagauuga

SEQ ID NO: 77598 - RNA, 1593 nt, Artificial Sequence
  derived and/or modified sequence opt5 from UGT2B15__Homo_sapiens__NP_001067
augagccugaaguggaccuccguguuccuccugauccagcuuucuugcuacuuuagcuccggcucuugugggaaaguccugguuuggcccacagaguauagccacuggauuaacaugaagacgauccucgaagaacuggugcaaagaggacaugaagugaccguccuuacauccucugccagcacccuggugaaugcuuccaaaagcucugccauuaagcucgagguuuacccuacaucccugaccaaaaacuaucuggaagacagccuccugaagauccuugaucgguggauuuacggcgugucuaagaauacauucugguccuauuuuagccagcugcaggagcucugcugggaguacuaugacuacucuaacaaacuguguaaggaugcgguccuuaauaaaaagcugaugaugaaacuccaggaauccaaguucgacgugauccuggcugaugcccugaacccgugcggggagcuccuggccgaacuuuuuaauauccccuuccuguacagccuccgcuuuuccguuggauauaccuucgagaagaacggcgggggauuucuguucccucccucuuacgugccugucgugaugagcgagcuuuccgaccaaaugauuuuuauggaaagaaucaaaaauaugauucacaugcuguauuucgauuuuugguuccagaucuacgaccucaagaaaugggaucaguucuauagcgaggugcugggccggcccacgacccuguuugaaacaaugggcaaggcugagauguggcucauucgcaccuacugggacuucgaauuuccuagaccguuccugcccaacgucgauuuuguugggggacuucauuguaaaccugccaagccccugccuaaagagauggaggaguucgugcagucuuccggcgagaaugggaucguggucuuuagccucggaucuaugauuagcaacauguccgaagagucugcuaauaugaucgccagcgcgcuggcccaaaucccccagaaggugcuuuggcgguucgacggcaagaaaccgaacacacugggguccaauacccgccucuauaaguggcugccucagaacgaucugcucggacaccccaaaacgaaggcuuuuauuacacauggcggcaccaacgggaucuacgaagccauuuaccacggaaucccuaugguuggcauuccccuguucgcugaccagcacgacaauaucgcccauaugaaagcgaagggggccgcucuuagcguggauaucagaacaaugucuucccgggaccugcucaacgcccuuaagagcgucauuaaugaucccguguauaaagagaacguuaugaagcugucucgcauccaccaugaccaaccuaugaaaccgcuugauagagcuguguuuuggauugaguucgucaugcggcacaagggagccaaacaccuccgcguggccgcucauaaucugaccuggauccaguaccacucccuggacgucauugcguuucuccuggccugcguggcuaccguuaucuucaucauuacaaaguucugucuguuuugcuucagaaagcuggccaaaaagggcaaaaagaaaaagcgggauuga

SEQ ID NO: 77599 - RNA, 1008 nt, Artificial Sequence
  derived and/or modified sequence opt5 from UGT2B28__Homo_sapiens__NP_001193933
auggcccugaaguggaccagcgugcuccugcuuauccaccugggcugcuacuucuccucugggagcuguggaaaaguccucguuuggacaggcgaguauucccauuggaugaacaugaagacgauucugaaagaacuugugcagagagggcacgaggugaccguccuggcuucuagcgccuccauccucuuugaccccaaugaugcguucacacugaagcuggaaguguacccuaccucucucacaaaaaccgaguuugaaaacauuaucaugcaacagguuaagcgguggagcgacauucagaaggauuccuucuggcuguauuuuagccaggagcaagagauccuuugggaguuccaugacaucuuucgcaauuucugcaaagauguggucucuaacaagaaagugaugaagaaacugcaggaauccagauuugacauuaucuucgcugaugccuuuuucccguguggagaacuccuggccgcccuucugaauauucccuuuguuuacagccucugcuucacaccuggcuauaccaucgagcggcacucugggggacugauuuuucccccuuccuacauccccguggucaugagcaagcugucugaccagaugacguucauggagcgcgugaagaacaugauuuaugugcucuacuucgauuuuugguuccagaugugugacaugaaaaagugggaucaauuuuacuccgaaguccugggcagaccuaccacacuuuucgagaccaugggcaaagcugacaucuggcugaugcggaauagcugguccuuucaguucccgcaucccuuucucccuaacaucgauuucguugggggacugcacugcaagcccgcuaaaccucuucccaaggaaauggaggaauuugugcagucuagcggcgagaaugggguggucguguucucccugggaagcguuauuucuaacaugacagccgagcgcgcgaaugugaucgccaccgcucucgccaaaauuccgcagaagaucuga

SEQ ID NO: 77600 - RNA, 1110 nt, Artificial Sequence
  derived and/or modified sequence opt5 from UGT2B4__Homo_sapiens__NP_001284544
augagcaugaaguggaccuccgcccugcuccugauccagcuuucuugcuacuucagcuccggcucuugugggaaagugcuggucuggcccacagaguuuagccacuggaugaacauuaagacgauccucgacgaacugguucaaagaggacaugaggugaccgugcuugcuuccucugccagcauuuccuucgauccuaauagcccgucuacacugaaauuugaagucuaucccgugucccucaccaagacagaguucgaagacaucauuaaacagcugguuaagcggugggcggagcugccuaaggauaccuuuuggagcuacuucucucaggugcaggagaucauguggacauuuaacgacauccuccgcaaauucugcaaggauauugucuccaauaaaaagcugaugaaaaagcugcaagaaagcagauuugacgugguucuugcugaugccguguuccccuuuggcgagcuccuggccgaacuucugaagaucccuuucgucuauucucuccgguuuucccccggguacgcuauugagaaacacagcggaggccugcuguucccuccguccuaugugcccguggucaugucugagcucagcgaccagaugaccuucaucgaacgcguuaagaacaugauuuacgugcuguauuuugaguucugguuucagaucuucgauaugaaaaagugggaccaguuuuacuccgaagugcuugggagaccuacgacccugagcgagacaauggccaaagcugauauuuggcucauccggaauuacugggacuuccaauuuccccauccucugcuucccaacgucgaguucgugggaggccugcacuguaagccggccaaaccucuccccaaggagauggaggaauuuguucagucuuccggcgagaaugggguggucguguucagccugggaucuaugguuagcaacaccuccgaagaacgcgcgaaugugaucgccucugcucuggccaagauuccucagaaaguccucuggagauuugauggcaacaagcccgacacacuggggcuuaauacccggcuguauaaauggaucccccagaacgaccuccuggauauuaagcgcaugcuuuga

SEQ ID NO: 77601 - RNA, 1590 nt, Artificial Sequence
  derived and/or modified sequence opt5 from UGT2B7__Homo_sapiens__NP_001065
augagcgugaaguggaccuccgucauccugcucauucagcugucuuucugcuuuagcuccggcaacugugggaaaguucuugugugggccgcugaguacucucacuggaugaauaucaagacaauucuggacgaacucauccaaagaggacaugaggugacgguccuggccagcuccgcgucuauucuuuucgaucccaacaauagcuccgcucugaaaaucgaaaucuauccuaccagccucacaaagaccgagcuggaaaacuuuauuaugcagcagaucaaacgguggucugaccugccgaaggauacauucuggcucuacuuuucccaggugcaagagauuaugagcaucuucggcgacauuacccgcaaguuuugcaaagauguugugucuaauaagaaauucaugaagaaaguccaggaguccagauuugacgugaucuucgccgaugccauuuuucccuguagcgaacugcuugcugagcuguucaacaucccuuuuguuuauucucucuccuucagccccggguacacauucgaaaagcacuccggaggcuuuaucuucccucccucuuaugugccugucgugaugagcgagcugaccgaccagaugacguuuauggagcgggugaagaauaugauuuacguccuuuauuucgauuuuugguucgaaaucuuugacaugaaaaagugggaucaguucuacuccgagguucuggggcgcccgaccacacucagcgaaaccaugggaaaagccgacguguggcugauuagaaacucuuggaauuuucaauuccccuacccucugcuccccaacguggauuuugucggcggccugcauugcaagccugcuaaaccccuuccgaaggagauggaagacuucgugcaguccagcggggagaauggaguuguggucuuuucucugggcagcaugguguccaacaugacagaggaacgggccaauguuaucgcgucugcccucgcucagauuccucagaaagugcuguggcgcuucgacgggaacaagcccgauacccuuggacugaauacgagacucuauaaguggaucccucaaaacgaccugcugggccaccccaaaacacgggccuucaucacccaugggggagcuaacggcauuuacgaggccaucuaucacggcauucccauggucgggaucccucucuuugcggaucagccggacaauauugcccacaugaaggcucgcggagccgcugugagagucgauuucaacacaaugagcuccaccgaccugcuuaaugcccugaaacgggugaucaacgaucccagcuacaaggaaaauguuaugaaacucucucgcauccagcaugaccaaccugugaagccccuggauagagccgucuuuuggauugaguucgugaugcggcacaagggcgcuaaacaucuucgcguugcggcccacgaccugaccugguuucaguaucacucccucgaugugaucggguuccugcuggucuguguggcuacagugauuuuuaucguuacgaagugcugucucuucugcuuuuggaaauucgccagaaaggccaaaaagggaaagaacgacuga

SEQ ID NO: 77602 - RNA, 1470 nt, Artificial Sequence
  derived and/or modified sequence opt5 from UGT3A2__Homo_sapiens__NP_001161788
auggccggccagagagugcugcuccuggucggguuccuucugcccggaguucuccugagcgaggcugccaagauccuuaccauuuccacaguggacuuuaaaaaggaagagaaaucuuaccaagugaucagcuggcuggcgccugaagaucaccagcgggaguucaagaaauccuuugacuucuuucucgaagagacgcugggcgggcgcggaaaguucgagaaccugcucaauguccuggaauaucuugcucugcagugcucucauuuucucaacagaaaggauauuauggacagccugaaaaaugagaacuucgauauggugaucguugaaaccuuugacuacuguccguuccuuauugccgagaagcugggcaaacccuuuguggccauccucuccacaucuuucgggagccuggaguuuggacugccuaucccccucuccuaugucccuguguuccggagccugcuuaccgaucacauggacuucuggggccgcguuaagaauuuucugauguucuuuucuuucugcagacggcagcaacauaugcaguccacauuugauaacaccauuaaagaacacuucacagagggcagccgccccgugcucucucaucugcuucugaaggcugaacucugguuuaucaauuccgacuucgccuuugauuucgcuagaccucugcugccgaacaccgucuacgucgggggacucauggagaagcccauuaaaccugugccccaggaccuggaaaauuuuaucgccaaguucggcgauagcggguuugugcuuguuacgcugggaucuauggugaacaccugucagaauccugagauuuucaaagagaugaacaaugcguucgcccaccucccccaaggcgugaucuggaagugccaguguucccacuggccgaaagacguccaucuggcugccaacgugaagauuguugacuggcuuccucagagcgaucugcucgcucaccccuccauccggcuguuugugacacaugggggacaaaauucuaucauggaagccauucagcacggcgucccuauggugggcaucccccuguucggggaccagcccgagaacaugguucgcguggaagcgaaaaaguuuggagucagcauucagcucaagaaacugaaggccgagacccuugcucugaaaaugaagcaaaucauggaagauaaaagauauaaguccgccgcuguggccgccagcgucauucuccggucucacccucuguccccgacacagcgccuggugggcuggaucgaccauguucuucagaccgggggagcuacgcaccucaagcccuacguguuccagcaaccuuggcaugagcaguaucugcuggaugucuuuguguuccuccugggccuuacacuggggacccucuggcugugcggaaaacugcuuggcauggcgguuugguggcucagaggcgcccggaaggugaaagagacauga

SEQ ID NO: 77603 - RNA, 1626 nt, Artificial Sequence
  derived and/or modified sequence opt5 from UGT8__Homo_sapiens__NP_001121646
augaaaagcuacacccccuauuucauccugcucugguccgccgugggcauugcuaaagccgcgaagaucauuaucgucccuccgauuauguuugagucucacauguacaucuucaaaacacuggcuagcgcccuucaugaaagagggcaccauacgguuuuucugcucuccgagggacgggacaucgcccccucuaaccacuauagccugcagcgcuacccuggcauuuucaauuccaccacaucugaugcuuuucuucaaagcaagaugagaaacaucuucuccgggcggcugaccgccauugaacucuuugacauccuggaucauuauacaaagaauugcgaccugauggugggaaaccacgcucucauucagggccugaagaaggagaaauucgaucuucugcucguggaccccaaugauauguguggguuugucaucgcccaucugcuuggagugaaguacgcgguuuucagcaccggccugugguauccugccgaagugggcgcucccgccccucucgcuuacgucccggaguuuaacucucugcugacagaccgcaugaaucuccugcagagaaugaaaaacaccgggguguaccuuauuucccggcugggaguuagcuuccucgugcugcccaaguaugagcgcaucaugcagaaauacaaucuucugccugaaaagucuauguaugaucucguccacggcuccagccuguggaugcugugcacggacguggcccucgaguuucccagaccuacccugcccaacguggucuacguugggggaauccuuacaaagccggcgucuccucugcccgaagaucuccaacggugggugaauggcgccaacgagcacggguucgugcuggucuccuucggagcuggcgugaaauaucuuagcgaggacauugccaauaagcuggcuggcgcccucgggcgccugccucagaaaguuaucuggagauuuuccggacccaagcccaaaaaccugggcaauaacaccaagcucauugaauggcugccucagaacgaucuucuggggcauucuaaaaucaaggccuuccucagccacggaggccuuaauuccauuuuugagacaauguaccacggggugccggucgugggaaucccccuguucggcgaccauuaugacaccaugacgcggguucaggcuaagggcauggggauccugcucgaauggaaaacagugaccgagaaggaacuguacgaggcgcuggucaaagugauuaacaauccuagcuaccgccaaagagcccagaagcucucugagauccacaaagaucagcccggacauccugucaaccggacaauuuauuggaucgacuacauuauccgccacaauggcgcucaucaccugagagccgccgugcaccagaucuccuuuugucaauauuuccuucuggauauugcuuuuguucuccugcugggggccgcgcuucucuacuuccugcugagcugggugaccaaguuuaucuaucggaagauuaaaucucucuggagcagaaacaagcauuccaccgucaauggacacuaccauaacggcauccugaaugggaaauauaagcgcaacggccacauuaaacacgaaaagaaggugaaauga

SEQ ID NO: 77604 - RNA, 1038 nt, Artificial Sequence
  derived and/or modified sequence opt5 from UHMK1__Homo_sapiens__NP_001171692
auguuccugaccagacccaaggugugcgucgaccucaaccggcgcguuacacuguacggcguguuuacgauccacuucagcccuaaugugccguccagaugucuucugcucgagcugcuugaugucucugugagcgaacugcuccuguauuccucucaucaggggugcagcauguggaugauucaacacugugcccgggacguucuggaggcucucgccuuucugcaucacgaaggauacgugcaugcggaucuuaaaccccgcaacauccugugguccgcugagaaugaaugcuucaagcucauugacuuuggccugucuuucaaagaggggaaccaggaugucaaguauauccagaccgacggauacagagccccugaggccgaacuucagaauugucuggcucaagccggccuccagagcgauacagagugcaccuccgcuguggaccuguggagccuggggauuauccuccuggaaauguuuucuggaaugaaacuuaagcacacaguucggucccaggaguggaaggccaacagcucugcgaucauugaucacaucuucgccuccaaagcuguggucaaugccgcuauucccgccuaucaucugcgcgaccucaucaagagcaugcugcacgaugacccuucuagacggauucccgcggagauggcccuuuguuccccguuuuucagcaucccuuuugcuccccauauugaagaucuggugaugcucccuacccccgugcugcgccugcucaacguccuggacgacgauuaccuugagaaugaagaggaauaugaggacguuguggaggaugugaaagaagagugccagaaguacggcccugucgugucccugcucguucccaaagaaaacccgggcagagggcaaguguucgucgaguacgccaaugcuggagacucuaaggccgcccagaagcugcuuacaggccggauguuugaugggaaauucgugguugcuaccuucuauccucugagcgcguacaagcgcggauaucucuaccagacgcugcuguga

SEQ ID NO: 77605 - RNA, 4323 nt, Artificial Sequence
  derived and/or modified sequence opt5 from UHRF1BP1__Homo_sapiens__NP_060224
auggccggcaucauuaagaaacagauccugaagcaccucagcagauucaccaaaaaccugucccccgacaagauuaaucuuucuacacugaaaggggagggacaacucacgaaccuggaacuugaugaggaagugcugcagaauguccucgagcugccuaccuggcuggcuaucacacggguuuacugcaaccgcgccagcauuagaauccaguggaccaagcucaagacacauccgaucugucugugccuugacaaaguggaaguggagaugaagaccugugaggauccccggccucccaauggccaguccccuauugcgcuggcuucugggcaaagcgaauauggauuugccgagaaagucguggaaggcauguucaucauuguuaacuccaucacaauuaagauccacucuaaagccuuucaugcuagcuucgagcucuggcagcugcagggguacuccgugaaucccaacuggcagcaaagcgaccuucgccugaccagaauuacggauccuugccggggagagguccucaccuuuaaggaaaucacauggcagacccugcgcaucgaggccgacgcuacagauaauggcgaccaggauccggugaccacgccccugagacucauuacaaaccagggccggauccaaauugcccugaagcgcagaaccaaagacuguaauguuaucucuuccaaacuuauguuccugcucgaugaccugcuuugggugcugacagauagccagcucaaagcgaugaugaaguaugccgaaucucuguccgaggcuauggagaaaagcgcccaccagcggaagucucuggcuccugagcccguccaaauuaccccucccgccccguccgcgcagcagagcugggcccaggcuuuugggggaucccaaggcaacucuaauagcuccagcucucgccucucccaguacuucgagaaauuugacgugaaggaaagcucuuaucaucugcuuaucagcagacuggaccuccacaucugcgaugacucccagucucgggagccuggggugagcgccaaccgccugaugggaggcgcuaugcagcuuaccuucagaaagauggccuuugauuacuaucccuuccacugggccggggacuccuguaaacauuggguccggcacugcgaagcuauggagacaagaggacaaugggcgcagaagcugguuauggaauuucagagcaaaauggagaaguggcaugaggaaacgggccucaaaccucccuggcaccugggcguggauucucuguuccgccggaaggccgacucccucagcucucccagaaagaauccucuggagcgcuccccgagccaggggcggcaacccgcuuuccagccucccgccuggaacagacuucgcuccucuuguauggugguccggguggaugaccuggauauucaccagguuagcaccgccggacagccuuccaaaaagcccucuacacuccugagcugcuccagaaaacugcauaaccuuccgacccaagugagcgcuauccacauugaauuuacagaguacuacuucccugacaaucaggaacuccccgucccuugucccaaccuguauauccagcugaauggccucaccuuuacgauggauccugugucucugcuuugggggaaccuguucugccucgaccuguaccgcucccuggagcaauuuaaggccauuuauaaacuugaggacagcucucagaaggaugaacaucucgacauccggcuggaugcguucuggcugaagguuuccuuuccccucgagaaaagagaacgcgcugagcugcaccggccgcaggcccuuguguucagcgccucuggaaugaucgcuacaaauaccagacaugccccucacugcagcuguuccgaccugcagagccucuuucggggcuucgcugccgcggaguuuuuccacucuaacuacgaucauuuucccaagguccccgggggauucucccugcugcacaugcuuuuccuccaucacgccuuucaaauggacagcugccugccucagccgaauacccugcccccucagcgccccaaggcuuccugggaucucuggucugugcacuucacacagauuagccuggacuuugaaggcaccgagaacuucaagggccauacacuuaauuuugucgccccuuucccccuguccaucugggcuugucucccucugagauggcaacaggcccaggcgcggaaacugcuucucgccucugaagggagacugaagcccagcgcuuccuuuggaucuccggugcagagcgaggcccuggcuccugauuccaugagccacccccgcucuaagacggaacaugaccucaaaucccugagcggccuuaccgagguuauggagauucugaaggaagggucuuccggaauggauaacaaaggcccucucacagagcuggaagacguggccgauguccacaugcuggugcauagccccgcccacguucgggugagacuugaccacuaucaauaccuggcucuccugcgccucaaggagguccugcagagacuucaggaacaacugaccaaagacacagagucuaugaccggguccccgcuccagaaucagacggcgugcaucggcgugcuguucccuagcgccgagguggcucugcuuaugcaucccgccccuggagccguugaugcugacuccgccggcagcgauucuaccagccuggucgacuccgaacucucucccagcgaggaucgggaacugaaguccgacgcgucuagcgaucaggggcccgcuuccccugagaaagugcucgaagagucuagcauugagaaccaagacgugucccaggaacgcccgcacagcaauggagagcugcaggauucuggcccccuugcccagcaacuggccgggaagggacaugaagcugucgagucccuccaggccaagaaacugagcagaacacaggcgucuuccagcccugcugcccugaagcccccugccggccgggagaccgcugugaacgggcagggcgaacuuaucccccugaaaaauauugagggagaacucuccucugccauccacaugacaaaggacgcuaccaaagaggcccugcaugcgacgauggaucucacaaaggaagccguuagccugaccaaggacgcuuuuucccuuggccgcgauagaaugacaagcaccaugcacaaaaugcugucucugccuccggccaaggagcccauggcuaaaaccgacgaggggguggccgccccugucuccggaggcgcugcgcggcuccgcuucuuuagcaugaagagaacagugucucaacagagcuucgacgggguuucccuggauucuagcggacccgaagaccggaucuccguggauucugacggcagcgauuccuuugucaugcuucuggagagcgaaucugggccugaguccgugcccccgggcagccucuccaacguuucugacaacgccggagugcagggcagcccucuggucaauaacuaugggcagggaucccccgcugccaauucuagcgugucccccagcggcgaagaucucauuuuccacccugugucuguccugguucuuaaagugaacgagguguccuucgggaucgagguccgcggagaagaccugacgguggcccugcaagcugaggaacucacccugcagcagcuuggcacaguugggcuguggcaauuucuccauggccagugucccggaaccugcuuccaggagagcucuacacugaagaccggccacauuagaccugccguggggcuccgguuugaagucggaccgggcgcggcugugcauagcccccuggccucccagaauggguuccuucaucugcugcuccacggaugugaucuggagcuucugacgucuguucucagcggccugggcccuuuucucgaggacgaagagauccccguggucgugccuaugcaaauugaacugcuuaacuccucuaucacacugaaggaugacauucccccgaucuacccuaccagccccgggccuauccccauuacccuggccauggagcacguugugcucaaaagauccgacgauggagucuuccacaucggcgcugccgcgcaggacaagccuagcgcugaggugcugaaauccgaaaagcgccagcccccgaaagaacagguguuucuugucccuacaggggaaguuuucgagcaacaggugaaggaacugcccauucuccagaaggagcugaucgagaccaaacaggcccuggccaaugcuaaccaagauaaggaaaaacuccuucaggagauccggaaguacaaucccuuuuucgaacuguga

SEQ ID NO: 77606 - RNA, 2382 nt, Artificial Sequence
  derived and/or modified sequence opt5 from UHRF1__Homo_sapiens__NP_001276980
auguggauccaggugagaaccauggacggccggcaaacacacacggucgauagccugucccgccucaccaagguugaggaacugagacggaaaauucaggagcuuuuccauguggaacccgggcugcagcgccucuuuuacagaggaaagcagauggaggacggccacacacuguucgauuaugaagugcggcuuaacgacaccauccaacugcucguccgccagucucuggugcugccucauagcacaaaagagagagauuccgagcucucugacaccgauagcgggugcugucugggacaguccgaaucugacaagagcuccacacacggcgaggccgcugccgaaaccgauagccggccggcggacgaggauaugugggacgagacggaacuugggcuguacaaaguuaaugaguauguggaugcucgcgacaccaacaugggagccugguuugaagcccaggucgugagaguuacacggaaggcucccucucgcgacgagccuugcuccagcaccucuagacccgcccucgaagaggaugugauuuaccaugucaaguaugacgauuacccugagaauggcguggugcaaaugaacucccgggacguccgcgcuagagcccggacaaucauuaaauggcaggaucuggaaguuggccagguggugaugcuuaauuauaaccccgacaauccuaaggagagaggguucugguacgaugcggaaaucagccgcaaacgggagaccagaacggcccgcgaacuguacgcuaacgucgugcucggagacgauucucugaaugacugucggaucauuuuuguugaugagguguucaagaucgagagaccgggcgaagggucccccauggucgacaacccuaugcgccggaaaagcggacccuccugcaagcacuguaaggacgaugugaauagacugugccgcguuugugccugccaccucuguggcgggcggcaggacccugauaaacaacugaugugcgacgagugugauauggcuuuucauauuuauugccuugaucccccgcugucuagcgugccuuccgaagacgagugguacugccccgaauguagaaacgacgccagcgaggucgugcucgcgggagagcgccugcgggaaucuaagaaaaaggccaaaauggcuuccgccacaagcucuagccagagagauuggggcaagggcauggcuugcgucgggcggaccaaagaguguacaaucgugccuuccaaucacuauggacccauucccggcaucccuguugggaccauguggcgcuucagagugcaggucucugaaagcggagugcaucggccgcacguugccggcauucacgggagauccaacgacggagccuacagccuugugcuggcuggcggcuaugaggaugacgucgaucaugggaacuuuuucaccuacacaggaucuggcgggcgcgaccucuccggaaauaagcggacggcggagcaaagcugcgaccagaagcugaccaacacaaauagagcccuggcucucaacuguuuugcccccaucaaugaucaggaaggcgccgaggcuaaagacuggcgcucugggaagccugugagagugguucggaacgucaaaggcggaaagaacuccaaauaugcccccgcggaaggcaaucgcuacgaugggaucuacaagguggugaaguauuggccugagaaaggaaagagcggcuuccuggucuggagauaccuucugcggcgcgacgaugacgaacccgggccguggaccaaagagggaaaggauagaauuaaaaagcucggccugacaaugcaguauccugagggguaccuugaagcucuggccaaucgggagcgcgaaaaggagaacuccaaaagagaagaggaggaacaacaggagggcggauuugccucuccccggaccggcaaggggaaauggaagcgcaaaagcgcuggaggcgggccuuccagagccggaucuccccggagaacgagcaagaagacaaaaguggaaccuuauucccucaccgcucagcagagcucucugauccgcgaggacaaguccaaugccaaacuguggaacgaaguucucgcgagccugaaggaucggcccgccucuggcuccccguuccaacuuuuccugagcaaaguggaggagaccuuucagugcauuuguugccaggaacucgucuucagaccuaucacaaccgugugucagcacaauguuugcaaggacugucuggaucgcucuuuucgggcucaaguguucagcugccccgccugcagauacgaccuggggcgcuccuaugcuaugcaggucaaccagccccuucagacagugcucaaucaacuguuuccuggcuacggaaacggccgguga

SEQ ID NO: 77607 - RNA, 2409 nt, Artificial Sequence
  derived and/or modified sequence opt5 from UHRF2__Homo_sapiens__NP_690856
auguggauccaggugagaaccauugacggcagcaagacaugcacgaucgaggaugucucccggaaagccaccauugaagaacugcgcgaaagaguuugggcucucuucgacgugcggcccgagugucaacgccuguuuuacagagggaagcagcuugaaaacggauauacacuguucgauuacgacgugggccucaaugauaucauucagcugcuuguccggccugacccggaucaucugcccgggaccucuacacagaucgaggccaaaccuugcagcaacucucccccuaaggugaaaaaggcgccccgcguuggaccuuccaaucaaccgagcaccuccgcuagagcccggcucaucgaccccggcuuugggauuuauaaggugaacgagcuggucgaugcccgcgacgugggacugggcgcuugguucgaagcccacauccacucuguuacaagagcuagcgauggccagucccgggggaaaaccccucucaagaauggaagcucuuguaaacgcacgaacggcaauauuaagcauaaauccaaggagaacaccaauaagcuggacagcgugcccucuacauccaacagcgauugcgucgccgcggacgaagacgugaucuaccacauucaguaugaugaguacccugagucugggacccuugaaaugaaugugaaagaccugagaccccgggcccgcacaauccucaaguggaacgagcugaaugucggagauguugugauggugaacuauaaugucgaauccccgggccagagaggguuuugguucgacgcugagauuaccacgcuuaaaacaaucagccggaccaagaaagaacugagagugaagaucuuucucggaggcuccgagggcacacugaacgauuguaaaauuaucucuguugacgagauuuucaagaucgaacgcccuggggcccauccccugagcuuugcugauggaaaguuccuccggagaaacgacccugagugcgaucuguguggcggggaccccgagaaaaagugccacuccuguagcugccgcguguguggaggcaaacacgagcccaauaugcaacuucugugcgaugaaugcaacgucgccuaccauauuuacugucucaauccuccgcuggacaaggugcccgaggaggaauauugguacugcccuucuuguaaaaccgacuccagcgagguugugaaggcgggggaacggcuuaagaugucuaaaaagaaagccaagaugcccagcgcuuccaccgagucuagacgcgauuggggacggggcauggccugcgucggcagaacacgcgaauguacgaucgugccuagcaaccacuaugggcccaucccgggcauuccugucggauccaccuggcgguuuagagugcagguuagcgaggcuggggugcaucgcccccacgucggaggcauccacgggcggucuaaugacggcgccuacucccuggugcucgccggaggcuucgcugaugagguugacagaggggaugaauuuacauauaccggaagcggcgggaaaaaccuggcgggaaauaagcggauuggcgccccuucugcugaccagacacugaccaacaugaaucgcgcccucgcccugaacugcgaugcuccccuugacgauaagaucggggccgaguccagaaauuggcgggcgggcaaaccugugagagucauucgcagcuucaagggacggaaaaucuccaaguacgcucccgaagagggcaacagauaugacgggaucuacaaaguggugaaguacuggccggagauuucuagcucccauggauuccugguuuggcgcuaucuccugagacgggaugacgucgaaccugcccccuggacgucugagggcaucgaacgcagcagacggcuuugucugcgccuccaguaccccgccggguauccuuccgauaaggagggcaaaaagccgaaaggacaaagcaagaaacagcccucugggacaaccaagagaccuauuuccgacgacgauugccccagcgcuucuaaaguguacaaggccuccgacagcgcugaagccaucgaggcguuucagcugaccccucaacagcagcaccugauucgggaggauugucagaaucaaaagcucugggacgaagugcugucucaucuugucgagggccccaacuuccugaaaaagcucgaacagagcuuuaugugcguguguugccaggagcugguuuaucagccugugacaaccgaaugcuuccacaaugucuguaaagauugccugcaacgcuccuuuaaggcccagguguucagcugucccgcuugcagacaugaccuuggacagaacuacaucaugauuccgaacgagauccuccagacacugcuggaucucuuuuucccuggcuauucuaaagggcgguga

SEQ ID NO: 77608 - RNA, 2160 nt, Artificial Sequence
  derived and/or modified sequence opt5 from UIMC1__Homo_sapiens__NP_057374
augcccagacggaagaaaaaggugaaagaggucagcgaaucccgcaaccuggagaagaaagacguugaaaccacaucuagcguguccgugaagagaaagcggcgccucgaggaugccuucaucgucauuucugacagcgauggcgaagaaccuaaagaggaaaaugggcugcagaagacgaaaaccaagcaauccaacagagcuaaaugccuugccaagcggaagaucgcgcagaugacagaggaagaacaguuugcucuggcccucaaaaugucugagcaggaagcccgcgaggugaauagccaagaagaggaagaggaggaacugcuuagaaaggcuauugccgagucccugaacagcugucggccgucugacgcuuccgccacccgcagcagaccccucgcgacaggaccuucuucccagagccaccaggagaaaaccacagauucuggccugaccgaggggaucuggcagcugguucccccuucccucuucaagggaagccauauuucccaaggcaaugaagccgaggagcgggaagaacccugggaccacacggagaaaaccgaggaggagccugugucugggagcuccggaagcugggaucagucuucccagccggucuuugagaacgugaauguuaagagcuucgaccgcugcacaggccauucugcugaacacacccaguguggcaaaccccaagagagcacagggagaggauccgccuuucugaaggcugugcagggcucuggggauaccagccggcauugccuuccuacgcuggccgacgcgaagggacuccaggauacaggcgggaccgucaacuacuucuggggaauccccuuuuguccugacggcguggaucccaaucaauauacaaaagugauccugugccagcuugaagucuaccagaagucccugaaaauggcccagcgccaacuccugaacaagaaaggcuucggggagccgguucugccuagacccccuagccucauucagaaugaguguggacagggcgaacaggcuucugagaagaacgaaugcaucuccgaggacaugggggacgaagauaaggaggagcggcaagaaagcagagccucugacuggcacuccaaaaccaaggauuuucaggagagcuccauuaaaucucugaaggaaaaacuucugcucgaggaggaacccaccacaagccacggacaguccucucagggcaucguggaggaaacgagcgaggaaggaaauuccgugcccgcuagccaaucugucgccgcccugaccuccaagcgcagccuugugcugaugccugagucuuccgcugaagagauuacaguuuguccggagacccagcucagcucuagcgaaacauucgaccuggagcgggaagugucccccgggagcagagauauccuggacggcguccgcauuaucauggcggauaaggaggugggcaacaaagaggacgccgaaaaggagguugcuaucucuaccuuuuccagcuccaaucaggugucuugcccucucugugaucagugcuuucccccuacgaaaauugaacggcaugccauguauugcaacgggcugauggaggaagacacaguccuuaccagacgccaaaaggaggccaaaaccaagagcgauuccggaacagcugcccagaccucucuggacaucgacaagaacgagaaauguuaccucugcaagagccuggugcccuuccgggaauaucagugucacgucgauuccugccuucaacuggcgaaagcugaccagggcgaugggccggagggaucuggcagagccuguagcacaguggaagggaaguggcagcagcgccucaaaaauccuaaggagaaaggccauuccgaaggacggcugcugagcuuccucgagcaaucugagcacaagacguccgacgccgauauuaagagcucugaaaccggcgcuuucagaguucccuccccugggauggaggaagccggaugcagccgcgagaugcagucuuccuuuacacggagagaccugaacgaaagccccgugaaauccuucgucagcaucucugaggcuaccgauugucuuguggacuuuaagaaacagguuacagugcagccuggcagccggacccgcacgaaggccgggagaggacggagacgcaaauucuga

SEQ ID NO: 77609 - RNA, 735 nt, Artificial Sequence
  derived and/or modified sequence opt5 from ULBP1__Homo_sapiens__NP_079494
auggccgcugccgcgagccccgcuuuccugcucugccugccucuucugcaccuccuguccggcuggucuagagccggguggguggacacccauugucuuugcuacgauuuuaucauuacacccaagagccggccggagccucaguggugugaaguccaaggacugguugacgagcgccccuuccuccacuaugauugcgugaaccauaaagccaaggcuuuugccucccugggcaaaaaggugaaugucacgaaaaccugggaggaacagacagaaacccugagagacgugguugauuuccucaaggggcagcugcuugacauccagguggagaaccugauuccuaucgagccccucacacugcaagcucggaugucuugugaacacgaggcccauggacacggccgcgggagcuggcaguuucuuuucaauggacagaaguuucuccuguucgauuccaacaauagaaaauggaccgcgcugcacccuggcgccaagaaaaugacagaaaagugggagaaaaaccgggacgucaccauguuuuuccagaagauuucucugggcgauugcaagauguggcucgaggaauuucugauguacugggagcaaaugcuugacccgacgaaacccccuagccuggcucccgggaccacacagccuaaggccauggcuaccacacucucccccuggagccugcuuaucaucuuccuguguuuuauucucgccggacgcuga

SEQ ID NO: 77610 - RNA, 741 nt, Artificial Sequence
  derived and/or modified sequence opt5 from ULBP2__Homo_sapiens__NP_079493
auggccgcugccgcggcuaccaagauccugcucugccugccccuucugcuccugcuuagcggcugguccagagccgggcgggccgacccucacucucuguguuacgauauuacagugaucccgaaauuccgccccggaccuagauggugcgcuguccagggccaaguugacgagaagacguuucuccauuaugauugugggaacaaaaccgugacacccgugagcccucugggaaagaaacugaaugucaccacagccuggaaggcucagaaccccgugcuccgggaaguuguggacauucugaccgagcagcuucgcgauauccagcuggaaaauuacacaccuaaggagccgcucacccugcaagccagaauguccugcgaacagaaagcggagggccacucuagcggguccuggcaguucucuuuugacggacagauuuuccuucuguuugauagcgagaagcggauguggacgaccguccaucccggcgcccgcaaaaugaaggaaaaaugggagaacgacaaggugguugcuauguccuuccacuauuuuagcaugggcgauuguaucggguggcucgaagacuuccugaugggaauggauucuacacuggagccuuccgccggcgcuccccucgccaugagcucugggaccacacaacugagagcgaccgccacgacacuuauccugugcugucuccugauuauccuuccuugcuuuauucugcccggaaucuga

SEQ ID NO: 77611 - RNA, 735 nt, Artificial Sequence
  derived and/or modified sequence opt5 from ULBP3__Homo_sapiens__NP_078794
auggccgcugccgcgagccccgcuauccugccuagacucgccauucugccguaccuucuguucgacugguccggcaccgggcgggccgaugcucacucucucugguauaacuuuacaaucauucaucugccccgccacggacagcaauggugcgaggugcagagccaggucgaccagaagaauuuccuuuccuacgauuguggcucugacaaaguucugagcauggggcaucucgaggaacaacuguaugccacggaugcuuggggaaagcagcuggaaaugcucagagaggugggccagcggcugcgccuugaacuggccgacaccgagcucgaggauuuuacaccuuccgggccccugacccuucaggugagaaugucuugcgaaugugaggcggacggauacauccggggcagcuggcaauucuccuuugauggccgcaaauuccugcucuuugacagcaacaauagaaaguggacagucgugcacgccggggcucggcgcaugaaagaaaagugggagaaggauucuggacugaccacauucuuuaaaaugguuuccaugagagacugcaagagcuggcugcgggauuuccucaugcaucgcaaaaagagacuggagccuaccgcucccccuacgauggccccgggccuugcccagcccaaagcgauugccaccacacugucuccuugguccuuucucaucauccuguguuucauucuucccgggaucuga

SEQ ID NO: 77612 - RNA, 3153 nt, Artificial Sequence
  derived and/or modified sequence opt5 from ULK1__Homo_sapiens__NP_003556
auggagcccggcagagggggaaccgaaacagugggcaaguucgaguuuagccggaaagaccugaucgggcacggagccuucgcugucguuuuuaagggccgccauagagaaaaacacgaucucgagguggccgugaagugcauuaacaaaaagaaucuggcgaagucccagacgcuucuggggaaagaaaucaagauucucaaagagcugaagcaugagaacaucgucgcucuuuacgacuuccaagaaauggccaauucuguguaucugguuauggaguacuguaacggaggcgaucucgccgacuaucugcacgcuaugcggacccugagcgaagauacaauucgccucuuucugcagcagaucgccggcgcuaugagacuucugcauuccaaagggaucauucaccgggaccucaagccucagaauauccugcuuucuaacccggccggacgcagagcgaaucccaacagcauucgggugaagaucgccgauuucggcuuugcucgcuaccugcaauccaauaugauggccgcuacccucugcgggucuccuauguauauggcccccgaggucauuaugagccagcacuacgacggaaaagcggaucugugguccaucggcacaauuguguaucagugucugaccgggaaggccccuuuccaggcuagcucuccccaagaccucagacuguuuuacgagaaaaacaagacacuuguuccuaccaucccgcgggaaacguccgcuccccugcgccagcuccugcuugcccugcuccagagaaaucauaaagaucggauggacuucgaugaguuuuuccaccauccuuuucuggacgccagccccucugugcgcaaguccccucccgucccggugccuagcuaccccucuuccggaagcggcuccucuagcuccuccucuuccaccagccaccuggccucuccucccagccucggcgaaaugcagcaacugcagaaaacacuugcuucccccgcggacaccgccggguuccugcacucuagcagagauuccggaggcagcaaggacucuuccugcgauacagacgauuucgugauggucccugcucaguuuccgggggaccucguugccgaggcccccagcgcuaagccucccccugauucucugauguguuccggaagcucccuuguggccucugcgggccuggaaagccaugggcggacccccuccccgucuccucccugcagcuccagcccuucucccuccggcagagcuggaccuuucuccucuucccgcuguggcgccagcgugcccaucccggucccuacgcaagugcagaacuaucagcggauugagagaaaucuccagucucccacacaauuucagacccccagaagcuccgccauccggagaagcgggucuacauccccucugggauucgcucgcgccagcccgagcccucccgcucacgccgagcauggcgggguucuggcgcggaaaaugucucucggaggcgggagacccuacaccccuagcccccaggugggcaccauuccugaacgccccggaugguccggcacaccgucuccucagggggccgagaugcggggaggcagaagcccccgcccuggguccucugcucccgaacacagcccgcggacguccggacugggcugcagacuucauagcgccccuaaccugucugaccuccacgucgugcggcccaagcugccuaaaccucccaccgauccccugggggcuguuuuuagcccgccccaagccagcccuccccagccuucucacggccuucaguccugucgcaaucucagaggaagccccaagcugccugacuuccugcagcggaacccgcugcccccuauccucggcucucccacaaaagcggugccuuccuuugauuuccccaagaccccgagcucccaaaaccuucuggcccuccuggcuagacagggggucgugaugacaccuccccgcaaucggacccugcccgaccuuagcgaggucggaccuuuucauggccagccccucgggccuggacugagaccgggcgaagaccccaaggggccuuucggccgcucuuuuagcacguccagacugacagaucuccugcuuaaagccgcuuucggaacccaggcccccgacccuggcucuaccgagagccugcaagagaagcccauggaaauugccccguccgcuggguuuggaggcucucuccacccuggggcgcgggccggaggcacaagcucccccucuccugugguuuucaccguggggagcccucccuccggcagcacacccccgcagggaccucgcacgagaauguucucugcuggccccaccggguccgccucuagcuccgcccggcaucugguccccggaccuugcagcgaggcuccggcccccgaacugccugcgcccggccacggguguuccuuugcugauccuaucgccgccaaccuugagggagcugugacauucgaagcccccgaccucccugaggagacccugauggaacaggagcacacagaaauccugcgcggccucagauuuacccugcuuuucguucaacaugugcuggagauugcggcucucaaaggcucugccagcgaggccgcugggggaccggaauaucagcugcaggaguccgucguggccgaucagaucagccugcuuucucgggaauggggcuuugcugagcaacucgugcuguaccugaagguugccgaacuccuguccagcgggcuucagucugcgauugaccagauccgcgccggaaaacugugccucagcuccacggucaaacagguggugagacggcugaaugagcuguauaaggcuucugucgugagcugccaaggccuuucccugcgccuccagagauucuuucuggauaagcagcggcuccuggaccgcauucacucuaucaccgccgagcgccuuaucuucagccaugcuguucagauggugcaauccgccgcccuggaugaaauguuucagcaccgggagggguguguccccagauaccauaaggcucuccugcugcuugaaggacugcagcacaugcucagcgaccaagcggauauugagaacgugacaaaaugcaagcuguguaucgaacgccggcucucugcccugcuuaccggcauuugcgcuuga

SEQ ID NO: 77613 - RNA, 3111 nt, Artificial Sequence
  derived and/or modified sequence opt5 from ULK2__Homo_sapiens__NP_001136082
auggagguggucggcgacuucgaauacagcaagagagaucugguugggcacggagccuuugcugugguguuccggggccgccauagacagaaaaccgacugggaggucgccaucaaguccauuaacaaaaagaaucucucuaaaagccaaauccugcuugggaaggaaauuaagauccugaaagagcuccagcacgaaaacauuguggcgcuguaugauguucaggagcuucccaauuccguguuucuggucauggaguacugcaacggaggcgaccucgcugauuaucugcaggccaaggggacacugucugaagacacgauccggguguuccuccaucaaaucgccgcugccaugcgcauucugcacagcaaaggaaucauucauagagaucuuaagccucagaauauccugcucuccuacgcuaaccggcgcaaaucuagcguuuccggcauuagaaucaagauugccgacuuuggcuucgcgcgguaucugcacagcaauaugauggccgcuacccuuugugggucuccgauguacauggcccccgaggugaucaugucccagcacuaugaugcuaaggccgaccuguggagcaucggaacagucauuuaccagugccucgugggcaaaccucccuuucaagcgaacucuccucaggaucugcgcauguucuacgaaaagaauagaucccugaugcccagcaucccucgggagaccucuccguaucucgccaaccugcuucuggggcuccugcagcgcaaucagaaagacagaauggauuuugaggcuuucuuuucccaucccuuccuugaacaaggaccugugaagaaaagcugucccgucccuguucccauguacuccggcucugugagcggguccagcugcggaucuuccccgagcugucgguuugccucuccucccagccugccugacaugcagcacauucaggaggaaaaccucuccucuccuccccuggggcccccgaauuaucugcaagugagcaaggacuccgcuagcacaucuuccaaaaacagcucuugcgauaccgacgauuucguccucgugccccauaauaucuccagcgaccacuccugugauaugccuguuggcacagccggccgcagagccucuaacgaguuccuggugugcggaggccagugucagcccaccgucagcccucacuccgaaacggcucccauuccggugccuacccagauccggaacuaccaaagaaucgagcagaaucuuacaucuaccgcgagcuccgggacaaacguucauggaagcccccgcucugccgugguccggagauccaauaccagcccuaugggcuuucugcgccccgggucuugcuccccugugcccgcugacacggcccagacagucggacggagacucagcaccggcucuagccgcccguauuccccuagcccccuggugggcacaauucccgagcaguucucucaauguugcugcgggcacccucagggacaugauucccggagcagaaacuccucuggcagcccgguuccccaggcccaguccccucaaucucuucugagcggggcucgccuccaguccgcccccacccugaccgacaucuaccagaauaagcagaagcugcggaaacaacacucugauccugugugucccagccauacaggagcgggcuauuccuacagcccucagcccucuagaccggggucccucggcacgagcccuaccaagcaccugggaucuagcccccgcuccucugacugguuuuucaaaacaccucuucccaccauuaucggcuccccgacaaagaccacggcuccuuuuaaaauucccaagacacaggccagcuccaaccugcucgcccuggucacccggcacgggccugcugaggaacaaagcaaggauggaaaugaacccagagagugcgcccauugucugcuugugcagggcucugaacggcagcgcgcugagcagcaaagcaaagccguuuucgggagauccgugucuaccggaaagcucagcgaccagcagggcaaaacacccaucugccggcaccagggguccaccgacucucugaacacagagagaccuauggauaucgcgccggccggcgcuuguggaggcguccuggcucccccugccgggacggccgcgagcuccaaggccgugcucuuuaccgugggaucucccccucauagcgcugccgcucccacaugcacccacauguuccugcgcacacggaccacguccguuggcccuagcaauucugggggaucccuuugugccaugagcggcagagucugcguggggucuccgcccggcccuggauuuggcuccagcccucccggggccgaagcugcgcccucccugcgcuacgugccguauggagccucuccucccagccucgagggccugauuaccuucgaagcucccgagcugccugaagagacacuuauggagagagaacacaccgacacacuccggcaucugaacgucaugcugauguuuaccgagugugugcucgaucugacggccaugcgcgggggaaaucccgaacuuugcacauccgccguuagccuguaccaaauccaggagucuguggucguggaccagauuucccagcucagcaaagauuggggcagaguugagcaacuggugcuguauaugaaggcugcccagcuucucgcggcuucucugcaccuggccaaggcccagaucaaaagcgggaagcucuccccuucuaccgcugucaaacaagugguuaagaaccugaaugaacgguacaaauucuguauuacaaugugcaagaaacuuaccgagaagcugaaccgcuuuuucagcgacaagcagagauucaucgaugaaauuaauuccgugaccgccgagaaacucaucuauaacugcgcggucgaaauggugcagucugcugcccuggacgagauguuucagcaaacagaggauaucguguaccgguaucauaaggccgcucugcuucucgaaggccugagccgcauucugcaggacccggccgauaucgagaacguccacaaauacaaguguuccauugaaagacggcucagcgcucugugccauucuacggccaccguuuga

SEQ ID NO: 77614 - RNA, 1419 nt, Artificial Sequence
  derived and/or modified sequence opt5 from ULK3__Homo_sapiens__NP_001092906
auggccggccccggguggggacccccgagacuggacggcuucauccucaccgagcggcuggggagcggaacauacgcuacgguguauaaggccuacgcgaaaaaggauacccgcgaagucguugcuauuaaaugcguggccaagaaaucccuuaacaaggccucuguggagaaucugcucacagaaaucgagauucugaagggcaucagacacccccauauuguccagcuuaaagacuuucaaugggauagcgacaacaucuaucugaucauggaguucugugcugggggagaucucucccgguuuauucacacccgcagaauccugccugagaagguggcccggguuuucaugcagcagcuggcuucugcccuccaguuucugcaugagcgcaauauuagccaccuugaccugaaaccccaaaacauccuccuguccucucuugaaaagccucaucugaaacucgcggauuucggcuuugcccagcacaugagccccugggacgagaagcacgugcugagaggcuccccucuguacauggcuccggaaauggucugccagcggcaguaugaugcccgcguggaccucuggagcauggggguuauucuguacgaggcucuuuucggacaacccccuuuugccucuagauccuucagcgagcuggaagagaagauccggucuaaucgcgugauugaacucccccugagaccucuucugucccgggauugucgcgaccuccugcagagacugcucgagcgggaucccagcagacgcaucucuuuucaggacuucuuugcgcauccgugggucgaccuggaacacaugccuuccggcgagagccuugggcgggccacagcucugguggugcaggccgucaaaaaggaucaagagggagacuccgcugccgcccucucucuguauugcaaagcucuugauuucuucguucccgcgcugcauuacgaaguggacgcccagagaaaggaggcuaucaaagccaaggugggccaguacgucagccgcgccgaagaacucaaagcuauuguguccagcucuaaccaagcccugcugcggcaggggaccuccgcgagagaucuccugcgcgaaauggcucgggacaagccuagacuucuggccgcccucgagguugcuagcgccgcuauggccaaggaggaagcggccggaggcgagcaggaugcucuggaccuguaucagcacucucuuggcgaacuccugcugcuccuggccgcugagccucccgggcgccggagagaacuucugcacacagaggugcaaaaucucauggcccgcgcggaguaccugaaagaacaggucaagaugcgggagagcagaugggaagccgauacccuggacaaagagggacuuuccgagucugugcggagcuccuguacgcuccaguga

SEQ ID NO: 77615 - RNA, 3828 nt, Artificial Sequence
  derived and/or modified sequence opt5 from ULK4__Homo_sapiens__NP_060356
auggagaacuucauccuguacgaagagauuggcagagggagcaagaccguggucuauaaaggacggcgcaagggcacaaucaauuuuguugccauucucugcacggacaaauguaagagacccgaaaucaccaacugggugcggcugacacgcgagauuaaacacaagaauaucgugaccuuccaugaaugguacgagacauccaaccaccuuuggcuggucguggagcucugcaccgggggaucucugaagacaguuaucgcucaggaugaaaaucuuccugaggacguggucagagaauuuggcauugaucugaucagcgggcuccaucaucugcacaaacugggcauucucuucugugacaucuccccgcggaagauucugcuugagggacccggcacccugaaauuuucuaacuucugccucgccaagguggagggggaaaaucuggaggaauuuuucgcgcuuguugcugccgaggaaggaggcggggauaacggagagaaugugcugaaaaagagcaugaagucccgcgucaaaggcucuccuguguauacggcccccgagguggucagaggggcugacuuuagcaucuccagcgaucucuggucucugggaugucugcucuacgaaauguucuccggcaagccucccuuuuucagcgagucuauuuccgaacugaccgagaaaauccuuugcgaagacccucugccgcccaucccuaaggauagcucucggcccaaagccuccagcgacuuuauuaaccuccuggauggccuucugcaacgcgacccucagaagagacucacauggacccggcugcugcagcacuccuucuggaaaaaggcuuucgccggggcggaucaggagucuagcguugaggaccucucccugagccgcaauacaauggaauguucuggaccccaagacuccaaggagcuucugcagaacagccagucuagacaggccaaaggccacaagagcgggcaaccgcucggacauuccuuucggcuggaaaauccuaccgaguuccgccccaaaucuacgcuugaaggccagcugaacgagagcauguuucuccuguccagcagaccuacaccccggaccucuacagcuguggaggugucccccggggaagauaugacccacugcagcccucagaagaccucuccgcugacaaaaaucacguccggacaucucagccagcaagaccuggagucccagaugagagaacuuauuuauaccgauucugaccuggucgugacacccaucauugauaauccuaagaucaugaagcagcccccuguuaaauucgacgccaagauccuccaucugcccaccuacagcguggauaaacugcuuuuucucaaggaccaagauuggaacgacuuccugcagcaggucuguucccagauugauucuacagagaaaagcaugggcgcuucccgcgccaagcugaaccuccugugcuaucuuugugugguugcgggccaccaagagguggccacccggcugcuccacagcccgcuguuucagcugcuuauccagcaccucagaauugcuccuaauugggacauccgcgccaaggucgcucaugugauugggcugcuggccucucacacggccgaacuccaggagaacacacccgucguggaagcuaucguucugcuuaccgagcugauccgggaaaauuucagaaacuccaaacucaagcaaugccugcugccuacccuuggagagcucauuuaccugguggcgacacaggaggaaaagaagaaaaauccccgcgagugcugggccgucccucuggcugccuacaccgugcucaugcggugucugagagaaggcgaggaacgcguugugaaccauauggccgcuaagaucauugagaaugucugcacaacguuuagcgcccagucucagggguucaucaccggagagauuggccccauccuuugguaucuguuucggcacuccacagcggacagccucagaauuaccgcugugucugcccugugucgcaucacacggcacagcccgaccgccuuccaaaacgugaucgaaaagguugggcuuaauuccgucauuaacagccuggcuucugccaucugcaaagugcagcaguacaugcucacgcuguuugcugccaugcuguccuguggcauucaucuccagagacugauccaagagaagggauucgugagcaccauuauccggcuucuggauuccccuucuacaugcauccgcgcgaaagccuuccucguccugcuguauauucuuaucuacaauagagaaaugcugcuccugagcugucaggcucggcucgugauguauauugagagagacucccgcaagaccacacccggcaaagaacagcaaucugggaacgaguaccugagcaagugccuugaucugcucaucugucacauuguucaggagcugccccggauccugggagacauccuuaauucccuggccaacgugucuggcagaaaacauccuagcaccguccaggugaagcagcucaagcugugccucccgcugaugcccguugugcuucaccuggucacgucccaaguguuucgcccucagguugugacagaagaguuccucuuuagcuaugggaccauucugucucacaucaaauccgucgauagcggagaaacaaauauugacggcgcuaucgggcugaccgccucugaggaguucauuaagaucacccuuuccgcguuugaagccaucauucaguaccccauccugcucaaagauuacagaagcacagugguggacuauauucugccuccccucgucucucugguucagucccaaaacguggaguggcggcuuuucagccugcgccugcucuccgaaacgaccagccugcuugugaaccaggaguuuggcgauggaaaggaaaaagccucugucgacagcgauuccaaucugcucgcccugaucagagacgugcuccugccucaguacgagcauauucuucuggagcccgauccgguuccugcuuaugcccugaagcuccugguggccaugacagaacacaaccccaccuucacacggcuugucgaggaaucuaagcugaucccucucauuuuugaggugacccuggaacaucaggagagcauccucggcaauacgaugcaauccguuaucgcucugcuuucuaaccugguggcguguaaagacagcaauauggagcugcucuacgaacaggggcuggucucccacauuugcaaccuucugacagagaccgccacccucugccuggacguggauaauaagaacaauaacgaaauggcugcuccccuccuguucucucuucuggacauccugcauagcaugcucacauauaccuccggaauuguucgccuggcccuucaggcucagaaaagcggcucuggggaggauccgcaagccgcggaagaccugcuccugcugaauagaccucucacagaucuuaucucccugcugauuccccuccugccuaacgaggaccccgagaucuuugaugugagcucuaagugucuuuccauccugguccagcucuacggaggcgaaaaucccgacagccuguccccugagaacguggaaauuuucgcucaucugcucacgucuaaagaggauccgaaggagcagaaacuucugcugcggauccuccgcagaaugauuaccagcaaugaaaaacaccuggagucccuuaagaacgccgggagccugcuccgggcccuggaacgccuggcucccggcucuggauccuuugccgacagcgcgguggcuccucucgcccuugagauccugcaagccgucggccacuga

SEQ ID NO: 77616 - RNA, 1923 nt, Artificial Sequence
  derived and/or modified sequence opt5 from UMOD__Homo_sapiens__NP_001008390
augggccagcccagccugaccuggaugcucaugguggucguugccuccugguucaucacaacggcugccaccgacacaucugaggcgagauggugcagcgaaugucacuccaacgcuaccugcacagaggaugaagccgugaccacauguaccugccaagagggguuuacgggagacggccugaccuguguggaucuugacgaaugcgccauuccuggggcucauaauuguucugccaacagcuccugcgucaauacaccgggaucuuucagcugugugugccccgagggcuuucggcuguccccugggcucggauguaccgauguugacgagugcgcugaacccggccugagccacugccaugcccuugcgacaugugugaacgucgugggcucuuaccugugcguuuguccugccggguaucgcggagauggcuggcacugcgaguguucccccgggagcugcggaccuggccucgacugugugccggaaggggaugcucuggucugcgccgaccccugucaggcucauagaacccuggaugaguacuggcggucuacggaguauggagaaggcuacgccugcgacacagaucuccgcggcugguauagauucguggggcagggaggcgcgcggauggccgagaccugugugccuguccugcgcugcaauacagcugcccccauguggcuuaacgggacccacccuuccagcgacgaaggaaucguuucuagaaaggcuugcgcccacugguccggccauuguugccugugggacgccagcguccaggugaaggcuugugccgggggauacuauguguacaaucucaccgcgcccccggagugccaccuggcuuacuguacagauccuuccucuguggaaggcacgugcgaggaguguagcauugacgaagauugcaaauccaacaauggccgguggcauugucaaugcaaacaggacuuuaacaucaccgauauuagccuucuggagcaccgccucgaauguggggccaaugacaugaagguuucucugggaaaaugccagcugaagucccucggcuucgauaagguguuuauguaucugagcgacucuagaugcagcggguucaacgaucgggacaaucgcgauugggucuccgugguuacacccgccagagacggaccuuguggcaccgugcuuacacggaacgagacccacgcuacguacucuaauacacuguaucucgccgacgaaaucaucauucgcgaucugaacaucaaaauuaacuuugcgugcagcuacccccuugacaugaaggucucccugaaaaccgcucuccagcccauggugagcgcccugaauaucagagucgggggcaccggaauguucacagugcggauggcccuguuucaaaccccuucuuauacacagccguaccagggcuccagcguuacgcucucuaccgaggcuuuccuguauguggggacaaugcuugauggaggcgaccuguccagauuugcccuccugaugaccaacuguuacgcuacacccagcuccaaugccaccgauccucuuaaguacuucauuauccaggaccgcugcccccauacgcgggauucuaccauucaagucguggagaacggggaaagcucccagggaagauucucuguucagauguuucgcuucgcgggcaauuaugaccugguguaccuccacugugaggucuaucugugcgauacaaugaacgaaaaauguaagccuaccugcagcgggacacgguuuagauccggcagcgugaucgaccaaucucgcgugcugaaucucggacccaucacccggaagggcguucaggccacggucuccagagcuuucagcucucuggggcuucugaaaguguggcucccgcugcugcuuuccgccacacucacccugacauuucaguga

SEQ ID NO: 77617 - RNA, 3957 nt, Artificial Sequence
  derived and/or modified sequence opt5 from UMODL1__Homo_sapiens__NP_001004416
augcugagaaccagcggccucgcccugcuugcucugguguccgccgucgggcccucucaggcgagcggauucacagagaagggccucucccugcuuggguaccaacugugcucucaccggguuacgcauaccgugcagaaaguggaagcuguccagacaagcuauaccuccuacgugucuuguggaggcuggaucccuuggcgcagaugcccgaagaugguuuaucggacacaguaccucguggucgaggugcccgaaagccgcaacguuaccgacuguugcgagggguaugaacaacugggacuguacugugugcucccucugaaucaguccggccaguuuacaagcagacccggcgccugcccugccgaggggcccgagccuucuaccuccccguguagccuugauauugacugccccggacuggaaaaauguugcccuuggucuggcgggcgguauuguauggcucccgccccucaggcucccgagcgcgauccggucggauccugguacaacgugacgauccucgugaagauggacuucaaagaacugcaacaggucgauccuagacuucugaaucacaugcggcuccugcauagccugguuaccucugcccuccagcccauggcguccacagugcaccaucugcacagcgccccuggcaacgcuuccaccacagugucucgccuucugcucgggcugcccagaccccuuccugucgccgacgugagcacccugcucggagauauugcuaagcggguuuacgaggugaucuccguccaggugcaagacguuaaugagugcuuuuaugaagaacugaacgccugcagcggccgcgaacugugugcgaaucucgagggcucuuacuggugcgugugucaccaggaagccccggcuacgucccccagaaagcugaaccuugagugggaggauugcccucccgucagcgacuaugugguccugaaugugacaucugauagcuuccagguuuccuggcggcucaacucuacccaaaaucauacauuucacgugcgcgucuacagagggauggaacugcuucggagcgccagaacccagucccaggcucuggccguggccggacucgaggcuggcguucuguaucgcgugaaaaccagcuaccagggguguggagcggacgucucuacaacgcugaccauuaagacaaacgcccaaguguucgaagugaccaucaaaaucguuaaucauaaccucacagagaagcugcuuaaucgguccagcgucgaauaucaggauuuuucuagacagcugcuccacgagguggaguccagcuucccucccguggucuccgaccuguaccgcucuggcaaacugcggaugcagauugugagccuucaagcuggguccguuguggucagacucaagcugaccgugcaggacccgggauuuccuaugggcaucucuacgcuggcccccauucuccagccucugcuugccagcacaguuuuccagaucgaucgccaaggcacccgggugcaggacugggaugaaugcgucgacuccgcugagcacgauuguagccccgccgcguggugcauuaaccuggaagggucuuacaccugucagugcagaacaacccgcgacgcuacaccuucccgggccgggagagccugugagggcgaucucgugagccccacagggggaggccugucugcugccaccgggguuacagugccgggccugggaaccggcacagcugcccuugggcucgaaaacuuuacccuguccccuagccccggauauccccagggcacgccugcggccgggcaggcuuggaccccggagcccucuccucgccggggaggcagcaaugucgugggguacgacagaaacaauacaggcaagggaguggagcaggaacugcagggcaacuccaucauggagcccccuagcuggcccucuccuaccgaagaucccacagggcauuuccucuggcacgccacccgguccacgcgcgagacacugcuuaauccgaccuggcugagaaacgaggacagcggaccuuccggcucugucgaucucccccugacaagcacccugaccgcucuuaaaacgccugccugcguucccguguccauugggcggaucauggugucuaaugucacgagcaccggauuucaucucgcgugggaagccgaccuggcuauggacuccacauuccaacugacccucacaucuauguggagcccggccgugguucuggagaccuggaacacguccgugacacuuagcggccuggaaccugggguccuccaccugguggagaucauggcuaaggccugcggcaaagaaggagccagagcucaucugaagguucgcaccgcggcccggaaacuuauuggcaaggugagaaucaaaaauguccgcuauucugaguccuucagaaacgcuagcucucaggaguaccgggauuuucucgaacuguucuuucgcauggugagagggucccugcccgccaccaugugucagcacauggacgccggaggcguucggauggagguggucagcgugacaaaugggucuauuguggucgaguuccaccuccugaucauugcugauguugacgugcaggagguguccgccgcguuucuuaccgcuuuccaaacagucccucugcucgaagugauccgcggagauacguuuauccaggacuaugaugagugcgagagaaaggaagacgauuguguucccggcaccagcugccggaacacacugggguccuucaccuguagcugcgagggcggagcccccgacuuuccuguggaauacucugagcgcccgugugaaggcgauagccccgggaaugagacaugggccaccuccccugagagaccccugacgaccgcuggaacaaaggccgcguucguccagggcaccucuccuacaccccaggggcuuccucaacggcugaaccucaccggagcugugcgcguucugugcgaaauugagaaaguggucguggccauccagaagagauuucuccagcaggaaagcauuccggaguccucucuguaucuuagccaucccuccuguaaugucucucacagcaacggcacacaugugcugcucgaggccggcugguccgaaugcgggacccugaugcaaagcaacaugacgaauacaguugugcggaccacccugagaaacgaccuuucucaggagggaaucauucaccaccugaaaauccucuccccuaucuacugugcuuuccagaaugaucugcucacaagcucuggcuuuacccuggaauggggagucuacacgauuaucgaggaccuucauggagccggcaacuucgugacagaaaugcaacuguucauuggggacucccccaucccucagaauuauagcguuuccgcuucugaugacgugcgcauugaggucggacucuaccggcaaaagagcaaccugaaaguggugcugaccgagugcugggccacacccuccagcaaugcgagagauccgaucaccuuuucuuucauuaacaauuccugcccuguucccaacacauauaccaaugucaucgaaaacggcaauagcaacaaggcccaguuuaaacuucgcaucuucucuuuuauuaaugacagcaucguguaccugcacuguaagcuccgggugugcauggagucccccggcgcuacguguaagauuaacugcaacaauuucagacugcuccaaaacucugaaaccagcgccacacaucagauguccugggggccucugauccgcucugagggagaacccccucacgcugaggccggccuuggggccggauaugucgugcugauuguuguggcuaucuuuguccugguggcgggcaccgccacacuccugaucguucgguaccagagaaugaaugggcgcuauaacuucaaaauucagagcaauaacuuuuccuaccaaguguucuacgaguga

SEQ ID NO: 77618 - RNA, 1443 nt, Artificial Sequence
  derived and/or modified sequence opt5 from UMPS__Homo_sapiens__NP_000364
auggccguggcuagagccgcgcugggcccccucgucaccgggcuguacgacguucaggcuuucaaguuuggagauuucgugcuuaaaagcggccuguccucuccuaucuauauugaccuccgggggaucgugagccgcccgagacugcuuucccaagucgccgauauucuguuucagacagcccagaacgcuggaaucucuuucgacacggugugcggcguucccuacaccgcccucccucuggcuacagugauuuguagcaccaaucagauccccaugcugauccggcgcaaggagacaaaagauuaugggaccaagagacucgucgaaggaacaauuaacccuggcgagaccugccugaucauugaagacgugguuacguccggcucuagcgugcuugagaccgucgaagugcugcaaaaagaggggcucaaggugacagaugccaucguccugcuugaccgggagcagggaggcaaggauaaacugcaggcgcacgggauucgccuccauuccguuuguacccugagcaagaugcuggaaauccucgagcagcagaaaaagguggacgccgaaacagugggaagagucaaacgguuuauucaagagaauguguucguugcugccaaccacaauggcucuccccuguccaucaaggaggcuccuaaggaacuuagcuuuggggcccgcgcggagcugccgagaauccaucccguggccucuaaacuccugcggcuuaugcagaagaaagaaaccaaccugugccucuccgcugaugucagccuggcccgcgagcugcuccagcuggcugacgcccuuggaccuucuauuuguaugcugaagacgcacguggauauccucaaugacuucacacuggacguuaugaaagaacuuauuacccuggccaagugccaugaguuucucaucuucgaggauagaaaauuugcugacauuggcaacacagugaagaagcaauacgaaggcgggaucuucaaaaucgcguccugggccgaucuggucaaugcucacgugguccccggaagcggcgugguuaaggggcugcaggaggugggacucccucugcaccggggcugucuucugauugccgaaauguccucuaccgggagccucgccaccggagacuauacacgcgcugccgucagaauggcggaggaacauuccgaguuugugguuggcuucaucagcggcucucggguguccaugaaacccgaguuccugcaccugacgccggggguccagcuugaagcuggaggcgauaaccucgggcaacaguacaauagcccucaggaggugauuggaaagagaggcucugacaucauuaucguggggcgcggcaucauuagcgccgccgaucggcuggaagcugccgagauguauagaaaagcugccugggaagcguaccugucccgccucggaguuuga

SEQ ID NO: 77619 - RNA, 723 nt, Artificial Sequence
  derived and/or modified sequence opt5 from UNC119__Homo_sapiens__NP_005139
augaaggugaaaaagggcgggggaggcgccgggaccgcuacagagagcgcccccggaccuuccggccagucugucgcgccgaucccccaaccucccgcugaaagcgaguccgggucugaaagcgagccugacgccggacccggcccuagaccgggcccccugcagcggaaacagccuauugggcccgaagauguucucggacugcagcgcaucacgggcgacuaccuuugcuccccugaggagaacauuuauaagaucgauuucgugagauuuaaaauucgggacauggauucugggaccgugcuguucgaaaucaagaagcccccggucagcgagcgccucccuaucaauagacgggaccuggaucccaacgccggacgcuuugugagauaccaauucaccccugcuuuucuucggcugcgccagguuggcgccaccguggaguucacagucggggacaaacccgugaauaacuuuagaaugauugagcggcacuauuuccgcaaucagcuccugaaguccuuugauuuccauuuuggauucuguauccccagcucuaaaaacacaugcgagcacauuuacgacuuuccuccgcuguccgaagaacucaucagcgaaaugauuagacaucccuaugagacacagucugauuccuucuacuucguugacgaucggcuggugaugcacaauaaggcugacuauagcuacucuggcaccccuuga

SEQ ID NO: 77620 - RNA, 5112 nt, Artificial Sequence
  derived and/or modified sequence opt5 from UNC13A__Homo_sapiens__NP_001073890
augagccugcucugcgugggcguuaagaaggccaaguucgacggggcucaagagaaguuuaacaccuacguuacacugaaggugcaaaaugugaaauccacgaccaucgccgucagaggaucucagcccagcugggaacaggauuucauguuugagaucaaccggcuugaccugggccucacaguggaaguuuggaauaaggggcugaucugggauaccauggugggaacagucuggauuccucuucgcaccaucagacaguccaacgaggaaggcccgggggaguggcugacacucgacucucaagugauuauggcggauagcgagaucuguggaaccaaggaccccacguuccaccggauccugcuggauacccgcuuugaacucccucuggacauucccgaggaagaggcuagauauugggccaagaaacuugagcagcugaaugccaugcgggaucaggacgaauacuccuuccaggaugagcaagacaaaccucuccccguuccuucuaaccagugcuguaauuggaacuauuuuggcuggggcgaacagcauaaugaugacccggacagcgcuguggaugaccgcgauuccgacuacagaagcgagacaucuaacuccauucccccucccuauuacaccacaagccagccuaaugccucuguccaccaauauuccgugcggcccccgccucuggggagccgcgaaucuuacuccgauagcaugcauuccuacgaggaguucucugaaccccaggcucuuagcccuaccggauccagcagauaugccucuuccggcgagcugagccaggggucuagccaacucuccgaagacuuugaucccgacgagcacucucugcagggaagcgauauggaagacgagcgggaucgcgacuccuaccauagcugccacucuuccgugagcuaucacaaagacucucccagaugggaucaggacgaggaggaacuggaagaggaucucgaagacuuccuggaggaggaggaacuuccugaagaugaggaggaacuggaggaagaggaagaggaggucccggacgaucucggcuccuacgcgcagcgggaagacguugccguggcugagcccaaagauuuuaagcgcauuagccugccucccgccgcuccugggaaggaagacaaagcccccguggcgccgacggaggccccugauauggcuaaggucgcccccaaaccugcuacacccgacaaggugccugccgccgaacaaauccccgaggcugagccgccuaaagaugaagaguccuucagaccccgggaagacgaggaaggacaggagggccaggacucuaugagcagagcgaaggccaacuggcuucgcgcuuuuaauaaaguucggaugcagcugcaagaggccagaggcgaaggggagauguccaagucucucugguucaagggaggccccgggggaggccugauuaucauugauagcaugccugacauccgcaaacggaagccgaucccccugguguccgaucucgccaugagccugguccagucuagaaaagcugggauuaccuccgcccuugcgagcucuacacugaacaaugaggaacucaagaaccauguguauaaaaagacccugcaggcucuuaucuacccuauuuccuguaccacaccccacaacuucgagguuuggacggccaccacaccuaccuauugcuacgaaugugagggacugcucuggggcaucgcccgccagggcaugcggugcacagaauguggggugaagugccaugagaaaugucaagaccugcugaaugcugauugccuccagagagccgcugaaaagagcucuaaacacggagccgaggaccgcacccagaacauuaucaugguccugaaggaucggaugaaaaucagagagcgcaauaagcccgaaauuuuugagcuuauccaggaaauuuucgcggugacgaagacagcccacacccaacagaugaaagcugucaagcagagcgugcuggacggcaccuccaaauggagcgccaagaucucuauuacaguugugugcgcucaagggcuccaggccaaagauaagaccggauccagcgacccuuacgucacagugcagguuggcaagacgaaaaagcggaccaaaacaaucuaugggaaccugaaucccgugugggaggaaaacuuucauuucgagugucacaauuccucugauagaaucaagguccgggugugggacgaggaugacgacauuaaaagccgcgugaagcagagauuuaaacgggaauccgaugacuuccugggccaaaccaucauugagguuagaacacuuucuggagaaauggaugucugguacaaccucgacaagcgcaccgauaagagcgcgguguccggcgccauccggcugcauauuucuguggagaucaaaggggaagagaaggucgcuccguaucacgugcaguacacgugccugcaugagaaucucuuucacuucguuaccgacgugcagaacaauggagucgugaaaauuccugaugccaagggcgacgaugcuuggaaaguuuauuacgacgaaacagcccaggagaucguggaugaauuugccaugagauauggggucgagagcaucuaccaagcuaugacccacuucgcgugucuguccagcaaguacaugugccccggagugccugccguuaugucuacacuucuggcuaacauuaaugccuauuacgcccauaccacggcuuccacaaacgugagcgccucugaccgcuuugcggcuuccaauuucggcaaggagagauuugucaaacuccuggaccagcugcacaacagccuucggaucgaucucucuauguaucgcaacaauuuccccgccuccagcccggaaagacugcaggaccugaaguccaccguggaucuccugacaagcauuaccuucuuucggaugaaagugcaggagcuucaaucuccuccccgcgccagccaggucguuaaggacugugugaaggcuugccugaacuccaccuacgaauauaucuucaauaacugucaugagcucuacucuagagaauaucagacagauccugccaaaaagggggaggugcugcccgaggaacaaggccccagcauuaaaaaucuggacuuuugguccaaacuuaucacgcucaucgucucuauuaucgaggaagauaaaaacagcuacaccccuugccugaaucaguucccgcaggagcugaacgugggaaagauuuccgcggaaguuauguggaaucucuuugcucaggacaugaaauacgccauggaggagcacgauaagcaccggcuguguaagucugccgacuauaugaaccuucauuucaaagugaaguggcuguacaaugaauaugucacagagcuccccgcuuuuaaagaucgcgugccugaauaccccgccugguucgagccuuuuguuauccaauggcuggacgaaaacgaggaggugagcagagauuuccugcacggcgcucuugaacgggacaagaaagacggguuucagcagaccuccgagcaugcccucuucagcugcucugucguggaugucuuuucccagcugaaucagagcuucgaaauuaucaagaaacuggagugucccgacccucagaucgugggacacuauaugcgcagauucgcgaagacaauuucuaacguccuccugcaguacgccgauaucauuuccaaggacuuugcuagcuauugcuccaaagagaaggaaaaagugccgugcauccuuaugaauaacacccagcaacugcgggugcagcucgagaagauguucgaagccaugggcgggaaagagcuggaugcugaagccucugacauucugaaggagcuucaggucaagcugaacaauguucucgaugagcugagcagaguguuugccacguccuuccagccccauaucgaagagugugugaaacaaaugggagacauccucagccaggucaagggcacagggaacgugccugcuucugcgugcuccagcguugcccaggaugcugacaaugugcugcaacccauuauggaucuucuggacucuaaccucacccuguuugccaaaaucugugaaaagaccguccugaaacgcgugcuuaaggagcuguggaagcucguuaugaauacaauggagaagaccauugugcugccuccccucacagaucagacgaugaucggcaaccugcuucggaagcacggaaaaggccuggagaaggggagagucaaacucccgagccacuccgacggaacccagaugauuuucaaugccgcuaaggagcugggccagcugucuaaacuuaaagaccauauggugcgcgaagaggccaagagccugacaccuaaacaaugcgcggucguggaacucgcucuggauaccaucaagcaguacuuucacgccgggggaguuggccucaaaaagacauuccuggagaagucccccgaccuucagucucugcgguacgcccugagccucuauacccaggcuacggaucugcuuauuaaaaccuuugugcaaacacaguccgcccaggggcugggcgucgaagaccccgugggagagguuagcgugcaugucgaacucuucacccacccuggcacaggggaacauaaggugaccgugaaaguugucgcggcuaacgaucugaaguggcagacaucuggaaucuuuagacccuucaucgaggugaauauuaucggcccucaacucuccgacaaaaagcgcaaauucgccaccaagagcaagaacaauuccugggccccgaaauacaacgaaucuuuucaguucacgcugagcgcugaugccgggcccgaguguuaugagcuucaggugugcgucaaggacuacuguuuugcucgggaagauagaacagugggacuggccguucugcaacuccgcgagcuggcgcagcggggcuccgccgcuugcuggcuuccucugggcagacggauucacauggacgauaccgggcucaccgugcugcgcauccucucucagagaagcaaugacgaagucgccaaagaguucgugaagcugaaauccgacacacggagcgcugaagagggaggcgccgcccccgcuccuuga

SEQ ID NO: 77621 - RNA, 4776 nt, Artificial Sequence
  derived and/or modified sequence opt5 from UNC13B__Homo_sapiens__NP_006368
augagccugcucugcgugagagucaagcgggccaaauuccagggcucccccgacaaguuuaacaccuacguuacacugaaagugcaaaaugugaagucuacgaccgucgcugugcgcggggaucagccuagcugggagcaggacuucauguuugaaaucuccagacuugaucugggacucucuguugagguguggaacaaaggccugauuugggacacaauggucgggaccguguggaucgcccuuaagacaauucggcagagcgaugaagagggaccgggcgaaugguccacccuggaggcggagacacucaugaaggacgaugaaaucugugggacccgcaaucccacgccucacaaaauucugcuggacaccagauucgagcuccccuuugauaucccugaagaggaggcucgguauuggacauacaagugggaacaaaucaacgcccugggagccgacaaugaguauucuagccaggaagagucccagcgcaaaccccuuccuaccgcugccgcucagugcagcuucgaagauccggacucugccguugaugacagagacuccgauuaccggagcgagacaucuaacuccuuucccccucccuaucauaccgcgagccaaccuaaugccucugugcaccaguuccccgucccggugcgcuccccucagcagcugcuccugcaaggcagcuccagagacucuuguaacgauagcaugcaguccuacgaccuugauuaucccgagcggcgcgcuauuagcccuacgucuuccagcagauacggcucuagcugcaaugugucccaggggucuagccaacuguccgaacucgaccaguaccaugagcaggaugacgaucaccgggaaacagacagcauccauucuugucacuccagccacucucugucccgcgauggacaggccggcuuuggggagcaagaaaagccccuggaggucaccggacaggcugagaaagaagccgcgugcgagcccaaggaaaugaaggaggacgccacaacccauccuccgcccgaccucguucugcagaaagaucacuuccuuggcccucaggagagcuuucccgaggagaacgcuuccucuccuuucacccaagccagagcucauuggauucgggccgugacaaaggugagacugcagcuccaggaaauccccgacgauggggacccgagccugccucaguggcuucccgagggaccugccggcggccuguaugggauugauuccaugcccgaccuccgccggaaaaagccucugccccuggucucugaucucagccuggugcaauccagaaaagcuggaaucacgagcgcgauggccacccgcacaucucuuaaggacgaagaacugaaaucccacguuuacaagaagacccuccaggcucugauuuauccgaucagcuguacaaccccucacaauuuugagguguggacggccacaacccccaccuacugcuaugaaugugagggccuucugugggggaucgcccggcagggaaugagaugcucugaauguggcgucaaaugccaugagaagugccaggaucuccugaacgcugacugucugcaacgcgccgcggaaaaauccugcaagcacggggcugaggaucggacacagaauauuaucauggccaugaaagacagaaugaagauucgcgagcggaacaagcccgaaaucuucgaggugauuagagauguuuucaccgugaauaaagccgcucauguccagcaaaugaagacagugaaacagagcguccucgacggaacgucuaaguggagcgccaaaaucaccaucacagugguuugugcucagggccugcaggccaaggacaagaccggcuccagcgauccuuacgugacaguccaagugucuaaaaccaagaaacgcacgaagaccauuuuugggaaccuuaacccgguuugggaagagaaauuccacuuugaaugccauaauuccagcgaccggaucaaggugagagucugggaugaggacgaugacauuaagucccgggugaaacagcgccugaagagagagucugaugacuuccucggacagacaaucauugaagugcggacccugagcggcgagauggauguuugguauaaccuggaaaaacggacagacaaguccgcggucucuggggccauccgccuucagaucagcguggagauuaaaggagaagagaagguggcucccuaccacguccaauacaccugucuccacgagaaucuguuucauuaucugacggauauccagggcuccgggggcgugcggauuccugaagccagaggagacgaugcuuggaaaguuuacuucgacgagacagcccaggaaaucguggacgaguuugcgaugcgcuauggcauugagucuaucuaccaggccaugacccacuucgcuugccucagcuccaaguauaugugucccggggucccugccgugaugagcacacugcuugcuaacauuaaugccuacuaugcccauaccaccgcuucuacaaacguuuccgcgagcgauagauuugccgcuucuaauuucggaaaggaacgguuugugaaacugcucgaccaacugcacaacucccugcgcaucgaucuuagcacguacagaaauaacuuccccgccggcucuccugagcggcuccaggaccugaaguccaccgucgaucugcucacaagcaucaccuuuuuccgcaugaaagugcaggaacugcaauccccgcccagagccagccagguugugaaggacugcgucaaggcuugucuuaauucuacauacgaguauauuuucaacaauugccacgaucuguacagccggcaguaucagcucaagcaagaacugccucccgaggagcaggggccuuccauccgcaaccuggacuuuuggcccaaacuuauuacccucaucgugucuauuaucgaagaggauaaaaauagcuacacgccggugcugaaccaguucccucaggaacugaacgucggaaagguuuccgccgaggugauguggcaucucuuugcgcaagacaugaaauaugcucuggaggaacacgagaaggaucaucuuuguaaaucugccgacuacaugaaucugcacuucaaggugaaguggcuccauaacgaauaugucagagaccugcccgugcugcagggccagguuccugaguaccccgccugguuugaacaguucgugcuucaauggcucgaugagaaugaagacgucagccuggaguuucugagaggggcucucgagcgcgauaaaaaggacggcuuccagcagacauccgaacacgcccuguuuucuugcagcgugguugauguguucacccagcuuaaccaauccuuugagaucauuagaaaacuggaaugccccgacccuagcauccucgcgcacuacaugcggagauucgcuaagaccauuggaaaaguccugaugcaguaugccgauauccugucuaaggacuuuccggccuacuguacaaaggagaaacuucccugcauucugaugaauaacgugcagcaacuccgcguucagcuggagaagauguucgaagcuaugggcgggaaagagcucgaucuggaagccgcugacucccuuaaggagcuccaggugaaacugaauaccguccuggaugaacugagcaugguguucggaaacucuuuucaggugcggaucgacgagugugucagacaaauggccgauauccuuggccagguucgcgggacaggaaaugcguccccugacgcccgggcuagcgccgcucaggacgccgauuccgugcugagaccccucauggacuuccuggauggcaaccucacgcuguuugccaccgugugcgagaagacaguccuuaaacgcgugcugaaggaacucuggcggguugugaugaauaccauggagagaaugauuguccugccuccccugacagaccagaccgggacgcaacuuaucuucaccgcugcgaaggaacugucucaucucagcaaacugaaggaucacauggugcgcgaggaaacacggaaccucaccccuaaacagugugccguucuggaccuugcucuggauacaauuaagcaguauuuucaugccggcggaaauggccugaaaaagaccuuccucgagaaguccccggaccugcagagccuuagauacgcccugucucucuauacacaaaccacggauacacugaucaaaaccuuugugcggucccagaccacacaggggagcggagucgacgaucccgugggcgaggucucuauucaaguggaccucuucacccacccugggacgggagaacauaagguuacagugaaagucguggcugccaacgaucugaaguggcagaccgcgggcauguuucgccccuucguugaggugacaauggucgggccucaccagagcgacaaaaagagaaaguuuaccacaaaauccaagucuaauaacugggcucccaaauacaacgaaaccuuccacuuccuucugggcaaugaggaaggaccggagagcuaugagcugcagaucugcgugaaggacuacuguuuugcccgggaagaucgcgugcucggccuggccguuaugccucuuagagacgucacggcuaaaggguccugcgccuguuggugcccccugggacggaagauccauauggaugagaccggccucacaauucugagaauccucucucaacgcagcaacgacgaaguggcgcgggaguucgugaagcugaaauccgagagcagaucuaccgaagagggguccuga

SEQ ID NO: 77622 - RNA, 6645 nt, Artificial Sequence
  derived and/or modified sequence opt5 from UNC13C__Homo_sapiens__NP_001074003
augguggccaacuucuuuaagagccugauccuccccuacauucacaagcugugcaagggcauguucaccaagaaacuugggaauaccaacaaaaauaaggaauauagacaacaaaagaaagaccaggauuuuccuacggcuggacagaccaaguccccgaaauucucuuacacauuuaagagcaccgucaaaaagaucgccaaguguuccucuacacauaaccugagcaccgaagaggacgaagccuccaaagaguucucucucagccccacauuuuccuaucggguugcuauugccaauggccugcagaagaacgccaaagugaccaauagcgauaacgaagaccuucugcaagagcucucuuccaucgagagcucuuacuccgaaagccugaaugagcugagaucuuccacggaaaaccaggcucagagcacccacacaaugccugugagacggaaucgcaaguccucuagcucccucgcccccagcgaggggucuuccgauggagagagaacccugcauggccuuaaacugggggcucuccggaagcugcgcaaauggaaaaagagccaggaaugcgucucuagcgacuccgagcuuucuacaaugaaaaagagcuggggaauuagauccaaaagccuggaucggaccgugcgcaacccuaagacgaaugcccucgaacccggcuucucuuccagcggcuguaucucucaaacacacgacguuauggagaugaucuuuaaagaacugcaggggauuucccagaucgagaccgagcugagcgaacucagaggacaugugaacgcgcugaagcacuccauugaugagaucucuagcuccgucgaagugguucagucugagauugaacaacuucggacaggcuucgugcagagccgcagagagacccgggacauccacgauuauauuaagcaucuggggcacaugggauccaaagccagccuccgcuuucugaaugucaccgaggaaagauucgaguacguggaaucuguggucuaucagauccuuaucgacaagaugggcuuuuccgaugcuccuaacgccauuaaaaucgaguucgcucaacggauugggcaucagagagacugcccgaacgccaagccccgcccuauccugguuuacuucgaaacaccccagcagcgggacagcgugcucaaaaagucuuacaagcugaaaggaacgggcauuggcaucuccaccgauauccugacacacgacauuagagagcgcaaggagaaagggaucccuagcucucaaaccuaugaaagcauggcgauuaagcucuccacacccgagccgaaaaucaagaagaauaacuggcagagcccugaugacucugaugaagaccuggaguccgaucuuaaucggaacagcuacgccgugcuguccaaaucugagcuccugaccaagggaagcacguccaaacccucuagcaagucccacucugcuagaagcaaaaauaagacagccaacuccagccgcauuucuaauaaauccgacuaugauaagaucagcucucagcuuccugaauccgacauccuggagaagcagaccaccacacauuacgcugaugccacaccccuguggcacagccaaucugacuuuuucacagccaaacugucccggagcgaauccgacuuuagcaagcugugucagucuuauagcgaggauuucuccgaaaaccaguuuuucacgagaaccaauggcucuagccuccuguccucuagcgaccgcgagcuuuggcagcggaaacaagaggggacagcuacccuguacgauucccccaaggaccagcaucucaacggaggcguccaggggauucagggacaaacagaaaccgagaauacggaaaccguggauucuggcaugagcaacggcaugguuugcgcguccggggacagaagccacuauucugauucccagcugagccugcaugaggaccuuucuccuuggaaagaauggaaucagggagccgaucucggccuggacuccagcacacaagagggguuugauuacgagaccaacucccuguucgaccagcagcucgauguguacaauaaggaccuggaauaucuuggaaagugucacucugaccugcaggaugacagcgaguccuacgaucucacacaagacgauaacagcucuccgugccccggccuggacaacgaaccucaggggcagugggucggccaguaugauuccuaccaaggagcuaauagcaacgagcuguaucagaaucagaaccagcuuucuaugauguaccgcagccaauccgaacuccagucugacgauagcgaggacgcgcccccuaaauccuggcacucucggcugagcaucgaucuguccgacaagaccuuuagcuuccccaaauuuggcucuacgcuccagagagccaaguccgcucuggaggugguuuggaauaaaagcacacaaucccuuucuggguaugaagauagcggauccucucugaugggccgguuccgcacccucagccaguccacagccaacgagagcucuaccacccuggacuccgacguguacacagaaccguacuauuacaaggcggaggaugaggaagacuauacggagccugucgcugauaaugaaaccgacuacguggaggucauggaacaggugcuggccaaacuugagaacagaacaagcauuaccgagacagaugaacagaugcaagccuaugaccaucucucuuacgagacccccuaugaaacgccucaggaugagggguacgacggacccgcugaugacaugguuuccgaagagggccuggagccucugaaugaaacaagcgccgagauggaaauccgggaggaugaaaaccagaauauucccgagcagccgguggagaucaccaaaccuaagcgcauucgccccucuuuuaaagaagcugcccuccgggcguacaagaaacaaauggccgagcuggaagagaagauccuugcuggggacagcuccucugucgacgagaaggccagaaucgugagcggcaacgaucuggacgcuuccaaauucagcgcccuccagguuuguggaggcgcgggcggagggcuguaugggauugauuccaugcccgaccugcgcagaaagaaaacccuuccuaucgugcgggaugucgccaugacacucgcugcccgcaagucugggcugagccuggcuauggugauuagaaccucccucaauaacgaagaacugaaaaugcacguguucaagaaaacacuucaggcccugaucuacccgaugucuagcacgauuccccauaauuuugaaguuuggaccgccacaaccccuacauauugcuacgagugugaaggccuccugugggggaucgcucggcagggcaugaagugccuggagugcggagucaagugucacgagaaaugccaagaccuucugaacgcggauugucuccagcgcgccgcugaaaaguccucuaaacacggcgccgaggacaagacccagacgaucauuaccgccaugaaagaaagaaugaagauccgggagaagaaccgccccgaaguguucgaggugauucaggagauguuucaaaucagcaaagaagauuucguccaguuuacaaaggcugccaaacaguccgugcuggacgggaccagcaaguggucugcgaaaauuacaaucaccguuguguccgcucaaggacuccaggccaaggauaagacaggcagcucugacccuuaugucaccgugcagguugggaaaaauaagagacggacgaaaacaaucuucggaaaccugaaucccgugugggaugagaaguuuuacuucgaaugccauaacuccaccgaccgcauuaaagucagagugugggacgaggaugacgauaucaagagccggguuaagcagcacuuuaaaaaggaaucugacgauuuccuuggccaaaccauuguggaggucagaacacuguccggggagauggacgugugguauaaucucgaaaaacgcaccgauaagagcgccguguccggcgcuauccggcugaaaauuaacgucgagaucaagggagaagagaagguugccccuuaccauauccaguacacgugucugcacgagaaucuuuuucauuaucugacagaagugaaaagcaacggcggggugaagauucccgaggucaaaggagacgaagcguggaagguguucuuugaugacgcuucucaggagaucguugaugaguucgccaugagauacggcauugagagcaucuaucaggccaugacccacuucuccugccucucuagcaaauacauguguccgggggugccugcugucauguccacacugcucgccaauauuaacgcuuuuuaugcccacaccacagugucuaccaauauccaaguuagcgcguccgaccgcuucgccgcuacgaacuuuggacgggagaaguucauuaaacugcuugaucagcugcauaauucucucagaaucgaccugagcaaguaccgcgaaaacuuucccgccuccaauaccgagcggcugcaggaccuuaagagcacaguggaucugcucaccucuaucacauucuuuagaaugaaaguccuggaacuccaguccccucccaaggcuagcauggugguuaaagacugcgugcgcgccugucuggauucuaccuauaaguacauuuucgacaacugccacgagcuuuacucccaacugacggauccgagcaaaaagcaggacaucccucgggaagaucagggccccacaaccaagaaccuggacuuuuggccucaacucauuacacugauggucaccaucauugaugaggacaaaaccgccuauacacccgugcuuaaucaguucccccaggagcugaacaugggcaagaucuccgcugaaaucauguggacgcucuuugcgcuggauaugaaauacgcccucgaggaacaugagaaucagagacuguguaagucuaccgacuauaugaaccuucacuucaaagugaagugguucuacaaugaauauguccgggagcugccugcuuuuaaggacgccguuccggaguacagccugugguucgaacccuuugugaugcaauggcucgaugagaacgaagacguguccauggaguuccugcauggggcccuuggacgcgauaaaaaggacggcuuucagcagacaagcgagcacgcucuguucucuugcuccgucguggauguuuuugcccagcucaaucagagcuucgaaauuaucaaaaagcuggagugcccuaaccccgaagcgcucucucaccugaugagacgguuugcuaaaaccauuaauaaggugcuucugcaguaugccgccaucgucagcuccgacuucucuagccauugugauaaggagaacgugccuugcauucugaugaauaacauccagcagcuccgcguucaacuggagaagauguuugaguccaugggaggaaaggagcuugacucugaagcuagcacaauccugaaagagcuccaggugaagcuguccggcguccucgaugaacugagcgugaccuacggggagucuuuccaggucauuaucgaagaguguauuaaacagauguccuuugagcuuaaucaaaugagagccaacggaaauacgacaagcaacaaaaauuccgcggcuauggacgccgaaaucgugcugcggucucugauggauuuccucgacaaaacccugagccuuuccgccaagauuugcgagaagaccguucugaaaagagugcucaaggaacuguggaaacugguccucaacaagaucgagaaacagauugugcuucccccucugacagaucagaccggcccgcaaaugaucuucaucgcugccaaggaccugggccagcucucuaagcugaaagaacacaugauucgcgaggacgcucgggggcuuacacccagacagugugccaucauggagguugugcuggcgacgauuaagcaguacuuucaugccggaggcaacgggcucaaaaagaauuuccuggaaaagagcccugaucugcaaucccuccgcuaugcucuuagccuguacacccagacaaccgacgcccugaucaagaaguuuauugauacacagaccucucagucccggagcucuaaagacgcugucggacaaaucuccgugcacguggauaucacggccacccccggcacaggggaccacaagguuaccgucaaagugauugccaucaacgaucucaauuggcagacaaccgcuauguucagaccuuuuguggaggucugcauucugggacccaaccuuggcgacaagaaacgcaagcagggcacaaagacgaaaagcaauaccuggucuccgaaguauaacgaaacauuccaguuuauccuggggaaagagaaucggccuggagcguacgagcuccaucuguccgugaaggauuauuguuucgccagagaagaccgcauuaucggcaugaccguuauccaacugcagaacauugcugagaaagggagcuacggagccugguauccccuccuuaagaauaucucuauggaugaaaccggccugacaauucugagaauccucagccagcggacguccgacgacguggccaaagaguuuguccgccucaagagcgaaaccagauccacagaggagucugcuuga

SEQ ID NO: 77623 - RNA, 3273 nt, Artificial Sequence
  derived and/or modified sequence opt5 from UNC13D__Homo_sapiens__NP_954712
auggccacccugcucagccacccccagcaaagaccuccguuccugcggcaggcuaucaagauucgcagacggcgcgugagagaccuucaggaucccccuccccagauggccccugagauccaacccccuucccaucacuuuucuccggaacagcgggcgcugcucuacgaggacgcucuguauacaguccuucaucgccugggccaccccgaaccuaaccauguuacggaggccagcgaacuccugagauaccugcaggaggccuuccacguggagcccgaggaacaccagcaaacccuccagcgggugcgcgaacuggagaaaccuauuuucugccuuaaggcuacagucaaacaggccaaggggauccugggaaaagauguguccggcuucucugaccccuauugucuccuggggauugagcagggaguuggcgugccugggggaagcccgggcuccagacaucggcaaaaggcugucgugcgccacaccauccccgaagaggaaacacauagaacccagguuaucacacagacccuuaauccugugugggaugagacguuuauucuggaauuugaggacaucaccaacgccucuuuucaccucgauaugugggaccuggauacagucgagagcgugcggcaaaagcugggcgaacucaccgaccugcacgggcuucgcagaauuuucaaagaggcgcggaaggauaaaggacaggacgauuuucugggcaaugugguccucagacugcaggaccuucgcugccgggaagaccagugguacccccuggagcccagaacagaaaccuauccugaucgcgggcaaugucaucuccaguuccagcugauccacaagcggagagccacguccgcuagccgcucucagccguccuacacaguucaucugcaccuccugcaacagcuugugagccaugaggugacccagcacgaggccggaucuacauccugggacggcagccugucuccccaggcugccaccguccucuuucugcacgcgacccaaaaagaucuuuccgacuuccaucagagcauggcccaguggcuggcuuauucccggcucuaccagucucuggaauuuccuagcuccugccugcuccaccccauuacaagcaucgaguaccaauggauucaggggagacugaaggccgaacagcaagaggaacuugcugccucuuucuccagccugcucacguauggacugucucugauccgccgguucagaagcguguuuccucuuuccguuucugauagccccgcccgccuccagucccugcugcgggugcucguccagauguguaagaugaaggcuuucggcgagcugugcccgaacaccgcgccucuuccccagcuggugacagaggcccuccaaaccggcacaaccgaaugguuucaucugaagcagcagcaccaccagccuaugguucaagggauccccgaggcuggaaaagcccugcuuggccucgugcaggacgucauuggggaucugcaucagugucagagaacgugggacaagaucuuccacaauacacugaaaauucaucucuuuagcauggccuuccgggaacugcaauggcuuguggcuaagcgcguccaggaucacaccaccgugguuggagacguggucucuccugagaugggcgagucccuguuucagcucuacaucagccugaaagaacugugccaacuuagaaugucuuccagcgagcgggauggggugcucgcccuggacaacuuccauagaugguuucagcccgcgauuccguccuggcugcagaagacauauaaugaagcucucgcccgcguucagcgggccgugcaaauggacgagcuggucccucuuggagaacugaccaagcacucuacaagcgcuguggaucucuccacguguuucgcccagaucucucacaccgcuagacagcuggacuggcccgaucccgaggaggccuuuaugaucacagugaaauucguugaagauaccugccgccuggcgcuugucuacuguagccucauuaaggccagagcucgggagcuguccagcggccagaaagaccaaggccaggccgcuaacaugcugugcgugguggucaaugacauggaacagcuccgccuggugaucgggaaacuuccugcccagcuggcgugggaggcccucgaacaaagaguuggagcugugcuggagcagggccagcugcagaacacacuucaugcccaacugcagucugcucucgccgggcugggacacgagauucggaccggcguccgcacgcucgccgaacagcuggagguggggaucgcuaaacauauucaaaaacuuguuggcgugagagaauccguccugccggaggaugcgauccucccccugaugaaguuucuggaaguggagcuuugcuauaugaauaccaaccugguucaggagaauuucagcucucuccugacacuccuguggacccacacacuuaccgugcuggucgaagccgcugccucccagcggagcucuagccucgccuccaaccgccugaagaucgcucugcagaaucuugagauuuguuuccaugccgaaggaugcggccugccucccaaggcgcuccacacggcuacauuucaagcccugcagagagaccucgagcugcaggccgcuagcucucgggagcuuauccgcaaauacuucuguucccggauucagcaacaggccgaaaccacaagcgaggaacugggggcggugaccgugaaggcuuccuauagagccucugagcagaaacugagagucgaacuccugagcgccuccucucuucugccucucgauagcaacggauccucugaccccuuuguucagcugacccucgagccucgccacgaguuccccgaacuggcugcccgggagacacaaaagcauaagaaagaucuucacccgcuguuugacgaaacguucgaguuucuggugccugcugaacccugcagaaaggccggcgcgugucuccugcuuaccgugcuggauuacgacacacucggggccgacgaucuggagggagaggcuuuccucccucugcgcgaaguccccggccuuagcggguccgaggaaccgggcgaggugccucagacccggcugccccugacauacccugcccccaacggagaccccauccuccagcugcuugaaggcagaaaaggggaucgcgaggcucaaguuuuugugcggcugagacgccaucgggccaagcaggccagccagcacgcucucagaccugcgccguga

SEQ ID NO: 77624 - RNA, 2790 nt, Artificial Sequence
  derived and/or modified sequence opt5 from UNC45A__Homo_sapiens__NP_001034764
augaccgccagcuccguggagcagcugagaaaggaaggcaacgagcuuuucaaaugcggggacuacggaggcgcucuggccgcguauacacaagcucuugggcuggaugccacgccccaggaccaggccguccuccaccggaaucgcgcugccugucaucugaagcucgaagauuacgacaaagcugagaccgaagccucuaaggcgaucgagaaagauggaggcgacguuaaggcccuguauagacggagccaggcucucgagaagcuggggcgccuggaucaagccgugcucgaccugcagagaugcgugucccuugaaccuaaaaacaaggucuuucaggaggcucugcggaauauuggaggccagauccaagaaaaagugcgcuacaugucuagcacagaugccaagguugagcagauguuccagauucuccuggacccggaggaaaaaggcaccgagaagaagcagaaagcgucccaaaaccuugugguccuggccagagaagaugcuggggccgagaagaucuuucggucuaauggagugcagcuccugcagcgccugcucgacaugggcgaaacagaucugaugcuugcugcccugagaacccucguugggauuuguagcgagcaccaaucccggacaguggccacccugagcauccuuggaacgcgcagagucgugucuauccugggcguggagucccaggcugucagccucgcggccugccaucugcugcagguuauguucgacgcucucaaagaaggggugaagaaaggauuucggggcaaggagggcgccauuaucguggaccccgcccgcgaacugaaaguccuuauuucuaaccugcucgaucugcuuaccgagguggggguuuccggacagggcagagacaaugcucugacacuccugaucaaggccgugccuagaaagagccugaaagaucccaacaauucucucacccugugggucauugaccaagggcuuaagaaaauccuggaagugggaggcucccuccaggauccucccggggagcuggcgguuacagcuaacagcagaauguccgccucuauucugcuuagcaaacucuucgacgaucugaagugugacgccgagcgcgaaaauuuucaccggcugugcgagaacuauaucaaguccugguucgaaggacagggccucgcuggcaagcugagagccauccagaccgugagcugucuucugcaagggccuugcgaugcuggaaaucgcgcccucgagcugucuggcgucauggaauccgugauugcgcugugugccagcgagcaggaggaagaacagcuugucgcuguggaagcccucauccaugcugccgggaaagcgaagcgggccucuuuuauuacggcuaacggaguuagccugcugaaagaccucuacaagugcuccgagaaagauucuauccggauucgcgcccuggugggccuuuguaagcuggggagcgcuggcggaacagacuucuccaugaagcaguuugccgagggcagcacccucaaacuggccaagcaaugccggaaauggcugugcaaugaccagaucgaugcugggacaagacgcugggcggucgaaggacuugccuaucucaccuucgacgcugaugugaaggaggaauuuguugaggacgccgccgcucugaaagcccuguuccagcucucucggcuggaagagagauccgugcuuuucgcggucgcuagcgcccuggugaacuguaccaacucuuacgauuacgaggaaccggaccccaagaugguggagcucgccaaguaugcuaaacagcacguuccugaacaacaccccaaggauaaaccuuccuuuguccgcgcccgggugaagaaacugcuggcggcuggcguggucagcgccauggugugcaugguuaagacagagucccccgugcuuacgucuagcuguagagaacuccugucccgggucuuccuggcccucguggaggagguugaagaccgcgggaccguggucgcucagggaggcgggagagcccugaucccgcuugcucuggagggcacagaugugggacagaccaaagccgcgcaagcccucgcuaagcugacaauuaccucuaauccugaaaugacguuucccggcgagcggaucuacgaaguugugagaccucuggucagccuucugcaucucaacugcuccgggcugcagaauuucgaggcccucauggcucugacaaaccuugccggaauuagcgagcgccugcggcagaagauccucaaagaaaaggccgugcccaugauugagggcuauauguuugaggagcacgagaugaucagacgcgcugcgaccgaauguaugugcaaucuggccaugucuaaagaggugcaggaccuguucgaagcucaagggaacgauagacuuaagcugcucguccuguacuccggagaggacgaugaacuccugcagcgggccgccgcuggcgggcuugccaugcugaccagcaugcgccccacacucuguucuagaaucccucagguuaccacacauuggcuggagauucugcaggcgcuucugcucuccagcaaucaagagcugcagcaccggggcgcuguggugguccucaacaugguggaagccucucgcgagaucgccagcacgcugauggaauccgagaugauggaaauucuuagcguucuggcuaaaggagaccacucuccggugaccagagccgcggcugccugccuggacaaggccgucgaguauggccucauccagcccaaucaggauggggaguga

SEQ ID NO: 77625 - RNA, 2790 nt, Artificial Sequence
  derived and/or modified sequence opt5 from UNC45B__Homo_sapiens__NP_001253981
auggccgagguggaagcuguccagcugaaggaggaaggcaacagacacuuccaacuccaggacuacaaagccgcgaccaauagcuauucccaggcucugaaacuuacaaaagauaaggcccugcucgccacgcuguaccggaaccgcgcugccugcgggcuuaaaaccgagucuuauguucaggcugccagcgacgcguccagagccaucgauauuaauucuagcgacaucaaggcucuguaccggcgcugucaagcccucgaacaucugggaaagcuggaucaggcuuuuaaagacgugcagagaugcgccacacucgagccccggaaccagaauuuccaagagaugcugcgcagacuuaacaccuccauucaggaaaagcugcgggugcaguuuucuacagauagccgcguccagaaaauguucgagauccuccuggacgaaaauuccgaggcggauaagagagagaaagccgcuaacaaucuuauugugcugggccgggaagaggccggggcugaaaagaucuuucaaaacaauggaguugcccuccugcugcagcuccuggacaccaagaaaccugagcuugugcuggccgcuguccgcacacucagcggcauguguucugggcaccaggcgagagccaccgugauccugcaugcuguucggauugaucgcaucugcucccuuauggccguggaaaacgaggagaugagccuggccgucuguaaucuccugcaagcuauuaucgacucucuguccggagaagauaagagagagcaccggggcaaagaagaggcccucgugcuggacacgaagaaagaccuuaagcagauuaccagccaucugcucgauaugcuggugucuaaaaaggucuccggccaggggagagaccaggcgcuuaaccugcucaauaagaacguuccgcgcaaagaucuggcuauccacgacaacagccggacaauuuaugugguggauaauggacugagaaagauccucaaagucgugggccaaguucccgaccugccuuccugccuuccccugaccgauaacacacgcaugcucgccucuauccugauuaauaagcuguacgacgaucuucggugugacccugaaagagaucacuuccgcaaaaucugcgaggaguauauuaccgggaaguuugacccccaggacauggauaagaaccucaaugccauccagacggugagcgggauucugcagggcccuuucgaccuggggaaccaacuccugggacuuaaaggcgucauggaaaugaugguggcucuguguggcuccgagcgggaaacagaucagcucguugccguggaggcucugauccaugccagcaccaagcugucuagagcgacauuuaucauuaccaauggggucucccuucucaaacagaucuacaagaccacaaagaacgaaaagauuaagauccgcacgcuggugggacugugcaaacucggcagcgccgggggaaccgacuacggccugcggcaguucgcugaggggucuacagagaaacuugccaagcaauguagaaaguggcugugcaauaugagcauugauacccgcacacggagaugggcugucgaaggacucgccuaucugacccuggacgcggaugugaaagacgauuuuguucaggacgugccggcccuucaggcuauguucgagcucgccaagacguccgauaagacaauccuguacucugucgcuaccacccuggugaacugcacaaauagcuaugacguuaaagaagugauccccgagcucguccagcuggccaaguuuuccaaacaacacgugccugaggaacaucccaaggauaaaaaggacuucauugacaugcgggugaaacgccuucugaaggccggcguuaucagcgcucucgcguguauggucaaggccgauucugcuauucugaccgaccagacaaaagagcugcuugccagaguguuccucgcccugugcgauaacccuaaggaccggggcacgaucguggcucagggaggaggcaaagcccugauuccccucgcgcuggaagggaccgaugucggaaaggugaaagcugcccacgcccuugcuaagaucgccgcgguuuccaauccggacauugcuuuuccuggcgagagaguguacgaagucgugcgcccccugguucggcuccuggauacacaaagagacgggcugcagaacuaugaggcccuucugggccucaccaaucugagcggacgcucugauaagcucagacagaaaaucuucaaggagcgggcccugccugacaucgaaaacuacauguuugagaaccacgaucagcuucgccaagcugccacagaauguaugugcaauauggugcugcauaaagagguccaggaaagauuccucgcugacggcaacgaucggcugaagcuggugguucuucuguguggggaggacgacgauaaagugcagaaugccgcggccggagcucucgccaugcugaccgcugcccacaagaagcucugccugaaaaugacgcaggucaccacacaauggcuugagauucugcagcgccucugucugcaugaccagcuguccgugcagcacagaggccuugugaucgccuauaaccugcucgcugcggaugccgaacuggcuaagaaacucgucgagagcgaacugcuugagauucugaccguuguggggaagcaagaacccgacgagaaaaaggccgaggugguccagacagcccgggaaugccugaucaaguguauggauuacggauuuauuaaacccguguccuga

SEQ ID NO: 77626 - RNA, 2529 nt, Artificial Sequence
  derived and/or modified sequence opt5 from UNC5A__Homo_sapiens__NP_588610
auggccgugagacccggccuguggccugcucuccuggggaucguccuugccgcguggcugcggggaagcggcgcucagcaauccgccaccguugccaacccggugcccggggcuaauccugaccuccugccccacuuccuuguggagccugaagaugucuacauugugaagaacaaacccguucugcucgugugcaaggccgucccugcuacacagaucuuuuucaaauguaauggagagugggugcgccagguugaccaugugauugaaagaucuacggauggcagcuccgggcugccgaccauggagguccggaucaacgugucucgccagcaaguggaaaaggucuuuggacuggaggaguauuggugccaguguguugccuggagcuccucuggcacaaccaaaagccagaaggcguacauuagaaucgccuaucuccggaagaauuucgaacaggagccccuggcuaaagaagugucccuugagcaaggcaucgugcugccuugcagacccccugaggggauucccccggccgaagucgaguggcuccgcaacgaagaccugguggauccuagccuugaccccaauguuuacaucacacgggagcacucucuggugguccgccaggcuagacucgccgauaccgcgaacuauacauguguggccaagaauauuguugcucggcgcagauccgccagcgcugccgugaucgucuacguggacggaucuugguccccuuggagcaaauggucugccugcggccuggauuguacccauuggcggucccgcgaaugcagcgaccccgcucccagaaacgggggagaggagugucagggcacggaucuggacacccggaauugcacauccgaucucuguguccacaccgcgucugggccugaagacguggcccuguauguuggacuuauugcuguggccgucugccuggugcuccugcuucugguucucauccugguguacugcagaaagaaagagggccuggacagcgaugucgccgacuccagcauucucacaucuggcuuucagccgguguccaucaagcccagcaaggcugauaacccucaucugcuuaccauccaacccgaccugucuacgacaaccacaaccuaccaggggagccucuguccucgccaggauggacccuccccgaaauuccaacugaccaauggccaccuucugucuccucucgggggaggccggcacacacugcaucacagcucccccacgagcgaagccgaggaauuugugucuagacuguccacccagaacuauuuccgcagccucccucgggggacaucuaauaugaccuacggaacauuuaacuuccugggcggcagacuuaugauucccaacaccgggaucucccugcucauuccucccgacgcgaucccgcgcggaaagauuuaugagaucuaccugacgcugcauaaaccugaggauguucggcuuccccucgcuggcugccagacacugcugagccccaucgucuccugugggccuccgggagugcuccugaccagacccgugauucuugccauggaccacugcggcgaaccuucucccgauagcuggucccugcgccucaagaaacagucuugugaggggagcugggaagacguccugcaccugggcgaggaagccccuucccaucuuuauuacugccaacucgaggcuagcgccuguuauguguuuaccgagcagcugggacgguucgcucugguuggcgaagcccucucuguggcggccgcuaagagacugaaacuucugcucuuugcccccgucgcuugcacaucccuggaguacaauauccgcguguacugucugcacgauacccaugacgcccuuaaggaaguugugcagcucgagaagcagcucgggggacaacugauucaggagccucggguccugcacuucaaagacagcuaucauaaccugagacuuucuauccacgaugugcccuccagccuguggaagucuaaacuccugguuagcuaccaggaaauuccguucuaucacaucuggaauggcacacagcgguaccugcauugcacguuuacccuugagcgcguguccccuagcacaucugaccucgcguguaagcugugggucuggcaaguggaaggggauggacaguccuucagcaucaacuuuaauauuaccaaagacacaagauucgccgagcugcucgcucuggaauccgaggccggcgugcccgcucuugucgggccuucugccuuuaagauccccuuccugauucggcagaagaucauuagcucccucgauccgccuugcagacgcggcgccgacuggcggacccuggcucagaaacugcaccuugauucucaucugagcuuuuucgcguccaagcccucuccuacggccaugauccucaaccugugggaggcuagacacuuucccaauggaaaccucagccaacuggccgccgcuguugccggccuugggcagcccgacgcgggacuguucaccguguccgaagcugagugcuga

SEQ ID NO: 77627 - RNA, 2805 nt, Artificial Sequence
  derived and/or modified sequence opt5 from UNC5B__Homo_sapiens__NP_001231818
augggcgccagaagcggggcucggggagcccugcuccuggcgcuucugcucugcugggacccccgccugucccaggcuggcaccgauucugggagcgaggugcuuccugacuccuucccgucugcccccgccgaaccucugcccuacuuucuccaagagccucaggaugcuuauaucgucaagaacaaacccguugaacugagaugucgggccuucccugcuacacagauuuacuuuaagugcaauggagagugggugagccagaacgaccacgugacgcaagaaggccuggaugaggccaccgggcuccgcgucagagaggugcagaucgaaguuucccggcaacagguggaggaacuguucggacuugaggacuauuggugucaaugcgucgcguggucuagcgccggcacaaccaaaucccgcagagcuuacgugcggauugccuaucugcgcaagaauuuugaucaggagccgcucggcaaagaaguuccccuggaccaugaggugcuucugcaguguagaccucccgaaggggucccuguggcugagguggaauggcucaagaacgaggaugucaucgaccccacacaggauaccaauuuccugcugacaauugaccacaaccucaucauccggcaagcccgccugagcgauaccgcgaauuacacgugcguugccaagaacauuguggcuaaaagacggucuaccacagccaccgugaucgucuaugugaauggaggcugguccagcugggcugaguggucuccguguuccaaccgcugcgggagaggauggcagaagcggacaagaaccuguacgaauccugcuccccuuaacggcggggccuuuugcgaaggacaggccuuccagaaaacagcguguaccacaauuugcccuguugacggcgccuggaccgaguggagcaaguggucugcuugcuccaccgaaugugcccauuggcgcagccgggagugcauggccccuccgccccagaauggcgggagagacuguuccggaacacugcucgauucuaaaaacugcacggacggccuguguaugcagaugcuugaagcuagcggggaugccgcgcuguacgcuggacucguggucgccaucuuugugguuguggccauucugauggcugucggcguggucguguaccgccggaauugcagagacuucgauaccgacaucacagauuccagcgccgcucugaccgggggauuucaccccguuaacuucaagacagcccgccccucuaacccucagcuccugcaucccuccgugccucccgaccuuaccgcgagcgccggcauuuaucggggcccggucuacgcucugcaagauucuacggacaagaucccuaugacaaauagcccccuccuggauccucuucccucccugaaagugaagguuuauucuagcuccaccaccgggagcggaccuggccucgccgacggggcugaccugcugggagugcugcccccgggcacauacccuucugauuuugccagagacacccacuuccugcaccuucgcuccgcgagccuggggucucagcagcuccugggccugccccgggaucccggauccagcgucuccggcacauucgggugucuuggaggcagacucucuaucccugggacgggagugagccugcuggugccgaacggcgccauuccccaggggaaauuuuaugagauguaccuccugaucaauaaggcugaguccacccuuccucugucugaaggcacacaaaccguucucagccccuccgucacaugcggaccuaccggccugcugcuuugucgccccgugauucucacgaugccucauugcgccgaggugagcgcucgggacuggaucuuccagcugaaaacccaggcccaccaggggcauugggaagaggucgugacacuggaugaagagacccucaacacacccuguuauugccaacuggagccgagagccugccacauucuucuggaccagcucggaaccuacguuuuuacgggcgaaucuuacucccggagcgcugugaagcgccugcagcuggcggucuucgccccugcucuuuguacaucucucgaguauucccugagaguguacugccuggaagauacccccguugcccucaaagaggugcuggagcuugaacggacacucgggggauaucucgucgaggaaccuaagccccugauguuuaaggacagcuaccacaaucugagacuuucucuccaugaucugccgcacgcccauuggcgcagcaaacugcucgcuaaguaucaggagaucccuuucuaccacaucugguccggcagccaaaaagcccugcauuguaccuuuacccuugaacggcacucucuggcguccacagagcucacgugcaagauuugugugagacagguugagggggaaggccagaucuuccaacugcacaccacacuggcugagacccccgccggaagccuugacacacugugcuccgccccuggcucuaccgugacgacacagcucgggcccuaugcuuuuaaaauuccccugagcauccgccagaagauuuguaacucccucgaugccccuaauucuagaggaaacgacuggcggaugcuggcgcagaaacuuagcauggaucgcuaccugaauuacuucgcuaccaaggccuccccgaccggcgucauccucgaccugugggaagcccugcaacaggacgauggggaccuuaacucucuggcuagcgcccucgaggaaaugggaaaguccgagaugcugguggcuguggccacagauggcgacugcuga

SEQ ID NO: 77628 - RNA, 2796 nt, Artificial Sequence
  derived and/or modified sequence opt5 from UNC5C__Homo_sapiens__NP_003719
augagaaagggccugcgggccaccgcugcccgcugcgggcucggacugggcuaccuucugcagaugcucgugcugcccgcgcuugcucugcucagcgccuccgggacaggaucugccgcucaagacgaugacuucuuucacgagcugccugaaacguucccgagcgaucccccugagccccugccucauuuucucaucgaacccgaggaagccuauauugucaaaaacaagccuguuaaucuguacuguaaggcuuccccggccacccagaucuauuucaagugcaacucugagugggugcaccagaaagaccauauuguggaugagagagucgacgaaacaagcggccuuaucgugcgggagguuuccauugaaaucucucgccagcaaguggaggagcuguuugggcccgaagauuacuggugucagugcgucgcguggagcuccgccggaaccacaaagagcagaaaggcuuaugugcggaucgccuaccuccgcaaaaccuucgagcaggaaccucugggcaaggagguuucucuugaacaggaggugcugcuccaauguagacccccugagggcauucccgucgcugaaguggaguggcugaaaaaugaagacaucauugauccgguggaggaccggaacuuuuauaucacaauugaucacaaucugaucauuaagcaggcccgccucuccgacaccgcgaacuacacgugcgucgccaaaaauaucguugcuaagagaaagagcaccacagccaccgugaucguguacgucaacgggggauggucuacauggaccgaaugguccguguguaauagccggugcggccgcggguaucagaaaagaacgcggacauguaccaacccugcuccccugaauggaggcgccuucugcgaggggcagucuguucaaaagauugccuguacaacccuuugcccuguggauggacgcuggacccccugguccaaauggagcacaugcggcacggaguguacccauuggagacggagagaaugcacagcucccgcgccuaagaacggcgggaaagacugugacggacugguccuccaguccaagaauugcaccgauggccuguguaugcagacagccccggacucugaugacguggcucuuuacguugggaucgugauugccgucaucgugugccuggccauuagcgucgugguugcucucuuuguguaucgcaaaaaccaccgggauuucgaguccgacaucaucgauagcucugcccugaauggaggcuuucaacccgucaacauuaaggcggcuagacaggaccugcucgccgugccucccgaucugaccuccgccgcugccauguaccgcgggccuguuuaugcccuucacgacgugagcgauaagauccccaugacgaacucuccgauucuggacccucuccccaaucugaaaaucaaggucuacaacacaagcggagcugugaccccucaggacgaucuuuccgaguucaccucuaaacugagcccccagaugacacaaucccuccuggagaaugaagcgcugagccucaagaaccagucucuggcccggcagaccgacccuuccuguacagcuuuuggcagcuucaauucucuuggcgggcaucugauugugcccaacuccggaguuagccuccugaucccggccggcgcuaucccucaggggagagucuaugagauguacgugacggugcaccgcaaagagaccaugcggccucccauggaugacucccaaacacugcuuacccccgucgugucuugcggaccgcccggcgcccuccugacaagaccuguugugcugaccaugcaucacugugcggaucccaauacggaagacuggaagauucuccugaagaaccaggccgcucaggggcagugggaggaugucgugguugugggcgaagagaauuucaccacaccuugcuacauccaacuugacgccgaggcuugucacauucugaccgaaaaccucagcacauaugcccuggucggacauuccaccacgaaagccgcugcgaagcgccugaaacuugccaucuuuggcccccucugcugcucuagccuggaguacuccauucggguguauugucuggaugacacacaggaugcucucaaggaaauccugcaccuugagagacagaugggagggcagcugcucgaagaaccuaaagcccugcauuucaagggcagcacccacaaucugcgccuuucuauucaugacaucgcccacucccucuggaaaagcaaacugcuggcuaaguaccaagagauccccuuuuaucacguuuggucugggucccagcggaaccuccauugcacauucacccuggaaagauuuagccuuaauaccguggagcuggucuguaaacucugcgugcgccagguggaaggagagggccaaauuuuccagcugaacuguacagucucugaggaaccgacggggaucgaucugccucuucucgaccccgccaauaccauuacaaccguuacaggcccuagcgcguuuuccaucccccugccgauucggcagaagcugugcagcucucucgacgcuccucagaccagaggacacgauuggcggaugcuggcccauaaacuuaaccuggacagauaccucaacuauuucgccacgaaguccagccccacaggcgugauccuggaucugugggaggcucaaaauuuuccugacgggaaccuuuccaugcuggccgcggugcucgaagagaugggacgccacgaaaccgucgugucucuggcugccgagggccaguacuga

SEQ ID NO: 77629 - RNA, 2862 nt, Artificial Sequence
  derived and/or modified sequence opt5 from UNC5D__Homo_sapiens__NP_543148
augggcagagccgcugccaccgcugggggaggcgggggagcgcggcgcuggcugcccuggcucggccugugcuucugggccgccgggacagcugccgcuagaggaacggacaacggcgaggcccuuccugaaagcaucccguccgcgcccggcacccugccucacuuuauugaggaacccgaugacgccuacaucauuaagucuaauccuaucgcucuccgguguaaagcccgccccgcuaugcagauuuucuuuaagugcaacggggagugggugcaucaaaaugaacacgucagcgaggagacacuggaugaauccucuggacuuaaaguuagagagguguucaucaacgugacccggcagcaggucgaagacuuucauggcccugaggauuauuggugucagugcguggccuggagccaccuggggacauccaagucucgcaaagcgagcguuagaaucgccuaccuccggaagaauuucgagcaagacccgcagggacgcgaagugcccauugagggcaugaucguccugcauuguagaccucccgaaggggugccugcugccgagguugaauggcugaagaacgaggagcccauugauuccgaacaggacgagaauaucgauacccgggcugaccacaaccucauuauccgccaggccagacugagcgauucuggaaauuauacaugcauggccgcuaacauuguggcgaaacggcgcucccuuagcgccaccgucgugguguacgucaauggcggcuggucuuccuggacggaauggagcgcuuguaacguuagaugcgggcggggauggcaaaagagaucucgcaccuguacaaauccggccccucugaacggcggggccuuuugcgagggaauguccgugcagaaaaucaccuguacaagccucugccccguggacggcuccugggaagucuggucugaguggagcgugugcuccccugagugugaacaucugcggaucagagagugcaccgcucccccuccccgcaaugggggaaaguucugugaaggccuuagccaggagucugaaaacugcacggauggccuguguauucucgacaaaaagccgcugcacgagaucaagccccaguccauugagaacgccagcgacaucgcgcuguauucugggcucggagcugccguuguggccgucgcugugcugguuauuggcgugacacuuuaccggagaagccaauccgauuauggggucgacgugaucgauucuagcgcccugaccggaggcuuucagacauucaauuuuaaaaccguccgccaggggaacucccuccugcuuaauagcgcuaugcaaccugaccugaccgugucucggacauacuccggccccaucugccuccaggauccucuggacaaggaacugaugacggagagcucucucuucaacccccuguccgauauuaaaguuaaggugcagagcuccuuuauggucucucuuggagugagcgaaagagccgaguaccacggcaaaaaucauucccgcaccuucccgcacgggaacaaucacucuuucagcacaaugcauccucggaacaagaugcccuauauccagaaucuguccagccucccuaccagaacagagcugcgcaccacgggaguuuuuggccaccuugggggacggcuggugaugcccaacacaggcgucucucuccugauuccucauggggcgauccccgaagaaaauuccugggaaauuuacaugagcaucaaccaaggcgagccgucucugcaguccgacggaagcgaagugcuccugucuccugaggugaccuguggcccucccgauaugaucguuaccacacccuucgcccuuaccauuccgcacugcgcugacgucagcuccgagcauuggaauauccaccugaaaaagagaacacagcaggggaagugggaagaggugaugagcguggaagaugagucuacguccuguuauugccuccuggaccccuuugccugucacguccugcuugacagcuucggaaccuacgcucucacaggcgaaccuauuaccgauugcgccgugaaacaacugaagguugcgguguuugggugcauguccuguaacucucuggacuauaaucuccgggucuacugcguggauaacacacccugugccuuccaggagguugugagcgacgagcgccaucagggaggccagcugcuugaggagccuaaacugcuccacuuuaaggggaacaccuucucccugcaaaucucuguccuggauauucccccuuuucuuuggagaaucaaacccuucacggcuugccaggaagugccguuuagccggguuugguguuccaauagacagccucuccauugcgccuucucucuggagcgcuauacccccacaaccacacagcugagcuguaagauuugcauccggcaacucaagggccacgaacagauccuucaggugcaaaccuccauucuggagagcgagagagaaacgaucacauuuuucgcucaggaggacucuaccuucccugcccagacaggacccaaagccuuuaagauuccguacuccauccgccagagaauuugugcuaccuucgauaccccuaacgcgaaaggcaaggacuggcaaaugcuggcccagaaaaauagcaucaaccggaaucucucuuacuuugcuacacaguccagccccucugccgucauccugaaccugugggaagcccgccaccagcaugauggggaccuugauucccucgcuugcgcccuggaggagauuggaagaacgcacaccaagcugagcaauaucuccgaaagccaacucgacgaggcggauuucaacuauucucggcagaauggccuguga

SEQ ID NO: 77630 - RNA, 7377 nt, Artificial Sequence
  derived and/or modified sequence opt5 from UNC79__Homo_sapiens__NP_065869
augaucuccacccuggcuacauuucccccuuuccuccacaaggacauuaucgaguaccuguccacgucuuuccuuccgauggcuauucugggcagcuccagacgggaaggggugcccgcccaugucaaccucucugccagcuccaugcugaugaucgcuaugcaguauaccucuaauccuguuuaccacugccaacuucuggagugucucaugaaguauaagcaggaaguguggaaggaucugcuguacgugauugccuauggacccagccaggucaagccucccgccgugcagaugcucuuucauuacuggccuaaccugaaaccucccggcgcuaucuccgaguaucgcgggcuucaauacacagccuggaaucccauccacugccagcauauugaaugucacaacgcuaucaauaagcccgccguuaagaugugcauugacccuagccugucuguggcccucggagauaaacccccuccccuguaccuuugugaggagugcuccgaaagaaucgccggcgaccacagcgaguggcugauugauguccuccugccccaggcugaaaucucugccauuugucagaagaaaaacugcuccagccaugugcggcgcgcuguugugaccuguuucucugccgggugcuguggaagacacggcaaucggccuguccgcuauugcaagagaugccauuccaaccaccacagcaaugaggugggcgcggccgcugagacacaucuguaccaaaccagcccgcccccuaucaacacacgggaauguggggccgaggaacucgugugcgcugucgaggccguuaucucucugcuuaaagaagccgaguuucacgcugagcagcgcgaacaugagcugaauagacggcgccagcucggacugagcuccagccaccauucucuugacaacgcggauuucgacaauaaggaugacgauaagcacgaccagagacugcucucccaauuuggcauuugguuccuggugagccuguguaccccgucugaaaacacgcccaccgagagccucgcccggcugguggcuauggucuuucagugguuccacuccacagccuauaugauggaugacgaaguggggucucuuguugagaaacugaagccucaguuugugaccaaauggcucaagacagucugcgacgugcgcuucgauguuauggugaugugucugcuucccaaaccuauggaguuugccagagucggaggcuacugggacaagagcugcuccaccgugacgcaacugaaagaagggcucaaucggauccugugucugauucccuauaacgucaucaaccagagcgugugggagugcauuaugccggaauggcucgaggcuaucagaacagaaguuccugauaaucagcugaaggaguuccgcgaggugcuuucuaagauguucgacaucgaacuguguccccucccuuuuuccauggaggaaauguucggauuuauuagcugccgguucaccggcuaccccucuuccguccaggagcaagcccugcuguggcuucaugugcucagcgagcuggauaucaugguuccucugcagcuccugauuuccauguuuucugacggcgugaacagcgucaaagaacuugcgaaucagagaaagucccgcgugucugagcuggcugggaaccucgccagccggagaguguccguugccagcgaucccggacgccggguccagcacaauaugcugucuccguuccauuccccuuuucaaagccccuucagaucuccccugcgcuccccuuuucggagcccguucaaaaacuuuggccaccccgggggaagaacaaucgacuucgauugugaagacgaugagaugaaucuuaacugcuuuauucucauguucgaccugcugcucaagcagauggaacugcaggacgauggcaucaccauggggcuugagcacucucugagcaaagacaucauuuccaucauuaauaacguguuccaggcuccuuggggaggcagccauaccugccaaaaggaugagaaggccaucgaauguaaucucugccagucuuccauucuguguuaucagcuggcuugcgagcuucucgaacgccuggcccccaaagaggaaagccggcugguggagccuacagacucccucgaggauucucugcuuagcuccagacccgaauuuaucauuggcccugagggggaagaggaagagaaccccgcgucuaagcacggagagaauccgggcaacuguacggaaccugucgagcaugccgcugugaaaaaugacaccgaacggaaguucugcuaccagcaacugcccguuacacuccgccugaucuacaccaucuuucaggagauggccaaauucgaggaaccugauauucuguuuaacaugcuuaacugucucaagauccugugccugcacggggagugucucuauauugcuagaaaggaccauccccaguuccuggccuacauccaagaucacaugcuuauugcgagccuguggcggguggucaaauccgaauuuucucagcucagcucccuggccgugccgcugcuucugcacgcucucagccugccucauggagccgacaucuucuggacaaucauuaauggcaacuuuaauucuaaggauuggaaaaugagauucgaggcuguugaaaagguggccgucaucugccgcuuucucgacauucacuccgugaccaaaaaccaucugcuuaaguauagccuggcccacgcuuucuguugcuuucucacggcgguugaggaugugaaucccgccgucgcuacacgggccgggcugcugcuugacaccaucaagagaccugcccugcagggccucugccugugucucgacuuccaguucgauaccguggugaaagaccgccccacaauucugucuaaacuucugcuccugcauuuucugaaacaagauauccccgcucuuuccugggaguucuuugucaacagauucgaaacccugagccucgaggcccagcugcaccucgacugcaauaaggaauuuccuuucccgacaacgaucaccgcgguucggacaaacguggcuaaucugucugaugccgcccuuuggaaaauuaagcgcgcuagauuugcccggaaccgccagaaauccgugagaagccugcgggacuccgucaagggacccguggagagcaagcgcgcgcugucucucccugaaacccugacaagcaaaaucagacagcaaucccccgagaaugauaacaccauuaaggaccuucugccugaggaugcuggcaucgaccaccagacgguucaucagcucauuaccgugcugaugaaauucauggccaaggaugaaucuagcgccgaguccgacaucucuagcgcuaaagccuuuaauacagucaagcggcaccucuacgugcugcuuggguaugaucagcaagaaggauguuucaugaucgcuccccagaagaugcgccugucuaccugcuuuaacgccuucauugcgggcaucgcccagguuauggacuacaauauuaaccuggggaaacaucuccugccucuugugguccaagugcugaaguauuguagcugcccgcagcucagacacuacuuccagcagcccccucgguguagccuguggucccucaaaccccacaucagacaaauguggcugaaggcccuucugguuauucuguacaaauauccuuaccgcgacugcgauaucagcaagauucuccugcaucuuauccacaucacagugaacacccugaaugcccaguaucauucuuguaagccccacgcuacggccggaccgcucuacuccgacaacagcaauauuucucgguauuccgagaaagaaaagggcgagaucgagcuggccgaauacagagagacaggggcucuccaggauagccugcuucauugcguccgcgaagaguccauuccuaaaaagaaacugcggucuuuuaagcagaagucccuggacaucggcaacgcggauucccuccuguucacccuugacgagcacagacgcaaaagcuguauugaucggugcgacaucgaaaagccgcccacacaagccgcuuauaucgcccagagaccuaaugaucccggacgcucucggcagaacuccgccaccagaccugacaauagcgagauuccggaaaaccccgcuauggagggcuuuccugaugcccggcgccccgugaucccugaagugagacugaauugcauggagaccuucgaggucaaaguugacucucccgugaagccggcgccuaaagaagaccucgaucugauugaccugagcuccgauucuacaagcgggcccgagaagcacuccauccucucuacgagcgacuccgauagccuuguguuugaaccucugcccccucugcggauugucgagucugacgaagaggaggaaaccaugaaccagggagaugacggccccuccgggaaaaaugcugccagcuccccgucugugccuagccaucccuccguucucucucugagcacagcgccccuugugcaagucuccguggaggauuguagcaaggacuucucuuccaaggauagcggaaacaaucagucugcuggcaacaccgacuccgcccugaucacacucgaagauccuauggacgcggaggggagcucuaaaccggaagaacugcccgaguuuagcugcggcuccccucugacccucaagcagaaacgcgaccuucugcagaagucuuucgcucugcccgaaaugagccucgaugaccacccugaucccggaacggagggcgaaaaaccuggggagcugaugccguccagcggagccaagacaguucuucugaaggugcccgaggacgccgaaaauccuaccgaguccgaaaaacccgauaccucugcugagagcgacacagaacaaaacccugagagaaaggucgaggaagauggcgccgaggaauccgaguuuaaaauccagauugugccccggcagagaaagcaacgcaaaaucgcugucucugccauucagcgggaauaccucgacaucagcuucaacauucuggauaagcugggggagcagaaggacccggauccuuccaccaaaggacucucuacacuugagaugcccagagaaagcuccagcgcgcccacgcuggacgccggcgugccugagaccucuucccauagcucuaucuccacacaguaccgccaaaugaagcgggggagccugggcguucucaccaugucucagcugaugaaaagacagcuugaacaccaguccagcgcuccccacaauauuuccaacugggauacagagcaaauccagccuggaaagcgccaguguaaugugccgaccugccugaaccccgaccucgaaggccagccucugcggaugagaggggccacgaaaagcucucugcucagcgcucccuccaucgucucuauguuugugccugcccccgaggaguucaccgacgaacaaccgacaguuaugaccgauaagugucaugacugcggagccauucuugaggaauaugaugaggagacacugggccuggcuaucgugguccucagcaccuuuauucaccuguccccugaccuugcggcgccccugcuccuggauaucaugcagucuguggggcgccuggcuagcuccacaaccuucucuaaucaggccgaaagcaugauggugccuggaaacgccgcuggcguugccaagcaauuccucagauguauuuuucaucagcuugcgcccaauggcaucuucccucagcuguuucaguccacgaucaaagacgggacauuccugcggacccucgcuagcucucugauggauuuuaacgagcuuuccagcauugccgcccugucucaacuccuggaaggacugaauaacaagaaaaaucuccccgcuggcggggccaugauccgcugccuugagaacauugcgaccuucauggaagcccugccgauggacuccccuagcucccuguggacaaccaucucuaaucaguuucagacguucuuugcuaagcuccccuguguccugccccuuaaaugcagccuggauuccagccucagaauuaugaucugucugcugaagaucccuucuacaaacgccacccggucccuccuugagccguucagcaagcugcugucuuuugugauucagaaugcuguguucacacucgccuaccuggucgagcuuugcggacugugcuaucgcgcuuuuaccaaagaaagagacaaguucuaccucagccgguccgugguucuggagcugcuccaagcccuuaaacugaagucuccccugccugauacaaaccuccugcuucuggugcaguucaucugugcggacgccggcaccaaacucgcugaaagcacgauucuguccaagcagaugaucgccucuguccccgggugcggaaccgcugccauggagugugugagacaguauauuaaugaaguucuggacuuuauggccgauaugcacacacucaccaaacuuaagagccauaugaagacaugcucccaaccucugcacgaggacaccuucggcggccaccugaaaguggggcucgcucagaucgcggccauggauauuagccgcggaaaccaucgggacaacaaggcugucaucagauaccugcccuggcuuuaucacccucccucugccaugcagcagggcccgaaagaguuuaucgaaugugugucccauauucgccugcucagcuggcugcugcucgggucccugacgcacaaugccguuugcccuaacgcuucuagccccugucuuccuaucccccuggaugccggaucccacguggcggaccaucucauugucauccugauuggcuucccggagcaaucuaagacaagcgugcuucacaugugcucccuguuucaugccuucaucuuugcucagcucuggaccguguacugugaacagagcgccgucgcuacaaaucugcaaaaccagaaugaguucucuuuuaccgccauccugaccgcgcucgaguucuggucccggguuacaccuagcauucugcagcuuauggcccacaacaaagugaugguggagauggucugccugcaugugaucucucucauggaggcucugcaggaauguaauuccacgauuuuuguuaaacuuauccccauguggcugcccaugauucaaagcaacaucaagcaccucucugccgggcugcagcugagacuccaggcuauccagaaucacgugaaccaucacucccugcggacccuuccuggaagcggccaaucuagcgccggccuggcugcccuccgcaaauggcugcagugcacacaguucaagauggcgcaggucgagauucaauccagcgaagccgcuucccaguuuuacccccuuuga

SEQ ID NO: 77631 - RNA, 1248 nt, Artificial Sequence
  derived and/or modified sequence opt5 from UNC93A__Homo_sapiens__NP_001137419
auggacagaagccugcggaacgugcucgucguuuccuucggcuuucugcuucuguucaccgccuacgggggacuccagucucugcaaagcucccuuuauucugaggaaggccugggggugacagcucucagcacgcuguacggaggcaugcugcucuccucuauguuucugcccccucuucugaucgagcgccucgggugcaagggaaccauuauccugagcauguguggcuauguggccuucuccgucggcaacuuuuucgcgagcugguacacacuuauuccgaccucuauccugcucgggcugggagcugcuccccugugguccgcccagugcacauaucucaccauuacaggcaauacccacgccgaaaaagccgggaagagaggaaaagauauggugaaucaguacuuuggcaucuucuuucugaucuuccagagcucugggguuuggggaaaccuuauuuccagccugguguuuggccaaacgccuucucagggcuccgggguccucgcugugcugaugaucgccgcguuccuucagcccauucgggacguucagcgcgagagcgaaggagagaagaaauccgugccuuuuuggucuacccugcucagcacauucaagcuguauagagauaagcggcugugucuccugauccuucugccccucuacuccggccugcaacagggguuccuuagcucugaguacacccgcuccuaugucacaugcacccuggggauucaguuugugggcuacgugaugaucuguuucagcgccacggacgcucucugcucuguccuguaugggaaaguuagccaguacacaggcagagccgugcuguaugugcucggagcugucacccauguguccuguaugauugcccugcuucuguggcggccucgcgcggaucaccucgccguuuucuuuguguuuucuggccuguggggagucgcugacgccguguggcaaacacagaauaacgcucuguacggaguucuuuucgaaaagagcaaagaggccgccuuugcuaauuauagacucugggaagcgcugggcuucgugaucgccuuuggguacuccauguuccugugcguccaugugaagcucuacauccugcuuggaguccugagccucaccaugguggcuuauggccugguugaguguguggagucuaaaaacccgauucggccccacgccccugggcaggucaaucaagccgaagaugaggaaauccagaccaagauguga

SEQ ID NO: 77632 - RNA, 1794 nt, Artificial Sequence
  derived and/or modified sequence opt5 from UNC93B1__Homo_sapiens__NP_112192
auggaggccgaacccccucuguacccgauggcuggcgccgcggggccccagggagacgaggaucuccugggcgugccugacgggcccgaagcuccucuugaugagcuggucggagccuaucccaacuacaaugaagaggaggaagagagacgguauuaccgcagaaagcggcucggcguucugaaaaacgugcuugccgcuagcgccgggggaaugcugaccuauggcguguaccucggccugcugcaaaugcagcucauccugcacuaugacgaaacauaccgcgaggucaaguacgggaauaugggacuuccugauauugacuccaaaaugcugaugggcaucaacgugacgccgauugcugcccuccuguauacccccguucuuaucagauucuuugggacaaaguggaugauguuccuggcggugggaauuuacgcccucuuugucucuaccaauuauugggagcgguacuauacacuggugccuagcgcuguugcccugggcauggcuaucgugccccucugggccuccauggggaacuacaucacccgcauggcgcagaaauaucaugaauacucucacuacaaggagcaggauggacaaggcaugaagcagagaccuccccggggcagccaugccccguaucugcuugucuuccaggcuaucuuuuacuccuucuuucaccugucuuucgccugcgcucagcucccuaugauuuauuuucugaaucauuaccuuuaugaccugaaccacacacucuacaaugugcaaagcugugggaccaacucccacggcauucugagcggauucaauaaaacggugcugcgcacccuccccagaucugggaaccugaucgucguugaauccgugcuuauggccguggccuuucuggcuaugcuccugguccuuggacugugcggcgcggccuaucggccuacagaggaaauugaucuccgcagcgugggguggggaaauaucuuccagcugcccuuuaagcauguuagagacuaccggcugcgccaccucgugcccuucuucauuuacucuggcuuugagguccuguucgcuuguaccggcaucgcccuuggguauggagugugcuccguuggccuggagagacucgccuaccugcugguggcuuauagccuuggggccucugcggcuucccuccugggacugcucggccuguggcuuccucggccggucccccugguggccggggccggcguccaucuccugcugacauuuauccuuuucuuuugggcuccugugcccagaguucuccagcacagcuggauucuguacguggccgcugcccuguggggagucggcuccgcgcucaacaaaaccgggcugucuacgcuucugggaauccucuaugaagauaaggagcgccaggacuucauuuuuacaaucuaccacugguggcaagccguggcuauuuucaccguuuaucugggcagcucccugcauaugaaagccaaacuugcugugcuccuggucacacugguggccgcggccgugagcuaccuccggauggaacagaagcugagacgcgggguugcuccucggcagcccagaaucccgcgcccucaacacaagguccggggauacagauaucuugaggaagauaauucugacgaguccgacgccgagggcgaacauggggauggcgcugaggaagaggcucccccugccggaccccgcccuggccccgaaccggccgggcugggacggagaccuugucccuacgagcaggcgcagggcggggacggacccgaggaacaguga

SEQ ID NO: 77633 - RNA, 915 nt, Artificial Sequence
  derived and/or modified sequence opt5 from UNG__Homo_sapiens__NP_003353
augggcguguucugccuggggcccuggggacucggcagaaagcugcggaccccugggaaaggaccgcuucagcugcucagccgccuguguggcgaccaccuucaagccauccccgcuaagaaagccccugcggggcaggaggaacccggaacaccucccuccucuccucugagcgcugagcagcucgaucggauucagcggaacaaggccgccgcucugcugcgccucgccgcuagaaaugucccgguuggcuuuggcgaauccuggaaaaagcaucugucuggggaguucggaaagcccuacuuuaucaaacuuaugggcuucguggccgaagagagaaagcacuauacgguguacccucccccucaucaagucuuuaccuggacacagaugugcgacauuaaagaugugaagguugugauccuggggcaggaccccuaucacggaccgaaccaggcgcauggccucuguuucagcguccaacgcccugugcccccuccucccucccuggagaauauuuacaaagaacuuucuaccgauaucgaggacuuuguucaccccgggcacggagaucugagcggcugggccaagcagggcgugcuccugcugaacgcuguccucacagugagagcccaucaggcuaauucccacaaggaacgggggugggagcaguucaccgacgccguggucagcuggcugaaccaaaauucuaacggacuuguuuuucugcucuggggcuccuaugcgcagaaaaaggggagcgccaucgaucgcaaaagacaucacgugcugcagacagcucacccgucuccccuuuccguguaccggggauucuuuggcugccgccauuucagcaagaccaaugagcugcuccaaaaaucugggaagaaaccuauugacuggaaggaacuguga

SEQ ID NO: 77634 - RNA, 1155 nt, Artificial Sequence
  derived and/or modified sequence opt5 from UPB1__Homo_sapiens__NP_057411
auggccggcgcugaguggaaaagccuggaagagugccucgaaaagcaccuuccccuuccugaccugcaggaggugaagagaguccucuacgggaaagaacugcggaagcuggaucugccgcgcgaggccuucgaggcggcuuccagagaagacuuugagcuccagggauaugccuucgaagccgcugaggagcagcugcggcgccccagaaucguucaugugggccuggugcagaaccggauuccucuccccgccaaugcuccugucgccgaacaggugucugcgcugcaccgcagaaucaaagccauuguugagguggcugccauguguggggucaacaucauuugcuuucaagaggcuuggaccaugcccuucgccuuuuguacacgggaaaaacuuccuuggacggaguucgcggaaagcgccgaggauggaccgaccacacgcuuuugccagaagcuggcuaagaaucaugacauggugguugugucccccauccucgaaagagauucugagcacggcgacguccuguggaacaccgccguggugaucagcaauuccggggcuguccuuggaaagacacggaaaaaccauauuccucgcguuggcgauuucaaugaaucuaccuacuauauggagggcaaccuggggcaccccguguuucagacacaguucggaagaaucgccgugaauauuuguuacggccggcaccauccucucaacuggcugauguauagcaucaauggggccgaaauuaucuuuaaccccuccgcuaccauuggagcgcugagcgagucucucuggccgaucgaggcccgcaaugcugccaucgccaaccacugcuucacgugugcuauuaauagagucggcaccgaacauuuuccuaacgaguucacauccggggacggaaagaaagcccaccaagauuucggcuacuuuuauggcagcucuuacguggcggcucccgacuccagccggaccccugggcugucuagaucccgcgauggacuucugguugccaagcucgaccugaaccuuugccaacaggugaaugaugucuggaacuucaagaugacaggccgguacgaaauguaugccagagagcuggcugaagccgugaaaagcaauuacucccccaccaucguuaaggaguga

SEQ ID NO: 77635 - RNA, 3357 nt, Artificial Sequence
  derived and/or modified sequence opt5 from UPF1__Homo_sapiens__NP_002902
augagcguggaggccuacggccccuccucucagacccugacauuccucgacacggaagaggcugaacugcuuggggccgauacccaaggaagcgaguuugaguucacagacuuuacccugccuucccagacacagaccccgcccggcgggccuggaggccccgggggaggcggcgcugggggaccuggcggggcgggagccggcgccgcugccgggcagcucgaugcucaagucggacccgaaggcauccugcagaacggcgccguugacgauucuguggcgaagacaagccagcuucuggccgagcucaauuucgaagaggacgaagaggauaccuauuacacgaaagaccugccuauucacgcuugcuccuauugugggauccaugauccggccugcguggucuacuguaacaccucuaagaaaugguuuugcaauggaagaggcaacacaagcgggucccacauugugaaucaucugguucgggcuaaguguaaagaggugacccuccacaaggacggaccccugggcgaaacaguccuugagugcuauaacugugggugccgcaauguguuccugcucggauuuaucccugccaaggcggauagcguugugguccugcuuuguagacagcccugcgccucucaauccagccugaaagacauuaacugggauucuucccaguggcagccucucauccaggaccgguguuuccugagcuggcuggugaagauccccucugaacaagagcagcuccgcgcuagacagauuaccgcccaacagaucaauaaacuggaggaacuuuggaaggagaacccguccgcuacgcuggaagaccucgagaaaccuggcguggaugaggaaccccagcauguccugcuucgguacgaagacgccuaucaguaccaaaauauuuuuggcccucugguuaagcucgaggccgauuacgacaagaaacugaaggagagccagacacaggauaacaucaccgugcgcugggaccuggggcucaauaaaaagagaauugcuuauuucacacugcccaaaaccgauuccgacaugcggcuuaugcagggagaugaaaucugccugcgcuacaagggcgaccucgcgccccuguggaaagggauuggacacgugaucaaggucccugauaacuauggcgacgagaucgccauugaacuuagaucuagcgugggggcuccgguugaggugacccacaauuuucaagucgacuucguguggaaguccacgagcuuugaucggaugcagucugcccugaaaacauucgccguugacgaaaccuccgugagcggcuacaucuaucauaagcuccugggacacgaggucgaggaugugauuaucaaaugccagcugcccaagcgcuucacagcucagggccucccugaccugaaccauucucaagucuacgccgugaaaaccguucuucagagaccccugagccucauucaggggccucccggaacaggcaagaccgugacguccgcgacaaucgucuaucaccuggcucggcaggggaacggaccggugcugguuugugccccuucuaauaucgccguggaucaacuuaccgaaaagauucaccagaccggccucaaagucgugcgccugugcgcuaagagcagagaggccaucgacucccccgugagcuuucuggcucuccauaaccagauucggaauauggauucuaugccugaacugcaaaaacuucagcagcugaaggacgagacaggggagcucuccagcgccgaugagaaaagauaccgcgcgcugaagcggaccgccgaaagagaacugcuuaugaacgcugacguuaucuguugcacaugugucggcgccggagauccccgccucgcuaagaugcaguuccggucuauucugaucgacgaguccacgcaagccaccgaaccugagugcauggugcccgugguccugggcgcgaaacagcucauccuggugggggaucacugucagcuuggaccgguugugaugugcaagaaagccgcuaaggccggccugagccagucccucuuugagagacuggucgugcuggggauucgcccuauccggcuucaaguucaguacagaaugcaucccgcucucucugccuuccccagcaauaucuuuuaugaaggaucccugcagaacggcgugacagccgcugaccgcgucaaaaagggguucgacuuucaguggccucaaccggauaagcccauguucuuuuacgugacccagggccaggaggaaauugcgucuagcggaacauccuaucugaaucggaccgaggccgcuaacguugagaaaauuacgaccaagcuccugaaagccggcgccaagccugaccaaaucgggauuaucacacccuacgaaggacagagaagcuaucuugugcaguacaugcaguucucuggcucccugcacaccaaacucuaucaagaggucgaaaucgcuagcguggaugccuuucaggggcgcgagaaggacuucauuauccugucuugugugcgggcgaaugaacaucagggaauuggcuuucugaacgauccuagacggcuuaaugucgcucucacacgcgccagauacgggguuaucauugugggcaaccccaaagcccuguccaagcagccucuguggaaucaccuccugaacuacuauaaggagcaaaaagugcuugucgaaggaccccugaauaaccuccgggagagccugaugcaguucucuaagccgagaaaacuggugaacaccaucaauccuggcgcucgcuucaugacgacagccauguacgacgcgcgggaggcuaucauucccgggagcguuuaugauagauccagccagggacgcccuucuuccauguacuuucagacccacgaccaaaucggcaugauuagcgccgggcccucccauguggccgcuaugaacaucccgauuccuuucaaucuugucaugcccccuaugcccccucccggauauuuuggccaggccaacggcccggcugccgggagaggaacacccaagggcaaaaccgggcggggaggccgccagaagaauagauucgggcugccuggacccucucagaccaaccucccuaauagccaagcgucccaggauguggccucucagcccuuuagccaaggcgcucugacacagggcuacaucuccaugucucagccuagccagaugucccaaccggggcucagccagcccgaacugucucaggacuccuaucuuggagaugaguucaagagccagaucgacguugcccugucucaagauuccacguaccagggcgaacgggcuuaccagcacgggggagugaccggccucagccaguauuga

SEQ ID NO: 77636 - RNA, 3819 nt, Artificial Sequence
  derived and/or modified sequence opt5 from UPF2__Homo_sapiens__NP_542166
augcccgccgagagaaagaaaccugcuagcauggaagagaaggacucccugccgaacaauaaagaaaaggauugcucugagcggcgcaccgugagcuccaaagaaagacccaaggacgauaucaagcucacagccaaaaaggaggucucuaaagcgccugaggacaagaaaaagcggcuggaagaugacaagcgcaaaaaggaggauaaagaaagaaagaaaaaggacgaggagaaaguuaaggcugaagaggaaagcaagaaaaaggaggaagaggagaaaaagaaacaccaggaagaggaacggaagaagcaagaggaacaggccaaacgccagcaggaggaggaagccgcugcccaaaugaaggagaaagaagaguccauucagcuucaucaggaggcuugggaaagacaccaucugcggaaggagcuccgcucuaaaaaccagaaugcccccgauagcagaccugaagagaacuucuuuucccggcuggacagcucucuuaagaagaauacggcguucgugaaaaagcugaaaaccaucacagaacaacagcgcgauucccucagccacgacuuuaacggccugaaucugucuaaguacauugccgaggcuguggccuccaucgucgaggcuaaacucaagauuagcgaugugaacugugccguucaucugugcucucuuuuccaccagagauaugcggacuuugcccccucccugcuccagguguggaagaaacacuucgaagcucggaaggaggaaaagaccccuaauaucacaaagcugcgcaccgaccuuagauuuaucgccgagcugacaauugucgggaucuucaccgauaaagaaggacucagccugauuuacgagcaacugaagaacaucauuaaugcugaccgggagucccauacgcacgugucuguugugaucagcuuuuguagacauugcggcgaugacauugccgggcucgucccgcgcaaagugaaguccgccgcugaaaaguucaaccugagcuuucccccuucugagaucaucucccccgaaaaacagcagccuuuccaaaaucuucugaaggaguauuuuaccagccucacaaaacaccugaagcgggaucacagagaacuucagaacaccgagcgccagaaucggcgcauucugcauucuaaaggagagcucagcgaagacagacacaagcaguacgaggaguucgcgauguccuaucaaaagcugcuggccaacucucagagccucgcugaucugcuugacgaaaacaugcccgaucugccgcaggacaaaccuacacccgaggaacauggcccugggaucgauauuuucacccccggaaagcccggcgaguacgaccucgaaggcgggaucugggaggacgaagaugcccggaauuuuuaugagaaccugauugaccuuaaagccuucgugccugcuauccuguuuaaggauaaugagaaauccugucagaacaaggaaagcaauaaggacgauacgaaagaggccaaggaaucuaaagagaacaaggaagucuccagcccggacgaucucgagcuggagcuggaaaaucucgagaucaacgacgauacacuggaacuugagggaggcgacgaagcggaggaucugaccaaaaagcuccuggacgagcaagaacaggaggaugaagaggcuucuacagggucccaccugaaacuuauuguugacgccuuccuccagcagcugcccaauugcgugaacagagaccugaucgauaaagccgcuauggacuuuuguaugaauaugaacaccaaggccaaucgcaaaaagcucgugcgggcucuguucauugucccuagacaacgccuugaucugcuccccuuuuacgcccggcugguggcgacccugcauccuugcaugagcgacguugccgaagaucuuuguuccaugcucagaggagacuuccgguuucacgugcgcaaaaaggaucagaucaacauugagacaaagaauaagacggucagauucaucggcgagcugaccaaguuuaaaauguucacaaagaacgacacccugcacugccucaaaaugcugcuuucugauuuuagccaucaccauaucgaaauggcuuguacacugcucgagaccugcgggcgguuccuguucagaucccccgaaucucaucugcgcacgagcgugcuucucgagcagaugaugcggaagaaacaggccaugcaccuggacgcuagauacguuacaaugguggagaacgccuauuacuauugcaauccgccucccgcggaaaagaccgucaagaaaaagcgcccuccccugcaagaguacgugagaaaacuccuguauaaggaucuuuccaaagucaccacagaaaaggugcugcggcagaugcgcaagcucccuuggcaggaccaagagguuaaagauuacgugauuuguugcaugaucaacauuuggaaugucaaguauaacagcauccacuguguggccaaucugcuggcuggacuuguucucuaccaggaagacgugggcauucacgucguggacggcgugcuggaggauaucagacuggggauggagguuaaccagcccaaauuuaaucagcggcgcauuucuuccgccaaguuccucggagaacuguacaacuauagaauggucgagagcgcugugaucuuucggacccuuuacucuuucacauccuuuggcgugaauccggacgggagcccuucuagccuggauccucccgaacaucucuuccgcaucagacuggucugcacgauucuggacaccuguggacaauauuuugaucggggcuccagcaaacgcaaacuugacugcuuccugguguacuuucagagauauguuugguggaagaaaucucucgagguguggacaaaggaucaccccuucccgaucgacauugauuacaugaucuccgacacccuggaacuccugcggcccaaaauuaaacuuuguaacagccuggaggaguccaucagacagguccaggaucucgaacgcgaguuucugaucaagcuggggcuugugaaugacaaggacucuaaggauagcaugacagaaggagagaaccuggaagaggacgaggaagaggaagagggcggcgccgagaccgaggaacaauccgggaaugaaucugagguuaacgaaccugaggaggaagagggaagcgauaaugacgaugacgaaggcgaggaagaggaggaagagaacacggauuaucucaccgacuccaacaaagaaaaugagacagaugaagagaacaccgaggugaugauuaagggcggaggccugaaacauguccccugcguggaagacgaggauuucauccaggcccucgacaagaugaugcuggaaaaucuucagcagcggucuggggagagcguuaaagugcaccaacuggaugucgcuauuccucuccaccugaagucccagcugagaaaagggcccccucuuggaggcggggagggagaagcggagagcgccgacacaaugcccuuugugaugcugacccgcaagggcaacaagcagcaauucaaaauccucaaugugccgaugucuucccagcuggcugccaaccauuggaaucagcagcaagccgaacaggaggaacggaugagaaugaagaaacucacgcuggacauuaacgagcgccaggagcaggaagauuaccaagagaugcuucagagccuggcucagcggccugcccccgcgaauacaaacagagaacgccggccuagauaccagcaccccaagggggcuccgaaugccgaccugaucuucaaaaccggaggccggcgcagauga

SEQ ID NO: 77637 - RNA, 1431 nt, Artificial Sequence
  derived and/or modified sequence opt5 from UPF3A__Homo_sapiens__NP_075387
augagaagcgagaaggaaggcgccgggggacugcgggcugccguggcggcucgcggccccuccgggagagagaaacucucugcccuggaaguccaguuccaccgggacagccaacagcaggaggccgaaaccccuccgacauccucuagcggaugcggcgggggagcuggcaagccccgcgaggagaaaagaacggcccuuuccaagguugugauccggcgccugccucccggccucaccaaagaacagcuggaggaacaacuuagaccucugcccgcucaugauuacuuugaguucuuugccgcggaccucucucuguauccucaccuguacagccgggccuauauuaacuuccgcaauccggaugacauccuccuguuuagagaucgguucgacggguacauuuuucuugauuccaagggacuggaguaucccgcuguggucgaguucgccccuuuucagaagaucgcuaaaaagaaacuccgcaagaaagacgccaagacaggcagcauugaggaugaccccgaauacaagaaauuccuggagaccuauuguguggaagaggagaagacaucugcgaacccugaaacccuucugggggagauggaagccaaaacaagagagcucaucgcucggcgcaccacgccccugcuggaauacaucaagaauagaaaacucgagaagcagcggauuagagaggaaaaacgcgaggaacggagacgccgggagcuggaaaagaagagacuucgcgaggaggaaaaacggagacgccgggaggaagagagaugcaagaaaaaggagaccgauaaacagaagaagaucgccgaaaaagagguucgcauuaagcugcucaaaaagccggaaaaaggagaggaaccuacaaccgagaagcccaaggagcggggcgaagagaucgacacagggggaggcaaacaagaauccugugcuccuggcgccguggucaaggccagacccauggaggggagccuggaagaaccccaggagaccucucauuccggaagcgauaaagaacaccgggacguggagcgcucucaggaacaggaguccgaagcucaaagauaccauguugacgauggccggagacaccgcgcgcaccaugagccugagcggcuuagcagacgcuccgaagacgagcagagaugggggaagggaccgggccaggaucgggggaaaaagggaucucaagacagcggcgcccccggcgaagcuauggagcgccuggggagagcccagcggugcgaugacuccccugcuccccgcaaggagagacucgccaacaaagaucggccugcccugcagcuguaugaccccggagcgcgcuuuagagcucgggaauguggcgggaaucgcagaauuugcaaggccgagggaagcggcacggggccggaaaaacgggaggaagccgaguga

SEQ ID NO: 77638 - RNA, 1413 nt, Artificial Sequence
  derived and/or modified sequence opt5 from UPF3B__Homo_sapiens__NP_075386
augaaggaggaaaaagagcacagacccaaggaaaaacgggugacccugcucacgccugccggcgcuacagggagcggaggcgggaccuccggagacucuagcaagggcgaggauaaacaggaccgcaacaaggaaaagaaagaggcccuguccaaggucguuaucagacggcuuccgcccacacugaccaaagagcaacuccaggaacaucugcagccuaugcccgagcacgauuacuucgaauuuuucucuaaugacacaagccuuuauccucauauguacgcgcgcgcuuauauuaacuuuaagaaucaggaggauaucauucuguucagagaccgguuugauggguacguguuccucgacaacaaaggacaagaguaucccgccaucguggaauuugccccuuuccagaaggcugccaagaaaaagaccaaaaagcgcgauacaaaagucggcaccauugacgaugacccggaguacagaaaguuucuggaauccuaugcuacggauaaugagaaaaugaccucuacacccgaaacccugcucgaggagaucgaagccaagaaccgggagcugaucgcgaagaaaacaaccccucuucugagcuuccucaagaauaaacagcgcaugagagaagagaagcgggaagaacgcagacggcgcgagauugaaagaaaacggcagagagaggaggagcgccggaaguggaaggaagaggagaaaagaaagcgcaaagacaucgaaaagcugaaaaagauugaccggauccccgagagagauaaacuuaaggacgaaccuaagauuaaacugcucaagaaacccgagaagggcgaugagaaggaacuggacaaacgcgagaaggccaaaaagcuggauaaagaaaaccucuccgacgagcgggcuagcgggcaaucuugcacgcugccgaagagauccgauagcgaacuuaaagacgagaagccuaagcgccccgaggaugaaucuggacgggacuacagagagcgcgaacgggaguacgaaagagaucaggagcggauccugcgcgagagagaacggcucaaaagacaggaggaggaacgccggagacagaaggaacgcuaugagaaagagaagacauuuaaaagaaaggaagaggaaaugaagaaagagaaggacacccugcgggacaaaggcaagaaagccgaguccacagaaagcauugggucuuccgagaagaccgaaaagaaagaggaagugguuaagcgcgauagaauccggaauaaagaccgcccugcuaugcaacuuuaccagcccggagccagaagccggaaccgccugugucccccugaugacuccaccaagucuggcgauagcgcggccgagagaaaacaggaguccgggaucagccaccggaaggaaggaggcgaggaauga

SEQ ID NO: 77639 - RNA, 822 nt, Artificial Sequence
  derived and/or modified sequence opt5 from UPK1A__Homo_sapiens__NP_001268372
auggccagcgcugccgcggcugaggccgaaaagggcucccccguggucguugggcugcucguggugggaaacaucauuauccugcuuucuggccugagccucuucgccgagaccauuugggucacagcugaccaguacagaguguauccucugauggggguuuccggaaaagaugacguguuugccggcgcuuggaucgccauuuucugcggguuuucuuucuuuauggucgcgagcuucggagugggcgccgcucuuugucggcgcagauccaugguucugacguaccucgugcugaugcugaucgucuauaucuuugaaugcgccucuuguauuaccagcuacacacaccgggauuauaugguguccaauccgagccucaucaccaagcaaaugcugacauucuacucugcugacaccgaucagggccaggagcuuacacgccugugggacagagugaugauugaacaggagugcugugggaccuccggacccauggauugggucaacuuuacgagcgccuuccgggcggccaccccugagguuguguuucccuggccuccccucugcugucgcagaacaggcaauuucaucccucugaacgaagaggggugccggcuuggacauauggacuaucuguuuaccaaagcuggcgugcaauggcacaaucucucuucccugcagcgccugccgcccggguucaagggauucagccaucucucuuuucaguccagcugggauuacagagccgcuuccaacacaucugccaccccuagcacggccacacggggcgucucccgcggccuggggcuucccagcuga

SEQ ID NO: 77640 - RNA, 783 nt, Artificial Sequence
  derived and/or modified sequence opt5 from UPK1B__Homo_sapiens__NP_008883
auggccaaggacaacagcaccgugagaugcuuccagggccugcucaucuuugggaaugucauuaucggauguugcggcauugcucugacagccgaguguaucuucuuuguuuccgaucaacacucucuuuacccccugcucgaagcgacggacaacgaugacauuuauggggcugccuggaucggaaucuucgugggcauuugccuguuuugucuuagcgugcuggggaucgucggaauuaugaaauccucucggaagauccuccuggccuacuucauucugauguuuaucguguaugcuuucgagguugccagcugcauuaccgcugccacacagcaggacuuuuucaccccuaaucucuuucugaaacagaugcuugaacgcuaccaaaacaauuccccgcccaacaaugaugaucaguggaagaacaauggcgugacaaaaaccugggacagacugaugcuccaggauaacuguugcggcgucaaugggccuucugacuggcagaaguauacaagcgcguuccggaccgagaacaaugaugccgacuaccccuggccucgccaauguugcgugaugaacaaucugaaggaaccccuuaaccuggaggcuuguaaacucggaguuccuggcuuuuaucauaaccaggggugcuacgagcugaucuccggaccgaugaauagacacgccuggggcguggcuugguucggguucgccauccugugcuggacguuuuggguccuccugggaaccauguucuacuggagccggauugaauauuga

SEQ ID NO: 77641 - RNA, 555 nt, Artificial Sequence
  derived and/or modified sequence opt5 from UPK2__Homo_sapiens__NP_006751
auggcuccccugcucccuaucagaacccugccgcuuauucugauccuccuggcccuucugagccccggcgccgcggacuucaacauuuccucucucagcgggcugcuguccccugcucucacagagucucugcuuguggcccugcccccuugccaccucacgggaggcaaugccacccugaugguccggcgcgcuaacgauagcaagguugugacauccucuuuuguggugcccccuuguagagggcggcgcgaacuugucagcguuguggacuccggagccggcuucaccgucacaagacugagcgcuuaccaggugaccaaucucguuccggggacaaaauuuuauaucucuuaccuggugaagaaaggaaccgccacggaguccagccgggaaauucccaugucuacccugccucgcagaaacauggaguccaucggccucggcauggcgcggacagggggaauggucgugaucaccgugcugcuuagcgucgccauguuccugcucguucugggcuuuauuaucgcucuugcccuggggucucgcaaguga

SEQ ID NO: 77642 - RNA, 501 nt, Artificial Sequence
  derived and/or modified sequence opt5 from UPK3A__Homo_sapiens__NP_001161046
augcccccucugugggcccuccuggcucuuggcugccugagauucgggagcgccgugaaccuccagccgcaacuggcguccgucaccuuugcuacaaauaaccccacgcuuaccacaguugcccuggagaagccucucuguauguucgacucuaaagaagcccugaccggaacacacgagguguaccuguaugugcucgucgauagcgugacccccuacuccacaaucgacaccuggccuggccggcgcucugggggaaugauuguuaucacgagcauucugggcucccuucccuuuuuccugcucgugggguuugcuggagccaucgcucugucucuugucgauaugggcagcuccgacggcgaaaccacacaugauagccagauuacccaggaggccgugccuaagucucugggggcguccgaaagcucuuauacauccguuaauagaggaccgccccucgaccgggccgagguguacagcucuaaacugcaggauuga

SEQ ID NO: 77643 - RNA, 933 nt, Artificial Sequence
  derived and/or modified sequence opt5 from UPP1__Homo_sapiens__NP_001274355
auggccgcuaccggcgccaacgcggagaaggcugaaagccacaaugacugccccgugagacugcucaacccuaauaucgccaaaaugaaggaggauauucuguaccauuucaaccuuacaacgucccggcacaauuuuccggcccuguucggggacgucaaauuuguuugugugggaggcucucccagccgcaugaaggcuuucaucagaugcgugggggccgaacucggacuggauuguccuggccgggacuaucccaacauuugcgcugggaccgaucgcuacgccauguauaaagucggaccugugcuuuccguuucucauggcaugggcauccccagcauuuccaucaugcugcacgagcucaucaagcugcuguacuaugcgagauguucuaaugugacaauuauccggauugggaccagcggaggcaucgggcucgaaccuggaacagucgugauuaccgagcaggccguugacacaugcuuuaaggcugaguucgaacaaaucgugcugggcaaacgcgucauuagaaagaccgaucuuaacaaaaagcuggugcaggagcuccugcuuuguuccgccgaacugagcgaguuuacgaccguggucgggaauacaaugugcacccucgacuucuacgagggacagggccggcuggauggcgcucuguguucuuauacagaaaaagacaagcaggccuaccucgaggcggccuacgcugccgggguucgcaacaucgaaauggaguccagcguguuugcugccaugugcucugccuguggacugcaagcugcgguggucugcgugacccuucugaauagacucgaaggcgaucagaucuccagcccgcggaacguucugucugaguaucagcagcgcccccaaagacuuguguccuacuucauuaagaaaaagcugagcaaagccuga

SEQ ID NO: 77644 - RNA, 1125 nt, Artificial Sequence
  derived and/or modified sequence opt5 from UPP2__Homo_sapiens__NP_001128570
augcuggcccccggcugcgagcucgacccugaucaggaaguggucagaacccggccggaggacguucccgcuagcccuuccacaucuacgaugaucgugagcgugcugagacccccuucccacgccucuuguaccgcgugcgggacagucaccuuccauauuguggaacgcauggcuagcguuauccccgccuccaaccggucuaugcgcagcgauagaaauacauacgugggaaagcgguuuguccacgugaaaaacccuuaucuugaccugauggaugaggacauucucuaccaucuggaucuuggcaccaagacacacaaucugccggccauguucggggacguuaaauuugugugugucggaggcucccccaaccgcaugaaggcuuucgcccucuuuaugcauaaagaacugggguucgaggaggcugaagaggauaucaaggacauuugcgccggaaccgauagauauuguauguacaagacgggcccugugcuggcgaucagccacggcauggggauccccucuauuuccaucaugcuccacgaacugauuaaacuucugcaucacgcccggugcugugacgugaccaucauucgcaucggaacaagcggcgggauuggaaucgcuccuggcaccgucguuaucacagauauugccguggacuccuuuuucaagcccagauuugagcaagugauccucgacaauauugucacccggucuacggagcuggauaaagaacuuagcgaggaacuguucaacugcucuaaggagaucccgaauuuuccuacacucguggggcauaccauguguacauaugacuucuacgaaggacagggccgccuggauggcgcucugugcuccuuuagcagagagaaaaagcucgacuaucugaagcgggccuucaaagcggggguucgcaacauugagauggaauccaccguguucgccgcuauguguggacuuugcggccugaaggccgcugucgugugcguuacccuccuggauagacuugacugugaucagaucaaucugccccacgacgugcucgucgaguaccagcaacggccucagcugcugaucucuaacuuuauuagacgccggcucgggcugugcgauuga

SEQ ID NO: 77645 - RNA, 930 nt, Artificial Sequence
  derived and/or modified sequence opt5 from UPRT__Homo_sapiens__NP_659489
auggccaccgagcugcagugccccgacagcaugccuugucacaaccaacaggucaauuccgcuucuacaccgagccccgaacagcucagaccuggcgaucugauccuugaccaugccgggggaaaccgggcgucccgcgcuaaggugauucugcucacgggcuacgcccacucuagccugcccgccgagcuugauuccggggcuugcggaggcucuagccucaauuccgaagggaacagcggaucuggcgacuccagcucuuaugaugccccugcuggcaauuccuuccuggaggacugugaacugagcagacagaucggggcccaacugaaacuccugcccaugaacgaucagauucgggagcuucagaccaucauucgcgacaagacagcgucuagaggagauuuuauguucuccgccgaccggcugauccgccucguuguggaggaaggccugaaucagcuuccuuacaaagagugcauggugaccacaccgaccggguauaaguacgaaggagucaaauuugagaagggcaacuguggggugagcaucaugagauccggagaggcuauggaacaaggccugcgggauugcugucgcucuauuagaaucggcaagauucucauccagagcgacgaggaaacacagcgggccaaaguuuauuacgcuaaguuucccccugauauuuaucgcagaaaagugcugcugauguaccccauccucuccaccgggaauacggucauugaggccgugaagguucugaucgaacauggagugcagccuagcgucaucauucuucugucucucuucuccacaccccacggcgcgaaaagcaucauucaagaguucccggagaucaccauucugaccacagaagugcauccuguggcccccacccacuuugggcagaaguacuucggaacggacuga

SEQ ID NO: 77646 - RNA, 696 nt, Artificial Sequence
  derived and/or modified sequence opt5 from UQCC1__Homo_sapiens__NP_001171906
auggcccugcucgugagaguccugcggaaccagaccagcaucucccaauggguucccgugugcucucgccuuauuccugugagcccgacacagggccagggggacagagcucugucccggacgucucagaagaucaaaauugccgcgcuccgcauguacaccagcugugucgagaagacagauuucgaagaguuuuuccugagaugccaaaugcccgacaccuuuaauuccugguuccuuaucacacugcuccacguguggaugugucugguucggaugaaacaggaaggacgcucuggcaaguauaugugcagaauuaucgugcauuuuaugugggaggauguccagcagcgggggcgcgugaugggaguuaacccuuacauccugaaaaagaauaugauucucaugaccaaccacuucuaugcugccauccugggcuacgacgaagggauucuuagcgaugaccauggacuggccgcugcccucuggagaacauuuuucaaucggaagugugaggauccccgccaccuggagcuucugguggaauaugucagaaaacaaauccaguaccucgacuccaugaacggcgaggaucugcugcucaccggcgaagugagcuggcggccucugguggagaagaauccccagucuauucuuaaaccucauuccccgacguauaacgacgaggggcuguga

SEQ ID NO: 77647 - RNA, 381 nt, Artificial Sequence
  derived and/or modified sequence opt5 from UQCC2__Homo_sapiens__NP_115716
auggccgcuagcagauaccggcgcuuccugaagcucugcgaggaauggcccguggacgagaccaaaagaggccgggaucugggggccuaucuucgccagagagucgcgcaggcuuuucgggaaggagagaacacacaaguugccgaaccugaggccugugaccagauguacgagucccuggcucgccuccacucuaauuauuacaagcauaaauauccgagaccccgggauacgagcuucuccggccugucucuugaagaguacaagcugauccucagcaccgacacacuggaggaacugaaagagauugauaaggggauguggaagaaacuccaggaaaaguuugccccuaaaggacccgaggaagaccacaaggcuuga

SEQ ID NO: 77648 - RNA, 336 nt, Artificial Sequence
  derived and/or modified sequence opt5 from UQCRB__Homo_sapiens__NP_006285
auggccggcaagcaggcugugagcgccuccgggaaauggcuggacggaaucagaaagugguacuauaacgcggcuggcuucaauaaacucgggcugaugcgggaugacaccauuuacgaggaugaagacgucaaggaggccauccgcagacuucccgaaaaccuguauaaugaucggauguuucgcauuaaaagagcccucgaccugaaccuuaagcaccaaauccugccuaaggagcaguggacaaaauacgaagaggagaauuucuaucucgaaccguaccugaaggagguuauucgggaacgcaaagagagagaggaaugggcuaagaaauga

SEQ ID NO: 77649 - RNA, 1443 nt, Artificial Sequence
  derived and/or modified sequence opt5 from UQCRC1__Homo_sapiens__NP_003356
auggccgcuagcguggucugcagagccgcgaccgcuggcgcccagguucugcuccgggcccgcagaucccccgcucugcuucggacgccugcccugcgcucuacagcuaccuucgcccaagcgcuccaguuugugccggagacacaggugagccugcuugacaacgggcugagagucgccuccgaacagucuagccaacccaccuguacagugggaguuuggaucgaugugggcucccgguucgagaccgaaaagaauaacggggcuggauacuuucucgagcaccuggccuucaaaggcacaaagaaucgcccugggucugcucuggaaaaagaggucgagagcaugggagcccaucucaacgcguauuccaccagagaacacacggccuacuauauuaaggcucugagcaaagaccuucccaaggccguggagcugcucggcgauaucguucagaauugcucucuggaagacucccagauugagaaggagcgggaugugauccuucgcgaaaugcaggagaacgacgcuagcaugagagaugucguguuuaauuaccugcaugccaccgccuuccaaggcacaccucucgcucaggcgguggaagggcccucugagaacguccggaaacugucccgcgccgaccugaccgaauaucucagcacacacuacaaggcuccuagaaugguucuggccgccgcuggaggcguggagcaucagcagcuucuggaucucgcccaaaaacaccugggagggauuccguggaccuaugcggaggacgcugugcccacgcuuacaccuugucgguuuaccggcucugaaauccgccacagagaugacgcccugcccuucgcccaugucgcuaucgccguggaggggccuggaugggcuucccccgauaauguugcccuccagguggcgaacgccauuaucggccacuacgacugcacauacggcgggggaguccaucugagcuccccgcuggcuucuggcgccguggcuaauaagcucugucagagcuuucaaaccuucuccauuugcuaugccgaaaccgggcugcuuggagcgcacuuuguuugugaccggaugaaaaucgaugacaugauguucgugcugcagggccaguggaugagacucugcacaagcgccacggagucugaagucgcucgcgggaagaacauucugcggaaugcccuugugucccaccuggauggaaccacaccugucugugaggacaucggcagaagccuccugaccuacggccgccggauuccccuggcugagugggaaucuagaaucgccgagguggaugccagcguugugcgcgaaaucugcuccaaguauauuuacgaccaguguccugcugucgcgggguauggacccaucgagcaacuccccgauuacaaccggauuagaucuggcauguuuuggcugcgcuucuga

SEQ ID NO: 77650 - RNA, 1362 nt, Artificial Sequence
  derived and/or modified sequence opt5 from UQCRC2__Homo_sapiens__NP_003357
augaagcugcucaccagagccggcagcuucucccgguuuuacucucugaaaguggcucccaaggucaaagccacagcggcuccugccggggccccgccccagccucaagaccuugaguucacgaagcugcccaacggacucguuaucgcuagccuggaaaauuauuccccugugucucgcauuggccuuuuuaucaaagccgggagcagauacgaggauuucuccaaccugggaaccacacaccuccugcggcugaccucuagccucacaaccaagggcgcuuccagcuuuaagauuacacgcgggaucgaagccgugggaggcaaacugucugucaccgcgacgagagagaauauggccuauaccguggaaugccuucggggcgacguugauauucugauggaguuccuccugaacgugacaaccgcucccgaguuucgcagaugggaagucgccgaccuucagccucagcugaagaucgauaaagcuguggccuuccagaauccgcaaacacauguuaucgagaaccuccacgcggccgcuuaccggaaugcccuggcuaacccccuguauuguccugacuaccgcauugggaaggugaccuccgaggaacuccauuauuuuguccagaaucacuucacgagcgccagaauggcccugaucggacuuggcgugucucaucccgugcugaaacaggucgcugagcaguuucucaacaugcgcgggggacugggccuuuccggggcgaaggccaauuaccggggaggcgaaauuagagagcaaaacggcgauagccugguucacgcugccuucguggccgaaucugcuguggccggguccgcggaggcuaaugccuuuagcguccuccagcacgugcugggagccggcccucauguuaagcggggguccaacacaaccucucaucugcaccaggcuguggccaaagcuacacagcaacccuucgacgucagcgccuucaaugcguccuacagcgauucuggacucuuuggcaucuauaccauuucccaggccaccgcugccggggacgugaucaaggcugccuacaaccagguuaaaacaauugcgcaaggaaaccugagcaauacggaugugcaggccgcuaagaacaaacuuaaggccggcuaucugaugucugucgaaagcuccgagugcuuccucgaggaagugggcucucaggcucuggucgccgggagcuacaugccgccuuccaccgugcuucagcaaaucgacagcguugccaaugcugauaucauuaacgcggccaaaaaguuugugucuggacagaaguccauggcugccagcggcaaucuggggcacacacccuucgucgacgagcucuga

SEQ ID NO: 77651 - RNA, 825 nt, Artificial Sequence
  derived and/or modified sequence opt5 from UQCRFS1__Homo_sapiens__NP_005994
augcugagcguggccuccagaucuggccccuucgcuccuguccucagcgccaccucccgcgggguugcgggagcucugcggccgcuugugcaggccacagugcccgccacgccugagcaacccguccuggaccucaagagaccuuuucugucucgggaaagccuuuccggccaggcugugcgcagaccccugguugccucuguggggcucaacgucccugcuagcgugugcuacucccacaccgauaucaaaguuccggacuucagcgaguaucggcgccuggaagugcuggauucuacaaaguccagcagagagucuuccgaagcccggaaaggauuuagcuaccucgucaccggcgugacaaccgugggggucgcguaugccgcuaagaaugccguuacacaguucgugucuuccaugagcgcuuccgccgacgugcuggcgcuugccaaaauugagaucaagcugucugauauucccgagggaaagaacauggcuuuuaaauggcgcggcaagccucucuucgucagacaucggacccagaaagaaaucgagcaagaagccgcuguggagcugagccagcuucgcgacccccagcacgaucuggacagaguuaagaaaccugagugggugauucucaucggcgucuguacgcaucuggggugcgugcccaucgccaaugccggagauuuuggcggguacuauuguccgugccacggaucccauuacgacgcuagcggccggauucgccuggggccugcgccccucaaccuggaaguuccuaccuaugaguucacaucugaugacauggugaucgucggauga

SEQ ID NO: 77652 - RNA, 249 nt, Artificial Sequence
  derived and/or modified sequence opt5 from UQCRQ__Homo_sapiens__NP_055217
augggcagagaguucgggaaccugacccggaugcgccacgugaucagcuacucccucucucccuuugaacagagagccuauccucaugucuucacaaagggcauuccgaauguucugcggcgcaucagagagagcuuuuuccggguggugccccaauuugucguguucuaccuuauuuauacguggggaaccgaagaguuugaacgcuccaaaagaaagaacccugcugccuacgagaaugacaaauga

SEQ ID NO: 77653 - RNA, 4464 nt, Artificial Sequence
  derived and/or modified sequence opt5 from URB2__Homo_sapiens__XP_005273417
auggccgcuguguacagcggcaucucccugaagcucaaaucuaagaccacaagcugggaggacaaacugaagcuggcccacuucgcguggauuucccaucagugcuuucugcccaacaaagaacaaguccuccuggauugggcuagacagucucuuguugccuucuauaagaagaaacuggagcucaaggaagacaucguggagcggcuguggauuuacaucgauaauauucugcacagccgcaaacuccagaaccugcuuaagaaugggaaaacgaucaaccugcagaucucccucgugaagauuaucaaugaaagagucgccgaguuuucucugagcggaucccaacggaacauuugugcugugcuucgcugcugucagggcauccugagcaccccugcccucgcuguuauuuauacagccaagcaggagcugaugguggcgcugcucucucagcugugcugguccgccuguagacaaccggaaggggcugucguggcccagcuuuucgagguuauccaucuggcucucggacacuaccugcuuauucugcagcagcaagugaauccccggcgcgccuuuggcgacgucaccgcgcaucuccugcagccuugccuggugcucagacaccuucuuagcgggggaacauggacccaggccggccaaggccagcugagacaggugcucucucgcgauaucagaucccagaucgaagcuauguuccgcgggggaauuuuucaacccgagcugcuuagcucuuauaaagagggccugcucgaccagcagcagggggaugucaagacaggagccaugaaaaaccugcuggcuccuauggacaccguucucaaucggcugguggaugccggcuacugugccgcuucccuucacacgagcguggucgcgaacuccguggcccugcucuauaagcuguuccuggacucuuacuuuaaagaagggaaucaacuucucugcuuccagguucugcccagacuguuuggaugucucaagaucagccaucugcaggaggaacaguccaaagcucuuagcaccucugauuggacaaccgagcugcucguggucgaacaacugcugaacuccguggccaauaacaauauuuacaacaucgccgcugaccggauucgccacgaggaggcccaguucagauuuuaucggcauguugcggaacuucucaucaaccacgcucaggccccuaucccggccugguucagaugccugaagacacugauuagccucaaucaccugauccuugagcccgaucuggacgaccuccuggcuucugccuggauugaugcugaagugaccgaguuccgcacgaagaaagcccaggaagcgcugauccggacagucuuucaaaccuacgccaaacuuagacaggugccucgccucuucgaggagguccugggcgugauuugucggcccgcugccgaagcucugagacagccuguucucgccagcggccccuccacagugcugucugcgugccuucuggagcucccgccuagccaaauccuggacaccuggucccugguccuugaaaaauuucagagccucgugcugcccuaucugcagucugaugccgacauggcucucaagucccugagccuuucucugcuccugcauugcaucauguucaacaugcgcucccuggauagcuccaccccucuucccauuguucggagaacacaguguaugauggagcgcaugaugcgggaacuggugcaaccccuccuggcccuccugccugacacgccggggcccgagccugagcuuuggcugcagaaagucucugauagcgugcuccugcuguccuacaccugggcucagguggacgccauguuuucucuuaauugcagccaguaucacuccaugagcggaccccugaucggcguugcccucgaaauuucuaaccugccuucccuccugcccggggucaagacacaacauuggaagaaaaucgagaaguucaccgcucaguuuagcucucuuggaacauacugucuggaacagcucuaucugcagaaaaugaagagaacccugaugcaaacguccuuccgcagcgagggcgcgauucagucucuucggugcgaugccgcuuuuaucauugggagcggaagaaaaucccugaaucagcggacaaccgccagcugggacggccaagugggcauggugucugggcucaccuacccggucgcccacuggcaucugaucguguccaaccucacaauccugauuagcuaccuuuguccugaugacguuggauaucuggcuuccgugcugcuccgcacccugcccaugggcaaggcccaggaggucucuaucgacgaagaggcguacauuacacuugaaaagaucagcaaggcuuuccugcacuccccucucuuucccgagaugcagucucugcacagcgccuuccucacgugcgugaccacauccuguucuagcauucugugcuccggggcccagagagauagcggacuuguuucucaacagcugccuuggcuguuugaaaaggaccauaugguggucggccacugggagaaucgguucgcuaaagccgggcccgagggcaucgaaccgagaggagagaucgcgcagaaccuccugucccuuguuaagagcgauuucccuauucagcuggaaggcgagcaacucgaaucuauccuggggcuccuggaggugauuuccgcccuucagcuggacagccugcucccucccuaucaugugcacuacuuucugguccuucugucuauggcugugaccaaacucggauguuccugcagcuccagccuggcccucaaguuccugacaaccuguuaucagcuucugggcuaccugcagaaggggaaaucugcucgcagcguguuuaagaucauguauggauccgauauuuucgaggucguucucacgucucuguuucgggccagcuccagauuccuuaucgaaauggacgaucccgcuuggcuggaguuucuccaagugaucggcaccuuccuggaggaacugaugcagaugcucauucagaugaaacuuucucuggugcugaauuuucgcaagaucacagccuuccucagcuccucuaaaccguacaccgaagcggccagcuccaagcagcuggagaaccaaaauccccaggggagacagcuucugcucgucagccugacacggcugugccacgugcucggcccuuuucuuaaagagcaaaagcugggacaggaagcucccgccgcucugucugagcuccugcagcagguugugcuucaaaccggcgccguccugcagcucugcuccgugccuggggcccgcggauggagacugcccagcguucugauuucuuccgugagcacgcuccuugaagcugaccugggccagcauugucgggaugggggagcggacaucucccagggcucugaucgcacacugcucagccacgucgcccuguaccaagggguguauucccagauucuucuggagcucccugcucuggccggccaugaccagagcuuccaggccgcucugcaauuucucacccuuuucuuccuggcccccgagcugcacccgaagaaagauucuguuuuuacauccauguuccauagcgugagacggguccucgcggacccugaaauccccguccaggugacccaggacaucgagccucaccugggagcucuuuuuacccaaaugcuggaagugggcacaacggaggaucuccgccugguuaugcagugcauucugcaggggcucgacgugucuaacauguggaaggccgaugugcagcuucugaauagagaagccagccaagagcagcccgucucccugaccgugguuggaccggugcucgacguccuggcugcccuucugcggcagggcgaggaagcgaucgggaacccucaccaugugucucucgcuuucagcauucugcugacaguuccccucgaucaccuuaaaccucuggaguacggauccguguuuccccgccugcauaauguccucuucucuauccugcagugucaccccaaggugaugcuuaaagccauuccuagcuuucugaacuccuucaacagacucgucuuuagcgugaugcgggaaggcagacaaaaggacaaggggucuaucgaugaccugccgaccguucugaaaugcgcccgccucguggagcggauguauucccauauugcugccagagcugaagaguucgccgucuuuagccccuucaugguggcgcaguacguucuugaggugcagaaggucacacuguauccugccgugaaaucccugcuccaggaaggcaucuaccugauccuugaucuguguauugagcccgacgugcaauuccuccgcgcuucucugcagccuggaaugcgggauaucuuuaaggaacuguauaaugacuaccucaaauaccacaaggccaagcacgagggcgaaaaacgguauaccgcuuga

SEQ ID NO: 77654 - RNA, 2796 nt, Artificial Sequence
  derived and/or modified sequence opt5 from URGCP__Homo_sapiens__NP_001071131
auggccagccccggcaucgagguggaacugcucgggaagggacacuccgaccugggcgaggucgcuccugaaauuaaagccucugagagacggaccgcgguugcuaucgccgaucuugaauggcgcgagauggagggggacgauugcgaguucagauacggagacggcacaaacgaagcccaggauaaugacuuuccgacgguggaacggagccgccugcaagagaugcucucccugcuugggcuggagaccuaucaggugcagaagcucucucugcaggauagccugcaaauuuccuucgacucuaugaaaaacugggcuccccaggucccuaaggaucuccccuggaauuuucugagaaaacuucaggcccugaacgcugacgcccggaauacaaccauggugcucgauguucugccugacgcgcgccccguggaaaaggagagccagauggaagaggaaaucauuuacugggauccugccgacgaccuugcugccgauaucuauuccuucagcgagcugccgacacccgacaccccugucaacccccucgaucugcugugugcucuccugcuuucuuccgacagcuuucugcaacaggagaucgcccucaagauggcgcugugccaguucgcccuuccucuggugcuccccgauucugaaaaucauuaccacacauuucugcugugggcuaugagaggaauuguucggaccugguggucccagccgccucgcggcaugggcagcuucagagaggacucugugguccucucccgggcccccgcuuuugccuucgugcgcauggaugugagcuccaacucuaaaagccaacugcuuaaugccguccuguccccugggcauagacagugggacuguuuuuggcaccgggaucucaaccugggaacgaaugcucgcgaaaucagcgacggccuuguugagauuucuugguucuuucccuccgggagagaagaucuggacaucuuccccgagccuguggcguuccucaaccugcggggagacauuggcagccauuggcugcaguuuaagcuccugaccgagaucucuagcgccguguucauucuuacagauaauaucuccaaaaaggaauauaaacugcucuacucuaugaaggagagcaccacaaaguauuacuuuauccuguccccguacagagggaaacgcaacaccaaucugcgguuccuuaacaagcucauucccguccugaaaaucgaccacagccacgugcugguuaaggugucuuccacggauagcgacucuuuugucaaacgcauuagagcuaucgugggaaacguucuccgggccccuugcagacgcguguccgucgaagauauggcccaugcugcccggaagcugggccuuaaaguggacgaggauugugaagagugccaaaaggcgaaggacagaauggagcgcauuacacggaaaaucaaggauagcgacgcuuauagacgcgaugaacugcggcuccagggcgaccccuggagaaaagccgcccaggucgagaaggaguucugucagcugcaaugggcuguggauccucccgaaaaacaccgggccgagcugcgcagacggcuucucgaacugagaaugcagcagaaugggcaugacccguccucuggaguucaggaguuuaucagcggcauuuccucuccuagccuguccgaaaagcaauacuuccuccgcuggauggagugggggcuggcucggguggcccagcccagacuucgccagccucccgaaacccugcucacacugagaccuaagcacggaggcaccaccgacgucggggagccccuguggccggagccucuuggaguggaacacuuucuccgggagaugggccaguucuaugaagcggagagcugccugguugaagccggccgccugcccgcugggcaaagacgguuugcccauuuccccggacucgcuucugagcugcuucugacaggccucccucuggagcugaucgauggguccacgcuuagcaugccggugcgcugggucaccggacuccugaaagaacugcacgugagacucgagcggcgcucuagacuggugguucuuuccacagucggcgugcccgggaccggcaagagcacacugcucaacaccauguuuggacugcgguucgccacgggcaaaucuugugggccucgcggagcguucaugcagcugauuacaguggccgaaggcuuuagccaggaccuugggugcgaucauauccuggucauugacuccggaggccucaucgggggcgcucugaccagcgccggagauagauucgagcucgaggcuucucuggccacccuucugaugggccucuccaaugugacaguuaucagccuggccgaaaccaaggacauucccgcugcgauccugcacgccuuucuucggcuggagaaaacagggcauaugccuaacuaccaguucguguaucaaaaucuccacgaugucuccgugcccggaccuagaccccgcgacaagcggcagcugcucgauccgccuggcgaccugucuagagcugccgcccagauggaaaagcaaggggauggauuucgcgcucuugccggccuggcguucugugaccccgagaaacagcacauuuggcauaucccugggcucuggcacggcgcucccccgauggccgccguuagccuggcuuacuccgaagccauuuuugagcugaagcggugccuucuggagaacaucagaaauggacucucuaaccagaauaaaaacauucagcaacugaucgaacucgugcgccggcuguga

SEQ ID NO: 77655 - RNA, 1428 nt, Artificial Sequence
  derived and/or modified sequence opt5 from URI1__Homo_sapiens__NP_001239570
augaccacauggagcucccugcagggcucucacgugagcaagagagcccucgcuuacgcccuggucguuacgaacugccaagagcggauccagcauuggaaaaagguggacaaugauuauaacgcgcuucgcgaaagacuguccacccuccccgacaaacugucuuacaauauuauggugccuuucgggccguuugcuuucaugcccggaaaacuuguccacacaaacgaggugaccguucugcucggcgauaauugguuugccaaauguagcgccaagcaggcuguggggcuggucgaacaucggaaggagcacgugcgcaaaacaaucgacgaucugaagaaaguuaugaagaacuucgaauccagaguggaguuuaccgaggaccuccagaaaaugucugaugccgcuggagacauugucgauauccgggaagagauuaagugcgacuucgaauuuaaggccaaacaucgcaucgcgcacaagccucacagcaaacccaagacauccgauaucuucgaggccgacauugcuaaugaugugaaaagcaaggaccugcuugccgacaaagagcugugggcuagacucgaggagcuggaacggcaagaggaacuucugggcgagcucgauucuaagccugacaccgugaucgccaacggggaggauacgaccuccagcgaagaggaaaaggaggaccgcaauacaaacgucaaugcgaugcaucagguuaccgauucucacacacccugucauaaagacguggccuccagcgaaccuuuuucuggacaggugaacucccagcugaauugcagcgucaacggcuccucuagcuaucacuccgaugacgaugacgaugacgacgaugacgaugacgaugacaauauugaugacgaugacggcgauaacgaccacgaggcucugggggugggagauaacagcaucccgaccauuuacuucucucauacgguugagcccaagagagugcggaucaauacaggcaaaaacaccacacucaaguuuuccgaaaagaaggaggaagccaagcgcaaaagaaagaauagcaccgggucuggacacagcgcucaagagcugccuaccauucggacacccgccgacaucuaucgcgccuucgucgacgugguuaacggcgaauacgugccuagaaaauccauccuuaagucucggagcagagaaaauuccgucuguagcgauacgucugaguccagcgcugcggaauuugacgaucgcagaggggugcugcggucuauuuccugcgaggaagccaccuguagcgacacauccgagucuauccucgaggaggaaccccaggaaaaccagaaaaagcugcuuccgcugagcgucaccccugaggugcuccgccugguuggauauucccggaaucuggcuccccucaacgugauucuguga

SEQ ID NO: 77656 - RNA, 441 nt, Artificial Sequence
  derived and/or modified sequence opt5 from URM1__Homo_sapiens__NP_001129419
auggccgcuccccugagcguggaggucgaguucggcgggggagccgagcuccuguuugacggcaucaagaaacacagaguuacccuuccugggcaggaagaaccgugggauauucggaaccugcucaucuggauuaagaaaaaucugcuuaaggaacgccccgagcuguucauccaaggagacuccgugagaccuggcauucucgugcugaucaacgaugcggacugggagcugcucgucucuacacugggggauauucccccucccgcuccugcccuugccgcuagcgugggaaaacggugggccuccccgcaggcucauaucgaauggcugggcaaucccccuccccacucuagcccuacgcuccgccugcuugagucccccaccccgggcgaagaggggaugggaucuuggggccaugggagcacaccucccuccuga

SEQ ID NO: 77657 - RNA, 2211 nt, Artificial Sequence
  derived and/or modified sequence opt5 from UROC1__Homo_sapiens__NP_001159446
augagcucccugcaggcccucugcucuggccugccccuuagaccucugccggagaaccgggggcgccaagcuggagugccccacgccccugucagaacccccagccucuccccuguugaaaagcagcuggcgcuucggaaugcucugcgcuacuucccucccgacgugcaggagcuccuggccccggaauuugcccaggagcugcaacucuauggccauaucuacauguauagauucugucccgauauugaaaugcgggcuuacccuaucgagcaguaucccugccagacaaaaguggccgcugccauuaugcacaugaucaugaacaaucuggacccugcggucgcccaguuuccccaagagcuugugacguacgggggaaacggccagguuuucucuaauugggcucaguuuuggcugaccauguucuaucucagcaagaugacagaggaacagacccuggugauguacuccgggcauccgcuuggacuguuuccuucuagccgcuccgcccccagacucgucauuacaaacggcauggugaucccuaauuacagcucucggaccgaauaugagaaacuguucgcucugggcguuacaauguacgggcaaaugaccgccggauccuauuguuacaucggcccccaggggauugugcacggaacgguccucaccgugcugaacgcggcccgcagauaucuuggcaucgaggaucuggcugggaagguguuugucacaagcggacucggcggcaugucuggggcccaggcuaaagccgccguuauugugggaugcaucggcgugauugcugaagucgacaaggcggcccuggagaagcggcaucgccaaggguggcuuauggaagugaccgauucccuggacagauguauccagcggcuccgcguucugcagcugggacuccagcaagcucugggcugggccgggcuucccgccgcucugggacucugcgugcugagcuguuucgucaaucuugccccucugggcgagggcagaugccucgcgccgucuggguuuucccggccccugcugggagcuccugugcuccugcuuugucccagcagagaagcccgcaaaaagaaagagguucugucccucggcuaccacgggaacguggucgcccugugggagcggcuggugcacgaacuugauacaaccggagagugccucgucgaccugggcucugaucagacgagcugucauaauccuuucaacgggggcuauuaccccgugcagcuguccuuuacagaagcucagagccucauggccucuaauccggcuguuuucaaggaccuggugcaagagucccuuagacgccaggucagcgccauuaaccggcuggcggaagagaaauucuuuuucugggauuacggaaaugccuuucuccuggaggcucagagagccggcgcugacguggaaaagaagggggccggacgcaccgaguuccgguauccuucuuacguucagcacaucaugggcgauaucuuuagccaaggguucggacccuuuagaugggugugcacauccggcgacccucaggaccuggcggucaccgaugaacuugccaccucugugcucgaggaagcuauugccgacggggugaaaguuagcgucaagcugcaguauauggauaacauccgcuggauucgggaggcugccagacaucgccugguggugggcucccaggcccggauccucuacagcgaccaaaaaggaagagucgcuauugcgguggccaucaaccaggcuaucgccugccggcgcauuaaggcccccguugugcugucuagagaucaccacgacgucuccggcacagauagcccuuuccgggagacgucuaauaucuaugacggguccgcuuuuugugccgauauggcggugcagaacuucguuggagacgcuugcagaggcgccaccuggguggcccuucauaaugggggaggcgucggguggggcgaagugauuaacggaggcuuugggcugguucucgauggaacacccgaggcugaaggccgcgcccggcugaugcugagcugggacguguccaauggggucgcgagacgcuguuggucuggaaaccaaaaggcuuacgagaucauuugccagaccaugcaggagaauagcacacuuguggugacccucccgcacaaagucgaagacgagagaguucugcagcaagcccugcagcucuga

SEQ ID NO: 77658 - RNA, 1041 nt, Artificial Sequence
  derived and/or modified sequence opt5 from UROD__Homo_sapiens__XP_011540382
auggaggccaacggccuggggccccagggauucccugaacucaagaaugacaccuuucugagagcugccuggggcgaggaaacagauuacacgccgguguggugcaugcggcaagcggggcgcuaucuucccgaguucagagaaacccgggcugcccaggacuuuuucagcacaugucgcuccccugaggccugcugugagcugacccuccaggcucugggaauggaagucacaaugguucccggcaaagggccuucuuuucccgagccucuuagagaggaacaggaucuggagcggcuccgcgacccggaagugguggccagcgagcugggauacgucuuccaagcuaucacccugacaagacagcggcucgccggccgcgugccccugauuggcuuugcgggggccccuuggacccuuaugacguauaugguugaaggaggcggguccucuaccauggcucaggccaagagauggcuguaccagcggccccaagcuagccaccagcuccugcgcauccuuacagaugcccuggugccuuaucucgucggacaggugguugcgggcgcccaggcucugcaacuguucgagucccaugccgggcaccucggaccccagcuguuuaacaaauucgcccuuccguacauuagagacguggcuaagcaggucaaagcccggcugcgcgaagcuggccucgcgccugugcccaugaucauuuuugccaaggauggccauuucgcucuggaggagcuugcccaagccggguaugaaguggucggacuggacuggaccguugcuccuaagaaagccagagagugcgugggcaagacagugacccuccaggggaaucuggaucccugugcgcuguacgcuucugaagaggaaaucggacagcucgucaaacagaugcuggacgauuuuggcccccaccgguacaucgccaaccuugggcauggacuguauccugacauggauccggagcacgugggcgccuucguugacgcugugcacaagcauagcagacuccugcgccaaaauuga

SEQ ID NO: 77659 - RNA, 798 nt, Artificial Sequence
  derived and/or modified sequence opt5 from UROS__Homo_sapiens__NP_000366
augaaggugcugcuccugaaagacgccaaggaggaugacugcggccaggaucccuacaucagagaacuugggcuguauggacucgaggcuacccugauuccuguccuuagcuucgaauuucugucccucccgucuuucagcgagaaacugucccaccccgaagacuacggcgggcugaucuuuacaucuccucgggccguugaggcggcugagcucugucuggaacaaaacaauaagacggaggugugggaacgcagccuuaaagagaaguggaacgccaaguccguguaugucgugggaaaugccaccgcuucucugguuagcaaaauuggccucgauacagagggggaaaccugcggaaacgccgagaagcuggcugaauacaucuguuccagagagagcucugcccuuccccuccuguucccuugcggcaaucugaaacgggaaauucugcccaaggcgcucaaagacaagggcaucgccauggaguccaucacaguguaucagaccgucgcucauccugggauucagggaaaccugaauagcuacuauucucagcaaggcgugccggccuccaucacauuuuucagccccucugggcuuaccuacucccugaagcacauucaggagcucagcggagauaacaucgaccagauuaaauuugcugccaucggcccuacgaccgcgcgcgcccuggcugcccaggggcuucccguuuccuguacagcugaaucuccuacaccccaagcccuggccaccggaauuagaaaggcucuccagccgcauggcugcuguuga

SEQ ID NO: 77660 - RNA, 744 nt, Artificial Sequence
  derived and/or modified sequence opt5 from USB1__Homo_sapiens__NP_001182231
augagcgccgcuccccuggugggcuacuccucuagcggguccgaggacgagucugaggauggaaugagaacccggccuggcgacgggagccaccgcagaggacaguccccgcucccccggcaacgcuucccuguccccgauucuguucugaacauguuuccuggcacagaagaggggcccgaagacgauagcacgaagcauggaggcagagugcggaccuucccucacgagcgcggcaauugggccacacauguguaugucccguacgaggcgaaagaagaguuucuugaccugcucgaugugcugcuuccccacgcucagaccuauguuccuagacuggugcggaugaaggucuuccaucucucccugagccagucugugguucugcgccaccacuggauccuccccuuugugcaggcccugaaagccagaaugacauccuuccaucggaccuuuauugggcuugaagucacaagcggacacgcucaauuccuggaccucgugucugagguggaucgcgucauggaggaauuuaaccugaccacguucuaccaggacccuuccuuucaucuuagccuggccuggugcguuggcgaugcuagacuccagcuggaggggcagugucugcaagaacuccaggccaucguggacggauucgaggaugcggaagugcugcuucggguccacaccgaacaggugcgcugcaagucuggcaauaaauuuuucuccaugccccugaaguga

SEQ ID NO: 77661 - RNA, 780 nt, Artificial Sequence
  derived and/or modified sequence opt5 from USE1__Homo_sapiens__NP_060937
auggccgcuagcagacuggagcucaaccuggugcggcuucugucccgcugcgaagccauggcggcugagaagagagaccccgaugaauggcggcucgagaaauacgucggcgcccuggaagacaugcuucaggcccugaagguucacgcuucuaaaccugccagcgaggugaucaaugaguauuccuggaagguggauuuccucaaagggaugcugcaagcugaaaagcugaccucuagcuccgagaaggcccucgcgaaccaguuucuggccccgggacgcguccccacaacggcuagagaacgggugccugccaccaaaacaguucaucuucagucucgcgcuagauacaccagcgagaugcgguccgagcugcucggcacagacagcgccgaacccgagauggaugugcgcaagagaaccggggucgcgggaucucagccuguguccgaaaaacaaagcgccgcugagcuggaccuuguucugcagcggcaccagaaucuccaggaaaagcuggccgaggagaugcugggccucgcucgcucucugaaaacaaacacccuugccgcccaauccgugauuaagaaggauaaucagacgcugagccauucucucaaaauggcugaccagaaccuggaaaaacuuaagaccgaguccgaaagacuggagcagcacacacaaaagagcgucaauuggcuccugugggcgaugcugaucauuguguguuucaucuuuauuuccaugauccucuucauccggauuaugcccaaacugaaguga

SEQ ID NO: 77662 - RNA, 933 nt, Artificial Sequence
  derived and/or modified sequence opt5 from USF1__Homo_sapiens__NP_001263302
augaagggccagcagaaaaccgccgagacagaagaggggacggugcagauccaggaaggagcugucgccaccggcgaggaccccacaagcguugcgauugcuuccauccagucugccgccaccuucccugauccgaacgugaaguacguguuuagaacagaaaaugggggacaagucauguaucgggugauucagguuagcgagggccagcuggacgggcagaccgagggaacaggcgcuaucuccggcuaccccgccacccaaucuaugacgcaggcugugauucagggggccuucaccagcgaugacgcggucgauacagaaggaaccgccgcugagacacacuauaccuacuuuccuuccacggccgugggcgacggggcuggaggcacaaccucugggagcacagccgcgguugugaccacccagggauccgaagcccuccugggccaagcuacacccccuggcacggggcaguucuuugucaugaugagcccccaggaggugcuucaaggaggcucucagcgcuccaucgccccuagaacccauccguauagccccaaaucugaggcuccucggacaacccgcgaugaaaagagacgggcccagcacaacgagguggaacgcagacggcgcgacaaaaucaauaacuggauuguccagcuguccaagaucauucccgauugcagcauggagucuacaaaguccgggcaaagcaaaggaggcauccucuccaaggccugugacuacauucaggaacugagacagucuaaucaucggcuuagcgaggagcugcaggggcucgaucaacugcagcuggacaacgauguucuccgccaacagguggaagaccugaaaaauaagaaccuucugcucagagcucaacugcggcaccauggacuugagguggucaucaaaaaugacuccaacuga

SEQ ID NO: 77663 - RNA, 1041 nt, Artificial Sequence
  derived and/or modified sequence opt5 from USF2__Homo_sapiens__NP_003358
auggacaugcuggaucccggccucgacccugccgcuagcgccaccgcggcugccgccgcuucccacgauaaggggccggaggccgaagagggaguggaacugcaggagggcggggacggacccggcgcugaggaacaaacagccgucgcgaucacgucuguucagcaggccgcuuucggggaucauaacauucaguaccaauuuagaaccgagacaaauggaggccaggugaccuaucgggugguccaggugacagacggccagcuugaugggcaaggagacaccgccggcgcuguuagcguggucuccacagccgcguucgccgggggacagcaggcugugacccagguuggcguggauggggccgcucaacgcccuggacccgccgccgcuucugucccucccggcccugcggccccguuuccccuggcugugauccagaacccuuucagcaauggcgggucccccgccgccgaagcugugucuggagaggccagauuugcguacuucccugcuagcuccgucggcgacacgaccgccguuagcgugcagacaaccgaucaaucucuccaggccgggggacaguuuuaugugaugaugacaccccaggacguccugcaaaccggcacgcagcggacaauugcuccgcgcacccacccuuacucccccaaaaucgaugggacaagaaccccucgggacgaacgcagacgggcccagcauaacgagguggagcgcagacggcgcgacaagauuaauaacuggaucguucagcuuagcaaaaucauucccgauugcaaugcugacaacucuaagaccggagccuccaaaggcggcauccugagcaaggcgugugauuauauuagagaacuccggcaaacaaaucagcgcaugcaggagacguucaaggaagccgagagacugcagauggacaacgaacugcuccggcaacagaucgaggagcugaaaaaugaaaacgcccuucugagagcucagcuccagcaacacaaucuggagauggugggggaaggaacccgccaguga

SEQ ID NO: 77664 - RNA, 1602 nt, Artificial Sequence
  derived and/or modified sequence opt5 from USH1C__Homo_sapiens__NP_001284693
auggacagaaagguggcccgggaguuccgccacaaagucgauuuucugaucgaaaacgacgcugagaaggauuaccucuaugacguucugagaauguaccaucagaccauggauguggccgugcuugucggcgaccugaaacucgugauuaaugaacccagccggcugccucuuuucgaugcgauccgcccgcugauuccccucaagcaccagguugaguaugaccagcugacaccuagacggucccgcaaacugaaggaagugagacucgaucggcugcaucccgaggggcuuggacugucuguccgcggcgggcucgaguuuggaugcggccuguucaucagccaccuuauuaaagggggacaggcugacuccgugggccugcagguuggcgaugaaaucgugagaaucaacggguacucuauuagcuccuguacgcaugaggaagucaucaaucucauucggaccaagaagacagugucuaucaaagugcgccacauuggacugaucccugucaagagcucccccgacgagccucugaccuggcaauauguugaucaguuugugagcgagucuggcggggugagaggaucccucggcagcccggggaaccgggaaaauaaagagaagaaggucuucauuucucuggugggaucccgcggccuuggcugcagcaucucuuccgggcccauccagaaaccuggaauuuuuaucagccacguuaagcccggcucccugucugccgaaguggggcucgagauuggagaccagaucgucgaagugaacggcguugacuucagcaaucuggaucauaaagaggggagagagcuuuuuaugacagaccgggaaagacuggccgaggcucgccaacgggaacuccagagacaggagcugcugaugcagaagcgccucgccauggaauccaacaaaauucugcaagagcagcaggagauggaacggcaaagacgcaaggagaucgcucagaaagccgcggaagagaaugaacgguacagaaaggagauggagcagaucguggaagaggaagagaaguucaaaaagcagugggaggaagauuggggaagcaaagagcaacuucugcucccuaagaccauuacagccgaaguccaccccgugccgcugcgcaaaccuaaguaugaccagggcgucgagcccgaacuugagccugcugaugaccuggauggcgggaccgaggaacagggagagcaggacuuucggaaguacgaagagggcuucgaucccuacucuauguuuacgcccgaacaaaucauggggaaagacgugagacuccugcgcauuaagaaagagggaucccuggaucucgcccuggagggcgggguugacagcccuaucggcaagguggucgugucugcuguuuaugaacggggagccgcggagagacauggcgggauugugaaaggagacgaaaucauggccaucaacggcaagauugucaccgauuacacacuugcugaggccgaagcugcccugcagaaggccuggaaucaagggggagacuggaucgaucucgugguggcuguuuguccgcccaaagaguaugacgaugagcugaccuucuucuga

SEQ ID NO: 77665 - RNA, 1386 nt, Artificial Sequence
  derived and/or modified sequence opt5 from USH1G__Homo_sapiens__NP_775748
augaacgaccaguaccacagagccgcucgggauggcuaucuggagcuccugaaggaagccacccgcaaagagcuuaaugcgcccgacgaagaugggaugacaccuacgcugugggcugccuaccauggaaaccucgagagccugagacuuaucgugucccggggcggggacccggauaagugcgacauuuggggaaauacaccccugcaccucgccgcuucuaacggccaucugcacugucugagcuuccucgucuccuuuggggccaauaucuggugccuggauaacgacuaucauaccccucuugauauggcugccaugaaaggacacauggaauguguucgcuaccuggacucuauugcggccaagcaaagcucccucaaucccaaacuggugggcaaacuuaaggauaaggcuuucagagaggccgagcggcgcaucagagaaugcgcuaagcugcagcggcgccaccaugagagaauggaacggcgcuauagacgggagcucgccgagcgcucugacacccugagcuuuuccagccugacaucuuccacccucagcagacggcugcagcaccuugcgcugggcucucaucucccuuacucccaggccacacugcacgggaccgcuagaggaaaaacgaagaugcaaaagaaacuugaacgccggaagcagggcggggagggaaccuucaaagugagcgaagauggcagaaagucugcccgcucccugagcgggcuccagcugggauccgacgucauguuugugcggcagggcacauaugcuaaccccaaagaguggggcagagccccucugcgcgacauguuccucucugaugaagacagcguuucccgggccacccuggcugcggagccggcccacagcgaggugucuacagauuccgggcaugacagccuuuuuaccagacccggacugggcacgauggucuuccgccggaauuaccucucuagcgggcugcacggacuuggcagagaagaugggggacuggacggcgugggcgcuccucgcgggcggcuccaauccucucccagccuggaugacgauucccugggaagcgccaacucucuccaggacagauccuguggcgaggaacugccuugggaugagcuugaccuggggcucgacgaagaucuggagcccgagacaagcccgcuggaaaccuuucuugccucucuccauauggaggacuucgcugcccugcugcggcaggaaaagauugaucucgaggcgcugaugcuuugcuccgaccuggaucuccgcagcaucuccguuccucugggaccccggaaaaagauccugggcgcugugagaagacgccggcaggccauggaaagaccucccgcccuugaggacacagagcucuga

SEQ ID NO: 77666 - RNA, 4641 nt, Artificial Sequence
  derived and/or modified sequence opt5 from USH2A__Homo_sapiens__NP_009054
augaacugccccgugcugagccucggcuccggguuccuguuucaggucaucgagaugcuuauuuucgccuacuuugcuucuaucagccugaccgaauccagaggacucuucccucggcuggagaauguuggcgccuuuaagaaagugucuauugugccgacacaagcggucugugggcuucccgaccgcagcacguucugccacuccucugcugccgccgaaagcauccaguuuuguacccagagauucugcauucaggauuguccuuaucgguccagccaucccacauacaccgcucuguuuucugccggacucuccagcugcaucacaccugacaagaacgaucugcaccccaaugcucauucuaacuccgccagcuucaucuuuggcaaucacaaaucuuguuucuccagcccuccgucccccaagcugauggcgucuuuuacccucgccguguggcugaaaccugagcaacaggggguuaugugcgugauugaaaagacagucgacggacagaucguguucaaacuuaccauuagcgagaaggagacgauguucuauuaccgcaccguuaacggccugcagcccccuaucaaggugaugacacucggccggauucuggucaaaaaguggauccaucuuuccgugcaagugcaccagaccaaaauuagcuuuuucaucaauggggucgaaaaggaucacacacccuuuaacgcuagaacccugucuggauccaucacggacuucgccagcggcacaguucagauugggcagucucucaauggacuggagcaauuugugggccgcaugcaggauuucagacuguaucagguggcucucaccaaccgggaaauccuggaggucuuuagcggggaccuucugcgccuccaugcccaaucccacuguagaugcccgggaucucauccucgggugcacccccuggcgcagcgcuacuguauuccuaaugaugccggcgacacagcugauaacagaguuagccggcuuaaucccgaggcccacccccuguccuucgugaacgacaaugaugucggcaccagcugggugucuaacguuuuuaccaacaucacacagcucaaucagggggugacgauuuccgucgaccuggaaaacggacaauaucagguguucuacaucaucauucaguuuuucagcccucagccgaccgagauccgcauucaaagaaagaaagaaaauucucuggacugggaggauuggcaguacuuugcucggaacugcggcgccuucgggaugaagaauaacggagaccucgaaaaacccgauuccgucaauugccugcagcuuagcaacuucacaccuuauuccagaggcaaugugaccuuuucuauccugacacccgggccuaacuaccgccccggauauaauaacuucuacaauaccccgagccuccaggaguuuguuaaggccacgcaaauucgguuccauuuucacggccaguauuacacaaccgagaccgcugugaaccugagacaucgcuauuacgcggucgacgaaaucacaaucuccggccggugucagugccacgggcaugccgauaauugugacaccacaucucagccuuacagaugccuuuguagccaagaguccuucacggaaggacugcacugcgaucgcugucucccccuguauaacgacaaaccuuuucggcagggcgaucagguguacgcuuucaacugcaagcccugucaaugcaauagccacucuaaauccugucauuauaacauuagcguugacccuuuucccuucgagcacuuuagagggggaggcggggugugcgaugacugcgaacauaauaccacaggccgcaacugugagcugugcaaggacuacuucuuucggcaggucggagccgauccgucugccaucgacguguguaagccuugcgauugugacaccgugggcacaagaaauggguccauucucugcgaucagaucggaggccaguguaacugcaaacgccacguuagcgggcggcaauguaaucagugccagaacggauucuauaaucugcaggagcuugaccccgauggcuguucucccugcaacugcaauaccagcgggacggucgacggcgauauuaccugucaccaaaacuccggacagugcaaguguaaagcuaaugugaucggccugagaugcgaccauuguaacuucggguuuaaguuccuccggagcuuuaaugaugugggaugcgaaccuugucagugcaaccugcacggcucugucaacaaauucuguaauccgcauuccgggcagugcgaguguaagaaggaagccaaaggacugcaaugcgacacaugccgcgagaacuuuuacggccuugaugugaccaauuguaaggcgugcgacugugacacagcugggagccuccccggcaccguuugcaacgccaaaacgggacaguguauuugcaagccuaauguggaaggcagacaguguaacaaaugccuggaggggaauuucuaucugcggcaaaacaauuccuuucucugucugcccugcaacugugauaagacaggaaccaucaauggcucucuucugugcaacaagagcacagggcagugcccuuguaaacucggagucaccggccugagaugcaaucagugugagccccaccgcuacaaccugaccaucgacaauuuccagcauugccaaaugugugaaugcgauucccuugggacacucccuggcacgauuugugaccccaucucuggacagugccugugugugccgaaccggcagggcagacgcugcaaccagugucaaccuggguuuuacauuagccccggaaaugccaccggcugccugccuugcuccugucacacaaccggggcuguuaaccacaucugcaauucucucacaggacagugugugugccaggaugccagcauugcuggccagagaugugaccaaugcaaggaucauuauuucggcuuugacccccagaccgggcggugucagccgugcaacugucaccuguccggagcccuuaaugagacgugccaucuggucacaggccaguguuucugcaaacaauucgugaccgggagcaagugugaugcgugcguuccuucugccucccaccucgacgugaacaaucugcugggaugcagcaaaacccccuuucagcagccuccuccccgcggccaaguccagucuuccagcgcuaucaaccuuucuugguccccuccggauagccccaaugcccauuggcucacauacucccugcugagagacggguucgaaaucuauaccacagaggaucaguacccuuauagcauucaguacuuucucgacacggaccugcuucccuauaccaaguacucuuacuauaucgagacaaccaacgugcacggaagcacacgguccguggcugucaccuacaagacgaaaccuggcguucccgaaggcaaucugacccucucuuauauuaucccuauugggagcgauuccgugacacugaccuggacaacccugucuaaccaaagcggaccgaucgagaaguacauccuuuccugugcgccccucgccggcgggcagccuugcgugucuuaugaaggacacgagacaagcgccaccauuuggaaucugguccccuucgcuaaauacgacuuuuccgugcaggccuguacgagcggcgggugccugcauucucucccuaucacaguuaccaccgcucaggcucccccgcaacgccuguccccucccaagaugcagaaaauuagcucuacagaacuucacguggagugguccccucccgccgagcugaacggaaucauuaucagauaugaacucuacaugcggcgccugagaagcaccaaggagacgacauccgaagagucucgggucuuccagagcuccggcuggcugagcccccauucuuuuguggaauccgccaaugagaacgcgcuuaaacccccgcagaccaugacaaccaucacaggccuggagcccuacaccaaguaugaguuccgcguucucgccgugaauauggcugggagcgucucuagcgccuggguguccgaaagaacgggagaaucugccccuguuuuuaugauucccccuagcguguucccccuguccucuuacagccucaacaucuccugggagaagccggcugauaacgucacccggggcaaaguggugggguaugacauuaauaugcugagcgaacaaucuccucagcaguccauccccauggccuuuagccaacuucugcacacagcgaagucccaggagcucucuuacaccgucgagggacugaaaccuuauagaauuuacgaguucacaaucacccuguguaacagcguuggcugcgugacguccgcuucuggggccggacagacacuugccgcugcccccgcgcagcugcgcccuccccucgugaagggcauuaauagcaccacaauccaccugaaaugguuuccgccugaagaacucaacggccccucccccaucuaucaacuggagcggagagagagcucucuuccugcucugaugaccaccaugaugaaggggauucgcuucaucggaaauggcuacuguaaguucccguccagcacacaucccgucaacacggauuuuaccgggaaaugcguguga

SEQ ID NO: 77667 - RNA, 2922 nt, Artificial Sequence
  derived and/or modified sequence opt5 from USO1__Homo_sapiens__NP_001276978
augaacuuccugagaggcgugaugggagggcagagcgccggcccccaacacaccgaggcugaaacaauccagaagcucugcgaccgggucgccuccucuacgcugcuugaugaccgcagaaaugcgguucgggcucugaaaagccucuccaagaaauaccgccuggagguggggauucaggccauggaacaucuuauccacgugcugcagaccgauagaucugacagcgagauuaucggauaugcccucgauacacuguacaacauuaucuccaaugaagaggaggaagaggucgacgauguggaagaggagaacucuacccggcaaagcgaagaccugggcucccaguuuacagagaucuucauuaagcagcaggaaaauguuacccuccugcuuagccugcucgaggaauuugauuuccaugugcgcuggccuggggucaaacugcuuacaucucugcucaagcaacugggaccccaggugcagcagaucauucugguuuccccgaugggcgugagcagacucauggaccugcuugcugauucucgggaggucauccgcaacgacggcgugcugcuccugcaagcccuuaccagauccaauggggcuauucagaagaucguggccuuugagaacgcguucgaacggcugcucgauauuaucagcgaggaaggaaauucugacggcgggaucgucguugaggacugucugauucugcuccagaaccugcuuaaaaauaacaauuccaaccaaaauuucuuuaaggaaggaagcuauauccagcgcaugaaaccuugguuugaggugggcgaugagaacuccggguggucugcccagaaggugacgaaccugcaccucaugcugcagcuugucagagugcugguuagccccaccaauccucccggagcuacauccagcugccaaaaagccauguuccaguguggccuccugcagcagcugugcaccauucucauggcuacaggcgugccugccgacauccugaccgaaacgauuaacacagucucugaggugauccgggggugucaaguuaaucaggauuacuuugcguccgugaacgccccgagcaaucccccucgccccgcuaucgucgugcuucugaugucuauggucaacgaaagacagccuuucgugcuccggugcgccguucuguauuguuuucagugcuuccuguacaagaaucaaaagggacagggcgagauugugagcacccuucuccccuccacaaucgacgcuaccgggaacucugucagcgccggacagcugcuguguggcgggcuguucuccaccgauagccugucuaauuggugcgccgcuguggcgcuugcccaugcucugcaggaaaacgccacacaaaaagagcagcuccugagaguucagcuggccacguccauuggaaauccgccugugagccuucuccaacaguguaccaacauccugucucagggcgacaagauugaucgccggggcuccaaaauccagacaagagucgggcugcucaugcugcuuugcaccuggcugagcaauugccccaucgcugugacacacuuucuccacaacuccgccaaugugccuuuccugaccggacaaauugcggagaaccugggcgaagaggaacagcuuguucaggggcucugugcucugcugcucggaaucucuauuuauuuuaacgacaauagccuggaguccuacaugaaggagaaacuuaagcagcugaucgaaaaacgcauuggcaaggagaacuucaucgaaaagcucggguuuauuucuaaacaugagcuguacagccgggccucccaaaagccccagcccaauuucccuagcccggaauauaugaucuuugaucacgaguucacgaaacuggucaaggagcuugaaggcgugaucacaaaagccauuuacaagucuuccgaggaagacaagaaagaggaagaggugaagaaaacccucgagcagcaugauaacaucgucacccacuauaagaauaugauuagagaacaggaccugcaacuggaggaacuccgccaacaggugagcacacugaaaugccagaacgagcagcuucagaccgcuguuacacagcaagugucucagauccagcagcacaaggaccaauacaaucugcucaagauucagcugggaaaagauaaccagcaucagggcuccuauagcgaaggggcccaaaugaauggaauccagcccgaggagaucggccggcugagagaagagauugaagaacuuaagcgcaaccaggagcugcuccagucucaacugacggaaaaagacagcaugaucgagaauaugaaguccagccagaccucugggacaaacgaacaguccagcgcuauugucuccgcccgggauucugagcaaguggcggaacucaaacaggagcuggccacccuuaagagccagcucaauucccagucuguugagaucacaaagcuccaaaccgaaaaacaggagcugcugcagaagacggaggcuuuugccaaaagcguggagguccagggagaaaccgagacaauuaucgcuaccaagacaaccgacguggagggcagacuuuccgcccugcuccaagaaacgaaagagcugaagaacgaaaucaaagcgcucucugaggaacgcacagccauuaaggagcagcuggauagcuccaauagcaccaucgcuauucuucagacagagaaggacaaacuggaacucgagaucaccgauucuaagaaagaacaggacgaucugcugguucuucuggccgaccaagaucagaagauucucucccugaaaaacaagcucaaggaccuggggcacccuguggaggaggaagaugagcuugaaagcggcgaccaggaggacgaagaugacgagucugaggaucccggaaaagaccuggaucauaucuga

SEQ ID NO: 77668 - RNA, 2397 nt, Artificial Sequence
  derived and/or modified sequence opt5 from USP10__Homo_sapiens__NP_005144
auggcccugcacagcccccaguacaucuucggcgacuuuuccccugaugaguucaaccaauuuuucgugaccccgagaucuagcgucgaacuucccccuuauuccgggacaguucugugcggaacgcaggcuguggacaagcuccccgauggccaggaguaccagcggauugaauuugggguggacgaggucaucgaaccuucugauacccugccccgcacaccuagcuauuccauuucuagcacccucaauccgcaagcccccgaguucauccugggauguacagcguccaaaauuaccccugacggcaucacaaaggaggcuagcuacgggucuaucgauugccaguaucccggauccgcccuugcccuggacggcagcucuaacguggaagcugagguucucgaaaaugauggcguguccgggggacugggccagagagagcggaaaaagaaaaagaagcgcccucccggguacuauagcuaccugaaagacggaggcgaugacucuauuuccaccgaggcccucgucaacgggcaugcuaauagcgccgugccgaacuccguuucugcggaagaugccgaguuuaugggagacaugccucccagcgugacgccuagaaccuguaauagcccccagaacuccacagacucugucuccgauaucgugcccgacagcccuuucccgggcgcucugggcucugauacccggacagccgggcaacccgaaggaggcccuggggcugacuuuggacagagcugcuuccccgccgaggcgggccgcgauacccuuuccagaacggccggggcucagccuugugugggaacagacaccacagaaaaucugggcgucgccaacggccagauucucgagucuagcggggagggaaccgcuaccaauggcguugaacugcacacaacggaguccaucgaucuugaccccaccaagccggaaagcgccucuccucccgccgaugggacaggauccgcuagcggcacccugccugugucucaacccaaauccugggcgagccucuuucaugacuccaagccuucuagcuccucucccguggccuacgucgagacaaaauauagcccgccugcuauuagcccccugguguccgaaaagcagguugaggugaaggaggggcugguccccgugucugaagauccuguugccaucaaaauugccgagcuccuggaaaacgugacccuuauccacaagccggucucccugcagccccggggccucaucaauaaaggaaacuggugcuacauuaaugcuacgcugcaagcccuuguggcguguccucccauguaucaucugaugaaguucaucccucucuacagcaaaguccagcgccccugcacaucuaccccuaugauugacuccuuugugagacugaugaacgaguucaccaacaugcccguuccgccuaagccccggcaggcucugggcgacaaaaucgugcgcgauauuagaccuggggccgccuucgaacccacauauaucuaccggcuccugaccgucaauaagagcucucuuagcgagaagggacgccaggaggacgcugaagaguaucugggcuuuauccucaacgggcugcacgaagagaugcuuaaucugaaaaagcuccuguccccgagcaacgagaaacugacaauuucuaauggaccuaagaaccacuccgugaaugaagaggaacaagaggaacagggcgaggggagcgaggaugaaugggagcagguuggccccagaaacaaaacguccgugacccggcaggccgacuucguccaaacaccuaucaccggaauuuuuggcgggcauaucagaucugugguguaccagcagagcuccaaggaaucugcuacacuccagcccuucuuuacccugcaacuugauauucagagcgacaagauccgcacgguucaggaugcccuggagucccucgucgcgcgggaaucugugcagggauacaccacaaaaaccaagcaagagguggagaucagcagacgcgucacacuggaaaaacugcccccugugcuuguucuccaccugaagcgguucguguaugagaaaaccggcgggugucagaagcugauuaagaauaucgaauacccggucgaccucgagauuuccaaagaacugcuuagccccggagugaagaacaaaaauuuuaagugccauagaacguaucgccuguucgccguuguguaccaccacggcaacucugcuacagggggccauuauaccacagaugucuuucagaucggacucaauggcuggcugcggauugacgaucaaaccgugaaaguuaucaaccaguaccagguggucaagccuaccgccgagagaacagcuuaucugcuuuacuaccgccggguggaccuccuguga

SEQ ID NO: 77669 - RNA, 2892 nt, Artificial Sequence
  derived and/or modified sequence opt5 from USP11__Homo_sapiens__NP_004642
auggccguggcucccagacuguucggcgggcucugcuuucgguuccgcgaccagaaccccgaggucgccguugaaggaagacugccgaucagccacuccugugugggcugccggcgcgagagaaccgcgauggcuacaguggccgccaaucccgcugccgcugccgcggccgucgcugccgcugccgcggugacggaagaucgggagccucaacaugaagaacuucccgggcuggacucucaguggcgccagauugagaacggagaaagcggcagagagcggccucuccgcgccggggaauccugguuucugguugagaagcacugguacaaacagugggaggcuuaugugcaaggaggcgaucaggacucuagcaccuuccccggcuguaucaauaacgccacacuuuuucaggaugaaauuaauuggagacugaaggaggggcucgucgaaggagaggacuacgugcugcugccugcugccgccuggcauuaucucguuuccugguacggccuggaacacgggcagccgcccaucgagcggaaagugauugagcuuccuaacauccaaaaggucgaaguguaucccguggagcugcuccugguccgccauaaugaucuuggaaaaucucacaccguucaguucagccacacagacuccaucggccuggugcucagaaccgcucgggaacgcuuucugguggagccucaggaagauacaagacugugggcgaagaacagcgaggggucucucgaccggcuguacgauacccauauuacgguccuugacgccgcucuggagaccggacagcucaucauuauggaaacaagaaagaaagauggcaccuggcccuccgcccaacugcacgugaugaauaacaauaugagcgaggaagacgaggacuucaagggccagccggggaucugcggacuuacaaaccugggcaauaccuguuuuaugaacucugcccuccagugccuguccaauguuccucaacugacggaauauuuccucaacaacuguuaccuggaggagcuuaauuuucgcaacccccuggggaugaaaggagaaauugcugaggccuacgcggaucucgugaagcaggcuuggagcggccaucaccggucuaucgucccucacguguucaaaaauaagguugggcauuuugccucccaguuccugggauaucagcaacacgacagccaggaacuucuguccuuccuccuggauggccugcaugaggaccucaacagagugaagaaaaaggaguacgucgaacugugcgaugccgcuggccgccccgaccaggagguggcccaggaagccuggcaaaaucacaaacggagaaacgauucugucauuguggacacauuucaugggcuuuucaagagcacccugguuugucccgauugcggaaauguguccgucacauuugacccuuucuguuaucucagcgugccgcugcccaucucucacaaacgcguucuggagguguuuuucaucccuauggauccccggagaaagccugaacagcaccgccuugucgugcccaaaaagggcaagauuuccgaccucugcguggcucugagcaaacauaccgggaucucuccggagcggaugaugguugcggacgucuuuagccacagauucuacaagcuguaucagcucgaggaaccucuguccucuauucuugaucgcgacgauaucuuuguguacgaggugagcggacggauugaagccaucgagggcuccagagaagacaucgucgugcccguuuaucugcgggagcgcaccccugcuagagauuacaacaauagcuacuaugggcucaugcuguucggccauccccugcuugugucugucccucgggacagauuuacaugggagggacucuacaacgugcugauguaucgccugucccgguacguuacgaaacccaauagcgaugacgaagaugacggcgaugagaaggaagacgaugaggaagacaaagacgaugugccggggccuucuaccggaggcucccucagagaccccgagcccgagcaggccgggccuagcuccggagucacaaaccgcugcccguuccugcuugauaauugucugggcaccucucaauggcccccuagacggcgcagaaagcagcucuuuacacugcagaccgugaacagcaaugggacguccgaccggacaaccucucccgaagagguucacgcucagccuuauauugccaucgauugggaacccgagaugaagaaacgcuacuaugacgagguggaagcggagggcuacgucaagcacgauugcgugggauacgugaugaaaaaggccccugucagacugcaagaauguauugagcuuuucaccacaguugaaacccucgagaaagagaaccccugguauugcccgagcuguaagcagcaucagcuggcuacaaagaaacuggaccucuggaugcugccugaaauccuuauuauccaccugaagcgguucuccuacacgaaauuuagccgcgagaagcucgauacccugguggaguuccccaucagagaccuggauuuuucugaguucgugauucaaccucagaacgaauccaaucccgagcuuuauaaauacgaccucaucgccgucagcaaccauuauggcgggaugcgggauggacacuacacaaccuuugcuugcaauaaggacucuggccaguggcauuauuucgacgauaacuccgugagcccgguuaaugagaaccagauugaaucuaaggccgccuacgugcuguuuuaccaacgccaggacgucgcuagacggcugcucagcccugcgggguccagcggagcccccgcuucuccugccuguuccagcccucccuccucugaguucauggaugugaauuga

SEQ ID NO: 77670 - RNA, 1113 nt, Artificial Sequence
  derived and/or modified sequence opt5 from USP12__Homo_sapiens__NP_872294
auggagauccugaugaccgugagcaaguucgccuccauuugcacaaugggcgcuaacgccucugcgcucgaaaaagagaucgggcccgaacaguuuccugucaaugagcacuacuucggacugguuaacuuuggcaauacguguuauugcaacagcgugcuucaagcucuguacuucuguagaccguuucgggaaaaggugcucgccuauaaaucccagccccgcaagaaagagucucugcuuaccugccuggccgaccucuuccauagcauugcuacacagaagaagaaagucggggugaucccucccaagaaauuuauuaccagacugcggaaggagaaugaacuguucgauaacuacaugcagcaagacgcccacgaguuucucaauuaucugcuuaacacaaucgcugauauccugcaggaggaacgcaaacaggagaagcagaauggaagacucccuaacggcaauauugacaacgaaaauaacaauuccacccccgauccuacauggguucaugagaucuuccaagggacccugacgaacgaaacccggugucuuacaugcgagaccauuucuagcaaggacgaagauuuucuggaccucuccguggaugucgagcagaacacaagcaucacccacugucugcgcggauucucuaauacggagacacugugcuccgaauacaaauauuacugugaggaaugcagaagcaagcaggaggcccauaaacggaugaaggugaaaaagcucccgaugauucuggcgcuucaccugaaacgcuuuaaguacauggaccagcuccacagauauaccaagcugucuuaccggguuguguucccccuugaacugcgccucuucaacacauccggcgaugccaccaauccugacagaauguaugaucuggucgcuguggugguccauuguggcagcgggcccaaccggggacacuacaucgccauuguuaaaucucaugacuuuuggcuccuguucgacgaugacaucguggagaagaucgaugcucaagccauugaggaauuuuauggccugaccuccgacaucagcaaaaauuccgagucuggguacauucuuuucuaucagagccgcgauuga

SEQ ID NO: 77671 - RNA, 2592 nt, Artificial Sequence
  derived and/or modified sequence opt5 from USP13__Homo_sapiens__NP_003931
augcagagacggggcgcccuguucgggaugcccggaggcagcgggggacgcaagauggcugccggcgacaucggggagcuccuggugccucacaugccgaccauuagagucccccgguccggagaucgcguuuacaaaaacgaaugcgcguuuucuuaugacagcccuaauuccgagggcggccuuuacguguguaugaacacauuccuggcuuuugggagagaacauguggagcggcacuuccgcaagacgggacaaucugucuauaugcaucucaaaagacacgugcgggaaaagguucgcggcgccagcgggggagcccugcccaaaagacgcaauuccaagaucuuucuugaucuggacaccgaugacgaucucaacucugacgauuacgaguaugaggacgaagcuaagcuggugauuuucccugaucauuacgagaucgcccugcccaauauugaagaacucccugcucuggucacaaucgccugcgacgcggugcuuagcuccaaaagcccguaucggaagcaggaucccgacaccugggagaacgaacugccuguuucuaaauacgccaauaaccucacacagcuggacaauggcgugagaaucccucccuccggguggaagugugcucggugcgaucuucgcgagaaccuguggcucaaucugaccgacggaagcguccuguguggcaaaugguuuuucgauucuuccggcgggaacggacacgcccucgaacacuacagagacaugggcuauccccuggcugugaaacuugggacaauuaccccggauggagccgacguguacagcuuucaggaggaggagccuguccuggauccccaucucgcgaagcaccuggcccauuucggcaucgacaugcuucacaugcacgggacggagaauggacugcaagauaacgacauuaaacuccggguuucugaaugggaggugauccaggaauccggcaccaagcugaaaccuauguauggccccggguacacaggacugaagaaucucggcaacagcugcuaucuguccucugugaugcaggcuauuuuuagcauccccgaguuccagagagccuacgucgggaaccuuccucgcauuuuugauuauuccccgcuggaccccacccaagacuucaauacacagaugaccaaacucggacauggccugcuuagcgggcaguacucuaagccucccgugaaauccgaacugaucgagcagguuaugaaggaggaacacaagccucaacagaacggcaucagcccccggauguucaaggcuuuugugucuaagagccauccggaguucuccucuaauagacagcaagaugcccaggaauuuuuccuccaccuggucaaccugguggagcgcaaucggauuggaagcgaaaacccuuccgacguuuuuagauuccucguggaggagcgcauccaguguugccagacgcggaaagucagauacacagaacgcguggauuaucugaugcaacuucccgucgccauggaggcugcgaccaauaaggacgaacugauugccuacgagcucacacggagagaggcugaagccaaccgccggccucugcccgagcuggugagagccaaaaucccuuuuagcgcuugucuucaggccuucucugaacccgagaauguugaugacuuuugguccagcgcgcuccaggcuaagucugccggcgugaagaccucccgguucgccagcuuuccggaauaucuggucgugcagauuaaaaaguucaccuuugggcuggauuggguuccuaaaaaguucgacguguccaucgauaugcccgaccuccuggauaucaaccaucuucgcgcuagaggacugcaacccggcgaggaggaacucccugacauuucuccgcccaucgucauuccugaugacagcaaagaccggcugaugaaucagcugaucgaucccuccgacauugaugagucuagcgugaugcagcuugccgaaaugggguucccucucgaggcuugcagaaaggccguguacuuuacaggaaacaugggcgcggaaguugccuucaauuggaucaucguccacauggaggagcccgacuuugcugaaccucugacgaugcccggguauggcggagccgcuuccgccggcgcgagcguguucggggccucuggacuggauaaccagccgccugaggaaauuguggcuaucauuaccuccaugggcuuucaacgcaaucaggccauccaggcucuccgggccacaaacaacaaucuggagagagcccuugacuggauuuucagccaccccgaauuugaggaggauucugacuucgucaucgaaauggagaacaaugcuaacgcgaauauuaucuccgaagccaagccugaggggccccgcgugaaagauggaagcggcaccuacgagcuguuugcuuucaucucucauauggggacaagcaccauguccggccacuauauuugucauaucaagaaagaaggaagauggguuauuuacaacgaccacaaggugugcgccagcgagcggccgccuaaagaucucggcuacauguauuuuuaccgcagaauccccucuuga

SEQ ID NO: 77672 - RNA, 1380 nt, Artificial Sequence
  derived and/or modified sequence opt5 from USP14__Homo_sapiens__NP_001032411
augccccuguacagcgugaccgucaaguggggcaaagagaaguucgaagggguugagcucaacacagacgaaccuccgaugguguuuaaagcccagcuguucgcucuuacgggagugcaacccgccagacagaaggucauggugaaaggcgggacccugaaggaugacgauuggggaaauaucaagauuaaaaacauggagcucccuugcggccugacaaaucuugggaacaccuguuauaugaaugcgacaguucagugcauccgguccgugcccgaacugaaggacgcucucaaacgcuacgccggagcccugagagcuucuggcgagauggccagcgcucaguauauuaccgccgcgcugcgggaucucuuugacuccauggauaagacaucuagcuccaucccucccauuauccugcuucaauuccugcacauggccuuuccucaguucgcugagaaaggcgaacaggggcaguaccuccaacaggacgccaacgaguguuggauccagaugaugcgcguccugcagcaaaaacuugaagcuauugaggaugacucugugaaggagaccgauagcuccagcgccucugcggccacgccguccaagaagaaaagccugaucgaccaguuuuucggaguugaauuugagaccacaaugaagugcaccgaaucugaggaagaggaggugacaaaaggcaaggaaaaucagcuccaacuguccuguuucauuaaccaggaggucaaauaucuguuuaccgggcucaagcugagacuucaggaagagaucacgaagcagagccccacacugcaacggaaugcucucuacauuaaaucuuccaagaucagccgccugccugccuaucuuaccauucagauggugagauucuuuuacaaagaaaaggaguccgugaacgcuaaaguccugaaggauguuaaguucccccucaugcuggacauguacgagcugugcacaccugaacuccaggagaaaauggugucuuuccggagcaaguuuaaagaccuggaagauaagaaagugaaucagcaacccaacaccuccgacaaaaagagcucuccgcagaaggaggucaaguaugaaccuuucuccuuugccgaugacaucggaagcaauaacuguggcuacuaugaucuucaggccgugcugacccaucaggggcgcucuagcuccucuggacacuacguuagcugggugaaaagaaagcaagacgaguggaucaaauucgaugacgauaaggucuccauugugacacccgaggacauccuccggcugagcggcggcggggauuggcauauugcuuauguucuucuguacggaccucgcagaguggaaaucauggaggaagagucugagcaguga

SEQ ID NO: 77673 - RNA, 2946 nt, Artificial Sequence
  derived and/or modified sequence opt5 from USP15__Homo_sapiens__NP_001239007
auggccgagggcggggcugccgaccuggauacccagagaagcgacaucgcgacacuccugaagacgucccuucggaaaggagauaccugguaccugguggacucucgcugguucaagcaauggaaaaaguaugucggcuuugauagcugggacaaauaccagaugggggaucagaacguuuaucccggaccuauugacaauuccggccuccugaaggauggggacgcucagucucuuaaggaacaccugaucgaugagcucgacuacauucugcugccgacagaaggauggaacaaacucgugagcugguauacccugauggagggccaagaacccaucgccagaaagguggucgagcagggcauguucgugaaacauugcaagguugagguguaccuuacagaacugaaacucugugagaaugggaacaugaauaacgucgugacccggcgcuuuuccaaggccgauacaauugacaccaucgaaaaggagaucagaaaaauuuucucuaucccugacgagaaggaaacgcggcuguggaauaaauauaugagcaacaccuuugagccccuuaauaagccugauuccacaauucaggacgcuggacuguaccagggccaaguucucgugaucgaacagaaaaacgaggaugggaccuggccccgcggaccuagcacaccgaagucucccggcgccuccaauuucagcacccugccuaaaauuucucccuccagccugucuaacaauuacaacaauaugaacaacagaaaugucaagaacuccaauuauugccucccuagcuacacggcuuauaagaacuacgacuauuccgaacccgggcggaauaacgagcagccgggacuguguggccuuucuaaucugggcaacacaugcuuuaugaauagcgccauccagugucucuccaacaccccuccccugacagaguacuuccuuaaugauaaauaucaagaagaacugaacuuugacaauccucucgggaugcgcggagaaauugccaagagcuacgccgagcugaucaaacagauguggucuggcaaguucuccuacgugacccccagagcuuuuaaaacccagguggggcgguucgcgccccaauuuagcggauaucagcagcaggauugccaagaacugcucgcuuuccugcuugacggccugcacgaggaucucaaccgcaucagaaagaagccuuacauucagcugaaagacgccgaugggcggccggacaaggucguugcggaggaagccugggagaaucaucuuaaacgcaacgacucuaucauuguggauaucuuccacggacuguuuaagagcacacucgugugucccgaaugcgcuaaaauuuccgucacguucgacccuuuuuguuaucugacccugccccucccuaugaagaaggagagaacacuggaaguguaccuuguucggauggauccccugaccaaaccgaugcaguauaagguggucgugccuaaaaucggcaacauccucgaccugugcacagcccugucugcucuuagcggcauucccgccgauaagaugaucguuaccgacauuuacaaucauagauuccaccgcaucuuugccauggaugagaaccucuccagcauuauggagcgggacgauaucuauguguucgaaaucaauauuaacagaacggaggacacagaacacgucaucauuccugugugucugcgcgagaaauuucggcauucuuccuacacccaccauaccgggagcucucuguucggacagcccuuucucauggcugucccuagaaauaacacagaggauaagcuguacaaucuucugcuccugcgcaugugccgguaugugaagaucuccaccgaaacagaggaaacggagggcagccugcacugcuguaaagaccaaaacauuaaugggaacggacccaauggcauccacgaagagggguccccgucugagauggaaaccgaugagccugacgacgaaagcucccaggaucaggagcuucccucugaaaacgagaauagccaguccgaggacagcguuggcggagauaacgacucugaaaauggccucugcacagaggauaccuguaaggggcaacugacaggacauaaaaagagacuguucaccuuucaguucaacaaccucggcaauacggacauuaacuacaucaaagaugacacccgccacauccgguuugaugacagacagcugcgccuugaugaacgguccuuccuggcgcucgacugggaucccgaccugaagaaaagauauuucgacgagaaugccgcugaagauuuugagaagcaugagagcguggaauacaagccuccgaaaaagcccuucgucaaacugaaggacugcauugagcuuuuuacaaccaaagaaaagcucggggccgaggauccuugguauugucccaacugcaaggagcaccagcaagccaccaaaaagcuggaccuguggucucucccucccgugcugguugugcaucuuaaacgguucuccuacagccgcuauaugagagauaagcuggacacacucgucgauuuuccuaucaaugaccuggauaugucugaguuccugauuaaccccaaugcuggaccgugucgguacaaccuuaucgccgugagcaaucacuacggcgggaugggcggaggccacuauacggcguuugcuaaaaacaaggacgaugggaagugguacuauuucgacgacuccagcgugucuacagccuccgaggaucagauuguuagcaaagccgcuuacguccucuuuuaucagagacaagacaccuucuccggaacaggcuuuuucccucuggaucgcgaaaccaagggggccucugcugccaccggaaucccccuggagagcgacgaagauuccaaugacaacgauaaugacaucgagaacgagaauugcaugcauacaaacuga

SEQ ID NO: 77674 - RNA, 1593 nt, Artificial Sequence
  derived and/or modified sequence opt5 from USP17L2__Homo_sapiens__NP_958804
auggaggacgauagccuguaccucggcggggaauggcaguucaaccacuuuuccaagcugaccucuagcagacccgacgccgcuuucgccgagauccaacggacaucccuuccugaaaaaucuccgcugagcuccgaggcgcgcguggaucucugcgacgaucuggcucccgucgccagacagcuugccccucggaagaaacugccccucucuagccgcagaccugcugccguuggagcuggccugcagaauauggggaacacguguuaugaaaaugccucccugcagugccucaccuacacacccccucuggcgaacuauaugcuuagccgggagcauucucaaaccugucagcgcccgaagugcuguaugcugugcacaaugcaggcccacauuaccugggcucuccauucccccggacacgugauccagccuagccaagcccuggcugccggcuuucauagagggaaacaggaggacgcgcacgaguuccuuauguuuacaguggaugccaugaagaaggcuugucugcccggacacaaacaggucgaccaucacucuaaggauaccacgcucauucaucagaucuucggcggcugcuggcggucccaaauuaaaugucugcacugccacgggaucagcgacaccuuugauccuuaccuggacaucgcccucgauauucaggcugcccagucugugaagcaagcccuggagcagcuuguuaaacccgaagaacugaauggagagaacgcuuaucauuguggccucugccugcagcgcgcgccggccuccaagacacuuacccugcacacaagcgcuaaggugcucauccugguccugaaaagauucuccgacgugaccgggaauaagcucgccaaaaacguucaguacccugaaugccuggacaugcaacccuauaugucucagcagaauacgggaccucuuguguacguccuguacgccgugcucgugcaugcuggcuggagcugucacgaugggcauuauuuuuccuacgucaaggcccaggagggacaaugguauaaaauggacgaugcgaagguuacagcuugcagcauuaccucugugcugucccagcaggccuacgugcuuuucuauauccagaaaagcgaaugggagcggcacucugaaagcgucucccgcggcagagagccccgggcccugggcgcugaggacacagaucgcagagccacccaaggggaacucaagcgggaccaccccugucugcaggcuccugagcuggaugaaagacucguggagcgcgccacccaggaaucuacacuggaccauuggaaguuuccgcaggagcaaaacaaaacgaagcccgaguucaauguucggaaaguggaaggaacccuuccucccaacguccuggugauucaccagagcaaguacaaaugcggcaugaagaaucaucacccugagcagcaauccagccuccugaaccugucuuccacaaccagaacagaucaggaaagcguuaauaccgggacgcuugcgucucuccagggacgcacacggagauccaagggcaaaaacaagcacagcaaacgcgcccugcuggugugucaguga

SEQ ID NO: 77675 - RNA, 1593 nt, Artificial Sequence
  derived and/or modified sequence opt5 from USP17L30__Homo_sapiens__NP_001243796
auggaggacgauagccuguaccucagaggcgaauggcaguucaaccacuuuuccaagcugaccucuagccggcccgacgccgcuuucgccgagauccaacgcacaucccuuccugaaaaaucuccgcugagcugcgagacgagaguggaucucugugacgaucuggcgcccgucgcucggcagcuugccccucgcgaaaagcugccccucuccucuagacggccugccgcuguuggggccggacugcagaauaugggcaauaccugcuaugugaacgcuagccugcagugucucacauacacacccccucuggccaacuauaugcuuucccgcgagcauagccaaaccugccacagacauaaaggguguaugcugugcaccaugcaggcgcacauuacacgggcccuccauaauccgggacacgugauccagcccucucaggcucuggccgcuggcuuucaccgcgggaagcaagaggacgcccaugaguuccuuauguuuaccgucgaugcgaugaaaaaggccugucugccuggacacaaacagguggaccaucacuccaaggauacgacccucauucaccagaucuucggcggcuacuggagaagccagauuaagugccugcauugucacgggaucucugacacauuugaucccuaucuggacaucgcucucgauauucaagccgcucaguccguucagcaagcccuggagcagcuugugaaaccugaagaacugaacggagagaaugccuaccauugcggcgucugucuccagcgggcucccgcgagcaagacccugacacuucacaccucugccaaagugcugauccucguucugaagcgcuucuccgacgugacggggaacaagauugcuaaaaauguccaguauccggaaugccuggacaugcaaccuuacaugagccagcccaacacaggaccucucguguacgugcuguaugccguccuuguucaugccggcugguccugccacaaugggcacuacuuuucuuaugugaaggcucaggagggacagugguacaaaauggaugacgccgaagugaccgcgagcuccaucacaagcguccugucucaacaggcuuauguucucuucuacauucagaaguccgagugggaaagacauagcgagucugugagccggggccgcgagcccagagcccugggcgccgaagauaccgaccggagagcuacccagggggagcuuaaacgcgaucaccccugucugcaagccccugaacucgacgagcaucugguggaacgggcuacacaggaguccacgcuggaucacuggaaguuucuccaggagcagaacaaaaccaagccggaguucaaugucagaaagguggaaggaacacugcccccugacguucuugugauccaccaaucuaaauauaagugcggcaugaaaaaccaucaccccgaacagcagagcucccugcucaaucugucuagcuccaccccuacacaucaagagagcaugaacaccgggacgcuggccucucuucgcggacgggcgagacgcuccaagggcaaaaacaagcacagcaagcgggcccuccuggucugucaguga

SEQ ID NO: 77676 - RNA, 1119 nt, Artificial Sequence
  derived and/or modified sequence opt5 from USP18__Homo_sapiens__NP_059110
augagcaaggccuucggccugcucagacagaucugccaauccauucuggcugagucuagccagucccccgccgaccuugaagagaaaaaggaagaggauucuaacaugaaacgggaacagccucgcgagagaccgcgggcgugggacuacccccacgggcuggugggacuccauaauaucggccagaccuguugccugaacagccuuauucaagucuuuguuaugaauguggauuucacacgcauccugaagagaauuacggugccucggggagcugacgagcagcgcagauccguccccuuucagaugcuccugcugcucgagaaaaugcaggauucucggcaaaaggccgugcgcccucuggaacuugccuauugucugcagaagugcaacguuccccucuucgugcagcacgacgcugcccagcuguaccuuaaacuguggaaucucaucaaggaucaaaucaccgacguccaucugguggaaagacugcaggcucucuauacaauucggguuaaagauagccugaucuguguggacugcgccauggaguccagccgcaacucuuccaugcuuacccugccucucagccuguuugaugucgacucuaagccgcuuaaaacacuggaggaugcgcuccacuguuucuuucagcccagagaacuguccagcaagucuaagugcuucugugagaauugcgggaaaaagacccggggcaaacaagugcugaagcucacacaucugccucagacccuuacgauucaccugaugcgcuuuuccaucagaaacagccagacccggaaaauuugucacucccucuacuucccccagucucuggacuuuagccaaauccuuccuaugaagagagaauccugcgacgccgaggaacagagcgggggacaguaugagcuguucgcugugauugcccaugucggcauggcugauucuggccacuacugcguuuauauccgcaaugccguggacgggaaaugguuuuguuucaacgauuccaauaucugccucgugagcugggaggacauucaguguacauacggaaaccccaauuaccauuggcaagaaaccgcguaucugcuggucuacaugaagauggagugcuga

SEQ ID NO: 77677 - RNA, 2745 nt, Artificial Sequence
  derived and/or modified sequence opt5 from USP20__Homo_sapiens__XP_005251722
augggcgacagcagagaucugugcccccaccucgacuccaucggggaggugaccaaggaagaucugcuucugaaaucuaagggaacaugucagagcugcggcgucacggggccuaaccucugggccugucugcaaguugcuugcccguacgugggauguggcgaguccuucgccgaccauucuaccauucacgcgcaggcuaaaaagcauaaucuuacagugaaccugaccacauuucggcucuggugcuaugccugugaaaaagaggucuuccuggaacagcgccuggccgcuccccuccuggggagcuccucuaaguuuagcgagcaggauuccccucccccuagccacccccuuaaggccgugccuaucgcuguugccgacgagggagaaucugaguccgaagaugacgaucugaaaccgagaggccucaccggcaugaagaaucuggggaacagcugcuacaugaaugcggcccuucaagcucugucuaacugucccccucucacacaguucuuucuggagugcggaggccuggugcggaccgacaaaaagcccgcccucuguaaauccuaucagaagcuggucagcgagguguggcauaagaaacgcccuucuuacguugugcccacgucccuuagccacgggauuaagcuggucaauccgauguucagaggauaugcucagcaagauacccaggaauuucuccggugccugauggaccagcuucacgaggaacugaaagagccugugguggccacagucgcgcucaccgaagcccgcgauuccgacucuagcgacacagaugagaagagagagggcgaccggucccccagcgaagaugaguuccugucuugcgacuccagcucugaucgcggggaaggagacggccagggcagagggggaggcagcucccaagcugagaccgaacugcucaucccugaugaggccgggcgggcuauuucugagaaagaacgcaugaaggacagaaaauuuagcuggggacagcagcggacgaacuccgagcaaguugaugaagacgccgauguggacacagccauggcugcgcuggacgaucagcccgccgaggcucagcccccuagcccgagaucuuccagccccugucgcaccccugaacccgacaaugaugcccaucuucggucuuccagcagaccuugcucccccgugcaccaucacgagggccacgccaagcugucuagcuccccgccucgcgcuucucccguccggauggccccuagcuacgugcucaagaaagcgcagguucuguccgcugggagcagacgccggaaggagcaaagauaucgcucugugaucuccgacaucuucgauggaagcauucuuucucugguccagugucucacaugcgaccggguguccaccaccguugaaacauuucaggaucugagccugcccaucccuggcaaagaggaccucgccaagcugcauucugccauuuaccagaacgugcccgcuaaaccgggcgccuguggggauagcuacgcugcccaaggauggcuugcguucaucgucgaauauauuagacgcuuuguggucuccugcacgccuagcugguucuggggccccgugguuacccuggaggacugucucgccgcuuucuuugccgcugaugagcugaagggggacaauauguacucuugcgaacgguguaagaaacugagaaacggagugaaguauugcaaaguccuucgccuccccgagauccuguguauucaccugaagcgguucagacaugaagugauguacuccuuuaaaaucaauagccacguuuccuucccucucgagggccuggaucuucggccguuucuggccaaggaaugcacaucucagaucaccacauaugaccuccugagcgugauuugccaucacgggaccgcgggcuccggacacuacaucgccuauugucagaacgucauuaauggccagugguacgaguucgacgaucaauacgugacggaggugcaugaaacaguuguccagaacgcugagggguaugugcuguuuuaccgcaagucuagcgaagaggccaugagagaacggcaacagguggucucccuugcugccaugagagagcccucucuccugcgcuucuaugugagccgggaguggcugaacaaauuuaauaccuucgccgaaccuggacccaucaccaaccaaacauuucucugcucccacggcgggauuccuccccauaaguaccacuauaucgacgaucugguugugauccuuccucagaaugucugggagcaccuguacaacagauucggaggcgggcccgcugugaaucaucucuauguuuguagcauuugccagguggaaaucgaggcgcuggccaaacgcagacggauugaaaucgacaccuuuauuaagcugaacaaggcuuuccaagccgaggagucuccgggcgucaucuacuguaucuccaugcagugguuccgcgaaugggaggccuuugugaaaggaaaggauaaugaaccucccggcccuauugacaacagcagaaucgcucagguuaaagggucuggacacgugcagcuuaagcaaggcgccgauuacgggcagauuuccgaggagacauggacguaucucaauagccuguacggaggcgggcccgaaaucgcgauucggcagucugucgcucagccgcugggcccugagaaccuccauggagaacagaaaaucgaggccgaaacccgcgccguguga

SEQ ID NO: 77678 - RNA, 1578 nt, Artificial Sequence
  derived and/or modified sequence opt5 from USP22__Homo_sapiens__NP_056091
auggugagcagacccgagccugaaggcgaggccauggacgcugaacuggccgucgcgccgcccgggugcucccaccucggaucuuucaagguugauaacuggaaacagaaucugcgggcuaucuaccaauguuuuguguggagcggcaccgccgaggcccgcaagagaaaagcuaaguccugcauuugucaugugugcgggguccaccuuaaccggcugcauucuugucucuauugcguguucuuuggauguuucacgaaaaagcacauccaugaacacgccaaggcuaaacgccacaaucuggccauugaccuuauguacggcgggaucuauugcuuucugugucaggauuacauuuaugacaaggauauggagaucaucgcgaaagaggaacagagaaaggccuggaaaaugcagggaguuggcgagaaguucagcacgugggaaccuaccaagcgggagcucgagcugcugaaacauaaccccaagcgcagaaaaauuacauccaauugcaccaucggccuccgggggcugauuaaccuuggaaauacauguuuuaugaacugcaucgugcaagcucugacccacacaccucuccugcgcgacuucuuucuuucugauagacaucggugcgaaaugcagagccccuccagcugucuggucugcgagaugucuucccucuuccaggaauuuuacagcggccaccgcucuccucacauuccguauaagcugcugcaucucguguggacccacgccagacaucuggcuggguacgagcagcaagacgcccacgaguuccuuaucgcggcccuggauguucuccaucggcacuguaaaggagacgauaauggcaagaaagcuaacaaucccaaccacugcaauuguauuaucgaccagaucuuuacagggggacugcaguccgaugugaccugccaggucugucauggcgugagcacaaccauugacccuuucugggacaucucucuugaucugcccggcuccagcacaccuuucuggccccucuccccggggucugaaggaaacguggucaauggcgagagccacguuuccgggaccacgacacugaccgacugccugcgcagauuuacacggccugaacaucucggaagcucugccaagauuaaguguuccggcugccacagcuaccaagagucuaccaaacagcugaccaugaagaaacuucccaucguggcuuguuuccaccugaagagauuugaacauagcgccaaacuccgccggaagauuacaacguauguguccuucccucuggagcuugauaugacccccuuuauggccucuagcaaggaauccagaaugaacgggcaguaccaacagcccacagacagccugaacaaugauaacaaauauucucucuucgcugucgugaaucaccagggaacccuggaguccggccauuacaccagcuuuauccgccagcacaaggaccaaugguucaaaugcgaugacgcgaucauuacaaaggccucuaucaaagauguucuggacuccgagggcuaucuccuguuuuaccauaagcaguuccuugaauaugaguga

SEQ ID NO: 77679 - RNA, 3378 nt, Artificial Sequence
  derived and/or modified sequence opt5 from USP25__Homo_sapiens__NP_001269970
augaccguggagcagaacguccugcaacagagcgccgcucagaagcaccagcaaacauuccucaaucagcugagagaaaucacgggcauuaacgacacccagauccuucagcaagcccugaaagauuccaaugggaaccucgagcuggcgguugcuuuucuuacagccaagaaugccaaaacaccccagcaggaagagaccaccuacuaucagacagcucugccuggaaacgaccgguacauuucugugggcagccaagccgauaccaaugugaucgaccucacgggggaugacaaggaugaccugcagcgcgcuauugcccugucccucgcggaaucuaacagagccuuccgggagaccggaaucacagaugaggaacaggcuaucagccgcguccuggaggccuccauugcugaaaauaaagccugccuuaagagaaccccgacagagguguggcgggacucucgcaaccccuaugauagaaagcggcaagacaaagcgccuguuggccugaagaauguggggaacaccuguugguuuagcgccgucauccagucccucuucaaucugcuugaguuucgcagacuggugcucaacuacaaacccccuagcaaugcucaggaucugccccggaaccagaaggaacaucgcaaccugccuuucaugagagagcuccgguaucuguuugcccuucugguuggaacgaaacgcaaguacguggacccgucuagagcugucgaaauucucaaggacgccuucaaauccaaugauagccaacagcaggacgugucugaguuuacacacaagcugcuugauuggcuggaagacgccuuccagaugaaagcugaggaggaaaccgaugaggaaaagcccaaaaacccuaugguggagcucuuuuauggccgguuccuggcggucggcguucuggaagggaagaaauuugagaauacagagauguucggacaauacccccuccaggugaacggcuucaaggaccugcaugaaugccuugaggccgcuaugaucgaaggggagauugaaucccugcacagcgaaaauucuggaaaguccggccaggagcauugguuuaccgaacucccucccgugcugaccuucgagcuuagcagauuugaguucaaccaggcccuggggcgcccggagaaaauccacaauaagcucgaguuuccucaaguccuguaccuggaucgguauaugcacagaaaccgcgaaauuacacggaucaaaagagaggaaaucaagcgccucaaagacuaccugacggugcuucagcagcggcuggagagauaucucuccuacggaucuggccccaagcgcuucccucugguugaugugcugcaguaugcccuugaauuugcuagcuccaagcccgucuguaccagccccguggacgauauugacgccucuuccccuccgagcggcucuauccccagccaaacacucccuuccaccacagagcagcagggggcgcugucuagcgagcugcccuccaccagcccuucuuccguugcugccauuagcucucgguccgugauccauaaacccuucacgcaaagccgcauuccgccugaccuccccaugcacccugcccccagacauaucacagaagaggaacuguccguccuugagucuugccugcaccgguggagaaccgaaaucgagaaugauacccgggaccuccaggagagcauuucccgcauccacagaacaauugaacugauguacucugauaagagcaugauccaggugccuuaucggcugcaugcuguccuugugcacgagggacaggccaacgcuggccauuacugggccuacauuuuugaccacagagaaucccgcuggaugaaauauaaugauaucgcgguuaccaagagcucuugggaggaacucgugcgggacuccuucgggggauacagaaacgccagcgcuuauugucugauguacaucaaugauaaagcccaauuucugauucaggaggaguucaacaaggaaacaggccagccccucgucgggaucgagacgcugccgccugaccuucgcgauuuuguggaagaggacaaucagagauucgagaaggaacuggaggaaugggaugcucaacucgcccagaaagcgcugcaggagaagcugcuugccucucagaaacuccgggaauccgagaccagcguuacaaccgcucaagccgcuggagaccccgaguaucuggaacagcccucucgcagcgauuucuccaagcaucugaaagaggaaacaauucagaucauuaccaaggccagccacgagcacgaagacaagucuccugagacggugcuccaauccaaaccggagaacaccacaagccagccccuguccaaccagagagucguggaaguggccaucccucauguuggcaaguuuaugauugagucuaaagaaggcggguacgacgaugagaucaugaugacccccaauaugcagggaaucauuauggcuaucggcaagagccgguccgucuaugaccgcugcgggccugaagcgggauucuuuaaagccauuaaacuugaguacgcuagacuggugaagcucgcccaagaggauacacccccugaaaccgacuaccggcugcaccauguggucguguauuucauccagaaccaggcccccaagaagauuaucgagaaaacgcugcuugaacaguuuggcgaucgcaaucucucuuucgacgagagaugucacaacaucaugaagguugcucaagccaaacuggagaugauuaagccggaagaggugaaucuggaagaguacgaagaguggcaccaggauuaucggaaauuucgcgagacaaccauguaccucaucauugggcuggaaaacuuccagagagagagcuauaucgacucccuucuguuucucauuugcgcguaccagaauaacaaggaacugcugucuaagggccuuuaucggggacaugaugaggaacugaucagccacuacagacgcgagugucuccugaaacucaaugagcaagcugccgaacuguucgaguccggcgaagaccgggaggucaacaaugggcuuaucauuaugaacgaauuuaucgugccuuuccugccccuccugcugguugaugagauggaggaaaaggacauucuugccguggaggauaugagaaaucgcuggugcagcuaccugggacaggaaauggagccucaucuccaggagaaacugacagacuuucuccccaagcugcuugacuguucuauggaaaucaaauccuuccacgagccgccuaagcugcccagcuauucuacccaugaacucugcgagcgguucgcuagaauuaugcugucccugagccgcaccccugccgauggccgguga

SEQ ID NO: 77680 - RNA, 2742 nt, Artificial Sequence
  derived and/or modified sequence opt5 from USP26__Homo_sapiens__NP_114113
auggccgcucuguuccucagaggcuuugugcagaucgggaacugcaagaccggaauuagcaaauccaaggaggccuucaucgaagcggucgagcggaaaaagaaagaccgccugguucuuuacuuuaagucuggcaaguauagcacauucagacuguccgauaauauucaaaacguggugcucaaaucuuaccgggggaaucagaaccaucugcaccuuacgcugcagaauaacaauggacucuuuaucgaaggccugagcuccaccgacgcugagcagcugaagauuuuccucgaucgcguccaccaaaacgaagugcagcccccuguuagaccggggaaaggaggcucuguguuuagcuccacaacccagaaggagaucaauaaaaccagcuuccauaaggucgacgagaagucuuccagcaaaucuuuugaaaucgccaagggcuccgggacaggagugcugcagcggaugccccuucugacaagcaaacucacccugacguguggcgagcuuucugaaaaccaacacaagaaacgcaagagaaugcuguccagcuccucugagaugaaugaggaguuccucaaagagaacaauagcguugaauauaagaaguccaaagccgauugcagccggugugugucuuacaaccgcgagaagcagcugaaacugaaggaacucgaggagaauaaaaagcuggaaugcgaguccagcuguauuaugaacgcuaccgggaacccuuaucuugacgauaucggacugcuccaggcccugacagaaaagaugguccuuguguuucugcuccagcaaggcuacucugacggguauaccaaaugggauaagcugaaacuguucuuugaacucuuccccgaaaagauuugccauggacugccuaaucuuggcaacacauguuacaugaaugcugugcugcagagccuccuguccauccccucuuucgccgacgaucuucugaaccagagcuuuccuuggggcaaaauuccgcucaaugcgcugaccaugugccuggccagacuccuguucuuuaaggacacguacaacaucgagauuaaggagaugcuucugcucaaucugaaaaaggcuaucuccgccgcugccgaaaucuuccacgggaacgcgcaaaaugaugcccacgaguuucuggcucauugucuugaccagcucaaagacaacauggaaaagcugaauacaauuuggaaacccaagagcgaguucggagaagauaacuuuccuaagcaggucuucgccgacgaucccgacaccucuggcuuuuccugcccuguuaucacaaauuucgagcuggagcuccugcacagcauugcuuguaaagccugcggacaggugauccuuaagaccgaacugaacaauuaucucucuauuaaccugccccaacggaucaaagcccauccguccagcauccaguccaccuuugaucuguucuuuggagcugaggaacuugaguacaagugcgcgaaaugugagcacaagacaucugugggcguccacagcuucucccgccucccucgcauucugaucgugcaucugaaacgguauucucucaacgaguucugcgcccugaagaagaaugaccaggaaguuauuaucagcaaauaccuuaagguguccagccacuguaacgaagggacgagacccccucugccccucucugaggauggagaaauuaccgacuuucagcugcugaaagucaucagaaagaugacauccggcaauaucagcgugucuuggcccgcuaccaaagaguccaaggauauucuugccccucauaucggcagcgacaaggagucugaacagaaaaaggggcagacaguuuucaaaggagccagccggagacagcagcaaaaguaucucggcaaaaacuccaagccgaaugagcuggaaagcguguacucuggggaucgcgcuuuuauugagaaggaaccccuggcccaccucaugaccuaucuggaggacacgucccuuugccaguuccauaaagcgggaggcaagccugcuagcucccccgggacaccucugucuaaagucgacuuucagaccgugcccgagaacccgaagcggaaaaaguacgucaagaccagcaaauucguggccuuugauagaaucauuaauccuacaaaggaccucuacgaagauaaaaacauccgcauucccgagcgguuccagaagguuuccgaacaaacccagcagugugacggcaugagaaucugcgagcaagccccucagcaggcucugccccagucuuuuccuaaacccggaacacaaggccacacgaagaaucugcuucgcccgaccaaacucaaccugcaaaagagcaaucggaacucccugcucgcccuggggucuaauaagaacccuagaaauaaagauauccuugacaagauuaaaagcaaggcuaaagaaacaaagcgcaacgaugacaagggagaucacaccuaucggcugaucuccguggucagccaucucggcaaaacacugaagucugggcacuacauuugugacgccuaugauuucgagaaacagaucugguuuaccuacgacgauaugagagugcuggggauucaggaggcgcaaaugcaggaagaccgccggugcacgggcuauaucuucuuuuacaugcauaacgagaucuucgaagagaugcuuaagagagaggaaaaugcccagcugaacuccaaagagguugaagagacccuccagaaggaauga

SEQ ID NO: 77681 - RNA, 3234 nt, Artificial Sequence
  derived and/or modified sequence opt5 from USP28__Homo_sapiens__NP_065937
augaccgccgagcugcagcaagacgaugcugccggcgcggcugacgggcacggaagcuccugccagaugcuccugaaccagcuuagagaaaucacaggcauucaggaucccucuuuccugcaugaggcccucaaggccagcaauggggacaucacgcaagcugugucccugcuuaccgaugaacgggucaaagagccuucucaggacacaguugccaccgaaccgagcgagguggagggauccgcugccaacaaggaagugcuggcgaaagucauugaucucacacacgacaauaaggaugaccugcaggccgcuaucgcccugucucuccuggagagccccaaaauucaggcugauggccgcgaccuuaacagaaugcaugaagccaccuccgcggagacaaagcggagcaagcgcaaaagaugugagguguggggagaaaauccuaaccccaaugauuggcggcgcguugacggguggccugugggccugaagaacgucggcaauaccugcugguuuucugccgugauccaaucccucuuccagcugcccgaguuuagacggcuuguucugagcuacucucucccucagaacgugcuggaaaauugucgcucccacacggagaaaagaaacaucauguucaugcaggaacugcaauaucucuuugcucugaugauggggagcaaucggaaguucgucgacccgucugccgcucuugaucugcucaaaggagccuuucgcuccagcgaggagcagcagcaagacguguccgaguucacccauaagcugcuugauuggcuggaggacgccuuucagcucgcugugaacgucaauucucccagaaacaagagcgaaaacccuaugguucagcuguucuacggcacauuucugaccgagggggugcgggaaggaaaacccuucugcaauaacgagacauuuggccaguauccucuccaagugaauggguaccgcaaccuggaugagugucuugaaggagcgauggucgagggcgacguggaacugcuccccuccgaucacagcguuaaguauggccaggagagaugguucaccaaacugccgccugugcuuacguucgaacugucucgguuugaguucaaucagucccucgggcagcccgagaagauucacaacaaacuggaauuuccucaaaucauuuacauggacagauauauguaccgcagcaaggagcugauccggaauaaaagagaaugcauucgcaagcucaaggaggagaucaaaauucugcagcagaaacuugaacgguacgucaaguauggaucuggccccgccagauucccccugccugauaugcucaaguacgugaucgaguuugcuagcacaaaaccggccuccgaaucuugucccccugagagcgacacccauaugacacugccccuguccagcguucacugcucuguguccgaucagaccagcaaggaaucuaccuccacagagagcuccucucaagacgucgagagcacguucuccucuccugaagacagccuucccaaguccaaaccgcucaccagcucucgcuccagcauggagaugccuucucagcccgccccucggacagugaccgaugaagagaucaacuuugucaagacaugucugcagagauggcgcuccgaaauugagcaggacauccaagaucugaaaaccugcauugcuagcacgacacagaccaucgagcagauguauugugacccccuccugcggcaagugccuuacagacuucaugccguucuggugcacgaagggcaggcgaaugcuggacacuauugggccuacauuuauaaccagccccgccagucuuggcucaaguacaaugauaucagcgucaccgaguccagcugggaagagguggaacgggacucuuacggcgggcugagaaacguuuccgccuauugccugauguacaucaaugauaaacuuccguauuucaacgcugaggccgcuccuacagagagcgaccaaauguccgaaguggaggcccucucugucgaacugaagcauuacauucaggaggauaauuggcgguuugagcaggaaguggaggaaugggaggaagaacagagcugcaagaucccccaaauggaguccucuaccaacagcuccucucaggacuauagcacaucccaggaacccagcguggcgucuucccacggaguucgcugucugagcucugagcaugccgucauugugaaagaacagacggcucaagccaucgcuaacaccgccagagcguacgagaaguccggcguggaagccgcucucagcgaggucaugcugucuccugccaugcagggcgugauucuugcuaucgccaaagcccggcagacauucgauagagacggguccgaggcuggacugaucaaggcguuucacgaagaguauagccgccucuaccaacuggccaaagaaaccccgacaucccauagcgauccccggcugcagcacguucuuguguacuucuuucagaaugaggcuccuaagagagucguggaacgcacccuccuggagcaguucgccgacaagaaccugucuuaugacgagagaagcauuuccaucaugaaaguugcccaagcuaagcucaaagaaauuggccccgaugacaugaauauggaggaauacaagaaauggcacgaggauuauucucuguuccggaaggugagcgucuaccuucugacggggcucgagcuguaucagaaaggaaaguaccaggaagcccuguccuaucuuguguacgcguaccagucuaacgcugcccuccugaugaagggcccucgcagagggguuaaagagagcgugaucgcccuguaucggcgcaagugccuccuggaacuuaaugcuaaagccgcgucccuguuugagaccaacgacgaucauucugucacagaaggcauuaaugugaugaacgagcucaucauucccuguauccaccugaucauuaauaacgacaucagcaaggaugaccuggaugcuauugaggugaugagaaaucauuggugcuccuaccuuggacaagacaucgccgaaaaccugcagcucugucugggcgaguuccucccucggcugcuugaucccagcgccgaaauuaucguccugaaagagccgccuaccauccgccccaauucuccuuaugaccucugcuccagauuugcugccguuauggaaagcauucagggggugucuacagugaccgucaaguga

SEQ ID NO: 77682 - RNA, 1089 nt, Artificial Sequence
  derived and/or modified sequence opt5 from USP2__Homo_sapiens__NP_001230688
augcuggugcccggcagcaccagaccuuacuccaagaaacggcagaacucuaagagcgcccaagggcucgcuggacugcgcaaucuuggcaacacaugcuucaugaacuccauccugcagugucucucuaauacgagagagcugcgggacuauugccuucagcgccuguacaugagagaucuccaccaugggagcaaugcccacaccgcgcuggucgaagaguuugcuaaacugauucagacaaucuggaccuccucuccgaacgacguugugagccccuccgaauuuaagacacaaauucagcgguaugccccucgcuucgugggauacaaucagcaggaugcccaagaguuccucagauuucugcuugacggccugcauaacgaagucaaucgggugacccuccgccccaaaagcaacccugagaaucuggaucaccuucccgacgaugagaaggggagacagauguggcggaaguaucuggaacgcgaggacucuagaaucggagaucucuucguuggccagcugaaauccagccugacauguaccgacugcggcuacuguucuacgguguuugauccuuucugggaccucucccugccgauugcuaagcggggguaucccgaagucacccuuauggauugcaugcgccuguuuacaaaagaggacgugcucgacggagaugagaagccuaccuguugcagaugucggggcagaaaacgcugcaucaagaaguucagcauccagcgguuucccaaaauucugguucuucaucugaagagauucucugaaucccgcauccggacaagcaaacucaccacguuugugaacuucccucugagagaccuggaucuccgcgaguucgccuccgaaaauacaaaccacgcugucuacaaucuguacgccgugucuaaccacagcgggaccacaaugggaggccauuauaccgcguacugucggucccccgggaccggagaguggcacacauuuaacgacagcucugugacgccgauguccagcucucaagucagaaccagcgaugccuaucuucuguucuacgaacucgcuuccccucccucucgcauguga

SEQ ID NO: 77683 - RNA, 4815 nt, Artificial Sequence
  derived and/or modified sequence opt5 from USP32__Homo_sapiens__NP_115971
augggcgccaaggagagcagaaucggguuccuguccuacgaagaggcucuccggcgcgugaccgacgucgaacugaaaagacuuaaggaugccuuuaaacggacaugcggacugucuuauuacaugggccagcacuguuucauucgcgagguucucggggacggagugcccccuaagguggcggaagucaucuauugcagcuuuggcgggacguccaaaggacugcauuucaacaaucuuauugugggccugguucuccugaccagaggcaaggaugaggagaaggcuaaauacaucuuuucucuguucagcuccgaaucugggaacuaugugauucgggaggaaauggagcgcaugcuccacgucguggacggaaagguuccggauacacugagaaaauguuuuagcgagggcgaaaaggugaauuacgagaaauuccggaacuggcuuuuucugaauaaggacgccuucaccuuuucccgcuggcuccugagcgggggagucuaugugacacuuaccgaugacucugauacacccaccuucuaccaaacgcuggccggcgugacccaucucgaagaguccgacaucaucgaucuggaaaagagauacuggcugcucaaagcucagagccggacagggcgcuuugaccuggagaccuucggaccucuugucucucccccuauuagacccucccugagcgagggccucuucaacgccuuugaugaaaaucgggacaaccacaucgacuucaaggagauuucuugcggccuguccgcuuguugccgcgggccucuugccgaaagacagaaauuuuguuucaagguuuuugauguggaccgggauggagugcugagcagagucgagcuccgcgacauggugguugcgcugcuggaaguguggaaagauaaucggacagacgauaucccggagcuccauauggaccuguccgauauugucgagggcauccuuaacgcccacgacaccacgaagauggggcaccugacacucgaagauuaucagauuuggucugugaaaaauguucuggcuaacgaguuccuuaaucugcucuuucaagugugccauaucguccugggacugagacccgccaccccugaagaggaaggccagaucauucgcggguggcucgagcgggagagcagauacggacugcaggcuggccacaacugguucaucauuuccaugcagugguggcaacaguggaaggaauaugugaaguacgacgccaaucccgucgugaucgagccuagcucuguucuuaacggcgggaaauauuccuuuggaacagcggcccaucccauggaacagguggaggaccgcauuggcagcucucugagcuacgucaacaccaccgaggaaaaguucuccgauaauaucucuacagcuagcgaggccuccgaaacggcugggagcggauuucucuauucugccaccccgggcgccgacguguguuucgcucggcagcacaacacauccgauaauaacaaucaaugccugcugggggcgaacggcaauauccuucuccaccugaacccucagaaacccggagccauugacaaucagccucugguuacccaagagcccgugaaggcuacaagccucacccuggaaggcgggagacuuaaacgcacgccccagcugauccauggacgggauuacgagauggucccugagccgguguggagagcccucuaccacugguauggcgccaaccuggcucugccccgcccugugauuaagaauagcaagacagacauccccgaacuugagcucuuuccucgguaccugcuguuccucagacagcagcccgccacccggacccaacaguccaacauuuggguuaauauggggaacgucccgagcccuaaugcgccccugaaacgcgugcuugcuuauacaggauguuucuccagaaugcagaccaucaaggaaauccaugaguaccugucucagcggcucagaauuaaagaagaggauaugcgccuguggcuguauaacagcgagaacuaccuuacacuccuggacgaugaagaccacaagcuggaguaucucaaaauccaagaugaacagcaucuggugauugagguccggaauaaggacauguccuggccugaagagaugucuuuuaucgccaacagcuccaagauugauagacacaaagugcccacggagaagggcgccaccgggcuuagcaaucugggcaacacaugcuucaugaacucuuccauccagugcguuagcaauacccagccucucacacaauacuuuauuucuggacgccaccuguacgaacugaauagaaccaaccccaucggcaugaaagggcauauggcuaaguguuauggagaccuugugcaggagcucugguccggcacgcagaaaaaugucgccccgcugaagcugcgguggaccaucgcuaaguacgccccucgcuucaacggguuucagcaacaggacagccaggaacuccuggcguuccuucuggauggacuccacgaggaccugaauagagugcaugagaaacccuauguugaacugaaggauucugacggccggcccgauugggagguggccgcugaagccugggacaaccaccuucgcagaaaucggagcauugucguggaucuguuucacgggcaacuccgcucccagguuaaaugcaagacauguggccauaucagcgugagauucgacccuuuuaacuuccugucucucccgcugcccauggauuccuacaugcaccuugagauuaccgucaucaaacuggacggaacaaccccugugcgguauggccuccgccugaauauggaugaaaaguacacggggcugaaaaagcagcuuagcgaccugugcggacucaacuccgagcagauucugcucgcugaggugcauggcucuaacaucaagaauuuuccccaagauaaccagaaagucagacugagcguuuccggguuccuuugugccuuugaaaucccugugcccgugucuccuauuagcgcguccucucccacacagaccgacuucagcuccagcccgucuacaaaugagauguucacccugaccacaaacggagaccucccucggcccaucuuuauuccuaauggcaugcccaacacggucgugccgugcgggaccgaaaagaauuucacaaacggcaugguuaauggacacaugccuucccugcccgauagcccuuuuaccggcuauaucauugccgugcauagaaaaaugaugcgcacagagcuguacuuccuuucuucccagaagaaccggcccagccuguuugggaugccccucaucgucccuuguaccgugcacacgagaaagaaggaccuguacgaugcuguuuggauccaagugucucgccucgccuccccgcugcccccucaggaagcuagcaaucacgcccaggacugcgaugacuccaugggauaucaguaccccuucacacuucgggucgugcaaaaggauggcaacagcugugccuggugcccuugguauagauuuugucgcgggugcaaaauugacugcggagaggaucgggcuuucaucggcaaugcguacauugccguugacugggaucccaccgcucugcaucugagauaucagaccucucaggagcgcguggucgacgaacacgagagcguggaacaaucccggagagcccaggccgagccuaucaaccucgacucuugucugcgggcuuuuacaagcgaagaggagcuuggcgaaaaugagauguacuauugcuccaaguguaaaacccauugccuggccacaaagaaacucgaucuguggcgccucccgcccauucugaucauccaccuuaagagauuccaguuugugaacgggcgguggauuaagucucagaaaaucgucaaguucccucgcgaaucuuucgaccccuccgcguuucugguuccuagagaucccgcucugugucaacauaaaccgcucacgccucagggagacgagcugucugagccccggauucuugccagagaagugaagaaaguggaugcccagagcuccgcuggcgaggaagacguccugcucagcaagucucccuccagccugucugccaacaucauuuccagcccuaaggggucccccucuagcucccgcaaaagcggaaccucuugcccuuccagcaaaaauucuagcccgaacuccucuccccggacacucggcagaagcaaagggcgccugcggcuuccucagaucggauccaagaauaaacugucuagcuccaaggagaaccuggaugcgagcaaagaaaauggcgcuggccaaauuugugagcucgccgacgcccugucuagagggcacgugcuuggaggcucccagcccgagcugguuaccccucaggaucacgaaguggcucucgccaacggguuccuguacgagcaugaggcuugcggaaauggcuacagcaacgggcagcucggaaaucacuccgaagaagacucuacagaugaccaacgcgaggauacccggaucaagcccaucuauaaccuguacgccauuagcugucauuccggcauccuuggcgggggacacuaugucacguacgcgaagaauccgaacugcaaaugguauuguuacaaugacucuagcugcaaggagcugcacccugacgaaauugauaccgacuccgccuauauccuguuuuacgagcagcagggcauugauuacgcucaguuccuccccaaaacagacgggaagaaaauggccgauaccagcucuauggacgaagauuuugaguccgacuauaagaaguacugcgugcugcaauga

SEQ ID NO: 77684 - RNA, 1803 nt, Artificial Sequence
  derived and/or modified sequence opt5 from USP33__Homo_sapiens__XP_011539358
augaccggcagcaacucccacaucacaauucugacgcucaaggugcugccccauuucgagucucuugggaaacaggaaaagaucccuaauaaaaugagcgccuuuagaaaccacugcccgcaucuggacuccgucggagagauuaccaaggaagaucucauccaaaaaucucugggcacaugucaggacugcaagguucaggggcccaaucuuugggcuugucuggagaaccggugcagcuacgugggauguggcgaaucccagguggaucacucuaccauucauagccaagagacaaagcacuaucucaccgucaaucugacaacccugcgcguguggugcuacgccuguuccaaagagguuuuccucgacagaaagcuggggacgcagccuagccuuccccacgugcggcagccucaucagauccaagaaaacucuguccaggauuuuaaaauccccuccaauaccacacugaagaccccucucguggcgguuuucgacgaucuggacauugaggcugaugaagaggacgagcuucgcgccagaggacugacaggccucaaaaacaucggcaauaccugcuauaugaacgccgcucugcaggcccugagcaauuguccgccccucacgcaguuuuuccuggauugcgggggacuugcucggacagacaagaagccugccauuuguaaaucuuaccugaagcucaugaccgaacuguggcacaaaucccgccccggcagcguggucccuacaacccuuuuucaagggaucaagaccgugaaccccacauucagaggauauucucagcaggaugcgcaagaguuucugcggugccucauggaccugcugcaugaagaacucaaagaacaggugauggaggucgaggaagacccgcagacgauuaccacagaggaaaccauggaggaagauaagucccagagcgacguugauuuccaauccugcgagucuuguagcaauuccgaccgcgccgagaacgaaaauggcagcagaugcuuuucugaggauaacaacgaaacaaccaugcugauccaggacgaugagaauaacuccgaaaugagcaaagacuggcagaaggagaagauguguaauaaaauuaacaaggucaauucugagggggaguucgauaaagaccgggauagcaucuccgagacgguggaccuuaacaaucaggaaacagugaaggugcaaauccacucucgcgcuagcgaguacauuaccgacguucacuccaacgaucugagcaccccucagauccuccccucuaaugagggagugaacccuagacuguccgccagcccucccaaaucuggcaaucuuuggcccggccuggcuccgccccauaagaaggcccaguccgcgagcccuaaacggaagaaacagcacaagaaauaucgcuccgucauuucugacaucuuugaugggacaauuaucagcuccgugcaaugccucaccugugacagaguuucugugacacuggaaacguuccaggaucugagccuccccaucccuggaaaggaggaccuggccaaacuucauuccagcucucaccccaccuccauugucaaggcuggcagcugcggggaagccuacgcuccgcagggauggaucgccuucuuuauggaguacgugaagcgguucgucgugucuuguguuccuuccugguuuuggggccccguggucacacugcaggauugccucgccgcuuucuuugcgagagacgaacugaaaggggauaacauguauagcugugagaagugcaaaaagaaugccaccgcuuguuga

SEQ ID NO: 77685 - RNA, 3372 nt, Artificial Sequence
  derived and/or modified sequence opt5 from USP36__Homo_sapiens__XP_005257599
augcccaucguggacaagcugaaagaggcccucaagccuggcagaaaagauagcgcugacgauggggaacugggaaaacuucuggccuccucugcgaaaaagguccuccugcagaagauugaguucgaaccggcuagcaaauccuuuucuuaccaacuugaggcccucaagagcaaauauguucugcugaaccccaagaccgaaggcgccucccggcacaaaucuggggacgauccucccgcucgcagacagggaagcgagcauacauacgaguccugcggcgacggggugccugcuccccagaaggugcuguucccuacggaacggcucagccugcgcugggagagagucuuucgggugggagccggccuucacaaucugggcaacaccuguuuccucaaugccacaauccagugccugaccuauacaccgccccuugcgaacuaccugcucucuaaggaacaugcccgcuccugucaccaagggagcuuuugcaugcuguguguuaugcagaaucauauugugcaggcuuucgccaacucuggaaaugcuaucaaaccugucuccuuuauuagagaucugaagaaaaucgcccggcacuuccgcuuuggcaaccaggaggacgcgcacgaguuccucagauauaccaucgaugccaugcaaaaggcuugccugaaugggugugccaaacuugaccggcagacacaggcuaccacgcuggugcaucagauuuuuggaggcuaccuccgcagcagaguuaagugcucuguguguaaauccgucagcgauaccuaugaccccuaccuggauguggcccuugaaauccggcaagccgcuaacauugugcgcgcgcuggaacucuucgucaaggccgacguucuguccggggagaaugcuuacaugugcgccaaguguaaaaagaaagugccugccucuaagagauuuacaauccaccggaccagcaacgugcugacacucucccugaaaagauucgcuaauuucagcggaggcaagauuaccaaggacgucggcuaucccgaguuucuuaacauccgcccguacaugucucagaauaacggggauccugugauguauggacuguacgccguucucgugcauuccggcuauagcugccacgcggggcacuacuauugcuacgucaaggcuucuaacggacagugguaccaaaugaaugacagccuggugcauuccucuaacguuaaggugguccuuaaucagcaggccuaugugcuguucuaccuccggauucccggcagcaaaaaguccccugaagggcugaucagcagaacgggaucuuccagccugcccggccgccccucugucaucccugaucacuccaaaaagaacauuggcaaugggaucauuagcuccccgcucacaggaaagcggcaggacucuggcaccaugaaaaagccccauacaaccgaggagaucggggugccuauuagcagaaacggauccacccugggccuuaaaucucaaaauggguguauucccccuaagcugcccagcggcuccccgagcccuaaacucucucagacacccacgcacaugccuaccauccuggaugaccccggaaagaagguuaaaaagccugcucccccgcagcauuuuuccccucgcacagcccagggccugcccgggaccagcaacucuaauuccagccggucuggaagccaaagacagggcuccugggauagccgcgacgugguccuuucuacaucccccaaacuccuggccaccgcuacggccaacgggcacggacugaagggcaaugaugaaagcgcggggcucgaccggagaggcuccucuagcuccucuccugagcacagcgccuccucugauagcacaaaagcuccgcagacccccagauccggagccgcucaucugugcgacagccaggaaaccaacuguucuacagccggccacuccaagaccccucccagcggggcggacucuaaaacagugaaacuuaaguccccuguucugagcaauacgaccacagagcccgccucuaccauguccccucccccggcuaaaaagcucgcccugagcgcuaaaaaggccuccacacuguggcgggccaccggaaacgaucuuagaccucccccucccagcccgucuagcgaccucacgcauccuaugaaaaccucccaccccguggucgcuucuacauggccugugcaccgggcgcgcgccgugagccccgcuccccaauccucuagcagacugcagccuccguucucuccccauccuacccugcucuccagcacacccaagccucccggcaccuccgaaccucggagcuguucuuccaucagcacggcccugccgcagguuaaugaggaucuugucucucugccccaccagcucccugaggccuccgaacccccucaaagccccuccgagaagagaaagaagacauuugugggggaaccgcagcgccugggaucugagacccggcugccucagcauaucagagaagcuacagccgcgccccacggcaaacgcaagcgcaaaaagaagaaacggcccgaggacaccgcugccagcgcccuucaagaggggcagacccagcgccagccuggcucccccauguauagacgggaaggacaagcucagcucccugccgugcgcagacaggaggauggcacacagccgcaagucaacgggcaacaggugggaugcguuacggacggccaucacgcgagcucucggaagcgcagacggaaaggggcugaaggacugggcgaggaagggggccugcaccaggauccccuccgccauuccugcagcccuaugggagacggcgaucccgaggccauggaggaaucuccuagaaagaaaaagaagaaaaagcggaaacaggagacccagagagccguggaagaggacgggcaccugaaguguccccgcagcgcuaaaccgcaggaugccgucgugccugaguccucuagcugcgcucccuccgccaacggaugguguccuggcgaccggauggggcuuucucaagcgcccccuguuagcuggaauggagaaagagaguccgaugugguccaggaacugcucaaguacagcucugacaaagccuauggccgcaaggugcugacaugggacggcaagauguccgcuguuagccaggaugccauugaggacucccggcaggcuagaaccgaaacaguggucgaugacugggaugaggaguucgaccgcgggaaagaaaagaaaaucaagaaauuuaagcgggagaagagacgcaacuucaaugccuuucaaaaacugcagacccggagaaacuucuggucugugacgcaucccgccaaggcugcgagccuuuccuaccggcgcuga

SEQ ID NO: 77686 - RNA, 2940 nt, Artificial Sequence
  derived and/or modified sequence opt5 from USP37__Homo_sapiens__XP_005246779
augagcccccugaagauccacggcccuauuagaauccgguccaugcagaccgggauuacaaaauggaaggagggaucuuucgaaaucguggagaaagaaaacaaggucagccucguugugcauuacaauacgggcgggauuccgcgcaucuuucaacugucccacaacaucaaaaaugugguccuuagacccucuggagccaagcagagccggcugaugcucacccugcaggacaacuccuuccuuucuauugauaaggugccuagcaaagacgcugaggaaaugcgccuguuucucgaugccguucaucagaauagacugcccgcggcuaugaagccuucccaaggcagcgggucuuucggagccauccugggcucccggacaagccagaaagagaccucucgccagcucuccuauagcgacaaccaggccucugcuaagagaggcucccuggagacaaaagaugacauucccuuucggaaggugcuugggaauccuggacgcggcagcaucaagaccgucgccggguccggaauugcuagaacaaucccgucucugaccagcacguccacaccccuccggagcggccugcuugaaaaccgcaccgagaaaagaaagcggaugauuucuaccggguccgaacugaaugaggauuacccuaaagagaacgacagcucuagcaauaacaaggccaugacagaucccucccgcaaauaucucaccucuagcagagaaaagcaacugucccugaaacagagcgaggaaaaucggacgucuggacuccugccucuucaguccagcucuuucuacggcuccagagcgggcagcaaggagcacuccucugggggaacaaaccuggaccgcaccaaugugagcucccagacacccucugccaagcggagccucggcuuucugccgcaaccuguuccccuuuccgugaaaaagcugagaugcaaccaggauuauaccggguggaacaaaccucgcgucccccucagcucucaucagcaacagcagcugcagggauucuccaaucugggcaacaccuguuacaugaaugcuauccuccaaagccuguuuucucuucaguccuucgccaacgaccugcucaagcaggggauccccuggaaaaagauuccucugaaugcucuuauccggagauuugcccaucugcucgugaagaaagauauuugcaacagcgaaacaaagaaagaccugcugaagaaagugaagaaugcgaucucugccacggcugagcgcuucagcggauauaugcagaacgacgcccacgaguuucucucccaaugucuggaucagcuuaaggaagacauggagaaacugaauaagaccuggaaaacagaaccggucagcggcgaggaaaacucucccgauauuuccgcuacccgggccuacacaugcccuguuaucaccaaucucgaguucgaggugcagcacagcaucauuuguaaggccugcggcgaaaucauucccaaaagagagcaguucaacgaccuguccaucgaucugccucgccggaagaagccccuuccgccuagaucuauucaagacagccucgaucuguuuuuccgcgcugaggagcuggaauacuccugugagaaaugcgggggaaagugugcgcucgugcggcacaaauuuaauagacugccccggguccuuauccugcaucucaagcgcuauucuuucaacguggcccugagccugaauaacaaaaucggccagcagguuauuaucccuagauaccuuacgcucuccucucacugcacagagaacaccaagcccccuuuuacccugggguggagcgcucacauggccauuucccggccccugaaagccagccagauggucaauucuuguaucacauccccgagcaccccuucuaagaaguucacauuuaaauccaagagcucucucgcucugugccuugacuccgauagcgaagacgagcugaaaagauccguggcccucagccaacgccugugcgaaaugcugggaaacgagcagcagcaagaggaucuugaaaaggacucuaaacucugucccauugagcccgacaagagcgaacuggaaaauuccggcuucgaucggaugucugaagaggagcugcucgcggcugugcuggaaaucagcaagagagacgccuccccuucucuuagccaugaggaugacgauaaaccgacguccucucccgacaccggguuugccgaagaugacauucaggagaugccugaaaaccccgauacaauggagaccgagaagccuaaaacaaucaccgaacuggaccccgcuagcuucacggagaucaccaaggauugcgacgaaaauaaagagaacaagacaccugaaggcucccagggagagguugauuggcuccagcaauaugacauggagcgcgaaagagaggaacaggagcugcagcaggcccuggcucaaagccuucaggagcaggaagccugggagcagaaggaagacgaugaccucaaacgggcgaccgagcugucucugcaagaauuuaauaacuccuucguggaugcccucggcagcgacgaggauucugggaaugaggacgucuuugauauggaauacacagaggcugaagccgaggaacugaagcgcaacgcugagaccggaaaucuuccccacuccuauagacugauuagcguggucucccauaucggcucuacgagcuccagcgggcacuacauuucugacguguaugauaucaaaaagcaggccugguucacauacaacgaccucgagguuuccaaaauucaggaagcggccgugcaaagcgaucgggaccgcucuggauacaucuucuuuuauaugcauaaggagaucuucgaugaacugcuggagaccgaaaagaauagccagucccuuucuacagaggucggcaaaaccaccagacaggcucuguga

SEQ ID NO: 77687 - RNA, 1431 nt, Artificial Sequence
  derived and/or modified sequence opt5 from USP3__Homo_sapiens__NP_001243631
auggagugcccccaccugagcuccucuguguguaucgccccugacagcgcuaaguucccgaacggcucccccucuagcuggugcuguuccgucugcagaucuaauaaaagcccuuggguuugucugaccugcuccagcgugcauugugggucuuaccggugcgaugacuuuguggucaacgauacaaagcugggacuugugcagaaaguucgcgaacaccuccaaaaucucgagaacuccgccuucacggcggacagacauaagaaacggaagcugcuugaaaauagcacccugaacucuaagcuccugaaagugaauggcuccacaaccgcuauuugugccacagggcugcgcaaccucggaaauaccugcuuuaugaacgccauccugcagagccuuucuaauauugagcaguucuguugcuauuuuaaggaacugcccgcugucgagcucagaaacggcaaaacagccgggcggcgcaccuaccacacgagaucccagggagauaauaacgugagccugguugaggaguuccggaagacccuuugcgcucuguggcaaggcucccagacagccuuuucuccugaaagccucuucuauguggucuggaaaaucaugcccaauuuucgcggcuaccagcagcaagacgcgcaugaguucaugagauaucugcuggaucaccuccaccuggaacuucaagggggauuuaacggcgugucccggagcgccauucugcaggagaacucuacccucuccgcuagcaauaaguguugcaucaacggggccucuacaguggucaccgcuaucuucggaggcauucugcagaaugaaguuaacugucuuaucugcgggacggagagccgcaaguuugacccuuuccuggaucucucccuggacauuccgucucaguucagaagcaaacgguccaagaaucaggaaaacggacccguguguagccugcgcgauugccucagaucuuuuacagaccuggaggaacuugaugagaccgagcuguacaugugucauaaaugcaagaaaaagcagaaauccacaaagaaguucuggauccaaaaacucccuaaggugcugugucuucaccugaaacgguuucauuggaccgccuaucucagaaauaaggucgacaccuacguggaguucccccugcgcggccuggacaugaaaugcuaccuccuggaaccugaaaacagcggccccgagucuugucuuuaugaucuggcggccguugugguccaccacggguccggagugggcagcgggcauuacacagcuuaugccacgcacgaaggacggugguuucauuucaaugacuccaccguuacacucaccgaugaggagacaguggucaaggcuaaggccuacauucuguuuuauguggaacaccaggccaaagcuggcucugacaagcuguga

SEQ ID NO: 77688 - RNA, 3744 nt, Artificial Sequence
  derived and/or modified sequence opt5 from USP40__Homo_sapiens__NP_060688
augagccuguuccucagaguggucuuuuccuucaccauguuuggcgaccuguucgaggaagaguacucuacaguuagcaacaaucaguaugggaagggaaagaagcugaaaacgaaggcccuggaacccccugcuccgcgggaguuuaccaaccucuccggcauccgcaaucaagggggaacaugcuaccugaacucucuucugcagacccuccacuucacacccgaauuuagagaggcccuguucagccugggcccugaggaacucgggcuguuugaggauaaagacaagcccgaugcgaaggugcggauuaucccucuucagcugcagcgccucuucgcucaacugcuucugcucgaccaggaagccgccuccaccgcugaucugacagacucuuuuggauggaccagcaaugaggagaugagacagcaugaugugcaggaacugaaccggauucucuucuccgcccuggagacgagccuugucggcaccucuggccacgaccugaucuaucgccucuaccaugggacaauugugaaucaaaucguuuguaaagaaugcaagaacguguccgagagacaggaagauuuucuggaccuuaccgucgcugugaaaaauguuagcggacuggaggaugcccucuggaacauguauguggaggaagaggucuucgacugugauaaucuguaccacugcggcacaugugaccggcuggugaaggcggccaaaucugcuaagcuccgcaagcugcccccuuuccuuaccgugucccugcucagauuuaacuucgacuuugucaaaugcgaacgguauaaggagacgagcuguuacacauucccgcugcgcaucaaucuuaaacccuuuugcgaacagucugagcuggaugaccucgaguacauuuaugaucuguucuccguuaucauucauaagggaggguguuacggcgggcacuaucacguguacaucaaagacguggaucaucugggaaacuggcaguuucaagaagaaaagagcaaaccugacgucaaucucaaggaucugcaguccgaggaggaaauugaccacccccuuaugauccugaaggccauucuccuggaggagaacaaccugaucccuguggaucagcuuggccaaaaacuccugaagaaaaucggcauuucuuggaauaagaaauauagaaagcagcaugggccccugcggaaguuccuccagcugcacagccagaucuuucuucuguccagcgacgaaucuaccguucgccuccugaaaaacuccagccugcaagcugagucugauuuccagagaaaugaccagcagauuuuuaagaugcuuccgccugaaagccccggacucaacaauuccaucucuugcccucacugguucgacauuaacgauagcaaagugcaacccauccgggagaaggacaucgagcagcaguuucagggcaaagaauccgccuacaugcuguucuauagaaagagccaacugcagcggcccccugaggcgcgcgccaauccgagauacgggguccccugucaucuccugaacgaaauggaugcugccaauauugagcuucagacaaagcgcgcugaaugcgacucugccaacaauaccuucgagcugcaccuccaucugggaccucaguaccacuuuuucaacggcgcccugcaucccgugguuucccaaaccgagagcgugugggaucuuacauuugacaaacggaagacgcucggggaucugagacagucuaucuuccagcugcucgaauuuugggagggagacaugguccuguccguggcuaaacuugucccugcgggccugcacauuuaucaaagccucggcggggaugaacugacccugugcgagacagaaaucgccgacggagaggauauuuucguguggaauggcguugaggucgggggagugcacauccagaccggcaucgacugugaaccccuucuccugaacgugcugcaucucgauacauccucugacggggagaagugcugucagguuauugaaagcccgcacguguuuccugcuaaugccgaggucggcaccgugcugacggcccuugcuauccccgccggagugauuuucaucaacuccgcgggcugcccugggggagaaggcuggacagcuauucccaaagaggacaugcgcaagaccuuucgggagcaggggcugagaaacggaucuagcauccucauucaagauucccaugacgauaauagccugcugaccaaggaagagaaauggguuacaucuaugaacgaaaucgacuggcuucacgucaagaaucugugucagcucgaguccgaggaaaaacaggugaagaucagcgccaccgugaacacaauggucuucgauauucgcaucaaagccauuaaggagcugaaacucaugaaggaacuggcugacaauucuugccuucggccuaucgauagaaacggcaagcugcucugucccgugccggacuccuacacgcugaaagaggccgaacugaagauggggagcucucuuggccugugccucggaaaagcuccuagcuccagccagcuguuucucuucuuugccaugggcucugauguucaacccgggaccgagauggagauuguggucgaagagacaaucuccgugcgcgacugucugaaacuuaugcugaaaaagagcggacuccagggcgaugcguggcaccuucggaagauggacuggugcuaugaagccggggagccccugugugaagaggaugcuacccuuaaagagcugcucaucugcuccggagacacacugcuccugauugaaggccagcuuccuccgcugggguuccugaagguucccaucuggugguaccagcuccaaggcccuucuggacauugggagagccaccaggaccagaccaauugcacguccucuuggggcagaguguggcgggccaccagcucccaaggggcuucuggaaacgaacccgcccaggucagccugcuuuaucugggcgauauugagaucuccgaagacgcgacacucgccgagcugaaaagccaggcuaugacccucccucccuuccuggaguuuggggugccuucucccgcccaucuucgcgcuuggacaguugaaagaaagcggccgggaagacugcugcgcaccgaucggcagccucucagagaguacaaacugggccgcagaauugaaaucugucuugagccccugcaaaagggggagaaucucggcccucaggacgugcugcuccggacgcagguccgcauccccggagaaagaacauaugccccggcccuggaucuuguguggaacgcugcgcagggcgggaccgccggaucccugcggcaacgcguggcugacuucuacagacugccugucgagaagauugaaaucgccaaauacuuucccgagaaguucgaauggcucccuauuagcucuuggaaucagcagaucacaaaacggaagaaaaagaagaaacaggauuaucugcaaggcgcccccuacuaucuuaaggacggggauaccauuggaguuaaaaaccugcucaucgacgaugacgacgauuuuuccaccauccgcgacgauacaggcaaggagaaacagaagcagagagcucugggccggcgcaaaagccaggaggcccuccacgaacaaucuuccuacauucugagcuccgcggagacgcccgcuagaccucgggccccggaaaccagccuuucuauccauguggggagcuucagauga

SEQ ID NO: 77689 - RNA, 3951 nt, Artificial Sequence
  derived and/or modified sequence opt5 from USP42__Homo_sapiens__NP_115548
augaccaucguggacaaggccagcgaguccucugaucccagcgcuuaccagaaccaaccuggcuccucugaagccgucagcccgggggacauggaugcgggauccgcuucuuggggcgccguuagcucccugaaugacgugagcaaccacacacucucucuggggcccgugccuggagccgucguguauuccucuagcuccguucccgauaaaagcaagccuucuccccagaaagaccaggcucuuggcgaugggauugccccuccgcagaaggugcuguuccccuccgagaaaaucugccucaaguggcaacagacgcauagagucggagcuggccugcagaaucuuggcaacaccuguuuugccaaugcggcccugcagugccucacauacaccccuccccuggcuaacuauaugcugagccacgaacauuccaagacaugucacgccgagggguucugcaugauguguaccaugcaagcucauauuacacaggcccucucuaauccuggagacgugaucaaacccauguuuguuauuaacgaaaugcggcgcaucgcgagacacuuccgguuuggcaaucaggaggaugcccacgaguuccugcaguacaccguggacgcuaugcaaaaggccugccuuaacgggagcaauaaacuggaucgccauacgcaggcuaccacacucgucugucagaucuuuggaggcuaucugagaucccgggugaagugccuuaacuguaaaggggugagcgacaccuucgauccguaccuggacauuacacucgaaaucaaggccgcccaaucugucaauaaggcucuggagcaguuuguuaaaccugaacagcuggacggagagaacuccuauaagugcagcaaauguaagaaaauggugcccgcgucuaagcgcuucaccauucacagaagcuccaaugugcucacgcugucucuuaaacgguuugccaacuucacaggcggcaagaucgcuaaggaugucaaauacccugaguaccuggacauucgccccuauaugagccagcccaacggggaaccuaucguguacguucucuaugccgugcugguccauaccggauuuaauugccacgccggccacuacuucugcuauauuaaggcuuccaacgggcuuugguaccaaaugaaugauagcaucgugucuacauccgacaucagaagcguucugucucagcaggccuaugugcuuuucuacauucggucccaugaugucaaaaacggaggcgagcugacccacccgacccauagccccgggcaguccucuccucgccccgugaucagccaaagagucgugacaaauaagcaggcggcuccuggauuuauuggcccccagcugccgucccacaugaucaaaaacccuccccaucucaauggcacggggccucugaaggacacccccucuagcuccaugagcucuccuaacggaaauuccagcguuaaccgggccucucccgugaaugccuccgcuagcguccagaacuggucugugaaucgcagcuccguuauuccggaacacccuaagaaacaaaagaucacaaucagcauucacaacaaacuucccgugagacagugucagucucagcccaaucugcauuccaacagccucgagaacccuaccaagccgguccccuccucuacaaucaccaauagcgccgugcaauccacgucuaacgcuagcacaauguccgugucuagcaaaguuaccaagccuauuccccgguccgaaagcugcucucagccugucaugaauggcaaguccaaacugaacagcucugugcuugugcccuacggggccgaguccagcgaggauucugacgaagaguccaagggacugggcaaagaaaaugggaucggcaccauugucagcucccacagcccuggacaggaugcggaggacgaagaggccacaccccaugagcuccaagaaccgaugacccugaacggcgcuaauucugccgauagcgacuccgacccuaaggagaacgggcuggcucccgauggagccucuugucagggccagccugcgcuccacagcgaaaaucccuucgccaaagcuaacgggcugccgggaaagcucaugccugcuccccugcucucccugccugaggacaagauccuggaaacauuuagacuuucuaauaaacucaagggcagcacggaugagauguccgcccccggggccgagcgcggacccccugaagaccgggaugccgagccgcagcccggcucuccugcugcggaaagccuggaggagcccgacgccgcugccggccuguccagcaccaaaaaggccccucccccuagagauccggggacacccgcuaccaaagaaggagccugggaggcgauggcuguggccccugaagaacccccucccucugccggcgaagacaucguuggggauacagcuccgccugaccucugcgaucccggaucccugaccggcgacgccagcccccuuucucaagaugcgaaggggaugauugcugagggcccucgcgacuccgcccuggccgaggcucccgaaggacucagcccugccccgcccgcucgguccgaggaaccuugugagcagccccugcuggugcacccuucuggcgaccaugccagagaugcgcaggaccccagccagucccuuggggccccggaagcugccgagcgcccucccgcuccuguccucgauauggcccccgccggacacccugagggcgacgcugaacccagcccgggggagcggguggaagaugcggccgcuccuaaagcccccggacccucuccugccaaggagaagaucggcucccugagaaaaguugaccgcgggcauuaucggagcagacgcgaacggucuagcuccggcgagccggcuagagagucucggagcaagacggaaggacaccgccauagacggagacggaccugcccccgcgagagagaucgccaagacagacacgccccugaacaccaucccggccacggggaucggcuguccccuggagagcgcagaucucucggccgguguagccaucaccauucccgccacagaagcgggguggagcuggacuggguccggcaccauuacacagaaggagagcgcggcuggggcagagaaaaauucuaucccgaucggccucgcugggacagaugccgguacuaucacgauagauacgcgcuuuaugcugcccgcgacuggaagccguuucaugggggacgggagcacgaaagagccggccugcacgagcgcccccauaaagaccacaaccgggggagacgcggaugugagccugcucgggaaagagagcgccaucggcccucuuccccuagagccggcgcgccccacgcucucgccccgcauccugaucgguucagccacgaccgcaccgcccugguggcuggggauaauugcaaccuguccgacagauuucacgaacaugagaauggaaagucucggaagcgcagacacgauagcguugaaaacuccgacucucauguggagaaaaaggcccggagaagcgagcagaaagauccccuugaggagcccaaggcuaaaaagcacaagaaauccaagaaaaagaaaaagagcaaggacaaacaccgcgaucgggacucuagacaucagcaggauuccgaccucagcgccgcguguucugacgccgaucugcaccgccauaagaaaaagaaaaagaaaaagaagcggcacuccagaaaaagcgaagacuucgucaaggauucugagcugcaucucccucgcgugacaagccuggaaaccguggcucaauuucggagagcccagggcggcuucccccuuuccgggggaccuccgcuggagggcgucgggcccuuucgcgagaaaacgaagcaccucagaauggaaucucgggacgaucgcugcagacuguucgaguacggacagggcgacuga

SEQ ID NO: 77690 - RNA, 3357 nt, Artificial Sequence
  derived and/or modified sequence opt5 from USP43__Homo_sapiens__NP_001254505
auggaccugggccccggggaugccgcuggaggcgggccucucgccccgagaccccggcgcagacggagccugcgcagacuuuucucccgguuucugcucgcgcugggaucucgcagcagaccuggcgacucucccccucggccccagccugggcacugcgauggagacggcgagggcggguucgcuugugccccgggacccgugccugccgcucccggcuccccuggggaagagagacccccgggaccucaaccccagcuucagcugccugccggcgauggggcuagaccucccggagcccagggccucaagaaccauggcaauaccugcuuuaugaacgcggucguucaaugucugagcaauacagaccugcucgccgaguuccuggcucuugggcgguaccgcgccgcucccggcagagccgaggugacggaacagcuggcggcccucgugcgggcucuguggacccgcgaguauacaccgcagcuuuccgccgaguuuaaaaacgcugucucuaaguacggcagccaguuccaaggaaauucccagcacgaugcccuggaauuucuccuguggcugcucgacagagugcaugaggaucuggaagggagcucucggggccccguuuccgagaaacuuccucccgaggccaccaagacaagcgaaaacugccugucuccuuccgcucagcucccccuggggcagagcuucgugcaaucucacuuucaggcgcaguauagauccagccuuaccuguccgcauugccugaaacaauccaauacauucgacccuuuucucugugucucucugcccaucccucugcgccagacccgguuccucagcgugacgcugguuuuucccuccaagagccagagauuccuucgcgugggacuggccgucccuauucucucuaccguggcugcccugcggaagaugguggccgaggaaggcggcguccccgcugaugagguuauccuuguggaacuguacccguccggguuccagcgcagcuuuuucgacgaggaggaucucaacacaauugccgaaggagacaauguguaugcguuucaagucccucccucucccagccagggcacccuguccgcucacccucuggggcucucugccagcccgcgccuggccgcucgggagggacagagauucucccuuagccugcacucugaauccaaagugcucauccuguuuugcaaccugguuggcagcgggcagcaagccucucgcuucggacccccuuuucuuauucgggaggacagagcuguguccugggcccagcuccagcagagcauccuguccaagguccgccaucugaugaaaucugaagcgcccgugcaaaaucucggaagccuguucuccauccggguugugggccuuucugucgccuguagcuaccuguccccuaaggauagcagaccccucugccacugggcuguggaccggguccugcaucugcgcagaccugggggacccccgcacgugaaacuugccguugagugggauucuuccgugaaggagcggcucuuuggcagccugcaggaagagagagcucaggacgccgauucugucuggcagcaacagcaggcgcaccaacagcauuccuguacacuggacgaaugcuuccaguuuuauaccaaggaggaacagcucgcccaagaugacgcuuggaaaugcccucacugucaggugcugcagcaggggaugguuaaacuuagccuguggacgcuccccgauauucugaucauucaucugaagcgcuucugccaagugggagagcggagaaacaaacuuucuacacucgucaaguuuccucugagcggccugaauauggcuccccacguggcccagcgcuccaccagcccggaggccgggcucggcccuuggcccucuuggaagcagccugacugucugcccacauccuacccccuugauuuccuguacgaccucuaugccgugugcaaccaucacggaaaucugcaggcuuacuguagaaacagccuggacggccaaugguauuccuacgaugacucuaccguugaaccucuucgggaggaugaagucaacacccgcggggcguauauccucuucuaccagaaaagaaauagcauuccgcccugguccgccucuagcuccaugcggggaucuacaagcuccagccugucugaccacuggcugcuccgccugggcucccaugcugggagcacgagaggaucucuucuguccuggagcucugccccuugccccucccucccucaggugcccgauagcccuaucuuuaccaacucccuguguaaucaagagaagggcgggcuggagccgcggcgccuugugagaggcgucaagggacggagcauuucuaugaaagcccccacaaccagccgcgcuaagcagggcccuuucaaaacaaugccccugagaugguccuuugggucuaaggaaaaaccucccggagccagcguggagcucguugaauaucuggagucccggagacgcccgcggucuaccagccaguccaucgugucucuccugacgggcacagcgggggaagacgaaaagagcgcuuccccuagaagcaacgucgcccuucccgccaauucugaggauggaggccgcgcuaucgaacgggggcccgccggcgugccuugccccuccgcgcagccuaaccacugucuggcuccgggaaauagcgacggccccaacaccgccagaaagcucaaagagaaugccgggcaagauauuaagcugccucgcaaauucgaccugccccuuaccguuaugccuucuguggaacaugagaagcccgcucggccggaaggacagaaagccaugaacuggaaggaguccuuucagaugggcagcaaguccucuccucccagcccuuacaugggguucuccggaaauagcaaagauucuagacgcggcacauccgagcuggaccggccccuccagggcacccugacacuccugagaagcgucuuucggaagaaagaaaaccgcagaaaugagcgggcugaagugucuccucaaguucccccggugagccuugucuccgggggacugucuccugccauggauggccaggcgcccgggagcccucccgcccuccgcaucccggagggacuggcuagaggccuggggucccggcuugaaagagacguguggucugcccccagcucccugcgccucccucggaaggcuagcagagcuccccgcggaucugcccugggcaugucccagcggacggugccuggcgagcaggccagcuacgggaccuuccaaagagucaaauaucacacacucucccugggacgcaagaagacccuucccgagucuagcuuuuga

SEQ ID NO: 77691 - RNA, 2139 nt, Artificial Sequence
  derived and/or modified sequence opt5 from USP44__Homo_sapiens__NP_001265322
augcuggccauggauaccugcaagcacgugggccagcuccaacuggcucaggaccauagcucccuuaacccccagaaauggcacugugucgacugcaauacaacggagucuaucugggccugucugagcugcucccauguugcgugugggagauacauugaagaacacgcucucaagcauuuccaggaaucuagccacccuguggcccuggaggugaacgaaauguaugucuuuugcuaccuuugugaugacuaugugcugaaugauaacaccacaggagaccucaaacugcugcggcgcacccucuccgccaucaagucucaaaauuaccacugcacaaccagaagcggccgguuccugcgcuccauggggacaggagaugacagcuauuuucuucaugauggcgcucagucucugcuccaguccgaggaccagcuguacaccgcccuuuggcacagacggcgcauucugauggggaaaaucuucagaacgugguuugagcaaagcccgauuggacggaagaagcaggaggagcccuuccaggagaaaaucguugugaagcgcgaagucaaaaagagacggcaggagcucgaauaucaagugaaagcugagcuggaaucuaugccuccccgcaagucccugagacuccagggccuggcccagagcaccaucauugagaucguuucugugcaagucccugcgcagacacccgccuccccugcuaaggauaaagugcuuagcaccuccgaaaacgagauuucucagaaggugagcgacuccagcgucaaacggcgcccgaucguuacacccggcgugaccgggcugagaaaucucggaaacacguguuacaugaacucugugcugcagguccuuucccaucugcucauuuuucggcaaugcuuccugaagcuggaucucaaucaguggcuggccaugacagcuagcgagaaaaccagaucuuguaagcacccucccgugacagacaccguuguguaccagaugaaugaaugccaggagaaagacaccggcuuugucugcagccgccaauccucucuuagcuccgggcugagcggaggcgccucuaaggggcggaagauggaacucauccagccuaaagagcccacaucccaguauauuagccugugucacgaacuucauacgcuguuccaggugauguggucuggaaagugggcgcucguuuccccguuugccaugcugcacagcguguggagacugaucccugcuuuccgcggcuacgcccaacaggaugcucaggaguuucucugcgagcugcuugacaaaauccagcgggaacuggagaccacaggcaccucccuccccgcccugauuccuacaucucaaagaaagcugaucaaacagguccuuaacguggucaauaacauuuuccaugggcagcuccugagccaagugaccugucuggccugcgauaauaaguccaacacgaucgaacccuucugggaccucucucuggaguuucccgaacgcuaucaguguagcggaaaggauauugcuucccagccuugccuuguuacagagaugcuggcgaaauucaccgagaccgaagcccucgagggcaagaucuacgugugugaccagugcaacagcaaacggagacgcuuuucuuccaagccggucgugcugacagaagcucaaaaacagcugaugaucugucaccuuccccagguucuccggcugcaucugaagagauuccgcuggagcgggcggaauaacagagagaagauuggagugcacgucggcuuugaggaaauccucaauauggagccuuauugcugucgggaaacccugaaaucucuucgccccgagugcuucauuuacgaucuguccgccguggugaugcaccaugggaagggauuuggcagcggccacuauacagccuacugcuacaacucugaagggggauucuggguucauuguaaugacagcaaacucuccaugugcacgauggaugaggucuguaaggcucaggccuauauccuguuuuacacccaaagagugacagagaacggccacagcaaacugcuuccucccgaacuccugcuggggucucagcacccgaaugaggacgcggauaccuccagcaacgaaauucucuccuga

SEQ ID NO: 77692 - RNA, 1080 nt, Artificial Sequence
  derived and/or modified sequence opt5 from USP46__Homo_sapiens__NP_001127695
augaacugcuuccagggcaccaaugccagcgcucuggagaaggacaucgggcccgaacaauuuccuauuaacgagcacuacuucggacucgugaauuuuggcaacacauguuauugcaauuccguccugcaggcccuuuacuucuguagaccguuucgggaaaacguucuggcguauaaagcucagcagaagaaaaaggagaaucuccugacgugccuugccgaucuguuccauucuaucgccacccagaaaaagaaggugggggugauucccccuaaaaaguuuaucagccgccucagaaaagaaaacgaccuguucgauaauuacaugcaacaggacgcucacgaguuucugaacuaucuccugaauacaauugccgauauccuucaggaggaaaagaaacaagagaagcagaacggaaagcugaaaaauggcaacaugaaugaacccgcugagaacaacaagccugagcucaccuggguccaugaaaucuuccaggggacacugaccaaugagacacggugucuuaacugcgaaaccguguccucuaaagacgaggauuuucuggaccucagcguugauguggaacagaauacguccauuacccacugucugcgcgacuucucuaacacagagacccugugcagcgagcaaaaguacuauugugaaacaugcuguuccaaacaggaggcccagaagagaaugcgggucaaaaagcuccccaugauccuggcgcuucaucugaagcgcuuuaaauacauggaacaacuccacagauacaccaagcugagcuaucgggugguuuucccucuugagcugcgccucuucaauacgucuuccgaugccgugaaccuggacagaauguacgaucuggucgcuguggugguccacugcggaagcggcccgaaucggggccauuauauuacaaucguuaaaucucacggguuuuggcuccuguucgacgacgauauuguggaaaagaucgacgcccaggcuauugaggaguuuuacggacuuaccuccgauaucagcaaaaacucugaauccggcuauauccuguucuaccagagccgcgaguga

SEQ ID NO: 77693 - RNA, 3105 nt, Artificial Sequence
  derived and/or modified sequence opt5 from USP48__Homo_sapiens__XP_011540564
auggcccccagacugcagcucgagaaggcugccuggcggugggcggaaaccgugcgcccugaggaagucagccaagagcacaucgaaacagcuuacagaauuuggcuggagccgugcauccggggcguuugucgcagaaacugcaaagggaaucccaacugucuugugggaauuggcgagcauaucuggcugggggaaauugacgaaaauuccuuccacaacaucgaugacccuaauugcgaacggcgcaagaaaaacucuuuugugggacucacgaaucugggcgccaccuguuaugucaacacauuccuucaggugugguuucugaaucucgagcugagacaggcccuguaccucugccccagcaccuguuccgauuauaugcugggggacggaauccaggaggaaaaggauuacgagccucaaacaauuugcgaacaucuucaguaucuguucgcucuccugcagaacucuaaucggcgcuacaucgaccccagcggcuuuguuaaagcccuuggccuggauaccgggcagcaacaggacgcucaggaguucuccaagcucuuuaugucucugcuggaagauacacucagcaagcagaaaaacccugacgugagaaauauuguccaacagcaguucuguggagaguaugccuacgugaccguuugcaaccaauguggccgggaguccaagcugcuuagcaaauuuuacgaacuggagcucaauauccaggggcacaagcagcugacggauugcauuucugaguuccuuaaagaggaaaagcuggagggagacaaccgcuauuuuugcgagaacugucaguccaagcaaaaugcgaccagaaaaauccggcuccugagccugccgugcacacucaaccugcagcuuaugcgcuucguguuugauagacagaccggccauaagaaaaagcugaauacauacauuggguucucugaaauccucgacauggagcccuaugucgaacacaaaggaggcuccuacguguaugagcugagcgccgugcuuauccaccggggcgucucugcuuacuccgggcauuauauugcccacguuaaggacccucagagcggagaaugguacaaauucaacgaugaggacaucgagaagauggaaggcaagaaacugcaacucgggauugaggaagaucuggagcccuccaagucucagaccagaaaaccuaaguguggaaaaggcacgcauugcagccgcaaugcuuacaugcugguguaucggcuccagacacaggagaagcccaacaccacagugcaagucccggccuuucugcaggaacuuguggacagagauaauuccaaguucgaggaaugguguaucgagauggcggaaaugcgcaaacagagcguugacaaggggaaagccaagcacgaggaggugaaagaacuguaccagcggcucccugcuggagccgagcccuaugaauuugucucucuggaguggcugcaaaaguggcuugaugaauccaccccuaccaagcccauugacaaccacgcuugccucuguagccaugauaaacugcaccccgacaagaucucuaucaugaaaagaauuagcgaguacgccgccgauaucuucuauucccgcuacggcggcgggccucggcugacagugaaggcucucugcaaagaguguguuguggaaagaugccgcauucugcggcuuaagaaucagcugaacgaggacuauaagacggucaauaaccuccugaaagcggccgugaagggaucugacggcuuuugggucgggaaaagcucccugagaagcuggcgccagcuugcucucgaacaacuggaugagcaggacggagaugccgaacagucuaauggcaagaugaacggguccacccugaauaaagacgagagcaaggaggaacggaaagaggaagaggagcucaacuucaacgaagauauccuguguccgcauggcgagcuuugcauuucugaaaaugagagacggcugguguccaaggaagccuggagcaagcuccagcaauacuuucccaaagcuccugaguuccccuccuacaaggagugcuguucucagugcaaaauccuggaacgcgagggagaagagaacgaagcccugcacaagaugaucgcgaaugagcagaaaacaagccuuccuaaccucuuucaggacaagaauagacccugucuguccaacuggccggaggauaccgacguucuguauauugugucucaauucuuugucgaagaguggcggaaguucgugagaaaaccuacacgcugcagccccguuuccagcgugggcaauucugcucuccuguguccucaugggggacuuauguuuaccuucgccuccaugacgaaggaagauagcaaacugaucgcccucauuuggcccucugaguggcagaugauccagaagcuguucgucguggaccacgugauuaaaaucacacggauugaaguuggcgaugucaacccuuccgagacccaguacaucagcgagcccaagcugugcccggaauguagagaggggcuucucugccaacagcagcgcgaccugagagaauauacccaagcuacaaucuacgugcacaagguggucgauaauaaaaaggugaugaaagacucugccccugagcugaacguuagcuccagcgagaccgaagaggacaaggaagaggcuaaacccgauggagaaaaggaccccgauuuuaaucagucuaacggcgggacaaagcggcagaaaauuucccaucagaauuauaucgccuaccaaaaacaggugauucgcagaagcaugcggcaccgcaaggucagaggcgagaaggcgcuccugguguccgccaaccagacgcuuaaagagcugaagauccagauuaugcaugcuuucucuguugccccuuuugaccaaaaucucagcaucgauggaaaaauccuguccgacgauugugcuacccugggcacacuuggggugauuccggaaucugucauccugcucaaggccgacgagcccauugcggauuaugccgcuauggacgaugugaugcagguuugcaugccugaagagggauucaagggcaccgggcugcucggacacuga

SEQ ID NO: 77694 - RNA, 2067 nt, Artificial Sequence
  derived and/or modified sequence opt5 from USP49__Homo_sapiens__NP_001273483
auggacagaugcaagcacgugggccggcugcgccucgcccaggaucauagcauccugaacccccaaaaaugguguugccuugagugugcuaccacagaauccgucugggccugccugaaguguucucacguugcgugcgggagauacauugaggaccaugcucucaaacacuucgaagagacgggacauccucuggccauggaagugcgggaucuuuauguguuuuguuaccugugcaaggacuauguccucaaugauaacccggagggcgaccugaaacugcuccgcagcucccugcuugccgugagagggcagaagcaggauacccccguucggcgcggaagaacacugcggucuauggcuagcggcgaggacgugguccucccucagcgcgcuccccaagggcagccucagaugcugaccgcccuuugguacagacggcagcgccugcucgccagaacacugcggcugugguucgaaaaguccucucgcggacaagcgaaacucgagcagagacggcaggaagaggcccuggagagaaagaaagaagaggcucgccggagacgccgggaagugaagagacgccuucuggaggaacucgccagcacacccccucggaaauccgcuagacugcuucugcacaccccgcgcgaugccggccccgcggccagccggccugcugcccuccccaccucuagacgcguuccugcugccacgcugaagcugcggagacagcccgccauggcuccgggcgugaccgggcuccggaaucugggaaacacauguuauaugaacuccauccuucaaguccugagccaccuccagaaguuucgcgagugcuuccugaaucuugacccuucuaaaaccgagcaucuguuucccaaggcgacaaauggcaaaacccagcucuccgggaagccuacgaacagcucugccacagaacugucccugagaaaugaucgggcugaggccugugaaagagagggauucugcuggaacggccgcgccagcauuucccggucucucgaacugauccaaaauaaagagcccagcuccaagcacauuagccuuugcagagagcugcauacccucuuucgcgugauguggucugggaaaugggcucuggugucccccuucgccaugcugcacagcgucuggucucuuaucccugcguuuagaggauacgaccagcaggaugcucaggaguuccucugugaacugcugcacaagguucaacaggaacucgagagcgaaggcacaacccggcgcauccugauuccguuuucccagagaaagcugaccaaacaggugcuuaagguggucaacacaaucuuccauggccaacuccugucucaggugacgugcauuagcuguaauuauaaauccaacaccaucgagcccuuuugggaccugagccuugaguucccugaacgguaccacugcauugagaagggguucguuccccucaaucagacagaaugucugcugaccgagaugcucgccaaauuuacagagaccgaagcccuggagggacgcaucuacgcuugcgaccaguguaacucuaagagacggaaguccaacccuaaaccccuugugcugagcgaagcccgcaagcaacucaugauuuauagacugccgcagguccugcggcuucaucucaaacgcuucagauggucuggccggaaucacagagagaagaucggggugcauguuguguuugaucagguccugacgauggaaccuuacugcugucgcgacaugcuguccagccucgauaaagagacauucgcuuaugaccuguccgccguggucaugcaccacggaaagggcuuugggucuggacauuacaccgcguauugcuacaacaccgagggcggcuucugggugcacuguaaugauagcaaacuuaacguuugcuccguggaagaggucugcaagacacaggccuauauccuguuuuacacccaacggacagugcaggggaaugcuagaauuucugaaacgcaucuccaggcccaaguucagagcuccaacaaugacgagggacgcccccagaccuucagcuga

SEQ ID NO: 77695 - RNA, 942 nt, Artificial Sequence
  derived and/or modified sequence opt5 from USP4__Homo_sapiens__NP_001238806
auggccgagggcgggggaugcagagaacggcccgacgcugagacccaaaagagcgaacugggcccucucaugcgcacaacgcugcagagaggggcccagugguaccuuaucgauucccggugguucaaacaguggaagaaauaugugggauuugacucuugggauauguacaacgucggcgagcacaaucuguucccggggcccauugacaacagcggacucuuuuccgauccugaaucucagacccugaaggagcaucuuaucgacgagcuggauuauguucucgugcccacagaagcguggaauaaacugcugaacugguacggcuguguggagggccaacagccuauuguccgcaaggugguugaacacgggcucuuugugaagcauugcaaagucgagguguaucugcuugagcugaagcucugugaaaauagcgaccccaccaacguucuguccugccacuuuucuaaagcugauacaaucgccaccauugagaaggaaaugagaaaacuuuucaauaucccugccgagcgggaaacacgccuguggaacaaguacaugagcaauaccuaugagcagcucuccaagcuggacaacacggugcaggaugcuggacuguaccaaggccagguccucgugaucgagccgcagaaugaagacgggaccuggcccagacagacacugcaaagcaaagugucuuucuuccuuccucggcuggaguguaacggagccauucucgcucauugcaauuuuugucugcccggcuccagcaacucuccugccuccgcgagccgcgucgcccccucucaccuugcuaauuucuuuuucuuugaaauggagucccacagcguuaccaagcuggaaugcgggggagccguguccgcuuacucuagagugcaggucaugcuccugccgcagccucccgaguggcugggcuga

SEQ ID NO: 77696 - RNA, 2577 nt, Artificial Sequence
  derived and/or modified sequence opt5 from USP5__Homo_sapiens__NP_001092006
auggccgagcugagcgaagaggcucuccuguccgugcuucccaccaucagagucccuaaggccggcgaccggguucacaaagaugaaugcgcguucucuuuugacacaccggagagcgaagggggacuguacauuuguaugaacacguuccucggcuuugggaagcaguauguggagcgccauuucaauaaaaccggacaaagaguguaccugcaccuucggcgcacaagacggcccaaggaggaagauccugcuaccggcacaggggaucccccucgcaaaaagcccaccagacuggccaucggagucgagggcggcuuugaccucuccgaagagaaguucgagcuggacgaagaugugaaaauuguuauccugccugacuaucucgagauugcccgggaugggcugggaggccuuccggacaucgugcgcgauagagucacaucugcuguggaagcccugcucagcgcugacuccgccucucggaagcaggagguucaggcgugggauggggaagugcgccaggucagcaaacaugccuuuucccugaagcaacuugacaaccccgcuagaaucccucccugcggauggaaauguagcaagugcgacaugcgggagaaucuguggcucaaccugaccgauggcucuauucugugugggcgcagauacuucgacggauccggcggcaauaaccacgccguggagcauuaucgggaaacgggguacccucucgcugugaagcugggaaccaucacacccgauggcgccgacgucuauagcuacgaugaggacgauaugguucuugacccgucucuggcggaacaccucucccacuuugggauugauaugcugaaaaugcagaagaccgacaaaacaaugaccgagcuugaaaucgauaugaaucagagaauuggagagugggagcugauccaggaaagcggcgugccucucaagccccuguucgggccuggauacacgggcauucgcaaccugggcaauucuugcuaucucaacuccgugguccaagugcuguuuagcauccccgacuuccagcggaaauacguugacaaacuugagaagaucuuucagaaugcccccacagauccuacccaggacuucuccacacaaguggcuaagcuggggcauggacuccugucuggcgaauauagcaagccgguccccgaguccggggauggagaaagagugccugagcagaaagagguucaggacggcauugcuccccgcauguucaaggcccuuaucgggaaaggccacccugaauuuagcaccaaccggcaacaggaugcccaggaguucuuucugcaucucauuaauaugguggaaagaaacugucggucuuccgagaaucccaacgaggucuuccgcuuucugguggaagagaagaucaaaugccuggccaccgaaaaggucaaguacacacagagaguggacuauauuaugcaacucccgguuccuauggaugcugcgcugaacaaagaggaacuucuggaguacgaggaaaagaaacgccaggccgaggaagagaagauggcucuccccgaacuggugcgggcccaggucccuuucagcucuugucuggaggccuauggagcucccgaacagguggacgauuuuuggagcacggcccuucaagcgaaauccguugcugugaagaccacaagauucgccucuuuuccugacuaccucgucauccagaucaagaaauucaccuuuggccuggauugggugcccaagaaacuggacgugagcauugaaaugccggaggaacucgauaucucccagcugcgcgggacaggacuucagccuggcgaggaggagcugcccgacauugcucccccucucguuaccccggacgagcccaaggggagccugggauucuacggcaaugaagaugaggacucuuuuugcuccccucacuucagcucucccacguccccuaugcuggaugaaagcgucaucauucaacuuguggagaugggguuccccauggacgccugucggaaagccguguauuacacaggcaacuccggagcugaggccgcgaugaauugggucaugucucacauggaugacccugauuuugccaacccccucauccugccgggcagcuccgggccuggaucuaccagcgcugccgcugaucccccucccgaagacugcgugaccacaaucguuuccaugggcuucagcagagaccaggcccugaaggcgcuccgggccaccaauaacucucuggagcgcgcuguggauuggaucuuuucccauauugacgaucuugacgccgaagcugccauggacauuagcgaggggagaucugccgcugauuccaucagcgaaucugucccggugggaccuaagguucgggacggccccgggaaauaucagcuguucgcguuuauuagccacaugggcacauccacgaugugcggacauuacgugugucacaucaagaaagagggcagaugggucauuuauaaugaucagaaggugugcgccagcgagaaaccucccaaggaccucggguacaucuauuucuaccaacgcguugcuucuuga

SEQ ID NO: 77697 - RNA, 4221 nt, Artificial Sequence
  derived and/or modified sequence opt5 from USP6__Homo_sapiens__NP_001291213
auggacaugguggagaacgccgauagccugcaggcucaagaaagaaaggacauccucaugaaauacgauaagggccaccgggccgggcugcccgaggacaaaggaccugaaccggucggcauuaauuccucuaucgaucgcuucgggauucuucaugagaccgaacugcccccuguuacagcgagagaggcuaagaaaauccggcgcgagaugacgagaaccagcaaguggauggaaaugcucggagagugggaaacauauaagcacuccucuaaacugauugaccggguguacaagggcauccccaugaacauccgcgggccuguguggagcguccuucugaauauucaggagaucaaacucaagaaccccggaagauaucagauuaugaaagagcggggcaagcgcuccucugaacauauccaccauauugaucuggacgugagaaccacacugcggaaucacguguuuuuccgcgauagauacggcgccaagcagcgggagcucuuuuauauccugcuugccuacagcgaauauaacccugagguuggguacugccgcgaccugucccacauuaccgcucucuuccugcuuuaccugccggaagaggaugccuuuugggcucucguccaacugcuggccagcgagagacauucucuccccggauuccacuccccuaauggcgggacagugcagggacugcaggaccagcaagaacauguugugcccaaaagccagccuaagaccauguggcaccaggauaaagagggccuuugugggcagugcgcgucucugggaugucuccugcggaaccuuaucgacggcaucucccugggccucacgcugagacugugggacgucuaucucguggaaggggagcaagugcugaugcccauuaccagcaucgcccuuaagguccagcagaaacgccugaugaagacaucucggugcggacucugggcuagacugcgcaaucaauuuuucgauaccugggccaugaacgacgauacaguucuuaaacaucugcgggcuuccaccaagaagcucacgagaaaacagggcgaccugccgccucccgccaagcgcgaacaggggagccuggcgccucggcccgugcccgccuccagaggaggcaaaacacucuguaagggguaccgccaggcuccuccgggacccccugcccaauuucagcggcccauuugcucugcuagcccucccugggccuccagauucagcaccccguguccuggcggcgccgugcgcgaggauacauaucccgucgggacccagggagugccuucucuggcucuugcgcagggcgggccccaaggauccuggcgguuucuggaguggaaaagcaugccuagacuccccaccgaccuggauaucggcgggccgugguucccucacuacgacuuugaauggucuugcuggguucgggccauuagccaggaggaucagcuggcuacauguuggcaggccgaacacugcggcgaggugcauaauaaggacauguccuggcccgaagagaugucuuucacggccaacagcuccaagaucgaucgccaaaaaguccccaccgagaagggagcuacaggccuuagcaaucucgggaacaccuguuucaugaacucuuccauccagugcgugagcaauacacagccucugacccaguauuuuauuucuggaagacaccuguacgaacucaaccggacgaauccgaucggcaugaaagggcauauggccaagugcuauggagaccugguucaagagcuuugguccggcacacagaaaagcguggcgccccugaagcucagacgcaccauugcuaaguacgccccuaaauucgacggguuucagcaacaggauucccaggaacugcuggccuuccuucucgacggccugcacgaggaucugaaccggguccacgagaagcccuacguggaacucaaagacucugauggaagaccugacugggaggucgcugccgaggcuugggauaaucaucugcgcagaaaccggagcaucauuguggaccuuuuucacggccagcugcgcucccaaguuaaguguaaaaccugcgggcauaucucugugagauucgaucccuuuaauuuccucagccugccucugcccauggacuccuauauggaucuugagaucacagucauuaagcucgacggaaccacaccggugcgguacggccugcgccugaacauggaugaaaaguauacggggcucaaaaagcagcugagagaccuuuguggacugaauagcgagcagauccuccuggccgagguucacgacucuaacauuaaaaauuuuccucaggauaaccaaaaggugcagcuguccgucagcggcuuccuuugcgcguuugaaauccccgugccuucuucccccauuagcgccucuagcccgacccagaucgacuucuccagcucuccuuccacaaaugggauguuuacccucacaaccaacggcgaucugcccaaaccuauuuucauccccaauggaaugcccaacacggugguuccuuguggcaccgagaagaauuucacaaacgggauggucaacggacacaugccgagccugcccgacuccccuuuuaccggcuacaucauugcugugcaucggaaaaugaugcgcacagaacucuauuuccugucuccccaggagaauagaccuagccuuuuugggaugccccugaucgugccuugcaccguccacacgcggaagaaggaucucuacgacgccguguggauucaaguuuccuggcuggcucgcccgcugcccccucaggaagccucuauccaugcgcaggauagagacaacuguaugggauaucaauaccccuucacacuucgggugguccagaaagauggcaauagcugcgccugguguccucaguacagauuuugccgcggguguaagauugacugcggcgaggaucgggcuuucaucggaaacgccuauaucgcuguggacuggcaccccaccgcccugcaucucagauaccagacaucccaagagcgcguuguggauaaacacgaaucugucgagcagagccggagagcccaggcugaaccgauuaaucuggacuccugccuccgcgcguuuaccagcgaggaagaacugggcgagucugaaauguauuacuguuccaagugcaaaacccacugucuugccacaaagaagcuggaccucuggcggcugccucccuuccugaucauucaucuuaaaagauuucaguucgugaacgaucaauggaucaagagccagaaaauuguucgcuuucugcgggagucuuucgaccccuccgcuuuucucgugccuagagaucccgcccugugccagcacaagccucucacgccgcagggggacgaacugagcaaaccccggauccuugcccgcgaggucaagaagguggaugcucaaucuuccgccggaaaagaggacaugcugcucagcaaguccccuagcucucugagcgcgaauaucuccucuagccccaaaggcuccccuucuagcuccagaaagucugggaccagcugucccuccagcaaaaacucuuccccgaauagcucuccucggacacugggacgcuccaagggcagacuucggcugccccagauuggcagcaagaacaaaccuuccucuagcaagaaaaaucucgaugcuuccaaggaaaacggggccggacagaucugcgagcuggccgacgcucucagcagaggccauaugcgcgggggaucucagcccgaacuggugaccccucaagaucacgaggucgcccuugcgaauggcuuccuguaugaacaugaggcuugugggaacggaugcggcgacggcuacuccaaugggcagcugggaaaccacagcgaggaagauucuacagacgaccagcgggaggauacccacauuaaacccaucuauaaccucuacgccauuagcugucauuccggcauccugucugggggacacuacaucacguaugccaagaauccgaacugcaaaugguacuguuauaaugacagcuccugcgaggaacuucauccugaugaaauugacacagauucugcuuacauccuguucuaugagcaacagggcauugacuacgcccaguuucuccccaagaucgaugggaagaaaauggcugacaccagcuccaccgaugaggacagcgaaucugauuaugagaaguacuccaugcugcaguga

SEQ ID NO: 77698 - RNA, 2538 nt, Artificial Sequence
  derived and/or modified sequence opt5 from USP6NL__Homo_sapiens__NP_001073960
augagaaccgaggccguggucaacagccagggccaaacagacuaccugacgaaggauuccgaccaggauguugcucucaaacuggcccaggaacgggcggagaucguggcuaaguaugaccgcgggagagaaggagccgagauugaacccugggaggaugccgacuaccuuguguauaaagucaccgaucgguucggcuuucugcacgaggaggaacucccugaccauaauguggcuguugaacgccagaagcaccuggagaucgagagaacaaccaaauggcuuaagaugcugaaggggugggaaaaauacaagaacacagagaaauuccaucggcgcauuuauaagggaaucccgcuccaacugagaggcgaagugugggcccugcuccuggagauucccaaaaugaaggaagagacccgggaucuuuacucuaagcugaaacaccgcgcuagagggugcagcccugacauccggcagaucgaucucgacgucaaucgcacauuuagagaucauauuauguuccgggaccgcuauggagugaagcagcagucccuguuucacguucuugccgcguacucuaucuacaacaccgaggugggcuauugucaaggcaugagccagauuacggcccugcuccugauguacaugaaugaagaggacgcuuucugggcccuggucaaacucuuuuccgggcccaagcacgcuaugcauggauucuuugugcagggcuucccuaaacugcuuagauuucaggaacaccaugagaagauccugaacaaauuccucucuaagcugaagcaacaccuugauagccaggaaauuuauaccuccuuuuacacaaugaaaugguucuuccagugcuuucuggaccggacccccuucacacucaaucugagaaucugggauauuuauaucuuugagggggagcgcgugcugaccgccaugagcuacacgauccucaagcugcacaaaaagcaucuuaugaaacugucuauggaggaacucgucgaguucuuucaagaaacacuggcgaaggacuucuuuuucgaagaugacuuuguuauugagcagcuucagaucuccaugaccgagcugaagcgggccaaacucgaucugccugaaccgggaaaggaggacgaauaucccaaaaagccucugggccagcuucccccugagcugcaaagcuggggcgugcaccaucuuucuaacggacagagauccgugggccgccccagcccgcuggcuucuggccggagagaguccggggccccucaccgccggcaugaacacagcccccacccucaguccagaacaggaacccccgagcgcgcucagcccccucggagaaaaucugucgaagaggaaagcaagaagcucaaagaugaggccgacuuccaacgcaagcugccguccggcccccaggauagcucucggcaguacaaucaugccgcugcgaaccaaaauuccaacgccaccagcaauauuagaaaagaguuugugccuaaguggaacaaacccucugacguuagcgcuacagaacggacggccaaguacaccauggaggggaagggacgcgccgcucacccugcccuggcggugacaguccccggcccggcugaagugagaguuuccaaugugcggccuaaaaugaaggcccuugacgccgaggaugggaaaagaggaucuaccgcuagccaguaugacaacguccccggcccugaacucgauuccggcgccagcguggaggaggcucuggaacgcgccuacucucagagcccccggcaugcgcuguauccucccuccccgagaaagcacgccgagccuucuuccagccccuccaaagucucuaacaaguucacauuuaaagugcagcccccuagccacgcucgcuacccgucccagcucgacggggaagccagaggacuggcucaucccccuucuuauagcaaucccccuguuuaccacggcaacucccccaagcauuucccuaccgccaauagcucuuucgcgagcccccaauuuuccccggggacgcagcuuaacccuucucggcgcccccacggauccacacugagcgugucugccagcccugagaaguccuauagcagacccucuccgcucguccugccuuccagccggaucgaagugcugcccguugauaccggcgcugggggcuacuccggaaauucuggcagcccuaaaaacgggaagcucauuaucccucccguggacuaccuccccgauaaucgcaccugguccgaggucucuuauacauacagaccggagacccagggacaaagcuggacacgggacgccucccgcggcaaccugcccaaauauucugcuuuccagcuggccccuuuucaggaucaugggcuccccgccgugagcguggacuccccuguuagauacaaggcuagccccgcggccgaagaugcuucuccuuccggauauccguacagcgggcccccucccccugccuaucacuaccggaaucgcgacgggcugucuauccaggaguccguccuucuguga

SEQ ID NO: 77699 - RNA, 3261 nt, Artificial Sequence
  derived and/or modified sequence opt5 from USP7__Homo_sapiens__NP_001273386
auggccggcaaccacagacuggggcucgaggcuggagacaccgaugaucccccucggaucacacagaauccggugauuaacggcaaugucgcccugagcgacgggcauaacacggcggaagaggacauggaagaugacaccuccuggcgcucugaggcuacauuccaauuuaccguugaaagauucagccggcuuuccgagucugugcugucucccccuugcuuugugcgcaaucuccccuggaagaucauggucaugccuagauucuaccccgaucggccucaccagaaauccgugggauuuuuccugcaguguaacgccgagucugacagcacauccuggagcugccaugcccaggcuguucuuaagauuaucaauuaucgcgaugacgaaaaaucuuuuuccagacggauuagccaccuguucuuucauaaggagaacgauuggggcuucucuaauuuuauggccugguccgaagugaccgacccggagaaaggguucaucgaugacgacaaggucacauuugagguguucguucaagcugaugcgccccacggaguggccugggacagcaagaaacacaccggcuacgucggccucaagaaccagggggccacguguuauaugaauagccugcugcagacccucuucuuuacaaaccagcugcgcaaagcuguguacaugaugccuaccgaaggagaugacuccagcaaguccgugccccuugcccugcaaagagucuucuaugagcuccagcauucugauaaaccuguuggcacaaagaagcugaccaagagcuuugggugggaaacgcuugacuccuucaugcagcacgaugugcaggagcugugccgggugcuccuggacaaugucgaaaacaaaaugaaaggaacauguguggagggcaccauccccaagcuguuucgcgggaaaaugguuagcuacauucaaugcaaggagguggauuauagaucugaccggcgcgaagauuacuacgacauccagcucuccauuaaaggaaagaagaauaucuucgagagcuuugucgacuauguggcuguuggccagcuggauggcgacaacaaauacgaugccggggaacauggacuucaagaggcggaaaagggcgugaaauuccugacacucccgccuguccugcaccuucagcugaugagauuuauguaugacccccagaccgaucagaacauuaagaucaaugaccgguucgaguuuccugagcaacucccccuggaugaauuucugcagaaaaccgaccccaaggauccugccaacuacauucuccacgcugugcugguccauucuggggacaaucacggaggccauuaugugguuuaccuuaacccgaagggggauggaaaaugguguaaguuugacgaugacguggucagcagaugcacaaaagaggaagccaucgagcacaauuauggcggccaugacgaugaccuguccgugcgccacuguacgaacgcuuacaugcucguuuacauccgggaaucuaagcugagcgaggugcuucaggccgucaccgaucacgacauuccccagcaacugguggagagacuccaggaagagaaacgcaucgaagcccagaagcggaaggagagacaggaggcucaucuguauaugcaagugcagauuguugcggaagaucaguucugcgggcaccagggaaaugacauguacgaugaggaaaaagucaaguauacaguguucaaagugcugaagaacuccagccucgccgaguuuguccaaucucugucccagaccaugggcuucccucaggaccaaauccgccuuuggcccaugcaggcucggagcaaugggacaaaaagaccugccaugcuggauaacgaagccgacggaaauaagaccaugauugagcucucugauaacgagaaucccuggacgaucuuucuggaaacaguggacccggagcuggcugccuccggcgcgacccuuccuaaguucgauaaagaccaugacguuaugcucuuucugaagauguacgaucccaaaacccgcagccugaacuauugugggcacaucuacacaccuauuuccugcaagauccgggaccuccugcccgugaugugcgauagagcuggcuucauucaggacaccucucuuauccuguaugaagaggucaaaccuaaucucacagaacgcauucaggauuacgacgugagccuggauaaggcccuggacgagcuuauggauggagacaucaucguuuuucaaaaagaugaccccgagaacgacaacuccgaacucccgacggccaaggaguacuuccgggaucuguaucacagaguggacgucauuuucugugauaagaccaucccuaaugaccccggcuucgugguuacacugucuaaccggaugaauuacuuucagguggcuaaaaccgucgcccagcgccucaacacagaucccaugcugcuucaguucuuuaagagccaaggguauagagacggaccuggcaauccgcugcggcauaacuacgaagggacccucagagaucugcugcaguucuucaaaccccgccagccuaagaaacuuuauuaccagcaacucaagaugaagauuacggacuuugagaaucggagauccuucaaaugcaucuggcugaacagccaguuucgcgaagaggagauuacccuguaucccgauaagcacggaugugugagagaccuccuggaagagugcaaaaaggcuguggaacuuggcgagaaagccucugggaagcugcggcuccuggagaucgucuccuacaagauuaucggcguucaucaggaagaugagcugcuugaaugucucagcccugcgacaucucgcaccuucagaaucgaggaaauuccccuggaccaaguggauaucgacaaagagaaugagaugcuggugacagucgcccacuuucauaaggaaguguucggaaccuuuggcauuccuuuccuccugcggauccaccagggggagcacuuucgcgaaguuaugaaacggauucagucccuucuggacauccaggagaaggaguucgaaaaauuuaaguucgcuaucgugaugaugggaagacaucaauacauuaacgaggaugaauaugaggucaaucucaaggacuucgaaccccagccgggcaacaugagccacccucgccccuggcuggggcuggaucauuuuaauaaagccccuaagagaucucgguacacguaucuugagaaagcuaucaagauucacaacuga

SEQ ID NO: 77700 - RNA, 3357 nt, Artificial Sequence
  derived and/or modified sequence opt5 from USP8__Homo_sapiens__NP_001122082
augcccgccguggcuagcgucccuaaggagcuguaccucuccucuagccugaaagaccuuaacaagaaaaccgaaguuaagccggagaaaaucuccacaaagucuuaugugcacagcgcccugaagauuuucaaaacggcggaagagugcagacucgaucgggacgaggagcgcgcuuacgugcuguauaugaaguacgucaccguguauaaucuuaucaaaaagagacccgauuuuaaacagcaacaggacuacuuccauuccauucugggcccugggaacaucaagaaggccguugaggaagccgagcggcucucugaaagccugaaacugcgcuaugaggaggcugaagugagaaagaaacucgaggaaaaggaucggcaggaggaagcccagcgccugcaacagaaaagacaggagacaggacgggaggacggcgggacccuugcuaagggaucccuggaaaauguccucgauagcaaagacaagacacagaagucuaacggcgagaaaaaugaaaagugugagaccaaagaaaagggggccauuacagcgaaagagcuguacaccaugaugacggauaagaacaucucccuuaucauuauggacgcccgcagaaugcaagauuaccaggacagcugcauccugcacucucucuccgugcccgaggaagcuauuagcccuggaguuaccgccucuuggaucgaggcucaucugcccgaugacuccaaggacacauggaaaaagcggggcaauguggaauaugucgugcugcucgauugguuuagcuccgccaaagaccugcagauuggcaccacacuucgcucucugaaggaugcccucuucaaaugggagagcaagaccgugcugagaaacgaaccucuuguccuggaagggggauacgagaauuggcuccuguguuauccgcaguacacgacaaacgccaagguuacacccccuccccggcgccaaaaugaagagguguccaucagccuggacuuuaccuauccuucucucgaagaguccauucccagcaaaccggcugcccagaccccucccgcuucuaucgagguggaugaaaacaucgagcugauuagcggccagaaugaaagaauggggccucuuaacaucuccacccccgucgagcccguggccgccucuaagagcgacguuuccccuauuauccaaccggugcccagcauuaaaaaugucccucagaucgaucggacaaagaaacccgcugugaagcugccugaggaacacagaaucaagucugaguccacgaaccaugaacagcagagcccccaaucuggaaaaguuauuccggaccgcuccaccaagccuguggucuucagccccacacucaugcugaccgaugaggaaaaagcgcggauccacgccgagacagcucuccugauggaaaagaacaaacaggagaaggagcucagagaacgccagcaggaggaacaaaaagagaagcugcggaaggaggaacaggagcagaaagccaagaaaaagcaggaagccgaggaaaaugagauuaccgagaaacaacagaaggcuaaggaagagauggagaaaaaggaauccgaacaggccaaaaaggaggacaaagagacgucugcgaagagaggcaaggaaaucacaggggugaaacgccagagcaaguccgagcacgaaaccucugaugcuaaaaagagcgucgaggaccggggaaaaagaugcccuacccccgaaauucaaaagaaguccacaggcgacgugccucauaccagcguuacaggcgauucuggguccggaaaacccuuuaagaucaaaggccagccggagagcgggauccugcgcacgggaaccuuccgggaggacacagaugacaccgaaagaaacaaggcccagcgcgagccucucacacgggccagaucugaagagaugggccggauugugcccgggcugcccuccggaugggcuaaauuucuugauccuaucaccggcacguuccgcuacuaucacagcccgaccaauacaguccauauguaucccccugaaauggcccccucuagcgcuccucccuccaccccucccacacacaaggccaaaccgcaaauuccugcggagagagaccgggagcccagcaagcugaagagaucuuacuccagcccugauaucacccaggccauucaggaagaggaaaaacgcaagcccacggugacaccgaccguuaaccgggagaauaaaccuacauguuaccccaaggcugagaucuccagacucucugccagccagauucgcaaccugaauccuguguuuggcggguccggacccgcucugaccggccuuagaaaccucgggaauaccugcuacaugaacucuauccugcaaugucugugcaaugcgccccaccucgcggacuauuucaaccggaauuguuaccaggaugacaucaaccgcagcaaucugcuuggacauaaaggcgaagucgccgaggaauuugggauuaucaugaaggcucuguggacaggccaguauagauacauuuccccuaaggauuucaaaaucacgauuggaaagaucaacgaccaguucgccggcuauucucaacaggauagccaggagcuccugcuguuucuuauggacgggcuccacgaagaccugaacaaagcugauaaucggaagcgcuacaaagaggagaacaaugaccaucuggaugacuucaaggccgccgaacacgcuuggcagaagcauaaacaacucaacgaguccaucauuguggcgcuguuucagggacaguucaagagcaccgugcaaugccuuacaugucacaaaaagucuagaaccuuugaagccuucauguaccugucccucccgcuggcuagcacaucuaaaugcacccugcaggauugccuucggcucuuuuccaaggaggaaaagcugacggacaauaaccgcuucuauuguagccacugcagagcccggcgcgauucucugaaaaagaucgagauuuggaaacuucccccuguucugcuuguccaucugaagagauuuuccuacgacggccgguggaaacagaagcuccagacaagcguggauuucccccuggagaaucuggaccuuucccaauaugugaucgggccuaagaacaaucucaaaaaguacaaccuguuuagcgucucuaaucacuauggaggccuggaugggggccauuacaccgccuauuguaaaaacgcugccagacagcgcugguucaaguuugacgaucacgaagugagcgacauuuccguuucuagcgugaaauccucugcggcuuacauccucuucuacaccagccugggaccccgggucacagacguggccaccuga

SEQ ID NO: 77701 - RNA, 7713 nt, Artificial Sequence
  derived and/or modified sequence opt5 from USP9X__Homo_sapiens__NP_001034679
augaccgccacaacgagaggaagccccgucgggggaaacgacaaccagggccaagcuccugaugggcagucccagccgccccugcagcaaaaccagaccucuagcccugacuccucuaaugagaacucccccgccacaccucccgaugaacagggacagggcgacgcgccuccccaacucgaggaugaagaacccgcuuucccucacaccgaccuggccaaacuugaugacaugaucaaucggccccgcugggugguuccugugcugcccaagggggaacucgaggugcugcuugaggccgcuauugaucuguccaagaagggacucgacgucaagucugaagccugccagagauuuuuccgggauggccugacaaucagcuuuaccaagauucugacagacgaggcuguguccggcuggaaguucgaaauccaccgcuguauuaucaacaauacccacagacucguugagcugugcguggccaaacuuagccaggauugguuuccgcugcucgagcugcuugcgauggcccugaacccucauuguaaauuccacaucuacaaugggacgcggcccugcgaaucugucuccagcucugugcagcucccugaggacgaacuguuugcucgcucccccgaccccagaagcccuaagggauggcugguugaucuccugaacaaguucggcacccuuaauggguuucaaauucugcaugaccgguucaucaacggaucugcccucaaugugcagauuaucgcugcccugauuaagccguuuggccaguguuaugaguuccuuacacugcacaccgucaaaaaguacuuucuccccaucauugaaauggugccucaauuccuggagaaccugacagaugaggaacucaagaaagaggcgaagaaugaagccaaaaacgacgcucuguccaugaucaucaagagccuuaaaaaccuggccucccgcgugcccgggcaggaggaaaccgucaagaaucucgagauuuucagacugaaaaugauccuucggcugcuccagauuucuagcuuuaacggaaagaugaaugcucugaacgagguuaauaaggugaucuccagcgugucuuauuacacgcaccgccauggcaacccugaagaggaagaguggcugacagccgaaagaauggccgaguggauucagcaaaauaacauccucuccaucguccugcgggauagccuucaccagccccaguauguggagaaacuggaaaagauucuccgcuucguuaucaaagagaaggcucugacccugcaggaccuugauaauauuugggcggcccaagcuggcaaacaugaagccaucgugaagaacguccacgaccuccuggccaagcuggcuugggauuuuucuccggagcagcucgaccaccuguucgauugcuuuaaagccagcuggacaaaugcguccaagaaacagagagagaaacuucuggaacucauucggagacuggcugaggacgacaaagauggggugauggcccauaagguucugaaccuucucuggaaucuggcccacucugacgaugugccugucgacaucauggaucuggcucucagcgcccauaucaagauucuggacuacuccuguagccaggaucgcgacacccagaagauccaguggauugaucgguucaucgaagaacuuagaaccaacgacaagugggugauucccgcucugaaacagauccgcgaaauuugcucucucuuuggagaggccccucagaaucugucccaaacacagcggagcccccacgucuucuauagacaugaucugaucaaccagcuucaacacaaccacgcgcucgugacgcugguugccgagaaucuggcuaccuacauggaaucuaugcgccucuacgcccgggaccaugaggauuaugacccucagacagugagacugggcucccgcuacagccacguccaggaagugcaggagcggcuuaacuuucugagauuccuccugaaggacgggcaacuguggcuuugugcuccccaggccaaacagaucuggaagugccucgcggaaaaugccguuuaucugugugaucgcgaggcuugcuuuaagugguacuccaaacugaugggagacgagccggaucucgacccugauauuaacaaggacuucuuugaaucuaaugugcugcagcuugaucccagccugcucaccgagaacggcaugaaaugcuucgaacgguucuuuaaggccgucaauuguagagaggggaaacugguggcuaagcggcgcgccuauaugauggacgaucuggaacuuaucggacuggacuaccucuggagagugguuauucaauccaacgaugacaucgccucucgggcuauugaucugcucaaagagaucuauacaaaucugggccccagacuucaggucaaccagguggugauccaugaggacuucauucagagcugcuuugaccgccugaaggcguccuacgauacccucuguguccuggacggcgauaaggacagcgugaauugcgcccggcaagaagcuguuagaauggugcgcguccugacggugcuuagagaguacaucaacgaaugugauucugacuaucacgaggagcggacaauucugccuaugucccgcgccuucagagggaaacaccucagcuuuguugugcgguucccgaaucagggacgccaggucgaugaccuggaaguguggucucauaccaacgauaccaucggcuccguuagacggugcauucucaaucgcaucaaggccaacguggcucacacaaaaaucgagcuguuugucgggggagaacuuauugaccccgccgaugacagaaagcugaucggccaacucaaccugaaagacaagagccugauuaccgcgaaacuuacacagaucucuagcaauaugccuuccagccccgauucuuccagcgacuccucuacggggagcccuggcaaccauggaaaucacuacuccgauggccccaacccugagguggaaucuugucugcccggggugauuaugagccuccauccgcgguauaucuccuuccuguggcaggucgcugaccucggaucuagccugaauaugccuccccuucgcgauggcgccagaguucugaugaaacugaugccucccgacuccaccacaaucgagaagcuccgggccauuugccuggaucacgcuaaacuuggggagagcucucuguccccgagccucgacucucuguuuuucggaccuuccgccagccaggugcucuaccugaccgaaguggucuaugcgcuucugaugcccgcuggcgccccucuggccgaugacucuuccgauuuucaauuccacuuucucaagagcgggggccugccccuugugcuguccaugcucacaagaaacaauuuccugcccaacgcugacauggagacccgccggggagccuaccucaaugcucugaaaaucgccaaacuucugcugacggcgauuggcuaugggcauguuagagccguggcugaagccugucagccuggagucgagggcgugaacccgaugacccagaucaaucagguuacacacgaucaagcugugguccuccagagcgcccugcagucuauucccaacccuagcuccgaaugcaugcuucgcaaugugucuguucggcuggcccagcaaaucagcgacgaggcuuccagauacaugcccgacauuugugugauccgcgcgauccagaagauuaucugggccucugggugcggaagccuccagcuggucuucuccccuaacgaggaaauuaccaaaaucuacgagaagacaaaugcuggcaacgaacccgaucucgaggacgaacaggugugcugugaggcccuggaggugaugacccuuugcuuugcccugauuccuacggcucuggaugcccucucuaaagaaaaggcguggcaaacauucaucaucgaccugcuucugcauugucacagcaaaaccguccggcagguugcucaggagcaauuuuuccucaugugcacaagauguugcauggggcaucgcccgcugcuguuuuucauuacccuccuuuuuaccgugcugggcuccacagcccgggaaagagccaagcacagcggagauuauuucacgcugcuccggcaucugcuuaacuacgcuuauaauucuaacaucaaugugcccaacgccgagguccugcucaauaacgagauugacuggcugaagcgcaucagagaugacgugaaacggaccggcgaaacagggauugaggaaaccauccuggagggacaucucggcguuacaaaggaacuucuggcguuucagaccuccgagaaaaaguuccacaucgggugugagaaaggaggcgcuaaucugauuaaggaacucaucgaugacuuuauuuucccugccagcaacguguaccugcaguauaugcgcaauggggagcuucccgccgaacaggcuaucccugucugcggcucucccccgacgauuaacgccggauucgagcugcucguggcucuggccguuggcugugugagaaaucugaaacaaaucgucgauucccucacagaaauguacuauauugggaccgcgaucaccacaugcgaggcccuuaccgagugggaauaccugccucccgugggaccccggccucccaagggcuuugucgggcugaagaacgcuggagccacauguuacaugaauagcgugauccagcagcucuauaugauuccuuccaucagaaacggcauucuggcuaucgagggcacggggucugacguugaugacgacaugagcggagaugaaaaacaggacaaugaguccaacguggauccgcgcgacgaugucuucggcuacccccaacaguuugaagacaagccugcccuuagcaaaaccgaggaucggaaggaguauaauauuggggugcugagacaucuccagguuaucuucggacaccuggccgcuucucgccugcaguacuaugugccccggggcuuuuggaaacaauucagacucuggggagagccugucaaccuucgcgagcagcacgacgcgcuggaauuuuucaacucccugguggauagccucgacgaggcccugaaggcucuugggcaucccgccaugcugucuaaggugcucggcggcagcuuugccgaucagaaaaucugccaagggugcccgcaccgguacgagugugaagaguccuucacaacccugaauguugacauuagaaaccaucagaaucugcucgacucucuugaacaguaugucaagggagaucugcuggagggcgcuaacgccuaccacugcgaaaaauguaauaagaaaguggacacagugaagcgccuccugaucaagaaacuuccucccguccuggcgauucagcucaagagauuugauuacgacugggagcgggagugcgcuaucaaauucaacgauuauuuugaguucccucgcgagcuggacauggaacccuacaccguggccgggguugccaagcuggagggagauaaugugaacccugaaagccaacucauucagcaguccgagcagucugagagcgaaacggcuggcuccaccaaauauagacuugucggggugcugguucauagcggacaagccucuggcggccacuacuauuccuacaucauccagcggaaugggggagacggcgagcgcaacagaugguauaaguucgaugacggggaugugacagaauguaagauggacgaugacgaggaaaugaaaaaucagugcuuuggaggcgaguacaugggggaggucuucgaccacaugaugaagcggaugagcuacagacgccagaaacggugguggaacgcguauauucuguuuuacgaaagaauggauaccaucgaccaagaugacgagcucauucgcuauaucuccgaacuggccauuacaacccggccccaucagaucauuaugccgucugcuaucgagagaagcgugcggaagcagaauguucaguucaugcacaaccgcaugcaauacuccauggaguauuuucaguucaugaagaaacuucugacauguaauggaguguaccucaacccuccgcccggccaggaucaucugcugccugaagccgaggaaaucaccaugauuucuauccaacucgcugccagauuucuuuucacgacaggcuuucacaccaagaaagucgugcgggggagcgcuuccgacugguaugaugcccugugcauucugcuccgccacagcaagaacgugagauucugguuugcgcauaauguccuguucaacguuucuaaucgguuuuccgaguaccuucuggaauguccgagcgccgaggugcgcggagcuuucgccaaacucaucguguucauugcucacuuuucucugcaggacggccccugcccuucccccuucgccagcccugggcccucuagccaggccuacgauaaccugucccucucugaccaucuucugagagcuguccugaaucuccugcggcgcgaggugagcgaacacggaagacaucuucagcaauauuuuaaccuguucguuauguacgcgaaucucggcguggccgagaagacccagcugcugaaacucuccgucccugcuacauuuaugcuugugagccuggaugaagggccgggacccccuaucaaguaucaguacgccgagcugggcaaacucuauuccguugugucucagcugauccgguguugcaacgucagcuccagaaugcaaucuagcauuaauggcaaucccccucuucccaauccguucggggacccuaaccugucccagcccaucaugcccauucagcagaauguggccgacauccucuuuguccgcaccucuuacgugaagaagauuaucgaagauugcagcaacuccgaggagacgguuaaacugcugcgguucuguugcugggaaaauccucaauuuagcucuacagugcucuccgagcugcuuuggcaaguggcuuauagcuacaccuacgaacugagacccuaucucgaccugcuucugcagauccuccugauugaggauucuuggcaaacacaccgcauccacaacgcccugaagggcauuccugacgaucgggacggccucuucgauaccauccagagauccaaaaaccauuaccagaagcgcgcguaucaguguauuaaaugcauggucgcccuguuuagcaauuguccgguugcuuaccaaauccuucaggggaacggagaccugaagcggaaguggacaugggccguggaauggcucggcgaugagcuggagagacgccccuauaccgggaauccucaguacacguauaacaauuggucucccccugugcaguccaacgaaaccagcaauggauacuuccuugagcggucccacagcgcuagaaugacacuggccaaagcgugcgaacucugucccgaggaggucaagaaagccaccucugugcaacagauugaaauggaggaaagcaaggagccggacgaucaggacgcuccugaugaacaugagucucccccucccgaggacgccccucuguacccccacagcccgggcagccaguaucaacagaacaaucacguucauggccagccuuacacagggcccgcugcccaccauaugaacaauccccaacgcaccggacagcgggcucaggaaaacuaugagggcuccgaagaggugucuccuccgcagacgaaagaccaauga

SEQ ID NO: 77702 - RNA, 7668 nt, Artificial Sequence
  derived and/or modified sequence opt5 from USP9Y__Homo_sapiens__XP_011529771
augacagccaucacacacggcagccccguugggggcaaugauucccagggccaagugcuggaugggcagucucagcaucucuuccagcaaaaucagacgagcuccccugacucuagcaaugaaaauagcguggcuaccccgcccccugaggaacagggacagggcgaugcgcccccucaacacgaagacgaggaacccgcguuuccucacacagagcuggcuaaccuugaugacaugauuaaucgcccgcgguggguggugcccgugcugccuaagggggagcucgaagugcugcuugaggccgccaucgaucugucuguuaagggacucgacgucaagagcgaggcuugccagcgcuucuuuagagauggccugaccauuuccuucacaaaaauccugauggacgaagccgucagcggcuggaaguuugagauucaccgguguaucaucaacaauacccaucgccucguggaacugugcguugcuaaacuuucucaggauugguucccccugcucgagcugcuugccauggcccugaacccucacuguaaguuucacauuuacaaugggacacggcccugcgaacucaucuccagcaacgcccagcugccggaggacgaacuguucgcucggucuuccgauccucgcagccccaagggauggcucguggaccugauuaauaaauuuggcacccuuaacggguuccaaauccugcaugacagauuuuucaauggaucugcccucaacauucagaucauugcugcccugaucaagccuuuuggccaguguuaugaguuccuuucccaacacacgcugaaaaaguacuucauccccgucauugagaucgugccccaucuccuggaaaaucugaccgaugaggaacucaaaaaggaggcgaagaacgaagccaaaaacgacgcucugagcaugauuaucaagucccuuaaaaaucuggccucucggauuagcgggcaggaugagacaaucaagaaccucgagaucuuucgccugaaaaugauucuuagacugcuccagaucuccagcuucaauggaaagaugaacgcucugaaugaaauuaacaaagugaucucuuccgucagcuauuacacccaccggcacucuaauccugaggaagaggaauggcugacagccgagcgcauggccgaguggauucagcaaaacaauauccucagcaucguucugcaggacucccuucaucagccgcaguauguggaaaagcuggagaagauucucagauuugugaucaaagaaaaggcucugacccugcaagaucuugacaacauuugggcggcccaggcuggcaaacacgaggccaucgucaagaaugugcaugaucuccuggccaaacuggcuugggacuucucucccggccagcucgaucaccuguuugacugcuucaaggccagcuggacgaacgcguccaagaaacagcgggagaaacuucuggaacucauucgcagacuggcugaggaugacaaagacgggguuauggcccauaaggugcugaaucuucucuggaaccuggcccaaagcgaugacgucccuguggauaucauggaccuggcucucucugcccacauuaaaauccuggauuacuccuguagccaggaccgggaugcucagaagauccaguggauugaccacuuuaucgaggaacuuagaacaaaugauaaguggguuauucccgcccugaaacaaauccgcgaaauuugcucucucuucggagaggcgucccagaaccugagccagacccaacgguccccucauaucuuuuauagacacgaccugaucaaccagcuucagcagaaucaugcccucgugacacuggucgcugagaaccuggccaccuacaugaacucuauucgccucuacgcuggcgaucacgaagacuaugauccccaaaccgugcggcuggggagcagauacucccacguccaggaggugcaggaacgccuuaacuuccugcgguuucuccugaaggacggacagcuguggcuuugugccccgcaagcgaaacagaucuggaagugccucgccgagaaugcuguuuaucugugugacagagaagccugcuucaaaugguacucuaagcugaugggcgaugagccugaccucgaucccgacauuaacaaggacuuuuucgagagcaaugugcugcagcuugacccuucccugcucacagaaaacgggaugaaaugcuucgagcgcuuuuucaaggcugucaauugucgggaaagaaaacugaucgccaagcgccggagcuauaugauggaugaccuggagcuuauuggacuggauuaccucuggagagugguuauccagucuuccgacgaaaucgccaaccgggcuauugaucugcucaaagagaucuauacgaaucugggcccccgccuuaaggcgaaccaaguggucauucaugaggacuuuauccagagcugcuucgauagacugaaagccucuuacgacacccucuguguguuugacggcgauaaaaauuccauuaacugcgcucggcaggaagccaucagaauggugcgcguucugacagucaucaaggaguacauuaaugaaugugacagcgauuaucacaaagagcggaugauccugccuaugucuagagccuuccgcgggaagcaucuuagccugauugugagauuucccaaccaaggaagacagguggacgagcucgauaucuggucccacaccaacgacacaauuggcagcguccgcagaugcaucgugaaucggauuaaagcuaacguugcccauaagaaaaucgaacuguucgucgggggagagcucaucgauucugaagacgaucgcaagcugauuggccagcuuaaucugaaggacaaaucccucaucaccgcgaagcugacgcagauuaacuuuaauaugccgagcuccccugauucuagcuccgacucuagcacagcuucccccgggaaccacagaaaucacuacaacgacggccccaaucuggaggucgaaucuugucuuccuggagugaucaugagcguucauccgcgguauauuuccuuccuguggcaaguggccgaucucggcagcaaccugaauaugcccccucuccgcgacggggccagaguccugaugaaacuuaugcccccugaucggaccgcuguggagaagcugcgcgccguuugccuggaccacgcgaaacucggagagggcaagcugucucccccucuugauucccuguuuuucgggcccagcgcuucucaggugcucuaccugaccgaagucguguaugcccuccugaugccggccggagugccucuuacagacggcuccagcgauuuucagguccauuuccugaagucugggggccugccccucguucuguccaugcuuaucagaaacaauuuccugccuaacaccgacauggagacacggagaggagcuuaccucaaugcccugaaaaucgcuaagcuccugcuuacggccauuggcuaugggcacgugcgcgcgguggccgaggcuugucagcccgucguggauggaaccgacccgaucacacaaauuaaccagguuacccaugaucaggccgugguccugcagagcgcucugcaauccaucccuaaccccagcucugagugcgugcuccggaaugaaagcauucugcuugcccaggagaucuccaacgaggccucuagauacaugccugacaucuguguuauucgcgcuauccagaaaauuaucugggcgagcgccugcggcgcucuggggcucguguuuucccccaaugaagagauuacaaagaucuaccagaugaccacgaacggaucuaauaaacuggaagucgaggaugaacaagugugcugugaggcccucgagguuaugacccugugcuucgcccuucugcccacagcucuggacgcccucagcaaggaaaaggcguggcagaccuuuauuaucgaccugcuucugcacuguccuuccaaaacagugcggcagcucgcucaagagcaguucuuucugaugugcaccagauguugcaugggccaccgcccgcugcuuuucuuuaucacgcuucuguucacaauucuggggucuaccgcccgggaaaagggcaaauauagcggagauuacuuuacacuccugagacaucuucugaacuaugccuacaauggcaacaucaauauucccaacgcugagguccuccugguguccgagaucgacuggcugaagcgcauucgggauaaugugaaaaacaccggggaaaccggagucgaggaaccuauccucgagggccaccuugggguuacaaaggaacugcuggccuuccagacgagcgagaaaaaguaucauuuuggaugugagaagggcggggcgaaucucaucaaagaacugauugacgauuucaucuuccccgcuucuaagguguaccuucaguaucugagauccggcgagcucccugccgaacaagccauucccgugugcagcucuccugucaccaucaacgcuggauuugagcugcugguggcccucgcuauuggcuguguucggaaucuuaaacagaucguggacugccugacagaaauguacuacauggggaccgccaucacaaccugugaggcgcugacggagugggaauaucucccgcccgucggaccuagacccccuaagggcuucguggggcugaaaaacgccggagcuacaugcuacaugaacuccguuauucagcagcuuuauaugauccccagcauuagaaacuccauccuggccauugagggcaccggcucugaucuccacgacgauauguuuggggacgaaaagcaagauagcgaguccaacguggacccgcgggaugacgucuucggauacccucaccaguuugaagacaagcccgcucugagcaaaaccgaggaucgcaaggaguauaauaucggcgugcugagacaucuccaggucauuuucgggcaccuugccgccucucagcugcaauacuaugugccccggggauuuuggaaacaguucagacuguggggcgaaccuguuaaccuccgcgagcagcaugacgcucuggaauuuuucaauucccuuguggauagccuggacgaggcgcucaaggcccuggggcaccccgcuauccugucuaaaguccucggaggcagcuuugccgaucaaaagaucugccagggcuguccucaucgguacgagugcgaagaguccuucacaacccuuaacguggacauuagaaaucaccagaaccugcuggauucucucgaacaguacaucaagggggaccugcuugagggagccaaugcuuaucacugugaaaaaugcgauaagaaaguugacacagugaagcgccugcucauuaaaaagcugccgcggguccuggccauccaacucaagagauuugauuacgacugggagcgcgagugugcgauuaaauucaacgacuauuucgaauuuccccgggagcuugauaugggcccuuacacgguggcugggguggccaaucuggaaagagacaacguuaauagcgagaacgaacugaucgagcagaaggagcaguccgauaaugaaaccgccggaggcacaaaauaucgccucgucggggugcuggugcauucuggacaggcuagcggcggccacuacuauuccuacaucauucaaagaaacgggaaggacgaucagaccgaccauugguacaaauucgaugacggagaugucacagagugcaagauggacgaugacgaagagaugaagaaucaguguuuuggcggggaauauaugggagagguguucgaucacaugaugaaacggaugagcuaccgcagacagaagcggugguggaacgccuauauccucuuuuacgagcaaauggacaugauugacgaagaugacgagaugauccgcuauauuucugaacugaccaucgcgagaccccaccagaucauuauguccccugccaucgagcggagcguuagaaaacagaacgugaaguucaugcauaaucgccuccaguacucccuggaguauuuucaauucgucaaaaagcugcucacgugcaacggcguguaccuuaaucccgcuccggggcaggauuaccugcugccugaagccgaggaaauuaccaugaucucuauucagcucgcugcccgguuucuguucacaaccggauuucacaccaagaagaucguuagaggccccgcuagcgacugguaugaugcccuuugugugcugcuccgccauuccaagaacguccgguucugguuuacccacaaugugcuguucaacguuucuaauagauucagcgaguaccugcucgaaugcccuuccgcggaggugcggggcgccuuugcuaaacuuauugucuucaucgcccauuuuagccugcaagacgggucuugucccuccccuuucgcuagccccggaccgucuucccaggccugcgauaaccugagccucucugaccaucugcuucgcgccacacugaaucuccugagacgggaggugagcgaacacggccaccaucugcagcaguauuuuaaccucuucgugauguacgcuaaucuuggggucgcggagaagacccaacugcugaaacucaacguuccugccacguuuaugcuggugucccuugaugaaggacccggacccccuaucaaguaucaguacgcugagcuggggaaacucuauucuguggucagccagcugauucgcugcuguaauguguccagcacaaugcaguccucuaucaacggaaauccgccccugccuaaccccuucggcgaccucaaccugagccaaccuauuaugcccauccagcagaauguucuugauauucuguuugugagaaccuccuacgucaagaagaucaucgaagacugcucuaacagcgaggacaccauuaaacuccugcgguucuguuccugggagaauccucaguuuucuagcacagugcuuuccgaacugcucuggcaaguugccuacagcuauaccuacgagcugcgcccguaucuggaucuccuguuccagauccuucugauugaagacucuuggcagacgcauagaauccacaacgcccucaagggcauucccgaugaccgggaugggcuguuugacacaauccaacgcuccaaaaaucacuaccagaagagagcuuaucagugcaucaaauguaugguggcccuuuucagcucuugcccugucgcguaccagauucugcaaggaaacggcgaucucaagcggaaguggaccugggccguggaguggcugggggacgaacuggagagacgccccuauacaggaaauccucaguacuccuacaacaauuggucucccccgguccaguccaacgagaccgcuaauggcuauuuccucgaacggucccauagcgccagaaugacacuggcuaaagccugugagcuuugcccugaagaggagcccgaugaccaggaugcgcccgacgaacacgagccuucccccagcgaagaugccccucuguacccgcauucucccgcuagccaauaucagcagaacaaucacgugcaugggcagccuuacaccggacccgccgcucaccaccucaacaauccucaaaagacgggccagcgcacccaggagaacuaugaaggcaacgaggagguuuccucuccccaaaugaaagaccaguga

SEQ ID NO: 77703 - RNA, 3279 nt, Artificial Sequence
  derived and/or modified sequence opt5 from USPL1__Homo_sapiens__NP_005791
augauggacagccccaagaucggcaacgggcugccugugauuggaccgggcaccgauaucgggauuuccucucuccacauggucggauaccugggcaaaaauuucgacagcgccaagguucccuccgaugaguauugcccugcuuguagagaaaaagggaagcugaaagcccugaagacauaccggaucucuuuucaggagagcauuuuccucugcgaagaccugcaauguaucuauccccuuggauccaagucucugaacaaucucaucagcccugaucuggaggaaugccauacgccccacaaaccucagaagcgcaaaucccuggagagcucuuacaaggacucccuccugcuugcgaacagcaaaaagaccagaaauuauauugcuaucgauggcggcaaggugcugaacucuaaacauaauggggagguguacgacgaaacauccagcaaccucccggauucuuccggacagcagaaucccauucggaccgccgacagccuggagcgcaacgaaauccuugaggccgauacagucgacauggcuaccacaaaggauccugccaccguggacguuuccggcacggggagacccucuccucaaaaugagggauguaccagcaaacuggaaaugccccucgaguccaagugcaccagcuuuccgcaggcucugugugugcaguggaaaaacgccuaugcgcugugcuggcucgacuguauucugucugcccuuguccacuccgaggaacugaagaauacagugacaggccucugcagcaaagaagagucuaucuucuggcggcugcuuaccaaguacaaccaggcuaauacgcugcucuacacaagccaacuguccgggguuaaggauggagacuguaaaaagcugaccucugagauuuuugccgaaaucgagacaugccucaacgaagugcgcgaugagaucuucauuagccugcagccucagcuuagaugcacccugggcgacauggaaucccccgucuuugcuuucccucuccugcuuaaacuggagacccauaucgagaagcucuuucuguauagcuucucuugggauuuugaauguucccagugcggccaccaauaccagaaccggcacaugaaaagccuggugacauucacgaaugugauucccgaguggcauccccucaacgccgcgcacuuugggccuuguaauaacugcaauucuaagucccagauccgcaagaugguccuggaaaaaguuagcccgauuuucaugcuucauuucguggagggacugccccaaaacgaccuccagcacuaugccuuucacuucgaaggcugucuguaccagaucaccuccgugauccaguauagagcuaauaaccauuuuauuacauggauccuggaugccgacgggucuuggcuugagugcgaugaccucaagggaccuuguagcgagcggcacaaaaaguucgaaguccccgcuuccgagauucauaucgugauuugggaacgcaaaaucucucaaguuaccgauaaggaggccgccugccugccucugaagaaaacaaaugaccagcacgcucucagcaacgagaagcccgugucccugaccagcuguucugucggcgacgcggccuccgcugaaacggccagcgugacacauccgaaagauaucucuguugccccuagaacccuuucccaggacaccgcugugacacacggggaucaccuucucagcggacccaagggccuggucgacaauauucugccucuuacccucgaggaaacaauccagaaaacggccucugugagccaacugaacuccgaggcguuucugcucgaaaauaagcccgucgcugagaacaccggcauucugaagacaaauacccuucugagccaggagucucucauggccuccagcguguccgccccuugcaacgaaaaacugauccaggaucaguucguugacauuucuuuucccagccaaguggucaacacaaauaugcaguccgugcagcugaacaccgaggauacgguuaauaccaagucugugaacaauacagacgcuaccgggcuuauccagggagucaaaagcguggaaauugagaaggaugcccaacucaaacaguuccugacaccgaagaccgaacagcugaaaccugagcgggugacgucccaaguuucuaaccucaagaagaaagagacaaccgcugacagccagacaaccaccuccaagagccugcagaaucagucucuuaaagaaaaccaaaagaaacccuuugucggcuccugggugaaggggcugaucagccgcggagccucuuucaugccccucuguguguccgcgcauaauagaaacacaaucacggaucugcagccuagcgucaagggcgugaauaacuuugggggcuucaaaaccaagggaauuaaucagaaagccucucacguuuccaagaaagcuagaaagagcgccuccaagccgcccccuaucagcaaacccccugcugggcccccuucuagcaacggcacagccgcgcauccccacgcccacgcugccuccgaggugcuggaaaagucuggaagcaccuccugcggcgcucagcuuaaucauucuagcuacgggaacggaauuuccucugccaaccacgaggaccucgucgaaggccaaauccauaaacugcggcugaagcuccgcaaaaagcugaaggccgagaaaaagaaacuugcugcgcugaugagcuccccgcagagccggacagugagaucugagaaucucgaacagguuccucaggaugggucccccaacgacugcgagagcauugaagaccugcugaaugagcuuccuuaucccaucgauaucgccucugaguccgcuuguaccacggugccgggcgucagccuguacuccucucaaacacacgaagagauucucgccgaacugcucagcccuacccccguguccaccgagcugagcgaaaacggagagggcgacuuucgcuaccuugggaugggagauucucauaucccuccucccguucccuccgaguucaaugacgugagccagaacacacaucugcggcaggaucacaauuauugcucuccgaccaagaaaaaccccugugaaguccaaccugacagccucacaaauaacgccugcgugagaacgcugaaucuggagucccccaugaagaccgauauuuucgacgaauuuuucucuagcuccgcucuuaacgcccuggcgaaugauacacucgaccugccucacuuugaugaguaccucuucgaaaacuauuga

SEQ ID NO: 77704 - RNA, 1221 nt, Artificial Sequence
  derived and/or modified sequence opt5 from UST__Homo_sapiens__NP_005706
augaagaaaaagcagcaacaccccggcgggggagccgacccuuggccgcauggcgcucccaugggcggagccccucccggccuggggagcuggaaaagacgggugccucuccugcccuuccuucgcuuuucccugagagauuacggauucugcauggcgacccuccuggucuuuugucuuggcucucugcucuaucagcugagcggcgggccuccgcgguuccugcucgaccugcgccaguaccuuggaaacuccacauaucuggaugaccacgggcccccucccucuaagguucucccuuuucccagccaggugguguacaauagagucgggaaaugcggaucccggacggugguucugcuucugcgcauccucucugagaagcauggcuucaaccuggugaccagcgauauucacaauaagacaagacugaccaaaaacgaacaaauggagcucaucaagaauauuuccacagcugaacagccguaucuguuuacccggcauguccacuuccuuaacuuuagccgcuucgggggagaccagccuguguacaucaauauuaucagagaucccguuaaccgguuucugucuaauuauuucuuucgcagauucggcgacuggcggggcgagcagaaccacaugauccgcacaccuuccaugagacaagaagaacgguaccucgauauuaaugaguguauccuggaaaacuaccccgagugcagcaaucccagacuuuucuauauuaucccuuacuuuugugggcagcauccgcgcugccgggaacccggagagugggcccuggagagagccaaacucaacgugaaugaaaacuuccugcuggucggcauucucgaggaacuggaggacgugcuucugcuccuggaacgcuuucuuccucacuauuucaagggggugcugucuaucuacaaagaucccgagcaucggaagcucggaaacaugaccgucacgguuaagaaaaccgugccuucccccgaggcugugcagauucuguaucagagaaugcgcuacgaauaugaguuuuaccacuacgucaaggaacaauuccaucugcucaaacggaaguuuggccugaaaagccacgugucuaagccgccucuuagaccccacuucuuuaucccuacaccccuggagaccgaggagccuaucgacgaugaggaacaggacgacgagaaauggcucgaagauauuuauaagcgcuga

SEQ ID NO: 77705 - RNA, 1026 nt, Artificial Sequence
  derived and/or modified sequence opt5 from UTF1__Homo_sapiens__NP_003568
augcugcucagaccccggcgcccuccgccccuggccccucccgcuccucccagcccugccuccccggaccccgagccuagaacccccggcgaugcgccugggacacccccgcggcgcccugcuucucccagcgcccuuggagaacugggccucccugugucccccgggucugcccagagaacgcccuggagcgcucgggagaccgaacugcuucugggaacacuccugcaaccugccgucuggcgcgcucugcuccuggacagacggcaggcccuuccgaccuaccgcagaguuuccgcggcccuggcucagcagcaagugcggcgcacacccgcccagugcagacggcgcuauaaguuccucaaagauaaguuuagagaggcucacggccagccucccgggccuuucgacgaacagauccggaaacugaugggacuucugggcgauaacggcagaaagcgcccccggagacgcucuccggggagcggacggccucaaagagcccgccggcccgugccuaaugcgcaugcccccgcuccuuccgagcccgacgccaccccgcucccuacagcuagagaucgcgacgccgaucccaccuggacgcugcgguuuagccccucuccuccgaaauccgccgacgcuagccccgcgccuggcucucccccugcccccgcuccuaccgcccuggccacauguauucccgaggauagagcuccgguccgcgggccuggaucccccccucccccgccugcccgggaagaccccgauagcccucccggcagacccgaggacugcgcgccuccgcccgcugccccucccucucucaacaccgcccugcuucagacacuggggcaccucggagacaucgcuaauauucugggcccucuucgggaucagcugcucacccugaaccagcauguggaacaacugcgcggcgccuucgaccagacgguuucccucgcugugggguuuauccugggaagcgccgcggccgagagaggcguccuucgggaucccugucaguga

SEQ ID NO: 77706 - RNA, 2160 nt, Artificial Sequence
  derived and/or modified sequence opt5 from UTP14A__Homo_sapiens__NP_001159693
augaccgccaacagacuggcugagagccuccuggcccuuucccagcaagaagaacuggcggaccuccccaaggauuaccugcuuucugaaagcgaggacgaaggcgauaaugacggggagcggaaacaccagaagcugcucgaggcuaucuccucucuggauggcaaaaaccgcagaaagcuggccgaacggagcgaggccucccucaaagugucugaguucaaugucagcuccgagggaagcggggagaagcugguucuugcugaccugcucgaaccugugaagacaucuuccagccuggccacggugaaaaagcagcuuucucgcgucaaauccaagaaaaccguggagcugccgcucaacaaggaagagauugaaagagcucggacaccccuggagcaggagaucuuuaaucugcuccauaagaacaaacaaccuguuaccgauccccugcuuacaccuguggaaaaggccagccugcgcgcgaugucucucgaggaagccaaaaugagacgggcugagcugcagcgcgccagagcccuucaguccuauuacgaagcuaaggcgcggcgcgagaaaaagauuaaaagcaagaaguaucacaaagucgugaagaaaggaaaggccaaaaaggcucugaaggaguucgaacagcucagaaaaguuaaucccgccgcugcccuggaggaacuggagaagaucgaaaaagcccggaugauggagcgcaugucccucaagcaucaaaacucuggcaaaugggcuaagagcaaggcgauuauggccaaauacgaccuggaggcuagacaggccaugcaggaacagcuuuccaagaauaaagagcugacccaaaagcuccagguggccagcgaaucugaggaggaagaagggggaacagaagaugucgaggaacugcuugugccugacguggucaacgagguucagaugaaugcugauggcccgaaccccuggaugcugcgguccugcaccagcgacacgaaagaggccgcgacccaagaagauccugagcagcuccccgaacuggaggcucacggcgugucugaaagcgagggggaggaaagaccuguggccgaggaagagauccugcuccgcgaauuugaggagcggagaucccugcgcaagcggucugaacuuagccaggacgccgagcccgcuggaucccaggaaacaaaggacagcggcucucaagagguccuguccgagcucagagugcugagccagaaacugaaggaaaaucaucagucucgcaaacagaaggccuccagcgaggggaccaucccgcaaguucagcgggaagaaccugcucccgaagaggaggaaccucuucuccugcagagacccgagcgcgugcagacacuggaggagcucgaggagcugggaaaagaggaauguuuccaaaacaaggagcuuccccggccuguccuggaaggccagcaguccgagagaaccccgaauaaccgccccgaugccccuaaagaaaagaagaaaaaggagcagaugauugaccuccaaaaccugcugacgacacagucucccagcgugaaaucccuugcgguuccuaccaucgaggaacucgaggaugaagaggagcggaaucacagacagaugauuaaggaagccuuugcuggggacgaugugauccgggacuuccugaaagagaagcgcgaagccgucgaggcuucuaagcccaaagauguggaccugacacucccgggauggggcgaauggggcggggucggacugaagccuagcgccaaaaagagacggagauuucuuauuaaagcgcccgagggcccuccccgcaaggauaagaaccugccuaaugugaucauuaacgagaaacggaauauccacgccgcugcccaucaaguuagagugcuccccuauccguucacccaccauuggcaguuugaacgcaccauccagacaccuauuggguccacguggaacacccagagagcuuuccaaaagcugacaacccccaaagucgugacaaagcccggacacaucauuaauccuaucaaagccgaggacguuggcuaccggucuagcucccgcagcgaucugucugugauucagagaaacccgaagcggaucaccacgcgccacaagaaacagcuuaagaaaugcuccgucgacuga

SEQ ID NO: 77707 - RNA, 2301 nt, Artificial Sequence
  derived and/or modified sequence opt5 from UTP14C__Homo_sapiens__NP_067677
augaacgugaaucaggucgccgagaaccuggcucucagccaccaagaagaacugguugaccuucccaagaauuacccucuguccgaaaacgaggaugaaggcgacucugauggggagagaaaacaucagaagcuccuggaggccaucauuagccuugacggcaaaaaucggcgcaagcuggcggaaagauccgaggcuucucucaaagugagcgaguucuccgugucuagcgagggauccggggagaagcugggacuggccgaucuccuggaaccggucaagaccuccucuucccuugccacagugaaaaagcagcugaaccggguuaaaagcaagaaaguggucgagcucccccugaauaaggaaaagaucgagcagauucaccgcgaaguggcuuuuucuaaaacgucccaaguucuuagcaagugggacccuaucauucugaaaaaccagcaggccgagcagcucguguucccccugggcaaggagcaaccugcuaucgcccccaucgaacaugcgcugucuggguggaaagccagaaccccucucgagcaggaaauuuuuaaucugcuucacaagaacaaacagccggucacagauccccugcucaccccuauggagaaggcuucccugcaggccaugagccuugaagaggcuaagaugcaucgggccgagcugcaacgcgcgagagcccuccaguccuauuacgaagcuaaagcccggaaggagaaaaagaucaaaucuaagaaguaucacaaaguggugaagaaaggaaaggcuaaaaaggcccugaaggaguucgaacagcugcaaaaagucaaucccacaguugcccucgaagagauggagaagauugaaaacgcucgcaugauggagagaaugagccugaaacaccagaauagcggcaagugggcgaaaagcaaggccaucauggcuaaguacgaccuugaagcccggcaggccaugcaggagcaacuggcuaaaaacaaggagcucacccagaaacuucagguggccucugaauccgaggaagaggaaggcgggacagagguggaggaacugcuggucccucauguggcgaaugagguucagaugaacguggauggacccaacccguggauguuucgcagcugcaccucugacacgaaggaagcugccacccaagaggauccugaacagguccccgagcucgccgcucacgaggugagcgccuccgaagcugaggaaagaccuguugccgaggaagagauucugcugcgggaguucgaggaacgccagucucucagaaaacggagcgaacugaaucaggacgcggagcccgccuccagccaagagacaaaggauucuuccagccaggaagugcuuucugagcugagagcucucucccagaaacugaaggaaaagcaucagagccgcaaacaaaaggccuccucugagggcaccgucccccaggugcagcgggaggaaccugcuccggaggaagccgagccccugcuucuccaaagaagcgaacgcguccagacacuggaggaacuggaggagcucgggaaagaagacuguuuucagaacaaggagcugccucggcccgugcuugaaggacagcaauccgagagaaccccuaauaaccgccccgacgcgccgaaagaaaagaaggagaaagagcagcugaucaaucuccagaacuuccugacgacacagucuccuagcguucggucccuggccgugcccaccauuaucgaggaacuugaagaugaggaggaaagagaccaacgccagaugaucaaggaggcuuuugccggcgaugacgucauucgggauuuccucaaagaaaagagagaggcuguggaagccagcaaaccuaaggacguugaucugacacugcccggguggggagaguggggcggcguggggcucaagccuucugccaaaaagcgccggcaguuucugaucaaagcucccgagggaccgccuagaaaggacaaaaaucuucccaacgucauuaucuccgaaaagcggaauauucacgcggccgcucaccaggugcaagugcugcccuauccuuucacccaucaccgccaguuugagagaaccauccagacaccgaucggcagcacguggaacacccaacgggccuuccagaagcucacaacccccaaaguugucacaaagccugggcauauuaucaaacccauuaaggccgaagaugugggauaccagucuuccagcagaucugaccugccugugauccagcgcaaucccaaacggauuaccacgagacacaacaaggaggaaaaacuguga

SEQ ID NO: 77708 - RNA, 8358 nt, Artificial Sequence
  derived and/or modified sequence opt5 from UTP20__Homo_sapiens__NP_055318
augaagacaaagcccgugagccacaagacagagaacacguacagauuccugaccuuugccgaacggcugggaaaugucaacaucgacauuauccaccgcauugaucggacagcuuccuaugaggaagagguugaaaccuacuucuuugaggggcugcuuaaauggcgggagcugaaucugacagaacacuucggaaaguuuuauaaagaggugaucgacaagugccagucuuucaaccaacugguguaccaccagaaugaaauuguccagagccuuaagacccaucuccaggugaaaaacuccuuugccuaucaaccucuccuggaucugguugugcagcucgcccgcgaccugcagauggauuucuacccgcauuuucccgaguucuuucuuacaaucaccucuauccuggagacgcaggacaccgaacuccuggagugggcuuucacaagccuuuccuaucuguacaaguaccucuggagacugauggucaaagauaugucuagcauuuauuccauguacagcacccugcucgcccacaagaaacugcacauccggaauuuugccgcugaaucuuucacauuccuuaugcgcaagguguccgacaagaacgcccuguuuaaucucauguuccuggaucuugacaaacauccugagaagguugaaggcguggggcaacugcucuuugagauguguaaaggagucagaaacauguuccacagcugcaccggccaggcugugaagcugauucugcggaaacucgggcccgugacggagacagaaacccagcugccuuggaugcuuaucggagagacacugaagaauauggucaaaucuaccguuuccuauauuagcaaggaacauuuuggcaccuucuuugagugucuccaggaaucucugcuugaucugcacacaaaggugacgaaaaccaacugcugugaguccagcgagcaaaucaagcgccuccuggaaacauaccugauucucgugaaacacggcuccgggaccaagauccccaccccugccgacgucugcaaagugcugucucagacccuucagguugcgagccuguccacgagcuguugggagacacuccuggaugugaucucugcccugauucuuggagaaaaugucucccucccggagacccugaucaaggaaaccauugagaagaucuucgagagcagauuugaaaaacggcugauuuucucuuuuagcgaggugauguucgcuaugaagcaauuugaacagcuguuccugcccuccuuccuuucuuauaucguuaacugcuuucugaucgacgacgccguggucaaagaugaggcucucgccauucuggcgaagcugauccuuaauaaagccgcuccucccacagccggcagcauggcuauugagaaguacccucucguguucagcccccagauggucggguuuuauaucaagcagaaaaagacccgcagcaaaggaagaaacgaacaauucccggugcuggaccaucugcucucuauuaucaagcugccucccaacaaagauacaacguaccuuucccagagcugggccgcccugguugugcucccucacauccggccccuggagaaggaaaaggucauuccccuggugaccggcuuuaucgaggcucuuuucaugacaguugacaaagggucuuuuggaaagggcaaucucuucgugcugugucaggcggucaacacccugcucucccuggaagagagcuccgagcuucugcaucucgugccuguggaacgcguuaaaaaucugguccugacauuuccgcuugagcccucugugcuccugcugaccgaucucuacuaucagagacuggcccuuugcggcuguaaggggccucugagccaagaagcucucauggagcuguuccccaaacugcaggccaacauuuccacgggagugucuaagauccggcuucugaccauuagaauccucaaucacuuugacguccagcugccugaaagcauggaggaugacggccucuccgagcgccagagcguguucgccauucugcggcaagcugaacuuguucccgccacagugaacgauuacagagagaaacugcuccaucugcgcaagcugcggcacgacgucgugcagaccgcgguuccggaugggccucuucaggaagugccccugagauaucuccugggaaugcucuacaucaauuuuucugcucugugggacccugucaucgagcuuauuuccagccacgcccaugaaauggagaacaagcaguucuggaaaguguauuacgagcaccuggaaaaggccgcuacacaugccgagaaagaacuccaaaaugacaugaccgaugagaagucuguuggcgacgaguccugggaacagacgcaggagggggaugugggagcucuguaucacgaacaacuggcccuuaaaacagacugccaggagcgccuggaucacaccaacuuccgguuucuccuguggagagcgcucacaaaguuccccgaacgcgucgagccucggagcagagagcugucuccccuuuuucugcgcuucaucaauaacgaauacuacccggccgaccuccagguggcuccuacccaggaucuccggagaaagggcaaaggcaugguggccgaggaaauugaggaagaacccgcugccggggacgaugaggaacuggaggaagaggcggucccccaagacgaaagcucccagaagaaaaagacccggcgcgccgcugccaaacagcuuaucgcucaucugcagguuuuuagcaaguucucuaauccuagagcccucuaucuggaguccaagcucuacgagcuguaucuucaacugcugcuccaccaggaucagauggugcagaaaauuacacuggacugcaucaugacguacaagcauccgcacgugcuucccuaucgggaaaaccugcaaagacuccuggaggaucgcagcuuuaaagaagagaucguccauuucuccauuucugaggacaaugccgugguuaagaccgcucaccgggcggaccucuuuccuauccugaugcgcauucuuuacggaagaaugaaaaacaagacaggcagcaagacccaggggaaauccgccucuggaacaagaauggcuaucgugcugcgguuccuggccggcacccagcccgaagagauucaaaucuuucucgaucugcuuuucgaaccuguccgccacuucaagaacggggagugucauagcgccgugauccaggcuguugaagaccuggaucucuccaaagugcugccccucggcagacagcacggcauucucaauucucuugagaucguccugaagaacauuagccaucugaucuccgccuaucucccuaaaauucugcagauccuucugugcaugacggcgacagugagccacauccucgaccaacgggagaagauucagcugcgcuuuaucaauccccugaaaaaccucagacggcuuggcauuaagaugguuaccgauaucuuccuggacugggaaucuuaccaguuucgcaccgaggaaauugaugcuguguuccauggggccgucuggccgcagaucuccagacugggaagcgagucucaauacuccccuacaccccuccugaaacuuauuagcaucuggucucggaaugcccgcuauuuuccucugcucgcuaaacagaagcccggccacccggaaugugacauccugaccaacguguucgccauucuguccgcgaaaaaucucagcgaugcuacagccuccaucgugauggacauugucgaugaccuucugaaccugccugauuuugagcccacggagaccguucucaaucugcuugugacagggugcguguacccuggaaucgccgaaaacauuggcgagagcaucaccaucgggggcagacugauucucccccacguccccgcuauccugcaguaucugucuaagacaaccauuagcgccgaaaaagugaagaagaaaaagaaucgggcucagguuuccaaagagcucggaauccuuucuaagauuagcaaauucaugaaggacaaggaacaauccucugugcugaucacgcugcuccugccuuuucuucauagaggcaacaucgccgaggacaccgaggucgauauucuggugacaguucagaaucuccugaaacacuguguggacccgaccagcuuccugaagcccaucgcgaaacucuuuuccgucauuaagaacaaacuuucucgcaagcugcugugcacaguguucgaaacccucagcgauuuugaguccgggcugaaguacaucacagacgucgugaaacuuaaugccuucgaucagcggcaucuggacgauauuaacuucgacguuagauuugaaaccuuccagacgaucacaagcuauauuaaggagaugcaaaucguggaugucaacuaccucaucccugugaugcacaauuguuuuuauaaccuggagcugggagacaugucucucuccgauaaugcuagcaugugccuuaugucuauuaucaaaaagcuggccgcucugaacguuaccgaaaaagacuaccgcgagauuauccaccggucccuccuggaaaaacuuagaaagggccugaaaagccagaccgaguccauucagcaagacuacacaaccauccucucuugucugauccagacguuccccaaucagcuggaauuuaaggaucucgugcagcuuacacauuaucacgacccugagauggauuucuuugagaacaugaaacauauucaaauccaccgccgggccagagcccugaagaaacuggcuaagcagcucauggaagggaaagucgugcugagcuccaagagccuucagaauuacauuaugcccuaugcgaugaccccuaucuucgacgagaagaugcugaaacaugaaaacauuacaaccgccgcuacagagaucaucggagccauuugcaagcaccucucuugguccgccuacauguauuaccugaaacacuuuauccaugugcugcagaccggccaaauuaaucagaagcucgggguuagccuucuggucaucgugcuggaggcuuuccacuuugaucauaaaacgcucgaggagcagaugggcaagauugaaaacgaggaaaaugccaucgaggcgauugaacugccggagcccgaggcuauggaacuugagcgcguggacgaagaggagaaggaauauaccuguaaaucucugagcgauaacggacagccuggcacacccgacccugccgauuccgggggaaccucugccaaggagagcgaaugcaucacaaaacccgucuccuuccucccgcaaaauaaggaggaaaucgagcggaccauuaaaaacauccagggcacgauuacaggggacauccugccuagacugcacaagugccucgcuucuaccacaaagcgggaggaagaacacaaacuugugaaguccaaaguugugaaugaugaagaggucgugcgcguuccccuggccuuugcgauggugaagcugaugcagucccucccccaagaagucauggaggcuaaccugccuagcauucuucugaaagugugugcccuccugaagaacagagcccaggagauccgggacaucgcucgcucuacccuggccaagauuaucgaagaucucggaguucauuuccuucuguacgugcugaaagagcuccagaccacacuggucagaggcuaccaggugcacgugcuuacguucaccguccauaugcugcuccaagggcugacaaauaagcugcagguuggcgaccucgacuccugccuggauauuaugaucgaaauuuuuaaccacgagcuuuucggagcuguggccgaagagaaagaggugaagcagauccugagcaaagucauggaagcgcggagauccaagucuuaugacagcuacgagauccucggcaaauuuguggggaaggaucagguuaccaagcugauucuuccccugaaagaaauccuccaaaauacaaccucccugaagcuggcccgcaaagugcaugagacgcuccggagaauuacagucggacugaucgugaaccaggagaugaccgcugaaucuauucuucugcucagcuauggccugaucuccgagaaucuuccucugcucaccgaaaaggagaaaaacccgguugcccccgcuccugacccccgccugccuccccagagcugucugcuccugccgccuacacccgugagagggggacagaaggccgucgugucuagaaagaccaauaugcacauuuucaucgaauccggccuucgccugcuccaccugagccuuaaaacaucuaagaucaaauccagcggcgagugcguccuggagaugcucgauccuuuugugucucugcugauugacugucucgggagcauggauguuaaggugaucacgggagcccugcaaugccuuauuugggugcugcgguucccccucccuuccaucgaaaccaaagcugagcagcugacaaagcaucuuuuucugcuccugaaggacuacgcgaaacugggcgccgcuagagggcagaacuuccaccucgucguuaauuguuuuaagugcgugaccauucuggugaaaaaggucaaaucuuaucagaucacagaaaagcaacuucaggugcugcucgccuacgccgaggaagauaucuaugacaccagccgccaggcuacggccuucggacugcuuaaggcgauucuguccagaaaacuccugguucccgagaucgaugaggugaugcggaaggucagcaaacuggcuguguccgcccaaucugaaccggcccgcguccaguguagacagguguuucucaaguacauucuggacuacccucuuggcgauaaacugcggcccaaccucgaguucaugcuggcucagcuuaauuaugaacaugagaccgggcgcgaaagcacacuggagaugaucgccuaccucuuugacaccuucccccaaggacugcugcacgagaacugcggcauguucuuuauuccucucugucugaugacaaucaaugacgauuccgcgaccugcaagaaaauggccucuaugacaaucaagagccuucugggcaagauuucccucgagaagaaggacuggcuguucgauaugguuacgaccugguuuggggcuaaaaagagacuuaaccggcagcuggccgcucucaucugcggacuguucguggagucugaaggcgucgacuuugagaaaagacuggggacagugcuuccgguuauugagaaggaaaucgaucccgagaauuucaaggacauuauggaagagaccgaagagaaagccgcugaucgccugcucuuuagcuuccugacccucaucacaaagcugauuaaagaguguaacaucauccaguuuacgaagccugccgaaacccuuuccaaaauuuggagccacgugcauucucaucugcggcauccccacaauugggucuggcugacagcggcccagaucuucggacuccuguuugcuuccugccaaccugaggaacuuauucagaaguggaacaccaagaaaacaaagaaacaucugcccgagccuguggccaucaaguuccucgcuagcgaccuggaucagaaaaugaagucuauuucccucgccagcugucaccagcugcacucuaaguuucuggaccaaucccuuggcgaacaggugguuaaaaaccuccuguucgccgcuaagguccuguaucuucuggagcucuacugcgaggauaaacagagcaagaucaaagaagaccuggaggaacaagaggcgcucgaagacgggguggccugugcugaugagaaggccgaguccgacggagaagagaaggaagaggugaaagaggaacugggcagaccggccacccugcuuuggcugauccagaagcucagccgcauugcuaaacuggaggccgcguauucuccccggaauccucuuaagagaacgugcaucuucaaauuucugggcgccgucgcuauggaucucgggauugacaagguuaaacccuaccugccuaugaucauugcgccccuguuccgggaacucaacagcacauauuccgagcaggauccgcugcuuaagaaucugucucaggaaaucaucgagcuccugaagaaacuugugggacuggagagcuuuucccucgcuuucgccucugugcaaaagcaggcgaacgaaaaacgcgcccugagaaagaaacggaaggcucuggaguuugucaccaauccugacauugccgcuaagaaaaagaugaaaaagcauaaaaacaagagcgaagccaagaaacgcaagaucgaguuccucagacccggcuacaaagcuaagcggcagaaaucccacucucugaaggaucuugccaugguggaauga

SEQ ID NO: 77709 - RNA, 10302 nt, Artificial Sequence
  derived and/or modified sequence opt5 from UTRN__Homo_sapiens__NP_009055
auggcuaaguacggcgagcacgaagcuagccccgacaacgggcagaaugaguucuccgauaucauuaagucucggagcgacgaacauaacgaugugcagaagaagaccuuuacaaaguggaucaaugcccgguucuccaagucuggaaagccuccgauuaacgacauguuuacggaucugaaggacggccgcaagcuccuggaucuucuggaggggcucaccggaacaagccugcccaaggaaagaggcuccacccggguccacgcgcuuaauaacguuaaucgcgugcuccaggugcuccaucagaacaaugucgagcuggugaacaucgggggaacagacauuguugauggcaaucacaaacugacccucggccugcuuuggucuaucauccugcauuggcaagugaaggacgucaugaaagaugugaugagcgaccuccagcagacaaacuccgagaagauucugcuuagcuggguuagacagaccacgcggccuuauucucaggugaauguccugaacuucaccacauccuggaccgaugggcucgcuuuuaaugccgugcugcaccgccacaagcccgaccuguucagcugggacaaaguggucaagaugucuccuaucgaaagacucgagcaugccuuuuccaaagcucaaacauaccugggaauugaaaaacuucuggaucccgaggacguugccgugcagcucccugauaaaaagagcaucauuauguaucugaccucucuuuucgaggugcugccgcagcaggucacgaucgacgcuauucgggaaguggagacacucccccgcaaauacaagaaggaaugcgaggaagaggccaucaacauccaauccaccgcgccugaggaagaacacgaaagccccagagccgagacaccuuccaccguuaccgaaguggauauggaccuggauucuuaucagauugcucuggaggagguccucacauggcugcuuagcgccgaagacacguuucaggagcaagaugacaucuccgaugacguggaagagguuaaagaccaguucgcuacccaugaagccuuuaugauggagcugacagcccaccagagcucugugggcuccguccuccaggccgggaaccaacugauuacccagggaacacuuagcgaugaggaagaguucgaaauccaggagcagaugacccugcucaaugcucggugggaggcccugcgcguggaaucuauggacagacaaagccggcugcacgauguccucauggagcugcagaagaaacagcuucagcaacuguccgcuuggcucacgcugacagaggaacgcauucagaagauggaaaccuguccccuggacgaugacgugaaaucucuucagaagcuccuggaggagcauaagagccugcaguccgaucucgaagccgagcaaguuaaagugaacagccugacccacauggucgugaucguugacgaaaauucuggcgaguccgccacagcuauccuugaagaucagcugcagaagcucggggagagauggaccgcggugugccgguggacagaggaaagauggaaccgccugcaagagauuaauauccuguggcaggaacuucucgaggaacagugucugcugaaagccuggcucacggagaaggaggaagcucugaacaaaguccagaccagcaauuuuaaggaccaaaaggagcuuucuguguccgugcggagacuggccauucucaaagaagauauggagaugaagcgccagacacuggaccagcugagcgagaucggacaggauguuggccaacuucucgacaacuccaaagccucuaagaaaauuaauagcgacuccgaggaacugacccagcggugggauucucugguccagagacucgaagacagcuccaaccaggugacacaagcuguggccaagcugggcaugagccagaucccgcagaaggaucuucuggagaccguccgcgugcgggaacaagcgaucacgaaaaagucuaaacaggagcucccucccccucccccucccaagaaaagacagauucauguugacaucgaggcuaagaaaaaguucgaugccauuuccgccgaacugcugaauuggauccuuaaguggaaaaccgcuauucagacaaccgagaucaaggaauacaugaaaaugcaagacacaagcgagaugaagaaaaagcucaaggcccuggaaaaagagcagcgcgagcggauuccgagagcugaugaacugaaccagaccgggcagauccucguggagcaaaugggaaaggaaggccugcccacggaggaaaucaaaaauguccuugagaaggugucuuccgaguggaaaaacguuagccagcaccuggaagaccucgagcgcaagauucagcugcaggaagauaucaaugccuauuucaagcaacuggacgagcuugagaaagugauuaagacaaaagaagagugggucaagcauaccucuaucagcgaauccagccggcagucucugccuucccucaaagauagcugccagagagagcugacaaaccuccuggggcuucaccccaagauugaaauggcgcgggccuccuguucugcucugaugagccagccuuccgcccccgacuuugugcaacgcggauucgauucuuuucucggcagauaccaggcuguucaggaggccguggaggaccggcaacagcaccuggaaaacgagcugaaggggcagccgggacaugcguaccuugaaacccugaaaacccucaaggacguccugaaugauagcgagaacaaagcccaggugucccucaaugugcugaacgaccuugcuaaggucgaaaaagcccugcaagagaagaaaacacucgaugagauccuggaaaaucagaagccugcucugcacaaacuugccgaggaaacgaaagcccuggagaagaacguucaucccgacguggaaaaacucuauaagcaggaguucgaugacgugcagggcaaauggaauaagcugaagguccucgugucuaaagaucugcaccuucuggaggaaaucgcucugacccucagagcguuugaggccgacagcacaguuauugaaaaguggauggauggcgugaaagacuuccugaugaagcaacaggcugcccagggggaugacgccggacuucagcgccaacuggaccagugcuccgcuuuugucaacgagaucgagaccauugaaagcucucucaaaaauaugaaggagaucgaaacaaaccugcgguccggcccuguggccgggauuaagaccuggguucagacgagacucggagauuaccaaacacagcuggagaaacuuagcaaggaaaucgcgacccagaaaucucgccuguccgagagccaggagaaggcugccaaucugaaaaaggaccucgccgaaaugcaagaguggaugacccaggcugaagaggaauaucuggagagagauuucgaguacaagucucccgaggaacuugaauccgccguggaggaaaugaaacgggcgaaggaggacguccugcagaaagaggugcgcguuaagauccucaaagauaacauuaagcugcucgcugccaaggugccuagcggcgggcaggaacugacauccgagcuuaaugucgugcuggaaaacuaucaacugcucuguaauagaauccggggcaaaugccacacccuggaggagguguggagcuguuggauugaacuucugcauuaccucgaccuggagacaacguggcucaacacccuggaggaacgcaugaagucuacagaaguccuucccgagaaaaccgaugccguuaacgaggcucuggaaagccuggaguccgugcucagacacccggccgacaaucggacacagauccgcgaacugggacagacccuuauugauggcgggauccuggacgauaucauuucugagaagcucgaggcuuuuaacagcagauaugaggaccugucccaucuggccgagucuaaacagaucagccucgaaaagcaacuucaggugcugcgggagacggaucagaugcugcagguccuccaagaaucccugggagagcuugacaaacagcugaccacauaccucaccgaccgcauugaugcguuccaggugccucaagaagcccagaagauccaggcugagauuucugcccacgagcugacacuggaggaacugagacggaauaugagaagccagccccuuaccucccccgaaagccgcacagcucggggcgggucucaaauggacguucugcagagaaagcugcgcgagguguccaccaaauuucaacucuuccagaagccugccaacuuugagcaacggaugcuggauugcaaaagaguccuugacggagugaaggccgaacugcauguucucgaugugaaagacgucgauccggacgugauccagacgcaccuggauaaguguaugaagcuguacaaaacacucagcgaggucaaacuugaaguggagaccguuauuaaaaccggccgccacaucgugcagaagcagcaaacagacaaucccaaagggauggaugaacagcugaccucucugaagguccucuauaacgaccugggcgcucaggugacggagggaaagcaagaucuugagcgggcgucccagcuggccagaaaaaugaagaaagaagcugccagccucuccgaguggcugucugccacagaaaccgagcugguucaaaagagcacauccgaaggccuccuuggggaccuggacaccgagaucagcugggcuaaaaaugugcugaaggaucucgagaagcgcaaagccgaccugaacacaauuaccgaaucuuccgcggcccuucagaaucugaucgagggaagcgaaccuauucucgaggaacggcugugcguccugaacgccggcuggucuagagugcggacguggaccgaggauuggugcaauacacucaugaaccaucaaaaucagcuugagaucuucgacgggaacguggcccacauuagcaccuggcuguaccaggcugaagcccugcucgaugagaucgaaaagaaacccacauccaagcaggaggagaucguuaaacgccuggucucugaacuugacgaugcgaaucugcaaguggagaacgugagagaccaggcucucauucugaugaacgcccggggaagcuccucucgcgaacuggucgagccuaagcucgccgaacuuaauagaaacuucgagaaagugagccagcauaucaaguccgcuaagcugcugauugcccaggagccccucuaucaaugucugguuaccacggaaacauuugagaccggcgugccuuucagcgaucuugaaaaacuggagaaugacaucgaaaacaugcucaaguuugucgagaaacaccuggagucuuccgaugaagacgagaagauggacgaagagagcgcucagauugaagaggugcugcagagaggggaagaaaugcuccaucaacccauggaggauaauaaaaaggaaaagaucagacuucagcugcugcuccugcacacacgcuacaacaaaaucaaggccauuccgauccagcagcggaaaaugggccaacuugcguccggaauuagaucuagccugcucccuaccgacuaucugguugagaucaauaagauucugcucugcauggaugacguggagcuuucccugaacguccccgaacugaauaccgccaucuacgaggauuucucuuuucaggaagacagccucaaaaacauuaaggaucagcuggacaaacuuggcgagcagaucgcugugauccacgaaaaacaaccugauguuauucuggaggccuccgggcccgaggcuauccagauucgcgacacacucacgcagcugaaugccaagugggaucggaucaacagaauguauagcgaccgcaaaggauguuucgaucgggccauggaagaguggagacaguuucauugcgaccugaaugaccucacccaauggauuacagaagcugaggaacuucugguggauaccugugcgccgggcgggucucuggaccucgagaaggcccgcauccaccagcaggagcuggaagucggaaucuccagccaucagccuucuuucgcugcccuuaacagaacaggcgaugggauugugcaaaaacugucccaggccgacggcagcuuucucaaggagaagcuggcuggacugaaucagcggugggaugccaucguggcggaagucaaagaccgccaacccagacucaagggcgagucuaaacagguuaugaaguaccggcaccagcuggaugaaauuaucugcuggcuuaccaaagcugagcacgccaugcagaagcgcagcacgacagagcugggggaaaaccuccaagagcugagagaccuuacccaggaaauggaggugcaugccgagaaacugaaguggcucaaucggaccgaacuggagaugcuguccgauaagucucucagccugccugaaagagacaaaauuuccgagagccuucgcacagugaacaugaccuggaacaagaucugucgggaaguccccacaacgcugaaagagugcauccaggagcccuccucugugagccagaccagaauugcugcccacccuaauguucaaaaggugguccucguguccucugcgagcgauaucccgguucagucccaucgcacaucugaaauuagcauccccgccgaccuggacaaaaccauuacagagcuugcugauuggcuggugcucaucgaccagaugcugaaguccaacauugucaccgugggagaugucgaagagaucaauaagacggugagccggaugaaaaucaccaaggccgaccuggaacagagacacccucaacucgauuacguuuucacacuggcucagaaccuuaaaaauaaggccucuuccagcgacaugcggaccgcuauuacagagaaacuggagcgcgugaagaaccagugggauggcacccaacaugggguggaacucagacagcagcagcuggaggacaugaucauugauucucuucaaugggacgaucaccgggaagagacagaggaacugaugcgcaaguaugaggccagacucuacauccugcagcaggcgcggcgcgacccccugacgaaacagauuuccgauaaucaaauccuccugcaggaacuuggaccuggcgacggcaucgucauggccuuugacaacguucugcagaagcuccuggaggaauaugggagcgaugacaccagaaaugugaaagagacaaccgaguaccuuaagaccucuuggauuaaccugaaacaguccaucgcugaucggcaaaaugcccucgaagcugaguggcgcacagugcaggccagcagacgggaccuggaaaacuuccugaaguggauucaggaggccgaaacgaccgucaaugugcucguugaugcuucccacagagagaacgcgcugcaggacagcauccuugcccgcgagcugaagcaacagaugcaggauauucaagcugaaaucgacgcccauaaugauaucuuuaaaucuauugacggaaaccggcagaagauggugaaagcccucggcaacagcgaggaagcuacaaugcugcagcacagacuugaugacaugaaucagcgcuggaacgaucugaaggccaaauccgcgucuauccgggcccaucucgaggcuagcgccgaaaaguggaauagacugcugaugucccucgaggagcugauuaaguggcuuaacaugaaagacgaggaacugaagaaacaaaugcccaucgggggagacgucccugcucuccagcugcaguaugaucacuguaaggcccuucgccgggaacugaaagagaaggaauacucugugcucaaugcggucgaccaggccagaguguuccuggcugaucaaccgauugaggcccccgaggaaccucgccggaaccugcagagcaaaaccgagcucacacccgaagagagagcucagaagaucgccaaggcuaugcgcaaacaguccucugagguuaaggaaaaaugggagagccugaaugccgugaccuccaacuggcaaaagcaggucgacaaagcgcuugaaaagcugcgggaucuccagggcgccauggacgaucuggacgcugauaugaaggaggccgaaagcgugagaaauggguggaaaccuguuggagaccuucugauugauucucuccaagaccacaucgagaagaucauggcuuuccgcgaggaaauugcccccaucaacuuuaaagugaagacggucaaugaccuguccagccagcugucuccgcuugaucugcauccuucccucaaaaugagcagacagcuggacgaucucaacaugcgguggaagcugcuucagguguccguggacgaucgccugaagcaacugcaggaggcccacagagacuucggccccucuagccagcauuuucucuccacaagcguucagcugcccuggcaacggucuauuucccacaauaaagucccuuauuacaucaaccaucagacccagaccacaugcugggaucaccccaagaugaccgaacuuuuccagagccuggcggaccucaauaacgugagauuuucugcuuaccggacagccauuaaaauccgcagacugcaaaaggcucucugucuggaucugcuugagcugagcaccacgaacgaaaucuucaaacagcacaagcucaaucagaacgaccaacugcuuuccgugccugaugucauuaauugccugacaaccacauaugacggccucgagcagaugcauaaggaucugguuaacgugccgcucugcguggacaugugucugaauuggcugcuuaacgucuacgacaccgggcggacgggaaaaauccgcgugcagucucugaagauuggccucaugagccuguccaaagggcuucuggaggaaaaguauagauaccucuuuaaagagguugccggacccaccgaaaugugcgaucagcggcaacugggccugcuccugcacgacgccauccagauuccucgccagcuuggggagguggcugccuucggaggcucuaauaucgaacccagcgucagauccuguuuucagcaaaacaauaacaagccugagaucagcgugaaagaguucauugauuggaugcaucuggaaccccagucuaugguuuggcucccggugcugcaccgggucgcggccgcugagacagccaagcaccaggcuaagugcaauaucuguaaagaaugcccuauugugggcuuucgcuauagaucccuuaagcauuucaacuacgacgugugucagagcugcuucuuuuccgggcggaccgccaaaggacacaagcugcauuaucccauggucgaguacuguaucccuacaaccucuggcgaggauguucgcgacuucacaaaagugcucaagaauaaguuuagaagcaaaaaguacuucgcgaaacacccccggcugggguaucugccugugcaaaccguccucgaaggagauaaccuggagacgcccauuacacuuaucuccauguggccggaacauuacgacccuucucagagcccccagcuguuucacgaugacacccacucccgcauugagcaguaugccaccagacucgcucaaauggaacggacaaauggcagcuuccugaccgauucuuccagcacaacggggucuguggaggacgagcaugcccuuauccagcaguacugccaaacccugggaggcgaaucccccguuagccagccucagucuccggcucagauccucaaguccguggagagagaggagcgcggcgaacuggagcggauuaucgccgaucuggaggaggaacagagaaaccuccaggucgaauaugagcagcugaaagaccagcaccuucgccgggggcugcccgugggaagcccucccgaaucuauuaucagcccucaucacacauccgaggacagcgagcucauugcugaagccaagcugcuuagacaacauaagggccgccuggaggcgcggaugcagauccucgaagaucacaacaaacagcuggagucccagcugcacagacuccgccaacugcuugagcagcccgaaucugacagccggaucaaugggguuuccccuugggccucuccgcagcauagcgcucuguccuacucucucgaucccgacgccagcggaccucaauuucaccaggcugccggcgaggaucugcuugcgcccccucaugacaccuccacagaucugaccgaagugauggagcagauucacagcacguuccccucuuguugcccgaacgucccuuccagaccccaggcgauguga

SEQ ID NO: 77710 - RNA, 360 nt, Artificial Sequence
  derived and/or modified sequence opt5 from UTS2B__Homo_sapiens__NP_937795
augaacaagauccugagcuccaccgugugcuucggccuccugacacuucugucuguccucagcuuucugcaguccguucacgggagacccuaccuuacgcaaggaaaugagauuuucccugacaaaaaguauaccaaccgggaagaacugcuccuggcccugcucaauaaaaacuuugauuuccagcgcccguuuaauacagaccuggcccuucccaacaagcuggaggagcucaaucagcuggaaaaacuuaaggagcagcugguggaggaaaaggauucugagaccagcuacgcuguggacggccucuucuccucucauccuagcaaaagagcguguuuuuggaaguauugcgucuga

SEQ ID NO: 77711 - RNA, 420 nt, Artificial Sequence
  derived and/or modified sequence opt5 from UTS2__Homo_sapiens__XP_011538839
auggagaccaacguguuccaccugaugcucugcgucacaagcgccagaacgcauaaguccaccucucuguguuuuggccacuucaauagcuaccccucccuuccucugauccaugaccuccugcuugaaauuucuuuucagcugagcgcuccgcacgaggaugcccggcucacacccgaggaacuggaacgcgcgucccugcuccaaauccugccugagaugcuuggggcugagagaggagacauucugcggaaagccgauucuagcaccaacaucuucaauccccgcggcaaccucagaaaguuucaggacuucuccgggcaggauccuaauauucugcuuagccaucugcucgcccggaucuggaaacccuauaagaaacgcgaaacaccugacugcuuuuggaaguacuguguuuga

SEQ ID NO: 77712 - RNA, 1170 nt, Artificial Sequence
  derived and/or modified sequence opt5 from UTS2R__Homo_sapiens__NP_061822
auggcccugacccccgagagcccuuccucuuucccgggccucgcugccacagggagcuccgugcccgaaccucccggaggcccuaacgcgacgcuuaauucuagcugggcuucccccaccgagccuucuagccuggaagaccuggucgccacagggaccaucggaacacuccuguccgccaugggcguuguggggguggucggaaacgcuuacacccuugugguuacaugcagaagccugcgggccguggcuucuauguaugucuacgugguuaaucucgcccuggcggaucugcucuaucugcuuuccauuccguuuaucguggccaccuacgucacgaaggaguggcacuucggcgacgugggcugucgcgugcuguuugggcucgauuuccugaccaugcaugcuagcauuuuuacacuuaccgucaugucuuccgaaagauaugccgcuguucugcggccccucgacacagugcagcgcccuaaaggauacagaaagcugcuggcccucggcaccuggcugcuugcgcugcuccugacgcuucccgugaugcuggccaugcggcucguccgcagagggccuaaaagccugugccugcccgcuuggggaccgcgggcccaccgcgcuuaucucacacugcuuuucgccaccucuaucgccggcccugggcugcucauuggacugcuuuacgcuagacuggcgcgggccuaccgcagaucccaacgggcuagcuuuaagcgcgccagacggcccggcgccagagcucuccgccuggugcugggcaucguucuccuguucugggccuguuuucuuccuuucuggcuguggcagcuccuggcgcaguaucaucaggcuccccuggcuccccggacagccagaaucgugaacuaccuuacaaccugccucaccuauggaaauuccugugccaacccuuuucuguacacgcugcucacccgcaauuaucgggaucaccugagagggcgcguccggggcccggggucuggaggcgggagaggacccgugccuagccuucaaccccgcgcccgguuccagagaugcuccggccgcagccugucuuccuguagcccucagcccacagacucucucguucuggcuccggccgcgccugcccggcccgcuccugagggccccagagccccugcuuga

SEQ ID NO: 77713 - RNA, 4179 nt, Artificial Sequence
  derived and/or modified sequence opt5 from UTY__Homo_sapiens__NP_001245181
augaaaagcugcgccgugucccugaccacagcugccgucgcguucggcgacgaggcuaagaagauggccgaagggaaagccucuagagagagcgaagaggaauccguuucucucacgguggaggagcgggaagcucugggaggcauggauagccgccuuuuuggguucgugagacugcacgaggacggagcccggaccaagacacuccugggcaaagcuguccgcuguuacgaaucccuuauccugaaggccgaggggaagguggagucugacuuuuucugccagcucggacauuuuaaccugcugcucgaagauuauagcaaagcgcuguccgccuaccaaagauauuacagccuucaggcugauuauuggaagaaugccgcuuuccuguacggccucggccugguuuauuuuuacuacaacgccuuccacugggcgauuaaagccuuucaggacgugcuuuaugucgaucccucuuucugucgggcuaaggagauccaucugcgccucgggcugauguuuaaagugaauaccgacuacaaguccagccugaagcacuuccagcucgcccugauugauugcaacccuuguacacuuucuaaugcugaaauccaauuucauauugcccaccuguaugagacccagagaaaauaccacuccgccaaggaggcuuaugaacagcuccugcagacagagaaccuuccggcgcaaguuaaagccaccgugcugcagcagcucggauggaugcaucacaauauggaccuggucggcgauaaggcuacgaaagaaagcuacgccauccaguaucugcaaaagucucucgaggccgaccccaacuccgggcagagcugguacuuccugggacggugcuacuccucuaucggcaaagugcaggaugcuuucauuagcuaucgccaauccaucgacaagagcgaagccucugcggacaccugguguuccauuggggugcuuuaccagcagcagaaucaaccuauggaugcucugcaggccuauaucugcgccguccagcucgaccauggacacgcugccgcuuggauggaucugggcacacuuuacgagagcuguaaccagccccaagacgccauuaagugcuaucugaaugcggccagaucuaaacgguguagcaacaccuccacacucgcugcccgcaucaaguuucugcaggcucagcugugcaaucucccucagucuagccugcaaaacaaaaccaaacuucugcccuccauugaagaggccuggagccucccuaucccggcggagcugacgucuagacagggcgccaugaauacagcucagcagaacggguccgauaacuggaauggaggccaaagccugucucaccaucccguucaacagguguacucccuuugccucaccccucagaagcugcagcaccuggaacagcuccgggccaaccgcgacaaucugaaccccgcucagaagcaucaacuugagcagcuggaaagccaguucgugcucaugcagcaaaugagacacaaggaggucgcccaggugcggacaaccgggauccauaauggagccauuaccgauuccucucugccuacaaacagcguuuccaauagacagccccacggcgcucugacgcgcgugucuagcgucucccagccgggggugcggccugcguguguugaaaaacuucucagcucuggagccuuuuccgcuggcugcauccccuguggcaccagcaagauucuggggucuacagacaccauccugcucggauccaacugcauugccggcagcgagucuaaugggaacgugccuuaucugcaacagaauacacacacccuuccccauaaccacacggaucugaauagcuccacagaggaacccuggagaaaacagcucagcaacucugcccaaggacugcauaagucccagagcuccugucugucuggcccuaaugaggaacagccgcuuuucagcaccggguccgcucaguaccaccaagccaccucuacaggcaucaaaaaggcgaacgagcaccucacccugcccagcaacuccgucccucagggagacgcugauucucaucugagcugccacacagccacguccggcgggcagcagggaaucauguuuaccaaggagagcaaacccucuaagaaucgcucccucgugccugaaacaagccggcauaccggcgacacaucuaacgggugugccgacgucaaaggacuguccaaucacgugcaucaacuuauugcugaugccguuagcucucccaaccacggcgacuccccgaaucugcucaucgcggauaacccucagcugagcgcucugcuuauugggaaggccaauggcaacgugggaaccggcacgugcgacaaagucaauaacauccaccccgccgugcauaccaagacagaucacuccguugcuagcucuccuagcuccgccauuucuaccgcuacacccagcccuaaguccaccgagcagagaucuaucaauagcgugacgucccucaacucuccccauagcgggcugcacacagucaauggagaaggccuggggaaaucccagagcucuaccaagguggaccucccgcuggccucccaucgcagcacaucucaaauccuuccuuccaugagcguguccauuugucccucuagcaccgagguucugaaagcgugccggaaccccggaaagaauggccucuccaacagcuguauccugcuggauaaaugcccuccgcccagaccucccaccucuccuuaucccccucuucccaaggacaaacugaacccgccuacacccuccauuuaccucgaaaauaagcgcgaugccuucuuuccuccccugcaccaguucugcacgaacccgaagaauccugucaccgugauccgggggcucgcuggcgcccugaaacuugaccugggacucuuuagcacaaagacccugguggaggcuaacaaugagcacauggucgaagugagaacacagcugcuucagcccgccgaugagaacugggacccuaccggcacgaaaaagauuuggcgcugugaaucuaaucggagccauacaaccaucgccaaauacgcucaauaucaggcguccucuuuccaggagagccugagagaagagaacgagaagcggacccaacacaaggaucauuccgacaaugaaucuacaagcuccgagaacagcgggcgcagacggaaaggacccuuuaagaccauuaaauucggcacaaauaucgaccucucugauaacaagaaauggaagcugcagcuccacgaacugacgaaacuucccgccuuugcuagaguuguguccgccgggaaucugcucacccacgucggacauacaauccugggcaugaacaccgugcagcuguacaugaagguuccugggagccgcacaccgggccaccaggagaauaacaacuucugcuccgugaauauuaacaucggacccggcgacugugaaugguucgucgugccugaggauuauuggggaguucuuaaugacuuuugcgagaagaacaaucugaacuuccucaugucuagcugguggcccaaucuggaagaucucuacgaggccaacgugccugucuaucgguuuauucaaagacccggggaccugguguggaucaaugcuggcaccgugcauuggguccaggccguugggugguguaacaauauugcguggaacgugggaccucuuacggcuugccaguacaaacuggccguggaacgcuacgaguggaauaagcugaaauccgucaagucuccggugcccaugguucaccucagcuggaacauggccagaaauaucaagguguccgauccuaaacuguucgagaugaucaaguauugucuucugaaaauucucaagcaguaccaaacccugcgggaagcucucgucgccgcgggcaaagaggugaucuggcauggccgcacaaacgacgaacccgcucacuauugcagcauuugugagguugaaguguuuaaucugcuuuucgucaccaacgagucuaacacacagaagaccuacaucgugcacugccaugauugugccagaaaaacauccaagagccuggagaauuuuguugugcuggaacaguauaagauggaggaccucauucaggucuacgaucaauucacccuggcccuuucucuguccagcucuagcuga

SEQ ID NO: 77714 - RNA, 2100 nt, Artificial Sequence
  derived and/or modified sequence opt5 from UVRAG__Homo_sapiens__NP_003360
augagcgccuccgcuucugugggcgggcccgucccucagccgcccccuggacccgccgcggcucugccucccggcagcgccgccagagcucuccacguugagcugccuucccaacagcggcgccuuagacaucugcggaacaucgccgcucgcaauauugugaacagaaaugggcaccagcuccuggacaccuacuucacacuucaucugugcucuacggaaaagaucuauaaagaguuuuaccggagcgaagugauuaagaacucccucaauccgaccuggcgcucucuggauuucggaaucaugcccgacagacuggauacaagcgucuccuguuuugugguuaaaauuuggggcgggaaggagaacaucuaucagcuccugaucgaauggaaagugugccuugacggacugaaguaccucggccaacagauucacgcccggaaucagaacgagaucauuuucggccugaaugauggguauuacggagcgccuuuugagcauaagggcuauagcaacgcccagaaaaccauccuucugcaagucgaccagaauugugugcgcaacucuuacgauguuuucucccuccugagacugcaccgggcucagugcgccauuaagcagacacaagugaccguccagaaaaucgggaaggaaauugaggaaaaacuccgccugacaagcaccucuaaugagcuuaagaagaaauccgagugucugcagcucaagauccuggugcuucaaaacgaacuggagagacagaaaaaggcucucggacgggaaguggcccugcugcacaaacagcagaucgcgcuccaagacaagggcagcgccuuuucugcugagcaucugaaacuucagcugcagaaggaaucccucaaugagcugcgcaaggagugcacggccaaaagagaacuuuuccugaagaccaacgcucagcucacaauucgguguagacaacugcugagcgagcucuccuacaucuaucccauugaucugaacgaacacaaagacuacuuugucugcgggguuaaacuuccuaauucugaggauuuccaggccaaggacgauggaagcaucgccguggcucugggcuauaccgcgcaucucguguccaugauuagcuuuuuccugcaggucccccugcgcuacccgaucauccacaagggcucucgguccacaauuaaggacaacaucaaugacaaacuuaccgaaaaggagagagaguuuccucucuaucccaaagggggagaaaagcugcaguucgauuacggcguguaucugcucaacaaaaauauugcccaacugcgcuaccagcacgggcuuggaacgccugaccugcggcagacacuccccaaccugaagaauuucauggagcauggccugaugguuagaugugaucgccaccauaccagcucugcuauccccgugccuaagcggcagagcuccauuuuugggggagccgacgucggcuucucuggcgggaucccgagccccgauaaaggacacagaaagcgcgccuccagcgaaaacgagcggcuucaauacaaaacaccucccccuucuuauaauuccgcucucgcccagcccgugaccaccguuccgagcaugggcgaaacagagagaaagaucacgucucuguccagcucccuggacaccucucucgauuuuagcaaagagaacaagaagaaaggggaagaccuggugggaucccuuaauggcgggcaugcgaacguccacccuucucaggagcaaggcgaagcucugagcggacaccgcgccacagugaauggcacccuccugcccuccgagcaggccgggagcgcuucuguccagcugccuggagaguuccaucccguguccgaagccgagcuuugcuguacaguugaacaggcugaggaaauuaucggccucgaggccaccggguuugcgagcggagaucaacuggaggccuucaacugcauuccuguggacucugcugucgccguggaaugcgaugagcagguucugggcgaauuugaggaguucucccggagaaucuacgcucucaaugaaaacgugagcucuuuucggcgccccagacggagcuccgacaaguga

SEQ ID NO: 77715 - RNA, 2457 nt, Artificial Sequence
  derived and/or modified sequence opt5 from UVSSA__Homo_sapiens__XP_011511824
augcagggccacgcccaucccccugagaaggaaaccccggcuagacggcgcagacccccucccugcacacaaccucgggagcccagccgcgccuccgcgcugagagggcucugucgggcuccucgcgaauggggaccgcaccaugcucccccuaaacccagauucccuaagcggggccuucaggugcgccccucugccgccgaccuggcccugccgugcgucagaggguguggacuccggcgccaggauggcagacggcugugcuuuagcuuccgcccugggcccgcuagagcccagggauaccuucuguguguuuggcggagagacauggaucaaaaacucuccaagcugguggaggaacugacgaccucuggcgagccucgccucaaccccgagaaaaugaaggaacugaagaaaaucugcaagagcuccgaggaacagcuuucucgggcguauagacugcucauugcccagcugacacaggagcacgcugagauccgccuuagcgccuuucaaauuguggaagaacuguucguccggucccaucaguuuagaaugcucgugguuagcaauuuccaggaauuucuggagcugacccucggcacagaccccgcucagccucugccgcccccucgcgaagccgcgcaacggcuuagacaggccaccacacgcgcuguggagggguggaacgagaaauucggagaagccuacaagaaacuggcucucggcuaucacuuucugcggcacaauaagaaggucgauuuccaggacaccaacgccagaucucuugccgagcgcaaacgggaagaggaaaagcaaaaacaucuggauaagaucuaccaggagagagcuucccaggcggagcgggaaaugcaggagaugagcggggaaauugagucuugucucacggaaguggaguccugcuuucgccugcugguucccuucgacuuugauccuaaucccgagaccgaaagccucggaauggccucuggcauguccgacgcucugagaagcuccugugccgggcaagugggaccgugccggucuggcacaccugaucccagagacggcgagcagccuuguugcagccgcgaucuucccgccuccgcugggcacccucgggccggaggcggggcgcagcccagccagaccgcuacaggagacccgucugacgaagaugaggacuccgaucuggaggaguucgucagaagccauggccucgggucucacaaauauacccuggacguggagcuuugcagcgaaggacugaaggugcaagagaacgaagauaaucucgcccugauccacgccgcucgcgacacgcugaaacucaucagaaacaaguuccugccugccgucuguuccuggauucagcgguuuacacgcguuggcacccauggcgggugccuuaagagagcuaucgaucugaaagccgagcucgagcuggugcugcggaaguacaaagaacuugacauugagcccgaaggaggcgagcgcagacggacagaagcgcucggggaugccgaggaggacgaagaugacgaggacuucguggaaguccccgagaaggaaggauaugagccucacaucccggaucaucugcgccccgaguacggccuggaagcugccccugagaaagacaccgugguuagaugucuccggacccgcacaagaauggaugaagaggugucugaccccacgagcgcugccgcgcagcugcggcagcuuagagaucaucugccucccccuuccagcgccucucccucccgcgcucucccggagccucaagaagcccagaagcuggcugccgagcgggccagagcucccgucgugccuuacgggguugaccugcacuauuggggccaggaacuucccaccgcgggaaagauugugaaaagcgauucucagcaccgcuuuuggaagccguccgaggucgaagaggagguggucaaugccgacaucagcgaaaugcuccgguccagacacauuacauucgcuggcaaauuugagccugugcaacauuggugccgcgcuccccggccugaugggagacugugugaacgccaggaccggcugaagugccccuuccacggaaaaaucguucccagagaugacgagggccggccucucgauccggaagaccgcgccagagagcagcggcgccaacugcagaagcaggagagacccgaauggcaggacccugagcuuaugcgggauguggaagccgccaccgggcaagaccugggaucuagcagauacuccggcaaggggcgcggcaaaaagcggagauaucccucucucacaaaccugaaagcgcaggcugauaccgcccgcgcccggaucggaagaaaggucuuugcuaaagccgcggugcgccggguuguggcugccaugaauagaauggaccagaagaagcaugagaaauucagcaaccaguuuaauuacgcccugaacuga

SEQ ID NO: 77716 - RNA, 1278 nt, Artificial Sequence
  derived and/or modified sequence opt5 from UXS1__Homo_sapiens__NP_001240804
auggugagcaaggcccugcucagacuggucuccgcuguuaaccggcgcagaaugaaacuucugcucggcaucgcccugcuugcguacguggcuucugugugggggaauuucgucaacaugagcuuucugcucaaucgguccauucaggagaacggagaacugaagaucgagucuaaaauugaagagaugguggaaccccugcgcgagaagaucagagaccucgagaaaucuuucacccaaaaguauccuccgguuaaguuucuguccgaaaaagaucggaagcgcauucuuaucacaggcggggccggauucgugggcucucaccugacggacaaacucaugauggaugggcaugaggucaccgugguugacaacuuuuucacaggaagaaagcggaauguggaacacuggaucggccaugagaauuuugagcugauuaaccacgaugucguggaaccccuuuacaucgagguggaccagauuuaucaucuggccagcccugcuuccccucccaauuacauguauaaccccaucaaaacccucaagacaaauaccauuggcacacugaacaugcuggggcucgccaagcgcgucggagcuagacugcuucuggccagcaccucugaaguuuacggcgauccugaggugcacccgcaguccgaagacuauugggggcacgugaaucccaucggaccucgggcgugcuacgaugagggcaaacgcgucgccgagacgauguguuacgcuuauaugaagcaggaagggguggagguuagaguggcccggauuuucaacaccuuuggaccccgcaugcauaugaaugacggcagagucgugagcaacuucauccuccaagcucugcagggcgaaccucuuacaguuuacgggucuggaucccagacccgggccuuucaguaugugagcgaucuggucaacggccucguggcgcugaugaauagcaacgucuccagccccgugaaucuggggaacccggaggaacacacaauccucgaguucgcccaacugauuaaaaaucuuguuggauccggcucugagauccaguuucugagcgaagcucaggacgauccucagaagagaaaacccgacauuaagaaagccaagcucaugcuggggugggagccuguggucccccuugaagagggacugaacaaggcuauccauuacuuccgcaaagaacucgaguaucaagccaauaaccaguacauucccaagccuaaaccggcccggaucaagaaaggcagaacccgccacuccuga

SEQ ID NO: 77717 - RNA, 474 nt, Artificial Sequence
  derived and/or modified sequence opt5 from UXT__Homo_sapiens__NP_004173
auggccacacccccuaagagacgggcuguggaggccaccggcgaaaaaguccugcgcuacgagacguucaucagcgacguucuccagagagaucugcggaaggugcuugaccaccgcgauaaaguguaugaacaacuggcgaaguaccuccagcugagaaacgucauugagcggcuucaggaagcuaaacauuccgagcuguauaugcaaguggaccucgggugcaacuuuuucguugauaccguggucccggacacaucucgcaucuacguggcccugggauauggcuuuuuccuggagcucacccuggccgaagcucuuaaguuuauugauagaaagagcucccugcucacagagcugucuaauagccuuaccaaagacuccaugaauaucaaggcccacauucauaugcugcucgaagggcugcgggagcugcagggacuccagaacuuccccgagaaaccucaccauuga

SEQ ID NO: 77718 - RNA, 2349 nt, Artificial Sequence
  derived and/or modified sequence opt5 from VAC14__Homo_sapiens__NP_060522
augaaccccgagaaggacuucgccccucugaccccgaauaucgugagagcucucaacgauaaacuguacgaaaagcggaaagucgccgcgcuugagauugaaaagcugguucgcgaguuuguggcucagaauaacacagugcaaaucaaacacgucauucagacgcucagccaggaguucgcccugucccagcauccccacucuagaaagggcgggcuuaucggacuggccgcuugcagcauugcccucggcaaggacuccgggcuguaucugaaagaacucaucgagccugugcugaccuguuuuaaugaugcugacucucggcuucgcuacuaugccugcgaagcgcuguacaacaucguuaagguggccagaggagcuguccucccccauuucaaugugcuguuugauggccuuagcaaacuggccgcugacccugaucccaacguuaaguccgggucugagcuccuggaccggcugcucaaagauauugugacagaaagcaauaaguucgaccuggucuccuuuaucccucuucugcgcgagagaauuuauagcaacaaucaauacgcccggcaguucaucauuucuuggauccucgugcuggaguccgugccggauauuaaccuucuggacuaucuccccgaaauccuggauggacuguuucagauccucggcgacaauggcaaggagauucgcaaaaugugugaagucguucugggggaguuccuuaaggaaaucaaaaagaacccuagcucugugaaauuugcggagauggccaauauucuggugauccacugccagaccacagacgaucucauucaacugaccgcuauguguuggaugagagaguucauccagcuugccggacgggucaugcugcccuacuccagcggcauccucacagcugugcugccuugccuggccuacgacgaucgcaagaaaucuauuaaggaaguugccaacguguguaaccagucccucaugaagcuggucacccccgaggacgaugaacuugacgagcugagaccggggcagcggcaagcugaaccuacgcccgaugacgcgcucccuaaacaggagggaaccgccagcggcgggcccgauggauccugcgacucuagcuuuuccagcggcaucucuguguucacagcugccuccaccgagcgcgcccccguuacacugcaucuggauggcauugugcagguccuuaauugucaccucagcgacaccgcuaucgggaugaugacgagaauugccgugcugaaguggcuguaucaccucuacaucaaaacaccucggaagauguucagacauaccgacucucuguuuccgauccuucugcaaacacucagcgaugaauccgacgaggucauucugaaagaucuggaagugcuugcggagaucgcuucuagccccgccggacagaccgacgauccuggcccccucgacgggccugaucugcaggccucccacagcgaacugcagguucccaccccgggacgcgcuggccuccugaacacaucugggacgaagggacuugagugcuccccuagcacccccacaaugaacucuuauuucuacaaguuuaugauuaaucugcucaaacgguucuccagcgagagaaagcugcuggaagugcgcggcccuuuuaucauucggcaacuuugucuccugcugaaugccgagaacaucuuccauuccauggcugacauucuccugagagaagaggaucuuaaauuugccucuaccaugguccacgcgcugaauacaauccuccugaccagcacggagcuguuccagcuucgcaaccagcucaaggaccugaaaacacuggaaucccagaaucucuuuugcugccuguaucggucuuggugucacaaccccgugaccaccguuagccuuugcuuccugacacaaaauuacagacaugccuaugaucucauccagaaguuuggcgaccuggaggugaccgucgauuuccuggcugaaguggacaaacuugugcagcugauugaguguccuaucuuuacauaccuccgccugcagcuccuggacguuaagaacaaucccuaccuuauuaaggcccuguaugggcuccugaugcugcuuccgcaauccagcgcuuuccagcugcucucucaccggcugcagugcgucccuaaccccgaacuccugcagacggaggauucccuuaaagccgcgcccaagagccaaaaagccgacucuccuuccaucgauuacgcugagcugcuccagcauuucgaaaaggugcagaauaagcaccuggaggugagacaucaacgcagcggacggggcgaccaccuggauagacgggucgugcuuuga

SEQ ID NO: 77719 - RNA, 351 nt, Artificial Sequence
  derived and/or modified sequence opt5 from VAMP1__Homo_sapiens__NP_001284367
augagcgcccccgcucagccuccggccgagggcaccgaagggacagcgcccggaggcgggccucccggaccucccccuaacaugacguccaauagacggcugcaacagacccaggcucagguggaggaagucguugacaucauucgcgugaacguggauaagguccucgagagagaccaaaaacugucugaacuugaugaccgggccgaugcccugcaggcuggcgccagccaguucgaguccucugcugccaagcucaaacgcaaguacugguggaaaaauugcaagaugaugaucaugcugggggcgauuugugccaucauugugguugugaucgucagacggggauga

SEQ ID NO: 77720 - RNA, 351 nt, Artificial Sequence
  derived and/or modified sequence opt5 from VAMP2__Homo_sapiens__NP_055047
augagcgccaccgcugccacagcgcccccugcugccccggccggcgaagggggacccccugcucccccucccaaccugacguccaauagacggcuccagcaaacccaggcccagguggacgaggucguugauaucaugcgcgugaacguggacaagguccuggagagagaucagaaacuuucugaacuggacgaucgggcugacgcccuccaagcgggcgccagccaguucgagacauccgcugccaagcugaaacgcaaguacugguggaaaaaucuuaagaugaugauuauccugggggugauuugcgcuaucauucucaucaucauuaucguuuauuuuucuaccuga

SEQ ID NO: 77721 - RNA, 423 nt, Artificial Sequence
  derived and/or modified sequence opt5 from VAMP4__Homo_sapiens__NP_001172056
augcccccuaaguucaaaagacaccugaacgacgaugacgugaccggcagcgucaaguccgagcggcgcaaucuccuggaagaugacucugaugaggaagaggacuuuuuccuugggccgagcggacccagauuuggcccucggaacgauaaaaucaagcauguucagaaucaaguggacgaagugauugaugucaugcaggagaacaucacaaaagugauugagcgcggggaaagacuggacgagcuccaggauaaguccgaaucucugagcgacaaugccacggcuuucuccaaccggucuaagcagcuucgcagacaaaugugguggcggggaugcaaaaucaaggccauuauggcgcugguugcugccauccuccugcuggugaucauuauccucauugucaugaaauaccgcaccuga

SEQ ID NO: 77722 - RNA, 540 nt, Artificial Sequence
  derived and/or modified sequence opt5 from VAMP7__Homo_sapiens__NP_001138621
auggccauccuguucgcuguggucgccagaggcaccacaauucucgcgaagcacgcuuggugcgggggaaacuuucuggaggacuucgaacggagccgcgccuuuaauuuccuuaacgagaucaaaaagagauuucagacgaccuacggcucccgggcccaaacagcucugcccuaugccaugaacucugaguucagcuccguucucgcugcccagcugaaacaucacucugaaaauaaggggcuugauaaagugauggaaacccaggcccagguggacgagcugaagggaauuaugguccgcaauaucgaucucguggcgcaaagaggcgagcggcuggaacugcucauugacaagacagagaaccugguugauagcuccgugaccuuuaaaacaaccucucgcaaucuugcuagagccauguguaugaagaaccugaaacucacgaucaucauuaucauugucagcaucguguucauuuacaucauuguuuccccucugugcgggggauuuaccuggccgagcugugugaagaaauga

SEQ ID NO: 77723 - RNA, 303 nt, Artificial Sequence
  derived and/or modified sequence opt5 from VAMP8__Homo_sapiens__NP_003752
auggaggaagccagcgagggcgggggaaacgacagagugcggaaucugcaguccgaagucgagggcguuaagaacaucaugacccaaaauguggaacgcauucucgcuagaggggagaaccuggagcaccuucggaauaaaacagaagaucuggaggccacgucugaacauuucaagaccacaagccagaaaguggcgcgcaaguuuugguggaaaaacgucaagaugaucgugcucauuugcguuaucguguucauuaucauccuguuuauuguccuuuucgcuaccggagccuuuuccuga

SEQ ID NO: 77724 - RNA, 1566 nt, Artificial Sequence
  derived and/or modified sequence opt5 from VANGL2__Homo_sapiens__NP_065068
auggacaccgagagccaguacuccggcuauucuuacaagagcgggcacuccagaucuagccggaaacaucgcgauagacgggaccgccacagauccaagucucgggauggaggccgcggggacaaaagcgugacaauccaagcccccggagaaccucugcucgauaacgaguccacgagaggcgacgaacgggaugacaauuggggagagaccacaaccgucguuacagggaccagcgaacauucuauuucccacgaugaccugacacgcaucgcuaaggauauggaggacagcgugccgcuugauugcucuagacaucugggcguggccgcgggcgcuacccucgcccugcuuuccuuccugacgccccucgccuuucugcugcucccuccccugcuuuggcgggaggaacuggagccuugugggaccgcuugcgaaggacucuucauuagcgucgccuuuaaacugcuuauccugcuccugggcucuugggcucuguucuuucgcagacccaaggccucccucccucggguguucguucugcgcgcgcuucugauggugcucgucuuucugcuugugguuagcuauuggcuguucuacggggugcggauucucgacgccagagagagauccuaucagggagucgugcaguuugcugugucucuggucgacgcccuccuguucguucacuaccuggcuguggugcuucuggagcuccgccagcugcaaccgcaguuuacacuuaaggucgugcggagcaccgauggcgccuccagauucuauaacguugggcaccugagcauccagcgcguggcggucuggauccucgaaaaauacuaccaugacuuucccguguauaauccugcccugcugaaccuccccaagucuguucuggcuaaaaagguguccggauucaaagucuacagccuuggcgaggaaaauucuacaaacaauagcaccggccagucccgggccgugauugcugccgccgcuagacgccgggauaacucucacaaugaguauuacuaugaagaggcggagcaugaaagacgcguccggaagagacgcgcccggcuggugguugcuguggaggaagccuucacgcacaucaagagacuccaagaggaagaacagaaaaacccucgggaggucauggacccccgcgaagccgcucaggccauuuuugcgagcauggcuagagccaugcagaaguaccugcggacaaccaaacaacagccguaucacacaauggaguccauccugcagcaucuugaguucuguauuacccacgauaugaccccuaaggccuuucucgagagauaccuggcugccgggcccacaauccaauaccauaaagaacgcuggcuggcuaagcaguggacgcucgugagcgaggagccuguuaccaauggacugaaagacggcauuguguuccuucugaagcggcaggauuuuucucucgucguguccacaaagaaagugcccuucuuuaagcugagcgaagaguucguugaccccaaaucucacaaguuugucaugagacugcaguccgaaaccagcguguga

SEQ ID NO: 77725 - RNA, 885 nt, Artificial Sequence
  derived and/or modified sequence opt5 from VAPA__Homo_sapiens__NP_003565
auggccagcgcuuccggcgccauggcgaagcacgagcagauccuggugcucgacccuccuaccgaucugaaauucaaggggccguuuacagacgucguuacgaccaaccuuaaacugagaaaucccucugaucggaaggugugcuucaaagugaagacaaccgcuccucgcagauacuguguccggcccaacagcggaauuaucgacccuggcuccacagugaccguuucugugaugcuccaacccuuugauuaugacccuaaugaaaagagcaaacauaaguucaugguccagacaauuuuugccccgcccaacaccuccgauauggaggccguguggaaagaagcuaagccugacgagcugauggauucuaaacuucgcugcguuuucgaaaugcccaaugagaacgacaagcuggggaucacgccucccggaaaugccccgaccgugacaagcauguccagcauuaacaauaccgucgcuacacccgccucuuaccacaccaaggaugaccccagaggccucuccgugcugaaacaggagaagcagaaaaacgauauggaaccuagcaaggcggugccccugaaugccucuaaacaagacgggcccaugccuaagccgcauuccgucagccucaacgacacggagacacggaaacugauggaagaguguaagcgccuucagggagagaugaugaagcugucugaagagaauagacaccuccgggaugaaggccugcgccuuagaaaaguugcucauuccgacaagcccggcagcaccuccacagccucuuuucgggauaacgugaccagcccucugcccucccuccugguggucaucgcugccaucuucauuggguuuuuccugggaaaauuuauccucuga

SEQ ID NO: 77726 - RNA, 300 nt, Artificial Sequence
  derived and/or modified sequence opt5 from VAPB__Homo_sapiens__NP_001182606
auggccaagguggagcagguccugagccucgaaccccaacacgagcugaaauucagaggcccuuuuaccgacguugugacaacgaaccuuaagcuggggaauccgaccgaucggaacgugugcuucaaagucaagacaaccgcuccccgcagauacugugugcggccuaauuccggaaucauugacgccggcgcgucuaucaacguuagcgggcgcagauggacagcugaugaagaggacuccgccgaacagcagccccauuuuucuauuagcccuaauugggagggacggcgccccuga

SEQ ID NO: 77727 - RNA, 2772 nt, Artificial Sequence
  derived and/or modified sequence opt5 from VARS2__Homo_sapiens__NP_001161205
augugcauucccccuccgaacgugaccggcagccugcacaucgggcaugcccucacagucgcuauccaggacgcccugguuagauggcaccggaugcgcggagaucaagugcuuugggugcccggcuccgaccaugcggggauugcuacgcaggccgucguggagaagcagcuguggaaagaaagaggaguucggcgccacgagcucucuagagaagccuuccugcgggagguguggcaguggaaggaagcuaaaggcggggagaucugugagcaacuucgcgcccugggagcuagccucgauugggacagagaaugcuuuaccauggaugucggcuccucuguggccguuacagaggcguucgugcggcuguacaaggccggccugcucuaucgcaaucaucagcuggucaacuggagcugugcucuuagauccgccauuucugacaucgaaguggagaaucggccucugcccgggcacacccagcuccgccugccuggaugccccacaccugugagcuuuggccuucuguucuccgucgcuuuuccgguugauggggagcccgacgccgaagugguggucggaaccacaagaccugagacccuccccggcgauguggcgguugccgugcacccugacgauagccgguacacgcaucugcacgggcgccagcugagacauccccucaugggacaaccgcugccucuuaucaccgacuaugcuguccagccccacgugggcacaggcgccguuaaagugaccccugcucacucucccgccgaugccgaaaugggggcucggcauggacugagcccccucaacgucauugcggaggacggcacaaugaccucccuguguggggacuggcuucagggacugcacagauucguggcccgcgaaaagaucaugucuguccucuccgaguggggccuguuucgggggcugcagaaucauccuauggugcucccgauuugcagcagaucuggagauguuaucgaguaccugcuuaagaaccaaugguucgugcgcugucaggaaaugggcgcucgggccgccaaagcugucgaguccggcgcccuggaacucagccccuccuuucaccagaagaauuggcaacauugguucucucacauuggggacuggugcgugagcagacagcugugguggggacaccagaucccugcguaucuuguuguggaggaucaugcucagggcgaagaggacuguugggucguggggcgcuccgaggccgaagcccgggagguggcugccgaacugacgggaagacccggcgcugagcucacacuggaacgcgauccugacguucuggauaccugguuuagcucugcccucuuccccuuuuccgcgcugggguggccgcaagagacaccugaccuugcccgguucuacccccugagccuccuggagaccggcucugaucugcuucucuucugggucggaagaauggugaugcugggcacccagcugacagggcagcucccuuuuagcaaagugcugcuucaccccaugguccgcgaccggcagggaagaaagauguccaaaucucugggcaacgugcucgauccucgggacauuaucagcgggguugaaaugcaagugcugcaggagaagcugcgcuccggaaaucuugaccccgcugaacucgccaucgucgcugccgcgcagaagaaagauuucccgcauggcauuccugagugcgggacggacgcccugagauuuacccuguguagccacggcgugcaggcuggagaucuccaccugucuguuuccgaggugcaaagcugccggcauuucugcaacaagaucuggaaugcccuuagauuuauucugaacgcucucggcgaaaaauucgucccccagcccgccgaggaacugucuccuuccagcccgauggacgccuggauccugucccgccuugcucucgcggcccaggagugugaacggggguuucugacaagagagcugucucucgugacccacgcucugcaucacuucuggcuucauaaucugugcgauguuuaucucgaggccgugaagcccguccuguggcacagcccucgcccccugggaccuccccaggugcucuuuuccugugccgaccuuggccugagacugcucgcuccucugaugcccuuccuugccgaggaacuguggcaacggcucccgccucgccccgggugcccucccgcgccgucuauuagcguggcuccuuaccccuccgccuguagccuggaacacuggagacagccugagcuggaacggcgcuuuucuagaguccaggagguugugcaagugcuucgggcccugcgcgcuacauaccagcucaccaaagccagaccccggguccugcuccaguccagcgagcccggagaucagggccuguucgaagcguuucuugagccucuggggacgcucggcuauugcggagcugugggccugcugccgcccggggccgccgcuccuucuggaugggcccaagcuccccuuuccgacacagcccagguuuacauggaacugcagggccucguggauccucagauccaacugccccuccuggcggcccgcagauauaaacuucagaagcagcuggacagccucaccgcucggaccccuucugagggggaagccggaacacagagacaacagaagcugagcucccugcagcuugagcugagcaagcucgauaaagcugccucucaucugcgccaacucauggacgagccgcccgccccuggcucccccgaacuguga

SEQ ID NO: 77728 - RNA, 3795 nt, Artificial Sequence
  derived and/or modified sequence opt5 from VARS__Homo_sapiens__NP_006286
augagcacccuguacgugucuccccacccugacgccuucccgucccucagagcucugaucgccgcgcgguauggcgaggcuggggaaggacccggcuggggaggagcccauccucgcauuugccuucagcccccucccacaagcagaacgccuuuuccgcccccucggcugcccgcccucgagcaaggcccugggggacugugggucuggggcgcuaccgccguugcucagcuucuguggcccgccggccucgggggaccgggcgggucccgcgcggccgugcuggugcagcagugggucucuuacgcugauacagaacugaucccugccgcuuguggagccacccuccccgcgcugggccuuagaagcuccgcccaagacccucaggcugugcugggggcccucggacgggcucugucuccccuugaggaauggcugcgccuccacacauaucuggccggcgaggcccccacccuggcugaucucgcggccguuacagcucugcuucugccuuucagauacgugcucgacccgcccgcccggcgcauuuggaacaaugucaccagaugguuugugacgugcguucggcagccugaguuccgcgccgugcugggcgaagucgugcuuuauagcggggcuagaccccugucccaucagccuggacccgaggccccggcgcucccuaagaccgcugcccaacugaaaaaggaagccaaaaagcgggagaaacuggagaaguuucagcagaagcagaaaauccaacagcagcaacccccucccggcgaaaagaaaccuaagcccgagaaacgcgaaaagagagauccgggggugauuacauacgaccucccuaccccucccggagagaagaaagaugucagcggccccaugccggacucuuauucccccagauacguugaagcugccugguacccuuggugggagcagcagggguucuuuaagcccgaguauggaagaccuaacgugagcgcugccaauccccgcggcguguucaugauguguaucccucccccgaacgucacaggcucucugcaccuugggcaugcgcugaccaaugccauccaggauucccucacgcgguggcacagaaugcgcggagaaacaacccuguggaacccuggcugcgaccacgcugggauugccacacaagugguuguggagaaaaagcuguggcgggaacagggacuuagcagacaucagcucggccgcgaggcuuuucugcaggaagucuggaaauggaaggaggagaaaggggaucggaucuaccaccaacugaagaagcucggaucuucccuggacugggauagagccuguuucaccauggaccccaaacuuagcgcggccgugaccgaggcuuuuguucgccugcaugaagaaggcauuaucuaucgguccacaagacucgugaauuggucuugcacgcugaacagcgccauuuccgacaucgaggucgauaagaaagaacugaccggccgcacacuucucagcgugccuggguacaaggagaaagucgaguucggagugcugguuucuuuugcuuauaaggugcagggcuccgacagcgaugaagaggucgugguugccaccacacggauugaaaccaugcugggggacguggccgucgcugugcaccccaaggauacgagauaccagcaccucaaaggaaagaaugugauccauccguuccugucucggagccuuccuaucguuuucgacgaguuugucgauauggacuucggcacaggggcggugaaaauuacccccgcccacgaucagaacgacuaugaggugggccaacgccauggacuggaagcuaucuccauuauggauucuagaggcgcccucaucaaugucccuccucccuuucuggggcugccccgguucgaggccagaaaggcugugcuuguugcccucaaagaacgcggacuguuucggggcauugaggacaacccgaugguggucccccuguguaauagaagcaaggacgugguugaaccucuccugcgcccccagugguacgugagaugcggggagauggcgcaggcugccuccgccgcugucacccggggagaucuucgcauccugccugaggcccaccagagaacauggcaugcguggauggacaacauccgggaaugguguauuagccgccaacucugguggggccacagaauccccgcuuacuucgugaccguuucugauccugccgugccgcccggggaggacccugauggccgguauugggucuccggacgcaaugaagccgaggcuagagaaaaggccgcuaaagaguuuggcgugagccccgacaagauuucucugcagcaggaugaggacgugcuggauacaugguucuccagcgggcuuuuuccucucuccauccugggauggcccaaccaaucugaagaccugagcgucuucuacccgggcacgcuccuggagaccgggcacgauauucuguuuuucuggguugcccggauggugaugcuuggacucaaacugacaggccgccugccuuuuagagaaguguaucuucaugcgaucguccgggacgcccacgggagaaagauguccaaaucucucggcaacgugaucgauccccuggacguuauuuacggaaucagccugcagggccuccauaaucagcugcuuaacuccaaucuggaccccagcgagguggaaaaggcuaaggaggggcagaaagccgauuucccugcugggauucccgagugcggcaccgacgcccuccgcuucgggcugugugccuauaugucucaaggacgggauaucaaccuggacgucaaucggauucuuggcuaccgccacuuuugcaacaagcuguggaaugcuacaaaauucgcgcuccggggccuggggaagggauuugugccuuccccgaccagccagcccggcgggcacgaaucucucguugauagauggauccgcucccggcugacggaggccgugagacuuagcaaccagggauuccaggcuuaugacuuuccugccgucaccacagcccaauacucuuucuggcuguacgaacucugcgauguguaucuggagugucugaaacccguucuuaauggcguggaccaggucgcugccgagugcgcgcgccagacccuguacacaugucucgauguggggcugcggcuccugagcccuuuuaugcccuucgugaccgaggaacuuuuucagagacugccgcggcgcaugccucaagcucccccuucccucugcgucacgcccuauccugaacccagcgaguguucuuggaaggacccggaagccgaggccgcucuggagcuggcccuuuccauuacaagagcgguucggagccugcgcgcugauuacaaccucaccagaauccggccugacugcuuccuggaaguggccgaugaggccacaggagcucucgccuccgcugugucuggcuauguccaggcccuggcgagcgccggcgugguugcugugcuugcccugggggcucccgcuccccagggaugugccgucgcccuggcguccgacagaugcucuauccaucuccaacugcagggccuuguggacccugcccgcgaacuggggaaacuccaggcuaagcggguugaggcccagagacaagcccagcgccugcgggaaagacgcgcugccagcggauacccggugaaggucccccucgaggugcaggaggcggaugaagcuaaacugcagcaaaccgaggccgaacuucggaaggucgacgaggccauugcucuguuucagaaaaugcuguga

SEQ ID NO: 77729 - RNA, 1098 nt, Artificial Sequence
  derived and/or modified sequence opt5 from VASH1__Homo_sapiens__NP_055724
augcccggcgggaagaaaguggccggaggcgggagcuccggagcuaccccuacaucugccgcggcuacggccccgagcggcgucagacggcuggagaccuccgaagggacaucugcccagcgcgacgaggaacccgaggaagagggagaggaagaucucagagacggcggcguuccuuucuuugugaacagagggggacugcccguggaugaggcuaccugggaacgcauguggaagcacgucgccaaaauccauccugacggcgagaagguggcucaacggauucgcggggccacagaucuucccaaaaucccuauuccgagcguucccaccuuccagccuuccacacccgugccugagcggcuggaagcgguccagagauacauccgggagcuccaguauaaucacaccggaacgcaauuuuucgaaauuaagaagucucgcccccugaccggccuuauggaccuggccaaagagaugacaaaggaagcucucccgaucaaaugccuggaggccgugauccuggggauuuaccucaccaacagcaugccuacacuggagagauuucccaucuccuucaagaccuauuuuagcggaaauuacuuccggcauauuguucuuggcgugaacuuugcuggccgcuauggggcccugggaaugucuagacgggaagaucucauguacaaaccucccgcguuccgcacgcuguccgagcuuguccuggacuuugaagccgcuuauggcagauguuggcacgugcucaagaaggugaaacuggggcagagcgucucucaugauccccacuccguugagcagaucgaauggaagcacagcgugcuggacguggagcggcucggaagagaugacuuccgcaaagagcuggaacggcaugccagagauaugcgccuuaagauuggcaaagggacaggaccuccgucucccaccaaggaccggaaaaaggacgucuccagcccucagagagcucaauccucuccccaccgccggaauagcagauccgagcgccggccuagcggcgauaagaaaacaucugaacccaaggccaugccggaccugaacggcuaccagaucagaguguga

SEQ ID NO: 77730 - RNA, 873 nt, Artificial Sequence
  derived and/or modified sequence opt5 from VASH2__Homo_sapiens__NP_001129946
auguggaugcacguggccaagguccaucccaaaggcggggagaugguuggagcuaucagaaacgccgcguuccuggcuaagccuagcauuccgcaagugcccaauuaccggcucuccaugaccaucccugacuggcugcaagccauucagaacuauaugaaaacacuucaguacaaucacacgggcacccaguuuuucgaaauccgcaagaugagaccccugucugggcucauggagacagccaaagaaaugacccgggagagccugccuauuaagugccuugaagcugugauccugggaaucuaucucacaaacggccaacccuccauugagcgcuuuccuaucucuuucaagaccuacuuuagcgggaauuauuuccaucacgucgugcugggaauuuacuguaacggcagauauggcucccuggggaugucucggcgcgccgagcucauggauaaaccgcugacauuuagaacccuuagcgaccugaucuucgauuuugaagacuccuacaagaaauaccuccauacgguuaagaaagugaagauuggacuguaugucccccacgagccucacagcuuccagcccaucgaauggaagcagcuugugcugaauguuucuaaaaugcuccgggcugauauucgcaaggagcuggagaaauacgccagagacaugcggaugaagauccugaaaccugcguccgcccauagccccacccaggugcgcucuagaggcaagucccucagcccgcggcgcagacaggcuucuccuccccggagacuggggcgccgggaaaaauccccugcccuucccgagaagaaggucgcugaucugagcacacucaacgaagugggauaucagaucagaauuuga

SEQ ID NO: 77731 - RNA, 1143 nt, Artificial Sequence
  derived and/or modified sequence opt5 from VASP__Homo_sapiens__NP_003361
augagcgagaccgugaucugcuccucuagagccacagucaugcuguacgacgauggcaacaagcgguggcuccccgcugggacgggaccucaggccuucagccgcguucaaauuuaucacaauccgaccgcgaacuccuuuagaguggugggccggaaaaugcagcccgaccagcaggucgugaucaauugugcuauuguucgcggggugaaguacaaccaagccacaccuaauuuccaucaguggagagaugcccggcaggucuggggacugaacuuuggcucuaaagaagacgcugcccaguucgcugccgggauggcgagcgcccuugaggcucuggaaggaggcgggcccccucccccuccggcccuccccaccugguccgugccuaauggccccucuccugaggaaguugagcaacagaagcgccagcagcccggaccgagcgagcacaucgaaagacggguguccaacgcuggcgggccucccgccccucccgcgggaggcccucccccgcccccugggcccccucccccgccuggacccccucccccucccggccugccgccuagcggcguccccgccgcugcccauggggcuggaggcgggcccccuccggcucccccucuucccgccgcccaaggaccuggcgggggaggcgcgggcgcccccgggcuggcugccgccauugcuggagccaaacuccgcaaggugucuaagcaggaggaagcguccggcgggccuacagcucccaaagccgagagcggaagaucuggcgggggcggacugauggaggaaaugaaugccaugcuggcucggcgcagaaaggccacccaggugggcgagaaaacaccgaaggaugaauccgcuaaccaagaggaaccugaggcccggguccccgcgcagagcgagucuguucgcagaccuugggagaaaaauuccaccacgcucccccggaugaagucuuccucuagcgugaccacauccgaaacccagccgugcacaccuagcagcuccgacuauagcgaucugcagagagugaagcaagaacuucuggaggaagucaaaaaggagcuccagaaagugaaggaggaaaucaucgaggccuuuguucaggaacugcgcaaacgggggucucccuga

SEQ ID NO: 77732 - RNA, 1182 nt, Artificial Sequence
  derived and/or modified sequence opt5 from VAT1__Homo_sapiens__NP_006364
augagcgacgagagagaaguggccgaggcugccaccggcgaagaugcguccucucccccuccgaagacagaggcugccagcgacccccagcacccugccgcuuccgaaggggccgcugccgcggccgcuucucccccucugcuccggugccugguccuuacgggauucggcggguacgauaaaguuaagcugcaaagccgccccgccgcuccuccggcccccggaccuggccagcucacccugagacuucgggcgugugggcugaacuuugccgaccucauggcucgccagggacuguaugauagacugcccccucuccccgugacaccgggcauggagggcgccgggguggucaucgcugugggagagggcguuuccgaccggaaagccggggaucgcgugaugguccugaauagaucuggaauguggcaggaagaggugaccguuccuagcgugcaaacauuccuuauucccgaagccaugaccuuugaggaggcugcggcccugcucgucaacuacaucacagcuuauauggugcuguucgacuuuggcaaucuucagccugggcauuccgugcugguccacauggccgccggaggcguuggcauggcugccgugcagcucugccggaccguggaaaacgucacgguguucgggaccgcgagcgcuucuaagcaugaggcccugaaagaaaauggaguuacacaccccauugauuaccauaccacagacuauguggaugagaucaagaagauuucccccaaaggcgucgacaucgugauggauccucucgggggaagcgacaccgccaagggcuacaaccugcugaaaccgauggggaagguugugacguauggaauggcuaaucuucugacaggccccaaacgcaaccucauggcccuggcuagaaccugguggaaucaguuuucugucacagcccuucaacugcuccaggcgaaccgggccguguguggcuuccaccugggguaccuggacggagaagucgagcucguguccggcguuguggcucgccugcuugcccuguacaaucaggggcacaucaagccucauauugauagcgucuggcccuuugagaagguggcugacgccaugaaacagaugcaagaaaagaaaaacguuggaaaggugcuccuggucccuggccccgagaaagaaaauuga

SEQ ID NO: 77733 - RNA, 1260 nt, Artificial Sequence
  derived and/or modified sequence opt5 from VAT1L__Homo_sapiens__NP_065978
auggccaaggagggcguggaaaaagcugaggaaaccgagcagaugaucgaaaaggaggccgggaaagagcccgcggaaggaggcgggggagacggcagccacagacugggggaugcucaagagaugcgggccgucguucucgccggauucggcggccugaacaaacuucgccuguuuagaaaagcuaugccugaaccgcaggacggggagcucaagauucgggugaaggccugcggacugaauuucaucgaucuuauggugcgccagggcaacauugacaaucccccuaaaacaccccuggucccuggguuugaguguuccggaaucguggaagcucucggcgauucuguuaagggguacgagauuggagacagagugauggccuucgucaacuauaaugcgugggccgaagugguuugcacgcccguggaguuugucuacaaaaucccugaugacaugagcuucuccgaagcugccgcuuuuccgaugaacuucgugaccgccuaugugaugcuguuugaggucgcgaaucugcgggagggcaugucuguucucgugcauagcgccggcgggggagugggccaggcugucgcccaacuguguuccacagugcccaacguuaccguguucgggacagcuucuaccuuuaagcacgaagccaucaaagauagcgucacacaucuuuucgaccgcaaugccgauuacgugcaggagguuaagagaauuuccgcugaaggaguggacaucguccuggauugccucuguggcgacaacaccgggaagggacugagccuucugaaaccucucggcacguauauucuguacgggucuuccaauauggugaccggcgagacaaagagcuuuuucucuuucgcgaaauccugguggcaggucgaaaaggugaaccccaucaaacuguaugaggagaauaagguuauugccggauuuagccuccugaaccuucuguucaaacagggccgggcugggcucauccgcggaguggucgaaaagcugauuggccuuuacaaucaaaagaaaaucaagccugugguugacucucugugggcccucgaggaagugaaagaggccaugcagagaauccacgaucgggggaacauuggcaagcugauccuggacgucgaaaagacccccacaccgcucauggcuaacgauuccaccgagacgagcgaggccggagaagaggaagaggaccaugagggcgauuccgaaaauaaggagcgcaugccuuuuauucaguga

SEQ ID NO: 77734 - RNA, 2442 nt, Artificial Sequence
  derived and/or modified sequence opt5 from VAV1__Homo_sapiens__NP_001245136
auggagcuguggagacagugcacccacuggcucauccaaugucgggugcugcccccuagccaucgcgucacaugggacggcgcccagguuugcgaacuugcucaggcccugagagauggggugcuccugugucagcuucugaacaaucuccugccgcacgcgauuaaccugcgggaggugaaucuccgcccccaaaugucccaguuccugugccuuaagaacaucagaacguuucugucuaccuguugcgaaaaauucggacucaagcggagcgagcuguuugaggcuuucgaccuuuuugauguccaggacuucggcaaagugauuuacacacuguccgcccucucuuggaccccuaucgcccagaaucgcgggauuaugcccuuuccuacagaagaggaaagcguuggagaugaggacaucuauuccggccugucugaucaaaucgacgauaccguggaagaggacgaggaucuguacgacugugucgaaaacgaggaagcugagggggaugaaauuuaugaggaccucaugagaagcgagcccguguccaugccucauuuccugaagccgcuucagcgguuucugaaaccccaggacaucgaaauuaucuucauuaauaucgaggaucuccugcgcguucacacacauuuucuuaaggaaaugaaggaggcccugggaaccccuggcgcugccaaccucuaccagguguucauuaaauauaaggaaagauuucuggucuacggccgguauugcagccaaguggagucugcguccaaacaccuggaccgcguggccgcugccagagaggauguccagaugaagcucgaagaguguagccagcgggcuaauaacgggcgcuucacgcugagagaccuucugaugguucccaugcaacgggugcucaaauaccaucugcuucugcaggaacucgugaagcacacccaggaggccauggaaaaggagaaucugagacuggcgcucgaugccaugcgcgaccuggcucagugcgucaacgaggugaaacgggauaaugaaacacuuagacaaaucaccaacuuccagcugucuaucgagaaucucgaccagucccuggcccacuacggacgcccuaagauugauggcgaacugaaaaucacaagcguugagcggagaucuaagauggaccgcuaugcuuuucuucucgauaaagcccugcugauuuguaagcggagaggggacuccuacgaccucaaagauuucgugaaccugcauagcuuucagguccgcgacgauuccucuggagaccgggauaacaagaaguggagccacauguuccuucugaucgaggaccaaggcgcccagggguaugaacucuuuuucaaaaccagagagcugaagaaaaaguggauggaacaguuugagauggcuauuuccaauaucuaccccgaaaacgcgacggccaauggacacgauuuccagauguuuagcuucgaggagacaaccucuugcaaggcuugccaaaugcugcuucgcggcacauuuuaucagggcuaccggugucauagaugccgggccuccgcccacaaagaaugucucgggcgcgugccgccuugcggaagacauggccaggacuuccccgggaccaugaagaaagauaagcugcaccggagagcucaggacaaaaagcgcaacgagcugggacucccuaaaauggaaguuuuucaagaguauuacggccugcccccucccccgggggccaucggacccuuccuucggcugaauccuggcgauauuguggaacucaccaaggcggaggcugagcagaacuggugggaaggcagaaauacaagcacgaacgagaucgggugguuccccuguaaucgcgucaagccuuacgugcauggacccccgcaggaccugucuguccaccugugguaugccggcccuauggaaagagccggggcugagagcauucuugccaaccgguccgauggaaccuuucucgugcgccaaagaguuaaagacgcugccgaguucgcgaucucuauuaaguacaauguggaagucaaacacaucaagaucaugacagccgagggccuguaucggauuaccgagaaaaaggcuuuucgcgggcugacagaacucguggaguucuaccagcagaacagccugaaggacugcuuuaaaucccuugauaccacgcugcaguuccccuuuaaggaaccugagaaaagaacaaucagccggcccgccguuggcucuaccaaguauuucggaaccgcuaaagcccgcuacgacuuuugugcgagagaucgguccgaacucagccugaaggagggcgacauuaucaaaauucugaauaagaaggggcaacagggaugguggcgcggcgaaaucuaugggagagugggaugguucccugccaacuacgucgaggaagauuacucugaguauugcuga

SEQ ID NO: 77735 - RNA, 2637 nt, Artificial Sequence
  derived and/or modified sequence opt5 from VAV2__Homo_sapiens__NP_001127870
auggagcaguggagacaaugcggccgguggcugaucgacuguaaggugcugcccccuaaccaccgcgucguuuggccgagcgccgugguguucgaucuggcucaggcccuuagagacgggguccugcucugccagcugcuucauaaucugucccccggaucuauugaucucaaagacaucaacuuucggccucagaugagccaauuccugugucugaagaauauucgcaccuuucucaaagugugccacgauaaguucggccugagaaacuccgaacuuuuugaccccuucgaucuguuugacguucgggauuucgggaaagugaucucugcggucagccgccucucccugcauucuauugcucagaauaagggaaucagaccuuuucccagcgaggaaacaacggagaacgacgaugacguguaccggucccuugaggaacuggccgaugagcacgaccucggcgaagacaucuaugauuguguuccuugcgaggacgggggagaugacauuuacgaagauaucauuaagguggagguccagcagccgaugauccgcuauaugcagaaaaugggcaugaccgaggacgauaagagaaauuguugccugcuggaaauucaagagacagaagccaaauacuaucggacccucgaggacaucgaaaagaacuacaugagcccccugcgccuugugcugucuccugcugauauggccgcuguguucauuaaucucgaggaccugaucaaaguccaucacuccuuucuuagagccaucgauguuagcgugauggugggcgggucuacacuggcgaaggucuuccucgacuuuaaggagcggcugcugauuuauggagaauacuguucccacauggagcaugcccagaacacccucaaucagcugcuugcuagccgcgaagacuucagacaaaaaguggaggaaugcacacugaagguucaggauggcaaauucaagcuccaggaccugcuugugguccccaugcaacgggugcugaaauaccaccuccugcugaaggagcuccugucucauuccgccgagagaccugaacgccagcagcuuaaagaggcucuggaagccaugcaggaucucgcgauguauaucaacgagguuaagcgggacaaggaaacccugagaaaaauuagcgaguuucaauccucuaucgagaaucuccaggugaaacuugaagaguucgggcgccccaaaauugauggagaacucaagguccggagcaucgugaaccacacgaaacaggacagauaccuguuucuguucgauaaggucgugaucguuuguaagcgcaaaggcuauuccuacgagcucaaggagauuaucgaacugcuuuuucacaaaaugaccgacgauccgaugaauaacaaggacgugaaaaagagccaugggaagauguggucuuauggauucuaccugauucaccuccagggcaaacaaggcuuucaguucuuuugcaagacagaggauaugaaacggaaguggauggaacaguucgagauggccauguccaacaucaaaccugacaaggcuaaugccaaccaucacagcuuucagauguauaccuucgauaagacaaccaauugcaaggcuuguaagauguuucugagagggacguucuaccaaggauacaugugcacaaaauguggcgucggggcccauaaggaaugccuggaggugauucccccuuguaaauucaccucucccgccgaccuugacgcuagcggagcgggccccgggccuaagaugguugccaugcagaacuaucacggaaauccggcucccccuggcaaacccgugcucacauuucagaccggcgauguccuggagcugcuccgcggggacccugaaucccccuggugggagggacggcuggugcagaccagaaagucuggcuacuucccgagcuccagcgugaagccuugccccguugaugggcgcccucccaucucucggccucccuccagagaaaucgacuauacagccuacccgugguuugccggaaacauggagcggcaacagacggauaaucuucugaaaagccacgcuucuggcaccuaucucauucgcgaaagaccugccgaggcggagcgguucgcuaucuccauuaaguuuaacgacgaagucaaacauaucaaggugguggagaaagauaauuggauucacaucacagaagccaagaaguucgacagccugcuggagcuugucgaauacuaucagugucauucccucaaagagucuuuuaagcaacuggauaccacacugaaauaccccuacaagagcagagagcgcuccgccucucgggcuagcuccagaagccccgccucuugcgcuuccuauaacuucagcuuucucucuccucaggggcuguccuucgccagccagggcccgucugcgcccuuuuggagcguguucaccccucgcguuauuggaacggccguggcuagauacaauuuugccgcucgggacaugcgcgaacuuucccugagagagggcgaugucgugcggaucuauagccgcaucgggggagaccagggcugguggaaaggggaaacaaacggaagaauuggcugguuccccucuaccuacguugaggaggaagggauccaauga

SEQ ID NO: 77736 - RNA, 2520 nt, Artificial Sequence
  derived and/or modified sequence opt5 from VAV3__Homo_sapiens__XP_011538805
augacccagagccuguccuaccucgccacaagagcugcccccuucaagaaagagcggacgcuguaugaccuuaucucuauguaccugaagcucgaacacacccaaagcuccgugauucugggcgucucuguuagcuccgggucuccugcgcuucagauccugcauagccucccggugugccugcagcccgcuggaggccagucccugcgcaaaaacagacacgggagcggagagucucauacauaucucaaguuucugugucuuaaaaauauucggaccuuccugacagccugcugugaaaccuuuggcaugcgcaaguccgagcuuuucgaagccuuugaucuguucgacgugagagauuuugggaaggucaucgagacacuuagccggcugucucgcaccccuauugcucucgccacgggaaucagacccuucccuaccgaggaauccaucaacgacgaggauauuuacaaaggccugcccgaccugaucgaugaaacacucguggaggacgaggaagaucuguaugacugcguuuacggcgaggaugaagggggagagguguaugaagaccuuaugaaggcugaggaggcccaccaaccuaaauguccggaaaaugauauucggagcugcugucuggcggagaucaagcagaccgaagagaaauacacagaaacccucgagucuauugagaaguacuuuauggcuccccugaagcgcuuccuuacggcugccgaauuugacuccgucuucaucaacauuccugagcuggugaaacuccauagaaaucugaugcaggaaauccacgacagcaucguuaacaagaaugaucagaaccuguaucaaguguuuauuaauuacaaagagcggcucgucaucuauggccaguacugcuccgggguggaaucugcuauuagcucccuggacuauaucagcaagacaaaagaggaugugaagcucaaacuggaggaauguucuaagcgcgccaacaauggaaaguucacccucagagaccugcuugucguucccaugcagcgggugcugaaauaccaccuccugcugcaggagcucgugaagcauacaaccgauccuaccgaaaaagcgaaccugaaacuugcccuggacgcuaugaaggaucucgcccaauaugucaaugaggugaagcgcgacaacgagacacugagagaaauuaagcaguuccagcuguccaucgagaaucuuaaccaacccguucuccuguuuggccggccgcagggggauggagaaaucagaauuacgacccuggacaaacacacaaagcaggagcgccauaucuuccucuuugaucuggcugugauugucugcaaacggaagggcgacaacuacgaaaugaaagagaucauugaccuucagcaauacaagaucgccaauaacccuaccacagauaaggagaauaaaaaguggagcuauggcuucuaccugauccacacccaggggcagaacggacucgaauuuuauuguaaaacgaaggaccugaaaaagaaguggcuggagcaguucgaaauggcccuuucuaauauuagacccgauuacgcugacagcaacuuucacgauuucaaaaugcauacauuuacccgcgugaccuccugcaagguuugccaaaugcuccugcggggcacauucuaucagggguaccuguguuuuaaaugcggagcgagagcccacaaggagugucucggccgcguggacaauugcgggcgggucaacucuggaggccugccuaaaaugcaagugaucagaaauuauagcggcacacccccucccgcccuucaugaagggccgccccugcagcuccaggccggagauaccgucgagcugcugaagggcgacgcccacucccuuuucuggcaggggcgcaaccucgcuagcggagaggugggcuuuuucccuucugaugccguuaaacccuguccuugcgugcccaagccggucgacuacuccugucagccuugguacgcgggggcuauggaacggcugcaggccgagacggaacugauuaauagagugaacagcaccuaucucguucgccaucggacaaaggagucuggcgaauacgccaucuccauuaaauauaauaacgaggcuaagcacaucaaaauucugaccagagauggauucuuucacaucgccgagaaucggaaguucaaaagccuuauggaacugguggaguacuauaagcaucacucccucaaggaaggcuuucgcacacuggacaccacgcugcaauuccccuacaaagagccugagcauucugcugggcagagaggaaaccgggccggcaacagccuucucucccccaagguccuggggaucgcgauugccagauaugauuuuugcgcucgcgacaugcgggaacugucucuccugaaaggagacguggugaagaucuacaccaaaaugagcgccaauggcugguggagaggggagguuaacggccgcgucggaugguucccuuccacauacguggaagaggaugaauga

SEQ ID NO: 77737 - RNA, 1005 nt, Artificial Sequence
  derived and/or modified sequence opt5 from VAX1__Homo_sapiens__NP_001106175
auguucggcaagcccgacaaaauggaugugagaugccacagcgacgccgaggcugcccgggucuccaagaacgcgcauaaagaaucucgcgagagcaagggggcugaaggaaaucugccugccgccuuucucaaagagccgcagggcgcuuucuccgccucuggggcugccgaagauuguaacaagagcaaguccaauucugcggccgaccccgauuacugcagacggauccugguucgcgacgcuaaaggaagcauuagagagaucauucuuccuaagggccuggaucucgaccggcccaaacgcaccagaacauccuuuacggccgagcaacuguaucggcuugaaauggaguuccagcgcugucaguacgugguggggagagaacggaccgagcuggcucgccagcucaaccugagcgagacacaagucaaggugugguuucagaauagacggaccaaacagaagaaggaucagggaaaagacucugaacugcgcuccguugugagcgagacagccgcgaccugcucuguccucagacugcuugaacaaggccggcugcucuccccucccggccugccugcccuucugccgcccugugcuacaggggcccucggaagcgcucugagaggcccuucucugcccgcccucggggccggagcugcggccggcuccgcugccgccgcugccgcggcugccccugggcccgccggagcugccagcccgcacccucccgcugugggcggcgccccugggcccggacccgcgggcccugggggacugcaugccggcgcuccggccgcugggcacucccuuuucucucugcccguuccuagccuccugggauccguggccagccgccuuucuuccgcgccccugaccauggccggcagccucgcuggcaaccugcaggagcugucugcccgguaucucagcuccucugcuuuugaaccuuacagcagaacgaauaacaaggagggggccgagaaaaaggcccuggauuga

SEQ ID NO: 77738 - RNA, 873 nt, Artificial Sequence
  derived and/or modified sequence opt5 from VAX2__Homo_sapiens__NP_036608
augggcgacgggggagccgagagagaucggggccccgcucgcagagccgaaagcgggggaggcgggggacggugcggcgaccgcuccggcgcgggggaucugagagcugacggaggcgggcacucuccuaccgagguggccggaacaagcgccuccucuccggcuggcagccgggaauccggggccgauucugacggacagcccggcccuggcgaggcugaucauugucgcagaauccucguccgggacgccaaggggacgauucgcgaaaucguucugcccaaaggacuugaucuggacagaccuaagcggacccgcacaucuuucaccgcggagcaacucuacagacuggagauggaauuucagcggugccaguauguggugggccgcgagagaacagaacuugcccggcagcugaaccucuccgagacccaagucaaagugugguuccagaauagacgcacaaagcagaaaaaggaucagagccgggaccuggagaagagagcuucuuccagcgccucugaggcuuuugccaccuccaacauucugcgccuccuggaacaagggcggcuucugagcguucccagagcgccuucucuccuggcccuuacgccgucccugcccggacucccugcuagccaccgcggcaccucccugggggauccccggaauagcagcccuagacugaacccccucuccagcgccucugcuuccccgccucugcccccuccccuucccgccguguguuucagcucugccccucugcucgaccugccggcuggauacgaacuuggcagcuccgcguuugagcccuauucuuggcuggaacgcaaagucggcagcgccuccagcugcaagaaagcuaauacauga

SEQ ID NO: 77739 - RNA, 702 nt, Artificial Sequence
  derived and/or modified sequence opt5 from VBP1__Homo_sapiens__NP_001290472
augaacgugcacggcgacggggaggccggacugcaggucagaaccagccaaucccggaaucccggcgggcgcagaccuggacggcagucucgcgcuagaaucccgaagauggccgcgguuaaagauagcugcggcaagggggaaauggcuacaggaaacggccggcgccuccaucugggcauucccgaggccguguucguggaagacgucgauuccuuuaugaaacagccugggaaugagacggccgacaccgugcuuaagaaacuggaugaacaguaccaaaaguauaaguucauggagcucaaccuggcucagaaaaagagacggcuuaaaggacagauccccgagauuaagcagacacuggaaauccucaaauacaugcaaaagaagaaagagucuaccaauagcauggaaacacgcuuucugcuggccgacaaccucuauuguaaggcuuccguuccucccaccgauaaagugugccuguggcuuggcgccaaugucaugcuggaguacgacauugaugaggcgcaggcccuccuggaaaagaaccuuucuacagcuaccaaaaaucuggacagccucgaggaagaucuggacuuccugagagaucaguuuacgaccacagaggugaacauggcccggguuuauaauugggacgugaagcgcagaaacaaagacgauuccaccaagaauaaggcuuga

SEQ ID NO: 77740 - RNA, 1968 nt, Artificial Sequence
  derived and/or modified sequence opt5 from VCAN__Homo_sapiens__NP_001119808
auguucaucaacauuaagagcauccuguggaugugcuccacccucauugugacacacgcccugcauaaagucaagguuggcaaaucucccccugugagagggagccuuuccggaaaggugucucugccgugucacuuuagcacgaugcccacccucccucccuccuacaauacaucugaguuccugcggaucaaauggagcaagauugaagucgacaagaacggcaaagaucuuaaggagaccacagugcugguugcucagaaugggaacaucaaaaucggacaagacuauaagggccgcguguccgucccuacccaucccgaagccgugggggaugcgagccucacaguugugaaacugcuggcuucugacgccggacucuacagaugcgaugucauguauggcauugaggacacccaggauacggugucccugaccguggacggcgucguuuuucacuaccgggccgcuacaagccgcuauacccuuaauuucgaagccgcucagaaggccugucuggaugugggggcggugaucgccacaccugagcagcucuuugcugccuacgaggacggauucgaacaaugcgaugcuggcuggcuggccgaccagaccgucagauauccgauucgggcgccccgcgugggguguuacggagauaagaugggcaaagccgggguuagaacguacggauuucggucuccucaggagacauaugacguguacugcuaugucgaccaucuugauggcgacguguuccaccugaccguucccuccaaguuuacauucgaagaggcugccaaagagugugaaaaccaggaugcucgccucgccaccgugggcgagcugcaagccgcuuggagaaauggguuugaccagugcgauuacggauggcugagcgacgcgucuguccggcacccugugaccgucgcccgcgcucaguguggcgggggacuccugggcgugagaacacuuuaucgguucgaaaaccagacgggguuucccccgccugauucccgcuucgacgccuacugcuucaagagacccgaucgguguaaaaugaauccuugccugaacggagggaccugcuaucccacagagaccagcuacguuuguacaugcgugcccggcuacuccggcgaccaaugugaacucgauuuugacgagugccauucuaauccuuguagaaacggagcuaccugcgucgacggcuucaauacguuucgcugucugugccuuccgagcuaugugggggcccugugugagcaggauacagaaaccugcgacuacggauggcacaaguuccagggccaauguuauaaauacuuugcccaucggagaaccugggaugcggcugagcgcgaaugccggcuccagggggcccaccugacauccauccugagccacgaggaacagauguucguuaacagagugggccaugacuaucaguggauuggacucaaugauaagauguuugagcacgacuuccgcuggaccgauggcucuacacugcaauacgagaacuggcggcccaaccagccugacuccuuuuucagcgccggggaagauugcgucgugaucauuuggcaugagaauggacaguggaacgacgugcccuguaauuaucaccuuacguauaccugcaagaaaggcacaguugcuugugggcagccucccgucguggaaaacgccaagaccuuuggaaaaaugaagccgagauacgagaucaauucucugauccgcuaccauugcaaagauggcuucauucaacggcaccucccuacaaucagaugucuggggaacggccgcugggcuauucccaagauuaccugcaugaauccuagcgccuaccagcggacguauuccaugaaguacuuuaaaaacucuagcuccgcgaaggacaauagcaucaacaccucuaaacacgaucauagauggucccggcgcuggcaggaaagcagacgguga

SEQ ID NO: 77741 - RNA, 3201 nt, Artificial Sequence
  derived and/or modified sequence opt5 from VCL__Homo_sapiens__NP_003364
augcccguguuccacaccagaacaaucgagagcauucuggaaccugucgcccagcaaaucucccaucucguuauuaugcacgaggaaggcgagguggacgggaaggcuaucccggaucugacggcccccguggcggcuguccaggccgccgugucuaaccuuguucgggugggaaaagaaaccguccagacaaccgaggaccagauucugaagcgcgauaugccucccgcuuuuaucaaaguggagaaugccugcacaaagcucguucaagcugcccagaugcugcagagcgacccuuacuccgugcccgcgagagauuaucuuaucgacggcucucgggggauucugagcggaaccuccgaucuccugcugacauucgacgaagccgagguccgcaaaaucauuagaguguguaagggcauccucgaauaccugaccguggcugaggucguugagacgauggaagaucuugugaccuauacaaagaaccuggggccuggaaugaccaaaauggccaagaugauugacgagcggcagcaagaacucacacaucaggagcaccgcgugaugcuggucaauucuaugaacaccgugaaagaacuucugccgguucucaucagcgcuaugaagauuuuugugacgaccaaaaauuccaagaaccagggcaucgaggaggcccugaagaauagaaacuucacagucgagaaaaugagcgcggagaucaaugaaauuauccgggugcugcagcucacaucuugggaugaggacgccugggcuuccaaggauaccgaagccaugaaacgcgcucuggccagcauugacucuaagcugaaccaagccaaaggcuggcugagagaccccuccgcuagcccuggggaugcgggagagcaggccauccggcagauucucgacgaggcuggcaagguuggggaacugugcgccggaaaagagcgcagagaaauccuuggcaccuguaagaugcuggggcaaaugacagaucagguggccgaccuccgggcucgcggacagggaucuucccccgucgccaugcagaaggcgcaacaggugagccagggccuggauguccugacggcuaaaguggagaaugccgccagaaagcucgaagcuaugaccaacuccaaacagucuaucgccaagaaaauugacgcugcccaaaauuggcuggcggauccuaacgggggacccgagggcgaggaacagaucagaggggcccuugcugaggcccggaagauugcugaacugugcgacgauccgaaggagcgcgacgauauccuccggagccugggagagauuuccgcccuuacaagcaaacuggcggaccucagacgccagggcaagggggacucuccugaagcccgggcucuggccaaacagguugcuaccgcccugcaaaaucuccagacaaagaccaacagagccguggcuaacucccgccccgcgaaagccgcuguccaucuggagggaaagaucgaacaggcccagcgguggaucgauaauccuacgguggacgauagaggcguuggccaagccgcuauucgcgggcuuguggccgagggacaccggcuggcgaacgucaugaugggccccuacagacaggaccuccuggcuaagugugaucgcguggaccagcugacagcccaacuugccgaucucgcugccagaggggaaggagagagcccccaggcgcgggcucuggccucucagcugcaggacagccucaaagaucugaaggcccggaugcaagaggcuaugacccaggaaguguccgacgucuuuucugauaccacaaccccuaucaaacuucuggccgucgcugccacagcgccgcccgacgccccuaaucgcgaggaaguguucgaugagagagcugccaacuuugaaaaucacagcggcaagcucggggcuacggccgagaaagccgcugcggugggcaccgccaacaaguccacagucgagggcauucaggcuagcgugaagaccgcccgggaacugacaccccagguugugucugccgcuagaauccugcuucgcaauccuggcaaccaagccgcguaugagcauuucgaaaccaugaaaaaucaguggauugacaacgucgagaagaugacggggcucguggacgaagcuaucgauaccaaaucccugcuggacgccagcgaggaggccauuaagaaagaucucgacaagugcaaaguugcuauggccaauauccagccccagaugcugguggcgggagcuacaucuaucgcccggagagccaaccgcauucuucuggucgcuaagagagaaguggaaaauuccgaagauccgaaguuucgggaggccguuaaagcugccagcgacgagcucuccaagaccaucucuccuauggugauggaugcgaaagccgucgcuggcaacauuagcgaccccgggcugcaaaaguccuuccuggauucuggauaccgcauccuuggcgccguggcuaaagugagagaagccuuucagccucaggagcccgacuucccucccccgccucccgaucucgaacaacugcggcugacagacgagcucgcucccccuaagccgccccugccugaaggggagguucccccuccccgcccucccccgccugaggaaaaggaugaggaauuucccgagcagaaagccggcgaaguuauuaaucagccuaugaugauggcggccagacagcuucacgacgaggcucggaaguggagcuccaaaggaaacgacaucaucgccgccgcuaagcgcauggcccugcucauggcggagaugagcagacuggugcggggcgggucuggaaccaaacgcgcucugauucaaugugccaaggauaucgccaaggcuuccgacgaagugacgagacuugccaaagaggucgcgaagcagugcacagauaaacggauuagaaccaaccuccuucaggugugugaacgcauccccacaauuagcacccagcugaagauccucucuaccguuaaagccacaaugcugggccggacgaauaucuccgacgaggaaagcgagcaagcuaccgagaugcuugugcauaacgcccagaaucugaugcagucugucaaggaaacagugagagaggcugaagccgcuagcauuaagauccgcaccgaugccggguucacacuccgguggguuagaaaaaccccgugguaucaguga

SEQ ID NO: 77742 - RNA, 2421 nt, Artificial Sequence
  derived and/or modified sequence opt5 from VCP__Homo_sapiens__NP_009057
auggccagcggcgcugacuccaagggggaugaccugucuaccgccauccucaaacagaagaacagacccaaucggcugauuguggaugaggcgaucaacgaagacaauagcgucguuucccuuucucaaccuaaaauggaugagcugcaacucuuccgcggagacacagugcugcuuaagggcaaaaagagacgggaagcugugugcauuguccugagcgaugacacguguuccgaugagaagauccgcaugaacagagugguucggaauaaccuccgcgugagacugggggacgucauuucuauccagccgugccccgaugugaaauacggaaagcggauccacguucugccuauugacgauaccguggaaggcaucacagggaaucucuuugaggucuaucugaaacccuacuuccuugaggccuaucgcccuauuagaaagggagacaucuuucuggugcggggcggcaugcgcgccguggaguucaaagucguugaaaccgaccccagcccuuacuguauuguggcuccggauacagugauccauugcgaaggggagcccauuaagagagaggacgaagaggaaucccucaacgaggucggauaugaugacaucggcgggugucggaagcagcuggcccagaucaaagaaaugguggagcuuccucugcgccaccccgcucucuuuaaggccauuggaguuaaaccucccagaggcauccugcuguacgggccgccuggaaccggcaagacacucauugcgcgggccguggcuaaugagaccggcgccuucuuuuuccugaucaacgggcccgaaauuaugagcaaacuugcuggagagucugaauccaaucugagaaaggccuuugaggaagcggagaaaaacgccccugcuaucaucuucauugaugagcucgacgccaucgcucccaagcgcgaaaagacgcauggcgaggucgaacggagaauugugagccagcugcuuacccugauggaugggcucaaacagcgcgcccacguuaucgugauggccgcuacaaaucggcccaacucuauugacccugcgcugagacgcuuuggacgguucgauagagaggucgacaucggcaucccggaugccaccgggcgccuggaaauucuccagauccauacaaagaauaugaaacuggcugacgacguggaucuugagcaagucgccaacgagacccacggacacgugggcgccgaccuggcugcccucugcuccgaagcggcucugcaggccauucggaagaaaauggaucuuaucgaccuggaggaugaaacgauugacgccgagguuaugaacagccucgcugugacaauggaugacuuuagaugggcccugucucaguccaaucccagcgcucugcgcgagaccgucguggaaguuccucaggugacaugggaggauaucggcgggcucgaagacgucaagcgggagcugcaagaacuugugcaguaucccguggagcauccugauaaguuccugaaauucggaaugacccccuccaagggcguucucuuuuacgggccgccuggauguggcaaaacccugcuggccaaggcgauugccaacgagugccaggcuaauuucaucucuaucaaagggcccgaacuucucacaaugugguuuggcgagagcgaagccaacgucagagagauuuucgacaaggcucggcaagccgcgccuugugugcuguuuuucgaugaacuggacuccaucgccaaggcucgcggaggcaauauuggggacggaggcggggccgcugauagagugaucaaccagauucucacggagauggacggaaugagcaccaaaaagaaugucuuuaucaucggcgccacaaaccggcccgauauuaucgacccugccauucugagacccgggcgccuugaucagcugaucuacauuccgcucccugacgagaaaucucggguggcuauccugaaggcgaaucugagaaaaucccccguugccaaggauguggaccuugaguuccucgcuaagaugaccaacggcuuuagcggagccgaucugacagaaaucugccagcgcgccuguaaacuggcuauuagagaaucuaucgagagcgaaauucggcgcgagagagagcggcaaaccaaucccuccgccauggaagucgaggaagacgauccugugccggagauccgcagagaccacuucgaggaagcgaugcgguuugcucgcagaucuguuagcgauaacgacauucggaaguaugagauguucgcccagacgcuccagcagucccgcggcuuugggagcuucagauuccccucuggaaaucaaggcggggccggaccuucccagggcagcgggggcggaacaggcgggucuguguacaccgaagacaacgaugacgaucuguauggauga

SEQ ID NO: 77743 - RNA, 420 nt, Artificial Sequence
  derived and/or modified sequence opt5 from VCX2__Homo_sapiens__NP_057462
augagccccaagccuagagccuccggcccgcccgcuaaagccaccgaggcggggaagcggaaaucuagcucccagccuucucccagcgacccuaagaaaaagacaacgaagguggcuaaaaagggaaaagccguccgcagaggccggcgcgggaagaaaggagccgcuaccaagauggccgcuguuacagcccccgaagcggaguccgccccugcugccccgggccccucugaucaaccuagccaggaacugccccagcacgagcucccucccgaagaaccgguguccgaggggacccagcaugacccucugagccaagaaucugagguggaggagccccuuucccaggagagcgaagucgaggaaccucugacaguguggauggcuucuuucucccccguuagcgagucuaccgauuga

SEQ ID NO: 77744 - RNA, 561 nt, Artificial Sequence
  derived and/or modified sequence opt5 from VCX3A__Homo_sapiens__NP_057463
augagccccaagccuagagccuccggcccgcccgcuaaagccaccgaggcggggaagcggaaaucuagcucccagccuucucccagcgacccuaagaaaaagacaacgaagguggcuaaaaagggaaaagccguccgcagaggccggcgcgggaagaaaggagccgcuaccaagauggccgcuguuacagcccccgaagcggaguccggcccugccgcuccggggcccucugaucaaccuagccaggaacugccccagcacgagcucccucccgaagaaccgguguccgagggaacccagcaugacccucugagccaagaaucugagcuugaagaaccccugucccaggagagcgaaguggaggaaccucucucucaggagucccaggucgaggagccccugagccaagagucugaaguggaggaaccccuuucccaggagagccagguugaggagccucugucccaggagucugaaguggaggaaccgcucagccaagagucccaggucgaggaaccccugagccaggagucugaaauggaggaacugccuuccguguga

SEQ ID NO: 77745 - RNA, 741 nt, Artificial Sequence
  derived and/or modified sequence opt5 from VCX3B__Homo_sapiens__NP_001001888
augagccccaagccuagagccuccggcccgcccgcuaaagccaaggaggcggggaaacggaagucuagcucccagccuucucccagcgacccuaaaaagaagaccacaaaaguggcuaagaaaggaaaggccguccgcagaggccggcgcgggaaaaagggagccgcuacgaagauggccgcuguuaccgcccccgaagcggaguccggcccugccgcuccggggcccucugaucaaccuagccaggaacugccccagcacgagcucccucccgaagaaccgguguccgagggaacacagcaugacccucugagccaagaaucugagcuugaagaaccccugucccaggagagcgaaguggaggaaccucucucucaggagucccaggucgaagaaccccugagccaagagucugaaguggaggaaccccuuucccaggagagccagguugaagaaccucugucccaggagucugaaguggaggaaccgcucagccaagaguccgaagucgaggagccccugagccaggaaucucagguggaggaaccucugucccaagagagcgagguugaggagccccucucucaggaaagccagguggaggaaccucugucccaggagucugagauggaggagccccuuagccaagaaucccaggucgaggaaccgcugagccaggagucugagauggaggagccucucucccaggaaagcgagauggaggagcugcccucuguguga

SEQ ID NO: 77746 - RNA, 621 nt, Artificial Sequence
  derived and/or modified sequence opt5 from VCX__Homo_sapiens__NP_038480
augagccccaagccuagagccuccggcccgcccgcuaaagccaccgaggcggggaagcggaaaucuagcucccagccuucucccagcgacccuaagaaaaagacaacgaagguggcuaaaaagggaaaagccguccgcagaggccggcgcgggaagaaaggagccgcuaccaagauggccgcuguuacagcccccgaagcggaguccgccccugcugccccgggccccucugaucaaccuagccaggaacugccccagcacgagcucccucccgaagaaccgguguccgaggggacccagcaugacccucugagccaagaagcugagcuugaagaaccccugucucaggaguccgaaguggaggaaccucucagccaggagucucaggucgaggagccccugucccaagagagcgaaguggaggaaccccuuucucaggagucccagguugaggagccucugagccaggaguccgaaguggaggaaccgcucucucaagagagccaggucgaggaaccccugucccaggagagcgaaauggaggaaccucugucucaagagucccagguggaggaacccccuagccaggagucugaaauggaggaacuccccagcguuuga

SEQ ID NO: 77747 - RNA, 378 nt, Artificial Sequence
  derived and/or modified sequence opt5 from VCY__Homo_sapiens__NP_004670
augagccccaagccuagagccuccggcccgcccgcuaaagccaaggagaccgggaaacggaagucuagcucccagccuucucccagcggaccuaaaaagaagacaacgaaaguggcggaaaagggcgaggcuguccgcgggggaagacggggcaaaaagggggccgccaccaaaauggcugccguuacagcucccgaagccgaguccggaccugcggccccgggccccucugaccaaccuagccaggaacugccccagcacgagcucccucccgaggaaccgguguccgagggcacccagcaugauccucugagccaagaaucugagcuugaggaaccccuguccaaggggcgcccuagcacaccccucucucccuga

SEQ ID NO: 77748 - RNA, 852 nt, Artificial Sequence
  derived and/or modified sequence opt5 from VDAC1__Homo_sapiens__XP_005272132
auggccgugcccccuaccuacgcugaccugggcaagagcgccagagaugucuucacaaaaggguauggauuuggccucaucaagcuggaccuuaaaacgaaguccgagaacgggcuggaguucaccucuagcggauccgcgaauacagaaaccacaaaaguuaccggcucucucgaaacaaaguaccgguggaccgaguaugggcugacguuuaccgaaaaguggaacacagauaauacccuuggaacagagauuaccguggaggaccagcuggcucgcggccucaaacugacguucgauagcuccuuuucuccgaacacaggcaagaaaaaugccaagaucaaaaccggguacaagagagaacacauuaaccugggaugcgacauggauuucgacaucgccggccccagcauucgcggggcucucgugcugggauaugagggcuggcuugccggguaccaaaugaauuuugaaacagcuaagucccgggucacccagagcaacuucgccgugggauauaaaaccgaugaguuucagcugcauacaaauguuaacgacggcacggaguucggcgggucuaucuaccagaaggugaauaaaaagcucgaaaccgcggucaaccuggccuggacagcuggaaauuccaacaccagauuuggcaucgccgcuaaauaccaaauugauccugacgccuguuucagcgcgaaggugaauaacucuucccuuaucgggcugggauauacacagacccucaaacccggcauuaagcugacgcugagcgcccuccuggaugggaagaacguuaaugcuggaggccacaaacuuggccuggggcucgaguuucaggccuga

SEQ ID NO: 77749 - RNA, 930 nt, Artificial Sequence
  derived and/or modified sequence opt5 from VDAC2__Homo_sapiens__NP_001171712
augagcuggugcaacgaacugagacuccccgcccugaagcagcacuccaucggccgggggcuugaaucucauauuaccauguguaucccuccgagcuacgcugaccugggaaaggccgcgcgcgauauuuucaauaagggcuuuggguucggacucgugaaacuggacgucaagacaaaauccugcucuggcguugaguuuagcacguccgggucuagcaacaccgauacaggaaaggugaccggcacacuugaaaccaaguauaaauggugugaguacggccugacauucaccgaaaaguggaauacggacaacacccucgggacagagaucgcuauugaggaucaaaucugccagggacugaaacugaccuuugacacaaccuucucccccaauacgggcaagaaaagcgggaagaucaagucuuccuauaaaagagaauguauuaaccucggaugcgauguggacuuugauuucgccggcccugccauccacgggagcgcugucuuuggauacgagggcuggcuggccggcuaucagaugacauucgacucugcuaaguccaaacuuacccggaauaacuuugccgugggguaccgcacaggagauuuccagcugcauaccaauguuaacgacggcaccgaauuugggggaagcauuuaucaaaaggugugugaggaucucgacacaucugucaaucuggcguggacguccggcaccaacugcacaagauucgggaucgccgcuaaauaccagcuugaccccaccgccagcauuuccgcuaaggugaauaacucuagccugaucggaguuggcuacacacagacccuccggccuggcgugaaacugacgcuguccgcccucgucgaugggaaaagcauuaaugcgggaggccacaagguggggcuggcccuugagcuggaggcuuga

SEQ ID NO: 77750 - RNA, 1284 nt, Artificial Sequence
  derived and/or modified sequence opt5 from VDR__Homo_sapiens__NP_000367
auggaggccauggcugccagcaccucccugcccgacccuggcgauuucgacagaaacgugccgcggaucugcggggucuguggagaucgcgcgacaggcuuucacuucaaugcuaugacgugcgaaggguguaagggauuuuucagacggucuaugaaacgcaaggcccucuuuaccugccccuucaacggcgacuguagaauuacaaaagauaaucggcgccauugccaggccuguagacugaagcggugcguugacaucgggaugaugaaagaguuuauucuuaccgaugaagaggugcaacgcaagagagaaaugauccugaagcggaaagaggaggaagcucucaaggacagccugcgcccuaaacuuuccgaggaacagcagagaauuaucgccauccugcucgaugcucaccauaagacauacgaccccaccuauucugauuucugucaguuucggccucccgugcgcgucaacgacggaggcggcagccacccuuccagacccaauucucggcauacacccagcuucuccggggauucuagcuccagcugcucugaccacuguauuaccuccagcgacaugauggauucuuccagcuuuuccaaccuggaccugucugaggaggauagcgacgauccuuccgugacgcucgaacugagccaacuuucuaugcugccccaccucgccgaccugguuuccuacagcauccagaaagugauuggauucgcgaagaugaucccuggcuuuagagaucuuaccucugaggaccagauuguccugcucaagagcuccgccaucgaagugauuaugcugcgcucuaaugagagcuucacaauggaugacauguccuggaccugcgggaaccaggauuauaaauaccggguuagcgacgugacaaaggcuggacauucucuggaacucaucgagccccugaucaaauuccaagucggccuuaagaaacugaaucuccacgaggaggaacaugugcugcuuauggccauuugcaucguguccccggacagaccugggguccaggaugcugcccugauugaagcgauccaggaccgccucagcaacacccugcagacguauauucgguguagacacccgccucccggaucucaucugcucuacgccaagaugauccaaaaacuggcugaucuucgcucccugaaugaggaacacagcaagcaguaucggugccucuccuuucagcccgaguguucuaugaagcugacaccucuuguucuggagguguucggcaacgaaaucagcuga

SEQ ID NO: 77751 - RNA, 1239 nt, Artificial Sequence
  derived and/or modified sequence opt5 from VEGFA__Homo_sapiens__NP_001020537
augaccgacagacagacagauacggcccccagcccuuccuaccaccuucucccgggccggcgcagaaccguggacgcugccgcgucucgggggcaaggacccgagccugcucccggcgggggagucgaaggcguuggggcccgcggaguggcccugaagcuguucgugcagcugcucggcugcagcagauuuggcggggcugucgugcgggccggagaggcugaaccuuccggcgccgcgcgcucugccagcuccgggagagaggaaccccagccugaggagggagaagaggaagaggagaaagaagaggaacggggcccgcaguggcgccugggggcuagaaagcccggaucuuggacaggcgaggccgcuguuugugccgauagcgcgccugccgcucgggcuccccaagcccuugcccgcgccuccggcagagggggacggguggcucgcagaggcgcggaagagagcgggccuccccauucuccgucccggagaggaagcgccucucgcgcuggcccugggcgggccuccgagaccaugaacuuccugcucagcuggguccacuggucucuggcccugcuccuguaucuucaucacgcuaaauggucccaggccgcgcccauggcugaaggaggcggccagaaucaucacgaggugguuaaguuuauggacguguaccagagaagcuauugccacccuaucgaaacacuggucgauauuuuccaagaguaccccgacgaaaucgaguauauuuuuaaacccuccugugugccucucaugcgcugcgggggauguugcaacgaugagggccuggaaugugugccgaccgaggaaucuaauaucacaaugcagauuaugcggaucaagccccaucaggggcagcacaucggagagaugagcuuccuucaacauaacaagugcgaauguagaccuaaaaaggaccgcgcccggcaggagaaaaaguccgucagaggcaaagggaagggccagaagcgcaaacggaagaaaagcagauacaagucuugguccguuuaugugggagcccgcugcugucugaugcccuggagccucccuggcccccacccgugcgggccuugcucugagcggagaaaacaccuguuugugcaagauccccagaccuguaagugcagcuguaaaaauacggacucccggugcaaggcucgccagcuggaacucaacgagagaaccugucggugcgauaagccuagacgcuga

SEQ ID NO: 77752 - RNA, 567 nt, Artificial Sequence
  derived and/or modified sequence opt5 from VEGFB__Homo_sapiens__NP_001230662
augagcccccugcucagacggcugcuucuggccgcucuccugcagcuugccccugcgcaagcuccggugucccagcccgacgccccuggccaccagcgcaaggucguuucuuggaucgauguguacaccagagccacaugccagccccgggagguggucgugccucugacgguugaacucauggggaccguggcuaaacaacugguccccagcugugugacaguucagcgcugcggaggcuguugcccugacgaugggcuggagugugugccgaccggacagcaucaggucagaaugcaaauucucaugauccgguaucccuccucucagcugggcgaaaugagccuugaggaacacucccagugcgagugucgcccuaagaaaaaggacucugccgugaaacccgauagcccuagaccccugugcccgcgguguacacagcaucaccaacgcccugaccccagaaccugccggugucgcugcagacggcgcuccuuccucagaugccaggggcggggacuggagcuuaacccugauacauguagaugccgcaagcugcggagauga

SEQ ID NO: 77753 - RNA, 1260 nt, Artificial Sequence
  derived and/or modified sequence opt5 from VEGFC__Homo_sapiens__NP_005420
augcaucugcucggcuucuuuagcguggccugcucccugcuugcugccgcgcugcuccccgggccuagagaggcuccggccgccgcugccgcuuucgaaucuggacuggaccuuagcgaugccgagcccgacgcgggcgaagccaccgcuuacgccuccaaggaucuggaggaacagcuccggucugucagcuccguugacgagcugaugacagugcuguauccugaguacuggaaaauguauaagugucaacuccgcaaagggggauggcagcacaacagagaacaggcuaaucugaacucucggacggaggaaaccaucaaguuugccgcggcccacuacaauacagagauucuuaaaagcaucgauaacgaguggcgcaagacccagugcaugcccagagaaguguguauugacgucggcaaggaguucgggguggcuacaaauaccuuuuucaaaccucccugcguuuccguguaucgguguggaggcugcuguaacagcgaaggccugcaaugcaugaauacaucuaccuccuaccucagcaagacgcuguuugagaucaccgucccucuuucucaggggccgaaacccgugacaauuuccuucgccaaccauaccagcugucgcugcaugucuaagcuggauguuuauagacaggugcacuccaucauccggcgcagccucccugcuacacugccccagugucaagccgccaauaaaaccugcccuacgaacuacauguggaauaaccauauuugcagaugucuggcucaggaagacuuuauguucuccucugaugcgggagacgauagcacagacggcuuucacgauaucugcgggcccaauaaggagcucgacgaggaaaccugucagugcgucugucgggccggacugcgcccggcuuccugcggcccucacaaggagcuugacagaaacagcugucagugcguguguaaaaauaagcuguuccccucucaaugcggggccaaccgggaauuugaugagaacacaugucagugcgugugcaaacgcaccuguccuagaaaucagccccucaaccccggaaagugcgccugugaaugcaccgaguccccucaaaaaugucugcuuaagggcaaaaaguuccaucaccagacaugcagcuguuaccggagaccgugcacgaaucgccagaaggcuugugagcccggcuucucuuauagcgaagaggucugccgguguguuccuuccuacuggaaaagaccccagaugucuuga

SEQ ID NO: 77754 - RNA, 777 nt, Artificial Sequence
  derived and/or modified sequence opt5 from VENTX__Homo_sapiens__NP_055283
augagacugagcuccucucccccucggggcccgcagcaacucagcuccuucgggucuguggacuggcugagccaguccucuugcagcggacccacccacacaccucgccccgccgauuuuucccuuggcagccugccugggcccggacagacgucuggcgcuagagagccuccgcaggccgucuccaucaaggaagcggcugggagcucuaaccuccccgccccugagcggaccauggccggacuguccaaagaacccaauacacuucgcgcuccuagaguucggaccgccuucacaauggagcaagugcgcacccuggaaggcguguuucagcaccaccaguaccucagcccccuggagagaaagcggcuggcucgcgagaugcagcucucugaaguccaaauuaaaacaugguuccagaacagacggaugaagcauaaacgccagaugcaggacccgcaacugcacuccccuuuuagcggcucccuucaugcgcccccugccuucuauucuaccagcuccgggcuggccaauggacuccagcugcuuugucccugggcuccccugagcggcccucaggcccucaugcugccgcccgggucuuuuuggggacugugccaaguggcucaggaggcccucgcguccgccggcgcuagcuguugcgggcagccucuggccucucaucccccuacgcccggaagaccgagccuuggcccugcucuguccaccggcccccgggggcucugugccaugccucagacaggagaugccuucuga

SEQ ID NO: 77755 - RNA, 2367 nt, Artificial Sequence
  derived and/or modified sequence opt5 from VEPH1__Homo_sapiens__NP_001161383
augcaccagcuguucagacucgugcugggccaaaaggaccuuagccgggccggggaucuguuuucccucgacgauucugagaucgaagacagccugaccgaggcucuugaacagauuaaaaucauuuccucuagcuccgauuaccagacaaacaauaacgaccaggccgucguugagaucugcauuacgcgcaucaccacagcgaucagagaaaccgagucuauugagaagcaugcuaaagcccuggugggacucugggauagcugucuggaacacaaucugcggcccuucggcaaggacgaggauacaccucaugccaaaaucgcuuccgacauuaugagcugcauccuccaaaacuauaaucgcccgcccgugauggcccuggcuauuccuaucgccgucaaguuucuucacagagggaacaaggaacugugucggaauaugucuaacuaccucucccuggcggccauuaccaaagcugaucuucuggccgaccauacagaggugaucguuaagagcauccuccagggaaauaccaugcugcugcgcgugcuccccgcugucuaugagaaacagccucagcccauuaacagacaccugacggaacuucuggcccucaugucucaacuggagcagccugaacaguaccaccuucugcggcuccugcauguggcggccaagaaaaagcagcuggagguugugcaaaagugcaucccguuccucauuggccaccugaaagauuccacccauaaugacaucauucuuaacauccugaucgaaauugcugucuaugagcccguggcccucaauagcuuucugccuaugcuuaaggagaucggggaacgcuuccccuaccugacaggacagauggcuagaauuuauggcgccgugggccacgucgacgaggaacgggcccgcucuugucucaccuaccugguuucccagcuggcuaacauggagcacagcuuucaucacauccuccugcuugaaauuaaauccaucacagauaccuucucuagcauccuggggccucaauccagagacauuuuucggaugagcaauucuuucacggcgaucgccaagcuccugacacgccagcuggagaacaccaaagcuggauccggcagacggaagauuagcacagagaucgaauuucccgagaaacuugaagagaccaagcucauugugaccgaaaacgaggaucaugagaagcuccaggugaaaauccaggccuucgaagacaagauuaaugccgggucuaacacaccgggaagcaucagacgcuacucccugggccaagucucuaaagaggaacggaagaauaucagauuuaaccgcagcaaaucccuggcuuuccacacgaugcugaccaagggggugggaagcgaugacggcgaggaugagaaucggggcgacauuccugccucuaucucccuuagcgaaauugauccccuggggcagggaaacgacaagcucccuuucaaaacagauaccgagagaucucagcugggcgaauccagcguuuccuaucccaauaucauucauaucgacucugagaaccugagcgaaacagugaaggaaaauucccaggaggagacccccgagacgacagcgucuccuaucgaauaccaagacaaacuuuaucuccaccugaagaaaaaccugagcaaggucaaggcuuacgccauggagauugggaaaaagaucccggugcccgaucagugcaccauugaagacaccguucgcuccuguguggccaaacucuuuuucacaugcagccugaagggacacuauugucuuuacucuaaauccagcuuuauccugauuucucaggagccucagcccuggauccaaaucauguuccucuuucagcaggaucuggaccagguccaacugcaucuugaggaagugcgguucuuugaugucuucggcuuuuccgagaccgcuggggccuggcagugcuucauguguaauaacccugaaaaggcuacagugguuaaucaggacggacaaccccucauugagggcaagcugaaagaaaaacaggugagauggaaguuuaucaagcgcuggaaaacgcgguauuucacccuggccggcaaccagcuccuguuucagaaggggaaaagcaaggaugacccggaugacugcccuauugagcuuucuaagguccaaagcgugaaagcgguugccaagaaaagacgcgaucggucccugcccagagcuuucgagaucuucacagacaauaagaccuacguguuuaaagccaaggaugaaaagaacgcugaggaauggcuccagugcauuaacgucgccguggcgcaggccaaagagcgggagagccgcgaagugacaaccuaccuguga

SEQ ID NO: 77756 - RNA, 2340 nt, Artificial Sequence
  derived and/or modified sequence opt5 from VEZT__Homo_sapiens__NP_060069
augacccccgaguucgacgaagagguggucuuugaaaacagcccucuguaccaguaucuccaagaucugggccacacagacuucgagaucugcuccucucuuagcccgaagacggaaaaauguaccacagaggggcagcagaagcccccuaccagaguucugcccaaacagggcauucuccugaagguggccgagacaaucaaauccuggaucuuuuucucucaaugcaauaagaaggaugaccuucugcauaaacucgauauuggauuucggcuggacagccugcacaccauucuccagcaggaagugcugcuucaggaggaugucgaacugaucgagcuccuggacccuuccauccuuucugcugggcaaagccagcagcaggagaacggacaucugcccacacucuguucccuggccaccccuaauauuugggaucugagcaugcuuuucgcguuuaucucucugcuugugaugcugccgacgugguggauuguuuccagcuggcucguguggggcgucauccuguucguguaccuuguuauucgcgcucugagacucuggcggaccgccaagcugcaagugacacugaaaaaguauucuguccaccucgaagacauggccaccaacucccgcgcuuuuacaaaucuggugagaaaagcccuucggcugauccaggagaccgaagugauuagccgcggguucacgcucgucucugcugccugccccuuuaacaaggcgggacagcauccuucccaacaccugaucggccuuagaaaggccguuuaccggacacugcgcgcuaauuuccaggccgcuagacucgccacccuguauaugcugaaaaacuacccccucaauagcgaguccgauaacgugacaaauuauaucuguguggucccuuuuaaggaacugggccuugggcugucugaggagcagauuagcgaagaggaagcgcacaacuucaccgacggauucucccuccccgcccugaaagugcuguuucagcuuuggguugcucaaagcucugaguucuuucggcgccucgcccugcugcucuccaccgcuaauagcccgccuggcccccugcuuacgccugcccugcucccccauagaauccugucugaugugacacaggggcugccccacgcccauagcgcuugccuugaagaacucaagcgguccuacgaguucuaccgcuauuuugaaacccagcaccagucugucccucaaugucugagcaaaacacagcagaaguccagagagcugaacaaugugcacaccgcgguucggagccuccagcugcaucuuaaagcccugcucaacgaagugauuauccuggaggacgaacuggagaagcucgucugcacaaaggagacccaagaacucgugucugaggcuuacccgauucuggaacagaaacugaagcucauccagccccacguccaggccuccaacaauuguugggaggaggccaucagccaaguggacaaacugcuuagacgcaacacggauaagaaaggaaagccugaaauugcuugcgagaauccccauuguacaguugugccucugaagcagcccacccuccacaucgccgacaaagauccgauuccugaggagcaggaacuggaggcguaugucgacgauaucgacauugauucugacuuccggaaggaugacuuuuacuaucugucccaagaggauaaagaaagacagaagcgcgagcaugaagagagcaaacgggugcuucaggaacucaaguccguucugggcuucaaggcuucugaggccgagagacagaaauggaagcaacugcucuuuagcgaccacgccgugcugaaaucccuuucucccgucgacccuguggaacccaucagcaacuccgagccuagcaugaacucugauauggggaagguguccaaaaaugacaccgaagaggaaagcaauaagucugcuacaaccgauaacgagaucucccgcacagaguaccugugcgaaaauagccucgagggaaagaacaaagacaauucuagcaacgaaguuuucccccagggcgccgaggagcggaugugcuaucagugugaauccgaggaugaaccgcaggcugacggcagcgggcugacgaccgccccucccacacccagagauucucugcaaccuuccauuaagcagcgccuugcgcggcugcagcucagcccggacuuuaccuucacagccggacuggcugccgaggucgcugccagaucccucucuuuuaccacgaugcaggaacaaaccuucggcggggaggaggaggaacagaucauugaagagaauaaaaacgaaaucgaggagaaguga

SEQ ID NO: 77757 - RNA, 1848 nt, Artificial Sequence
  derived and/or modified sequence opt5 from VGF__Homo_sapiens__XP_011514851
augaaggcccugagacucagcgcuuccgcccuguucugccuucugcucaucaacggccugggggcggcucccccuggacggccggaggcccagcccccuccccuuucuagcgaacacaaagagccuguggccggcgacgcuguccccgggccuaaggauggauccgccccggaaguucgcggcgcuagaaauucugagccccaagacgaaggggagcuguuucagggaguggauccucgggcccucgcggccgugcugcugcaggcucucgaccgccccgccagcccucccgcuccguccggcucucagcaaggcccugaggaagaggccgcggaagcccugcuuaccgagacagucagaagccagacgcauucccugcccgcuccugagagccccgaacccgccgcuccuccgcggccccagaccccugagaacgggcccgaagccucugauccuuccgaggaacucgaggcccuggcuagccuucugcaggagcuccgcgacuucucucccuccagcgcgaaaagacaacaggaaacagccgcugccgagaccgaaacacggacccacacacugacccgcgugaaucuggagucuccgggaccugaaagaguuuggcgggccuccuggggcgaguuucaggcucgcgugcccgagagagccccucugcccccucccgcgccgagccaguuccaagcucggaugccugauuccgggccccuccccgaaacgcauaaguuuggagagggcgucucuagcccuaaaacccaccuuggggaagcccuggccccgcucuccaaggcuuaccagggaguggccgcucccuucccuaaggcccgcagacccgagagcgcgcugcuuggcggcucugaagccggggagcggcugcuccagcaaggacuggcucagguugaggccggcagacgccaggcugaagccacacggcaggcggccgcucaagaggaaagacuggccgaccucgcuuccgaucugcuucugcaguaucuccugcaagggggagcccgccagcggggccuugggggaagaggccugcaggaggccgcugaggaacgcgagagcgcgcgggaagaggaagaggccgagcaggaaagacgcggcggggaggaacgggugggagaggaagacgaggaggcugccgaagccgaggcugaagccgaggaagcggagagagcucgccagaacgcccuccuguuugccgaggaagaggauggcgaagcuggggccgaggacaaacggucucaggaggaaaccccuggacauagacggaaggaggcggaaggcacagaggaagggggcgaggaggaagaugacgaggaaauggacccccaaaccauugauagccugaucgagcucuccacgaaacugcaccuuccugcugacgaugucgugucuauuaucgaagagguggaggaaaagcgcaaaagaaagaagaaugcucccccggagccuguucccccuccccgggccgcuccggccccuacacacgucagaagcccccagccucccccucccgcuccggcccccgcgcgcgacgaacugccugauuggaacgaggugcugcccccuugggaccgggaagaggaugagguguaucccccuggaccguaccaucccuucccuaauuacauuagaccccgcacccuccagccucccuccgcccugagacggcgccacuaucaucacgcccuuccgccuagcagacacuaccccggccgggaagcccaggcucgcagagcccaagaggaagccgaggcugaggaacggcgccuccaggagcaggaggaacuggaaaacuauaucgagcauguccugcucagacggcccuga

SEQ ID NO: 77758 - RNA, 777 nt, Artificial Sequence
  derived and/or modified sequence opt5 from VGLL1__Homo_sapiens__NP_057351
auggaggaaaugaagaaaaccgccaucagacugcccaagggcaaacagaagccuauuaaaacagaguggaacagccggugcguccucuucacguacuuucaaggggacaucuccucugugguugaugaacacuucagccgcgcucuguccaauauuaagucuccgcaggagcuuacccccagcucccagucugaaggagugaugcugaagaacgacgauagcauguccccuaaucaguggagauauagcucucccuggacaaaaccucaacccgaggugccugucaccaaccgggccgcgaauuguaaccuccaugugccgggccccauggcuguuaaucaguuuuccccuagccuggcccgcagagccucugugcggcccggggagcuuuggcacuucuccagccuggcuggaacaucuucccucgaaccuggcuacagccaucccuuuccggcccgccaccuggucccugagccccagccugacgggaagagagaaccccugcucucccugcuucagcaagaucggugccuggcucgcccccaggagucugccgcgagagagaacggaaauccuggccagaucgccggcagcaccgggcuccuguucaaccuuccgcccggauccgugcauuauaaaaagcuguacguuagccggggcucugcuuccacaagccucccuaaugaaacccugucugagcuggaaacgcccgggaaauauagccucaccccucccaaccacuggggacacccgcaucgcuaccugcagcaccuuuga

SEQ ID NO: 77759 - RNA, 432 nt, Artificial Sequence
  derived and/or modified sequence opt5 from VGLL2__Homo_sapiens__NP_703154
augagcugccuggacgugauguaccaggucuaugggcccccucaaccguacuucgccgcugccuauacccccuaccaccagaagcucgcguauuacuccaaaaugcaggaggcucaggaauguaacgccucuccuagcuccucuggcagcggauccucuagcuuuuccagccaaacacccgccucuaucaaggaggaagagggcuccccugaaaaagagagacccccugaggcugaauauauuaauagccggugcguucuguucacguacuuucagggggauaucucuuccgugguggacgagcauuucagccgcgcccuuucucagccguccagcuacucccccucuuguaccagcuccaaggcuccuagaagcucuggacccuggcgggcccgcagauauucccugugcggcgcgagccuccugucuuga

SEQ ID NO: 77760 - RNA, 981 nt, Artificial Sequence
  derived and/or modified sequence opt5 from VGLL3__Homo_sapiens__NP_057290
augagcugcgccgaggugauguaccacccccagccuuauggcgcuucccaauaccugccgaaccccauggccgcgaccacauguccuacggcuuauuaccagcccgccccucagcccgggcagcaaaagaaacucgccgucuucucuaagaugcaggacagccuggaaguuacccuuccuuccaaacaggaggaagaggaugaagaggaggaagaggaagagaaggaccagccggcugagauggaauaucucaauucuagaugcgugcuguuuacauacuuccaaggagauaucggcagcguggucgacgagcauuuuucccgggcccuggggcaggcuauuacccuucaccccgaaucugccaucagcaaauccaagaugggacugacaccucucuggcgcgauagcucugcgcuguccagccagagaaacucuuuccccaccuccuuuuggacaagcucuuaucagccucccccggccccuugucugggcggggugcaucccgacuuccaaguuaccggaccucccggcacguuuuccgcugccgaucccagcccuuggccgggccacaaucuccaucagaccgggcccgcuccucccccugccguguccgagucuuggcccuacccgcugacaagccaggucuccccuagcuacucucacaugcacgacguguauaugcggcaucaccauccccacgcgcacaugcaucaccgccauagacaccaucaccaccaucaccauccucccgccggauccgcucuugauccuagcuacggcccccugcucaugccgucuguucacgccgcucggauuccugcuccccaaugcgacaucaccaagacagaacccaccacggugacaagcgccaccuccgccugggcgggggccuuccacggaacagucgauauugugccuucugugggcuuugacaccgggcugcagcaucaggauaaaagcaaggaguccccgugguauuga

SEQ ID NO: 77761 - RNA, 891 nt, Artificial Sequence
  derived and/or modified sequence opt5 from VGLL4__Homo_sapiens__NP_001121691
augcuguucaugaagauggaccuccugaacuaccaguaucuugauaaaaugaauaacaauaucggcauucugugcuacgagggggaagccgcucucagaggagagccccggauccaaacccugccuguggccagcgcgcuuuccucucaccgcacaggcccgcccccuauuagccccuccaagagaaaauuuucuauggaaccuggggacgaggaucuggacugugauaacgaccaugucagcaagaugucccggaucuucaauccccaccucaacaaaacggcuaauggagauugccgcagagacccucgggaacgcucuagaagcccgauugagcgggccguugcccccaccaugucccugcauggcagccaccuguauacaucucucccuucccuggggcuugagcagccccuggcucucaccaagaacagccuggaugccucucgcccugcuggacuuucccccacacugaccccgggcgaaagacagcagaaucggccuagcgugaucacaugugccucugcgggcgcccgcaacugcaaucucucccauugucccaucgcucacagcgggugcgccgcuccuggacccgccuccuacagacggcccccuucugcggccaccacgugugacccgguggucgaggaacacuuucgcagaagccugggcaagaacuauaaagagcccgagccugcucccaauuccgugagcauuaccgggucuguugaugaccauuucgccaaggcucugggagauacauggcuccaaaucaaagccgccaaggacggcgcuuccagcucuccugaaagcgcgucccggagagggcagcccgccucuccgagcgcucacauggugucccauagccacucuccuuccgucgugagcuga

SEQ ID NO: 77762 - RNA, 642 nt, Artificial Sequence
  derived and/or modified sequence opt5 from VHL__Homo_sapiens__NP_000542
augcccagacgggccgagaacugggacgaagcugaggugggcgccgaagaggcgggggucgaagaguacggaccugaggaagauggcggggaggaaagcggagcugaggaguccggcccggaagagucugggcccgaggaacugggagccgaagaggagauggaagccggccgcccuagacccguucuccggagcgucaauucccgcgagccuucucaggugaucuucugcaacagaagcccccggguggugcugccuguuuggcuuaauuuugacggcgaaccgcaacccuauccuacccugcccccugggacaggacgccggauucacuccuacagaggccaucucuggcuguuccgcgaugcugggacgcacgacggacuucuggugaaccagaccgagcucuuuguccccucucugaauguggauggccagccgaucuucgccaacauuacacugccuguuuauacccucaaggaaagaugucuucaggugguccggagccuggugaaacccgagaauuaccgcagacuggacaucgugcggucccucuaugaggaucuggaagaccauccuaacguccaaaaggaucuugagcgccugacacaggaaagaauugcucaccagcggaugggggacuga

SEQ ID NO: 77763 - RNA, 420 nt, Artificial Sequence
  derived and/or modified sequence opt5 from VHLL__Homo_sapiens__NP_001004319
augcccuggagagccggcaacggggugggacuggaggcucaggccggcacccaagaagcggggccugaggaauacugccaggaggaacucggagcugaggaggaaauggccgcccgggcugccuggccgguccugcgcagcguuaauuccagagagcuuucucggaucauuaucuguaaccacagcccccgcauugugcugccuguguggcucaauuauuacggcaagcugcuucccuaucugacacuccugccugggagagacuuccggauccauaacuuucgcucccaccccuggcuguucagagaugcucggacgcaugacaaacuccuggucaaucagaccgaacuuuuugugccuucuagcaacguuaauggacagccgguguucgccaacauuacacugcaaugcauccccuga

SEQ ID NO: 77764 - RNA, 2484 nt, Artificial Sequence
  derived and/or modified sequence opt5 from VIL1__Homo_sapiens__NP_009058
augaccaagcugagcgcccaggugaaaggcucccucaacaucacaacgcccgggcugcaaauuuggagaaucgaggcuaugcagauggucccuguuccgucuagcaccuucggauccuuuuucgacggcgauugcuacauuauccuugccauucacaagacagcgucuagccuguccuaugacauccauuacuggaucgggcaggauucuagccucgacgaacagggagcugccgccauuuauaccacacaaauggaugacuuucugaaaggccgggcugugcagcaccgcgaggugcaggggaaugaauccgaggccuucagaggauacuuuaagcagggccuugucauccggaaaggcgggguggcuagcggaaugaagcauguugaaaccaacucuuaugaugugcaacgccugcuccacgucaagggcaaaagaaaugugguugccggggagguggagauguccuggaagucuuucaaccggggagacgucuuucugcuggaucucggcaaacugauuauccaguggaaugggcccgaaagcacacgcauggagagacuucggggaaugacccuggcgaaggaaauucgcgaccaggagagaggcggccggacguacguggggguggucgauggagagaacgaacucgccuccccuaaacugauggagguuaugaaucaugugcuuggcaagcgcagagaacugaaggcugccgugcccgacaccgucguggagccugcucucaaagccgcgcugaagcuguaucacguuagcgauucugaagggaaccucgugguccgggagguggccacacgcccccugacccaggaccuucugucccacgaggacuguuacauccucgaucaaggaggccugaaaauuuacguuuggaaggggaaaaaggcuaaugaacaggagaaaaagggagccaugagccaugcucuuaacuucaucaaggccaaacaguauccuccguccacacaaguggaaguccagaaugacggcgccgagucugcuguguuucagcagcuguuccaaaaguggaccgcgagcaacagaacguccggccucgggaaaacacacaccgucggaagcguggccaagguugaacaggugaaauuugaugcuacaucuaugcaugucaagccccagguggccgcccagcaaaagaugguugacgauggcuccggggaggugcaggucuggcggaucgagaaucuggaacuggugccuguggacagcaaauggcucggacacuucuacggcggggauugcuaucugcuucuguacaccuaucucauuggcgagaagcagcacuaccugcuuuauguuuggcagggaucucaagcuagccaggacgaaaucaccgccuccgcguaccaggcugucauucuggaucagaaauacaacggcgagcccgugcaaaucagagugccuauggggaaggaacccccgcaucucaugucuauuuuuaaaggacgcauggucguguaucagggcgggacaagccggacgaauaaccuggagaccggaccuuccacaagacuguuccagguucaaggcaccggggccaacaauacaaaggccuucgaggugcccgcucgcgccaacuuucucaauagcaacgacgucuucgugcugaagacccagucuuguugcuaccuuugguguggcaaaggaugcuccggcgaugaacgggagauggcuaagaugguugccgacacgaucagcagaacagaaaaacagguggucguggaggggcaggagccugcgaauuuuuggauggcccugggaggcaaggcucccuaugccaacaccaaacgccuccaagaagagaaucugguuaucacaccccggcuguucgaauguucuaacaagaccgggagauuucuugcuaccgagauuccugacuucaaucaggaugaccucgaagaggaugacguguuucugcuggaugucugggaccagguguucuuuuggaucggaaagcacgccaacgaggaagagaaaaaggcggccgcuacaacggcccaggaauaccucaaaacccauccguccggccgcgaucccgagacaccuauuaucguggucaagcaagggcacgaacccccuaccuucacaggcugguuucuggcuugggaccccuucaaauggagcaauaccaaguccuaugaggaucuuaaagccgagcugggaaacucucgggacuggagccagauuacggccgaaguuaccuccccgaagguggauguguuuaaugcuaacucuaaucucagcuccggcccucugcccaucuucccucuggagcagcuugucaacaagcccguggaggaacucccugaagggguugaccccagcagaaaagaggagcaucugucuaucgaagauuucacacaggcguuuggaaugaccccggccgcuuucuccgcccugccucgcuggaagcaacagaaccucaaaaaggagaaaggccuguuuuga

SEQ ID NO: 77765 - RNA, 1401 nt, Artificial Sequence
  derived and/or modified sequence opt5 from VIM__Homo_sapiens__XP_011517951
augagcaccagauccgugucuagcuccucuuaccggcgcauguucggcgggcccggaacagccagcagaccuuccucuagccgguccuaugucacgaccagcacacgcaccuacucucugggcuccgcucucagaccgagcacaucucggucccuguaugccagcucucccgggggaguuuacgcgacccgcuccagcgcugugagacuucgguccucugugccuggcguccgccugcuccaggacagcguggauuuuucccuggccgacgccaucaacacagaguucaagaauaccagaacgaacgaaaaaguugagcuucaagaacugaaugaucgguuugcuaacuauauugacaaggugcgcuuccucgagcagcagaauaaaauccugcuggccgaacucgagcagcugaaggggcaaggaaaaagcagacuuggcgaucuguacgaggaagagaugcgggaacuccgcagacaggucgaccagcugaccaacgauaaggcucggguggagguugagagagacaaucuugccgaagauauuaugcgccugcgggagaagcuccaggaagagaugcugcaaagagaagaggcggagaacacacugcagucuuuucgccaggacguggauaaugccucccucgcucggcuggaccuugaaagaaaagucgagagccugcaggaagagaucgccuuccucaagaaacugcacgaagaggagauucaagaacuucaggcucagauccaagagcagcaugugcagaucgauguggacgucucuaagcccgaccugaccgccgcgcuccgcgauguucggcagcaauaugaaagcguggccgcuaaaaaccugcaggaggccgaagagugguacaaguccaaguuugcugaccugucugaggccgccaauagaaacaaugaugcucuccgccaggcgaaacaggaaagcacagaguaccggagacaagugcagucccugaccugcgaagucgacgcccuuaagggcacgaacgagagccuggagcgccagaugcgggaaauggaggaaaauuucgcuguggaggccgccaacuaucaggauacaauugggagacuccaagacgaaauccagaacaugaaagaggagauggcucggcaucugcgcgaauaccaggaucuucugaauguuaagauggcccucgacauugagaucgcgaccuauagaaaacugcuggaaggagaggaaucucggauuucccucccucugcccaacuuuagcucucuuaaucugagagagacaaaccucgauucccugccucugguggacacccacagcaagcgcacccuucucaucaaaacagucgagacgcgggauggccaggugauuaaugaaaccucccaacaccaugacgaccuggaguga

SEQ ID NO: 77766 - RNA, 1482 nt, Artificial Sequence
  derived and/or modified sequence opt5 from VIPAS39__Homo_sapiens__NP_001180244
augaacagaaccaagggcgacgaggaagaguacuggaauagcuccaaauucaaggccuuuacauucgaugacgaagaugacgagcugucucagcucaaagaaagcaagcgggcugugaacucccugcgcgauuuugucgacgaugacgaugacgaugaccuugagagaguuucuuggagcggggagcccgugggauccaucucuuggagcauucgggaaacggccggcaauuccgggagcacccacgagggacgcgaacaacugaaaucuagaaacuccuucagcucuuaugcgcagcucccuaagccgacauccaccuacagccugucuuccuuuuuccggggccgcacaagacccgggagcuuucagucccuuucugaugcucugagcgacaccccugccaaguccuaugcccccgagcucggacggccuaaaggcgaguaccgcgacuauagcaaugauuggucucccuccgacacagugagacggcugcgcaagggcaaagucugcagccuggaaagauuccggucucuccaggauaagcugcaacuucuggaggaagcugugagcaugcaugacgggaacguuaucaccgccgugcucauuuuucugaaacgcacgcuuuccaaggagauccuguucagagaacucgaggucagacagguggcucugcggcaccugauucauuuucucaaggagaucggagaucagaaacugcuucuggaccucuuccgcuuucuggaucggaccgaggaacuugcccugucucacuacagagaacaucucaauauccaggacccugauaagcgcaaagaguuccugaagacauguguuggccugccguucagcgcggaagacuccgcccacauucaagaucacuauacccuccuggagcggcagaucauuaucgaggcuaacgacagacaucuugaaagcgccgggcagacagagauuuuucgcaaacacccccggaaggcuucuauccugaauaugccucucgugaccacgcuguucuacuccugcuuuuaccauuauacagaagccgagggaaccuucagcucucccgucaaccuuaaaaagacauuuaagauuccugacaaacaguacgugcugaccgcgcucgccgcuagagccaagcugcgcgcuuggaaugauguggacgcccuguucaccacgaaaaacuggcucggcuauacaaagaaacgggcccccaucggguuucacagagucguugaaauccugcacaagaauaacgcuccggugcaaauucuucaggaguacgugaaucuggucgaggauguggacaccaagcucaaccuggcgacaaaauucaagugucaugauguugugaucgacaccuaucgcgaucugaaagaccggcagcaacuucucgccuacagauccaaggucgauaaaggaagcgcugaagaggaaaagauugacgcccugcuguccucuagccagauccgguggaagaacuga

SEQ ID NO: 77767 - RNA, 513 nt, Artificial Sequence
  derived and/or modified sequence opt5 from VIP__Homo_sapiens__NP_003372
auggacaccagaaacaaggcccagcugcucgugcugcuuacacugcucagcguccuguucucccaaacgucugcuuggccccuuuaccgggccccuagcgcgcugcgccucggcgauagaaucccguuugagggggcuaaugaacccgaccagguuucccugaaagaggauauugacaugcugcagaacgcccucgccgaaaaugauaccccuuauuacgacgugucucggaacgcucgccacgccgauggaguguucacaagcgacuuuuccaagcugcuuggccagcugucugcuaaaaaguaucucgagagccugauggggaaaagagucuccagcaauaucucugaagaucccgugccuguuaagcggcauuccgacgccguguucaccgauaacuacacacgccuuagaaagcaaauggcggucaaaaaguaucugaauagcauucucaacggaaaacggucuuccgagggcgagagccccgacuuuccugaggaacuggaaaaguga

SEQ ID NO: 77768 - RNA, 1251 nt, Artificial Sequence
  derived and/or modified sequence opt5 from VIPR1__Homo_sapiens__NP_001238811
augaucgaggugcagcacaagcaaugccuggaagaggcccagcucgaaaacgagaccauuggcuguagcaaaaugugggacaaucugacaugcuggcccgcuacgccuagagggcaggucguugugcuugccuguccgcugaucuucaagcucuuuuccucuauucagggacggaacgugagccgcuccugcaccgaugaaggcuggacacaucuggagcccgggccuuaccccaucgcguguggacuugacgauaaagcugccucucuggacgagcaacagaccauguucuauggcagcgucaagacaggguacaccauuggauauggccucucccuggccacacugcucguggcuaccgccauccugucucuuuuuagaaaacugcacugcacgcggaauuacauccauaugcaccucuucauuagcuuuauccugcgcgcugccgcgguuuucauuaaggaucuugcccuguuugacuccggcgaaagcgaucaguguucugagggguccgugggaugcaaggcugccauggucuucuuucaguauugugugauggcuaacuucuuuuggcuccugguugaaggccuguaccucuauacccugcuugccgugagcuucuuuucugagagaaaauacuucuggggguacauccugauuggauggggcgucccuuccacauucaccaugguguggacaaucgcgcggauucauuuugaggacuaugggugcugggauaccaucaauagcucucucugguggaucauuaagggacccauccugacguccauucuugugaacuucauccuguuuauuuguaucauccgcauucuccugcaaaaacugagaccuccggacauccgcaagagcgauuccucucccuacagccggcucgccagauccacacugcuucugauuccucucuucggcguccacuauaucauguuugcuuucuuucccgacaauuucaaaccugaaguuaagaugguguuugagcugguggucggcagcuuccagggguuugugguugccauucuuuacugcuuccugaacggagaagugcaggcugagcuccggcgcaaguggagacgguggcaucugcagggcguccugggguggaaucccaaauaucgccacccgucuggaggcuccaacggggcuaccugcagcacacaagugucuaugcucaccagaguuagcccuggagcccggagauccucuagcuuucaggccgaagugucccuggucuga

SEQ ID NO: 77769 - RNA, 1077 nt, Artificial Sequence
  derived and/or modified sequence opt5 from VIPR2__Homo_sapiens__NP_001291451
augagaacccugcugcccccugcccuccuuacaugcuggcugcucgcuccggugaacagcauccaccccgagugucgguuccaucuggaaauucaggaggaagagacgaagugcgccgaacuucugcgcucccaaaccgagaaacacaaggcguguucuggcgucugggacaauaucacaugcuggagaccugcuaacguuggggagaccgugacagugcccuguccuaaagucuuuagcaauuucuacuccaaggccggaaacauuucuaaaaauugcaccagcgauggcugguccgaaacauuucccgacuucguggaugccuguggguauucugacccugaggaugaaagcaagguuggaugcaagcucucccugguguuucugcaguacuguaucauggcuaacuucuuuuggcuccuggucgagggccuuuaucugcauacccuccugguggccaugcuuccgccccggcgcugcuuccuggcuuaccuccugauuggguggggacugccuacgguuuguaucggcgccuggaccgcggccagacucuaucuggaggacacaggcugcugggauaccaaugaccacagcgugcccuggugggucauccggauuccuauccuuauuucuaucauugugaacuuugugcuguucaucuccauuauccgcauccuccugcagaaacuuacaagccccgaugucgggggaaaugaccagucucaauacaagagacuggcuaaauccacccuccugcugauuccgcucuuuggcguucauuauaugguguucgccguguuuccuaucagcauuucuuccaaguaccagauccuguucgaacuuugccuggggagcuuccagggacucgucguggcuguucuguacuguuuucuuaacuccgaggugcagugcgaacugaaacggaaguggcgcucuagaugucccacgccuagcgccucccgggauuaucgcgucugcggcagcucuuucuccagaaaugggagcgagggagcgcuccaauuucaccggggcucucgcgcccagagcuuccugcagacagaaaccuccgugauuuga

SEQ ID NO: 77770 - RNA, 2037 nt, Artificial Sequence
  derived and/or modified sequence opt5 from VIT__Homo_sapiens__NP_001171440
augagaaccgugguccugacaaugaaggccagcguuaucgaaauguuccucgugcugcuugugacgggcguccacuccaacaaagaaaccgcuaagaaaauuaagcggcccaaauuuacagugccucagaucaauugcgacguuaaggccgggaagauuaucgauccggaguucauugugaaaugucccgcgggaugccaagacccuaaguaccaugucuauggcaccgauguguacgcuucuuauagcuccguuuguggggccgccgugcacucuggaguccuggacaacagcggcgggaaaauccucgugcgcaagguggcuggacaguccggcuacaaaggcucuuauagcaaugggguccagucccugagccuucccagauggcgggaaucuuuuaucguucuggaguccaagccuaagaaaggagugacauaccccagcgcccucaccuauucuuccagcaagucuccugcugcccaggcgggcgaaacaaccaaagccuaccaacgcccgcccauuccugggacgaccgcucagcccgugacacugaugcagcugcucgccgucaccguggcuguugccacaccuaccacgcugcccagaccguccccuagcgcggccuccacaaccucuaucccccggccucagagcgugggacaucgcucccaagagauggaucuuuggagcacagcuaccuacaccucuucccagaacagaccccgggccgaccccggcauucagcgccaggauccuagcggggcugccuuccaaaagccggucggagccgacgugucucugggccucguucccaaagaggaacugagcacacagucccuugagccugugucucugggcgaucccaauugcaagaucgaccucagcuuucugauugauggguccacgagcaucggaaaaagacgguuccgcauucagaagcaacugcucgcugacgucgcgcaggcccuggauaucggcccugcugggccccuuaugggagugguccaguauggcgacaacccggccacccacuuuaaucugaagacacauaccaacucuagagaccucaaaacagccaucgaaaagauuacccagcgcgggggacuguccaaugugggccgggcuaucagcuucguuacgaaaaacuuuuucucuaaggccaauggcaacagauccggggcgccuaauguggucgugguuaugguggauggauggcccacagacaaagucgaggaggcuagccggcuugccagagaauccggcauuaacaucuuuuucauuaccaucgagggggccgcugaaaaugagaagcaauacgugguggaaccuaacuuugccaacaaggcuguuugucgcaccaauggauucuauucucugcacguccagagcugguucggccuccacaaaacacugcagccccuggugaagcgggugugcgauaccgacagacucgccuguuccaaaacaugccugaacucugcggauaucggguuugucauugacggcagcuccagcgugggaacgggcaauuuccgcaccguucuucaguuugugacaaaccugaccaaggaguucgagaucucugauacagacacccggauuggggccguccaauacacguaugaacagagacucgaguuuggauucgauaaauacuccagcaagccugacauccugaaugcuauuaagcgcgugggcuauuggucugggggaaccuccacaggcgccgcuaucaacuuugcccuugaacagcuguucaaaaagagcaaacccaauaagcggaaacucaugauccugauuaccgaugggagaucuuacgacgacguucgcaucccggcgauggccgcucaucugaagggcgugauuacauacgccaucggagucgcuugggccgcccaggaggaacucgaggugauugcuacccacccugcgcgggaucauagcuuuuucguugacgaguuugauaaccugcaccaauaugugcccagaaucauucagaauaucuguacggaguucaacucccagccccgcaauuga

SEQ ID NO: 77771 - RNA, 492 nt, Artificial Sequence
  derived and/or modified sequence opt5 from VKORC1__Homo_sapiens__NP_076869
augggcagcaccugggggucccccggaugggugagacuggcccucugccugacaggccuuguccugucucucuacgcucugcacguuaaggccgcgcgggcucgcgacagagauuaucgggcccuuugugacguggggacggccaucagcugcucccgcguguucucuagcagauggggacggggcuuugggcuggucgagcaugugcucggacaggauuccauucugaaccaaucuaauagcaucuucggcuguaucuuuuacacccugcagcuccugcuuggcugccugcgcacaagaugggcuuccguucucaugcugcuuagcucucuggugucccucgccgggagcgucuaucuggcuuggauucuguucuuugugcucuacgacuucuguauuguuugcaucaccacauaugccaucaacgugucucugauguggcuuuccuuucggaaaguccaggaaccucagggaaaggcgaaacgccacuga

SEQ ID NO: 77772 - RNA, 2538 nt, Artificial Sequence
  derived and/or modified sequence opt5 from VLDLR__Homo_sapiens__NP_001018066
augggcaccagcgcccugugggcucucuggcugcuucuggcccucugcugggcgcccagagaguccggggcuacaggaacgggccggaaggccaaaugugaaccuucucaguuccaaugcaccaacgggcgcuguaucacacugcuuuggaagugcgacggagaugaggacuguguggauggcagcgacgagaaaaauugcgucaagaaaaccugugccgaauccgauuuuguuugcaacaaugggcagugugugccgucuagauggaagugcgacggagaucccgacugugaagauggcagcgacgaguccccugagcagugccacaugcggacaugccgcauucaugaaaucucuuguggcgcucacagcacccagugcauucccguguccuggagaugugauggggagaacgacugcgauagcggagaagacgaggagaauuguggcaacaucacaugcucuccugacgaguucaccuguuccagcgggcggugcauuucucgcaauuuugucuguaacggacaagaugacugcuccgauggcagcgacgaacuggauugugcucccccuacgugcggggcccaugaguuccagugcucuaccuccagcuguaucccgaucuccugggugugcgacgaugacgccgauuguucugaccagagcgaugaaucccucgaacagugcggaagacaacccguuauucacacaaaguguccugcgagcgagauccagugcggcucuggcgaguguauucauaaaaaguggcggugcgacggggaccccgauuguaaagacggauccgaugaagugaauugcccuagccgcaccuguagacccgaccaguuugagugcgaagauggcucuugcauccacgggagccggcaguguaacggcauucgcgacugcgucgauggauccgacgaggugaauuguaagaacguuaaucaaugccuggggccgggaaaauucaaguguagaucuggcgaaugcaucgauauuagcaagguguguaaccaggagcaggacugccgggauugguccgacgagccucugaaagaaugucacaucaaugagugccucgucaacaacggcggguguagccauaucugcaaggaucuggugauuggauacgaaugcgacugugccgcuggcuuugagcuuaucgaccgcaaaacaugcggggauauugacgaaugucaaaaucccggaaucugcucucagauuuguaucaaccugaagggcggguauaaaugcgaguguuccagaggcuaccagauggaucucgccaccggagugugcaaggcugucggcaaagagccuagccugaucuucacgaaucggagagacauucgcaagaucgggcuugaacggaaggaguauauucagcugguugaacaacucagaaacacaguggcccuggaugcggacaucgccgcucagaaacuguuuugggccgaucucucucagaaggcuauuuucuccgccagcaucgacgauaaagugggacgccacgucaagaugaucgacaauguguacaaccccgccgcuauugcgguugauuggguguauaaaaccaucuacuggacagacgccgcuuccaagaccauuucugucgccacccuggauggcacaaagcggaaauuucuuuucaauagcgaccugagagagcccgccuccaucgcuguggacccucucucuggguuuguuuauuggagcgauuggggagagccggccaagauugaaaaagcgggcaugaacggguucgaccgccggccccuggugacggcugauauccaguggccuaauggcauuacccuugaccugaucaaguccagacucuacuggcuggauagcaaacugcauaugcucucuuccgucgaccugaacggacaagaucgccggaucgugcuuaagagccuggaguuccucgcccacccccuggcccuuacaauuuuugaagacagagucuacuggaucgauggcgagaaugaagcuguguauggggccaacaaguucaccggaucugagcuggcuacacucguuaauaaccugaaugacgcccaggauauuaucguguaccacgagcugguccagccuuccggcaaaaacuggugugaagaggacauggaaaacgggggaugcgaguaucucugucugcccgcgccgcagauuaaugaccauagcccuaaguauaccugcucuugccccagcggcuacaacguggaagagaaugggcgcgauugucaacggaucaacguuacgacagccguguccgaggucagcgugccucccaaaggcaccucugcugccugggcuauccuuccucugcuccugcuggugauggccgcgguuggaggcuaccuuauguggagaaauuggcagcacaagaacaugaaauccaugaauuuugacaaccccgucuaucucaagaccacagaagaggaucugagcauugacaucgggcggcauuccgccucugugggacacaccuacccggcuauuagcguggucuccacagaugacgaucuggccuga

SEQ ID NO: 77773 - RNA, 306 nt, Artificial Sequence
  derived and/or modified sequence opt5 from VMA21__Homo_sapiens__NP_001017980
auggagagacccgacaaggccgcucugaacgcccuccagccuccggaguuccggaaugaaagcucccuggcgucuacccuuaaaacacugcucuuuuucacggcucugaugaucaccgugcccauuggccuuuacuuuacaaccaagagcuauaucuucgaaggggcccugggaauguccaaccgcgauucuuacuuuuaugccgcuauugucgccguuguggcugugcacgucgugcucgcccuguucguuuacguggcguggaaugagggcagcagacaauggcgggaagggaaacaggacuga

SEQ ID NO: 77774 - RNA, 345 nt, Artificial Sequence
  derived and/or modified sequence opt5 from VMO1__Homo_sapiens__NP_001138411
auggagagaggcgccggggcuaagcugcucccccugcuucugcuccugcgggccaccggauucacaugcgcgcagacggacggccgcaacggguacaccgcugugaucgaagucacaagcggaggcccuuggggagauugggccuggccggagaugugucccgacggguuuuucgccuccggcuuuucucuuaaaguugaaccuccccaaggcauuccuggggaugacaccgcucugaauggaaucagacuccacugcgcccggggcaacgugcuggggaauacacauguggucgagagccaguccggacgcuggggcgcugggguggaagauccccugggauga

SEQ ID NO: 77775 - RNA, 1221 nt, Artificial Sequence
  derived and/or modified sequence opt5 from VMP1__Homo_sapiens__NP_112200
auggccgagaacggcaagaauugcgaccagagacggguggcuaugaacaaagaacaccauaaugggaacuucaccgaucccagcuccgucaaugagaagaaacgcagagaacgggaggaacgccaaaacaucguucuguggagacagccucucauuacacugcaguacuuuucucuugagauccuggugauucucaaggaguggacgagcaaacuguggcaccggcaguccaucguggucucuuuccuucugcuccuggccgugcugauugcgaccuauuacguugaaggagugcaucaacaguauguccagcgcaucgagaagcaguuucuccuguacgcuuauuggaucggccuugggauucugagcuccgugggacucggcacagggcugcacaccuuccuucuguaccucggaccgcauaucgccucuguuacacuggccgcuuaugaauguaauagcgugaacuuucccgagccucccuacccugaccaaauuaucugccccgaugaggaaggcaccgagggcacaauuucccuguggagcaucauuucuaaggucagaaucgaagccuguaugugggggaucggaaccgcuauuggcgagcucccuccguacuucauggcccgggcggcccgccuguccggggcugaacccgacgaugaggaguaucaggaauuugaggaaaugcuugagcacgccgaaagcgcucaggacuucgccucuagagcgaaacuggccgugcagaagcucgugcaaaaagucggauuuuucggcauccuggcuugcgccuccauuccuaauccccuuuuugaucuggcugggaucacguguggacacuuccucguuccuuuuuggaccuucuucggcgccacacugauuggcaaggccaucaucaaaaugcauauucagaagaucuuugugauuaucaccuucagcaagcacauuguggagcagauggucgcuuuuaucggggcggugcccggaaucggcccgucucugcaaaaaccuuuccaggaguaccucgaagcccagcggcagaagcugcaucacaaauccgagauggggacaccccaaggagaaaacuggcuuagcuggauguuugagaagcugguuguggucauggugugcuauuucauucucuccaucauuaauucuauggcucagagcuacgccaaacgcauccagcagagacugaacuccgaagagaagaccaaauga

SEQ ID NO: 77776 - RNA, 1188 nt, Artificial Sequence
  derived and/or modified sequence opt5 from VN1R2__Homo_sapiens__NP_776255
augacccacacacuguaccccacgccuuucgcccucuauccgaucaacauuagcgcugccuggcaucugggcccccuuccuguguccugcuuugucucuaauaaguaccaguguagccuggcguucggggcuaccacaggacucagaguucuggugguggucgugccccaaacccagcuuuccuuucugucuagccucugccugguuucccuguuccuccacucucuggugagcgcccauggcgagaaaccuacaaagcccgucgggcuugacccuacccuguuucaggugguugugggaauccucggcaacuucucccugcuuuauuacuauauguuucuguacuuccggggguauaaaccgcgcagcacagaucucauucugagacaccugaccgucgccgacucucucgugauccuguccaagcggauucccgaaacgauggcuaccuuuggacuuaaacauuucgauaauuacuuuggcuguaaguuccugcucuacgcccaccgcgugggcagaggggucagcaucggaucuacaugccugcuuuccguuuuucaggugaucaccauuaacccucggaauagccgcugggcugagaugaaggugaaagcccccacauauaucggccugucuaacauucucuguugggcguuccacaugcuggucaaugccaucuucccuauuuacaccacggggaagugguccaacaauaacaucaccaaaaagggagaccugggcuauugcagcgcuccccucuccgaugaagugacaaaaucuguuuacgccgcucugacauccuuucaugacgugcuuugucuggggcucaugcugugggccuccagcucuauuguccuugugcuguauagacacaagcaacagguucagcauaucugccggaauaaccucuacccgaauagcagcccuggaaaccgcgcgauccagucuauucuggcccuggugagcaccuucgcucucuguuaugcccuguccuuuaucaccuacgucuaccuugcucuguucgauaauucuagcugguggcucgugaacacagccgcccugauuaucgcuugcuuucccacgauuuccccuuucguccugauguguagagaccccagccggucucgccuuugcuccaucugcuguagacggaaccgcagauuuuuccacgauuuucggaagauguga

SEQ ID NO: 77777 - RNA, 906 nt, Artificial Sequence
  derived and/or modified sequence opt5 from VN1R4__Homo_sapiens__NP_776256
auggccagcagauacguggcugucggcaugauccugucccagaccguugugggggugcucggaucuuucagcguccugcuucacuaucuguccuuuuacugcacaggcugucggcuccgcucuacggaccugauugugaagcaucuuaucguugccaacuuccuggcgcucagaugcaaaggggugccccaaaccauggcugccuuuggaguccgguauuuccugaaugcccugggcuguaagcucguguuuuaccugcaccgcguugggagaggagugagcauuggcacaaccugccuucuguccgucuuccaggugaucacagugucuagccggaaaucccgcugggcuaagcucaaagagaaggccccuaagcaugucggcuuuagcguucugcuuuguuggauugugugcaugcuggugaacaucaucuucccgauguaugucaccgggaaauggaauuacacaaacauuaccgugaaugaagaucucggauauuguucuggcgggggaaacaauaagaucgcucagacgcugagagccaugcugcucuccuuucccgacguucugugccuuggccugaugcucugggugucuagcuccauggucuguauucugcaccggcauaaacagcgcgugcaacacaucgauagaagcaaccuuucuccucgggcgucccccgagaaucgcgccacccagagcauucugauccucguuuccacauucgugucuagcuacacccuguccugccuguuucaggucuguauggcucuccuggacaacccuaauagccuucuggugaacacaucugcccucauguccgucugcuuccccacccugagcccuuuugugcuuaugucuugcgauccgagcguuuacagauucuguuucgcuuggaagcgguga

SEQ ID NO: 77778 - RNA, 1542 nt, Artificial Sequence
  derived and/or modified sequence opt5 from VNN1__Homo_sapiens__NP_004657
augaccacacagcugcccgccuacguggcuauccuccuguucuaugucagcagagccuccugccaagacacguuuaccgcggcuguuuacgagcacgccgccauucuuccuaacgcuacacugaccccggugucucgggaagaggcccucgcucugaugaaucgcaaccuugauauccuggaaggcgccauuacaagcgcggccgaccagggggcucauaucauugugacccccgaggaugccaucuauggauggaauuucaacagagacucccucuacccuuaucuggaagauauccccgacccugaggucaauuggauucccuguaacaaucggaaccgcuuuggccagacaccugugcaggagagacugucuugccucgcuaagaauaacagcaucuacguuguggccaauauuggggauaaaaagccgugugacaccuccgauccccaaugcccucccgacggacgguaucaguacaacacggaugucguguucgacucucagggcaaacugguugcgcgcuaccacaagcagaaucuuuuuaugggggaaaaccaauucaaugugccuaaagagcccgaaaucgucaccuuuaacacaaccuucggcagcuuuggaauuuucacauguuuugauauccuguuccaugacccggccgugacccucgugaaggacuuucacgucgauacgauuguuuucccuacagcuuggaugaacgugcugccccaucuuuccgccguggaguuccacagcgcuugggccaugggcaugagagucaauuuucuggccucuaacauccacuauccuuccaagaaaaugaccgggagcggaaucuacgcucccaauucuucccgggcguuccauuaugacaugaagacagaggaaggcaaacuccugcugagccagcucgauucucaccccucccauagcgccgugguuaacuggaccuccuacgcuucuagcauugaggcccuguccagcgggaauaaggaauuuaaaggaaccguguucuuugacgaguucacauuugucaagcucacgggcguggccgggaacuauaccguuugccagaaggaucuguguugccaccucucuuacaaaauguccgaaaauaucccuaacgagguguaugcucugggagccuucgacggccuucacacagucgagggccgcuacuaccugcagauuuguacccuccugaagugcaaaacaaccaaucugaacacguguggggauagcgcggaaacagcuucuaccagauuugagauguucagccucuccggaaccuuuggcacacaauauguguucccggaaguccugcuuucugagaaucagcuggcccccggggaauuucaggugagcaccgacggacggcuuuucucccugaagccuacaagcggccccguucuuacggugacccuguucgggcgccucuacgagaaagauugggccucuaacgcuuccagcggacugacagcccaagcuagaaucauuaugcugaucgucaucgccccuauugugugcucucucuccugguga

SEQ ID NO: 77779 - RNA, 900 nt, Artificial Sequence
  derived and/or modified sequence opt5 from VNN2__Homo_sapiens__NP_001229279
auggugaccagcuccuuccccaucucugucgccguuuuugcucugauuacacuccaggugggcacgcaagacagcuucaucgccgcgguguacgagcacgcugucauucugccuaacaagaccgaaacaccggugucccaggaggaugcccuuaaucugaugaacgaaaauaucgacauucucgagaccgccaucaaacaggcugccgaacagggggcuagaaucauuguuacacccgaggaugcccuguauggauggaaguuuacccgggagacaguguucccuuaccuugaagacauccccgauccucaagucaacuggauucccugccaggacccucaucgcuuuggccacaccccggugcaggcgagacugucuugucucgccaaagauaauagcaucuauguucuggcuaaccugggggacaagaaacccugcaauucccgggauucuacguguccucccaacggauacuuccaguauaauaccaacguggucuacaauacagagggcaagcucguggcccgcuaucauaaggugugcaccaugcugaaauguaagacaaccaaccuuacgacaugcgggagaccugucgaaaccgcuagcacacgguuugagauguucucccugagcggaaccuuuggcaccgaguacguuuuccccgaagugcuccugacagagauucaccuuucuccgggcaaauuugaagugcugaaggacgggcgccucgucaauaaaaacggauccagcggcccuauccugacggugucucuguucgggagaugguacaccaaggauucccucuauagcucuuguggaacauccaauagcgccauuaccuaccugcuuaucuuuauccugcucaugauuaucgcgcugcaaaacauuguuaugcuuuga

SEQ ID NO: 77780 - RNA, 732 nt, Artificial Sequence
  derived and/or modified sequence opt5 from VNN3__Homo_sapiens__NP_001278632
augggcgugaaccugcucgccgcuaauacccacaacacaagcaugcauaugacgggguccggaaucuacgcccccgaggcggucaagguuuaucacuacgacauggaaaccgagucuggccagcugcuucugagcgaacucaaauccagaccucggcgcgagccgacauaucccgcugccguggacuggcaugccuacgcuucuagcgugaagccuuucuccucugaacaaagcgacuuucuggggaugauuuauuucgaugaguuuaccuucacaaaacuuaagagaaauaccggaaacuacacagccugccagaaagaccuguguugccaccucaccuauaagauguccgagaagcggacggaugaaaucuacgcucugggcgccuuugacgggcugcauaccgucgagggacaguacuaucuccagauuugugcgcugcuuaaaugccaaacaaccgaucuggaaacauguggcgagcccgugggcagcgccuucaccaaguuugaggacuucucucucuccgggacguuuggaacacgcuacguuuucccucagaucauucugagcggcucucagcuugcucccgaaagacacuaugagaucucccgggaugggcgccugagaagccggucuggagccccucucccggugcuggucauggcucuguacggccgcguguuugaaaaagaucccccuagacucgggcagggauccggcaaguuccaauga

SEQ ID NO: 77781 - RNA, 510 nt, Artificial Sequence
  derived and/or modified sequence opt5 from VOPP1__Homo_sapiens__NP_001271212
augcugagcgagacccucggcuaccuguccucugugcuucugcagugcacagaagccaagaaacacuguugguauuucgaggggcucuaccccacguauuacaucugcagaagcuaugaagacuguugcggaucccgguguugcguccgcgcucugucuauucaaagacuuugguacuuuugguuccugcucaugaugggcguucuguuuuguugcggggccggauucuuuauccggcgcagaauguauccuccgccccugauugaggaaccugcguucaacgugagcuacacccggcagcccccuaaucccggcccuggggcucagcagccgggacccccuuacuauacagaucccggcggcccugggaugaaccccgugggaaauuccauggccauggccuuucaagucccgccuaacucuccccagggcagcguggcuuguccucccccucccgccuacugcaauaccccgcccccucccuaugagcagguugugaaggcuaaauga

SEQ ID NO: 77782 - RNA, 4524 nt, Artificial Sequence
  derived and/or modified sequence opt5 from VPRBP__Homo_sapiens__NP_055518
augaccacaguggucguucacguggacagcaaggccgagcugacgacccuccuggaacagugggagaaagaacauggcuccgggcaagauauggugcccauccuuacaagaaugucucagcugauugagaaggaaaccgaggaguaccggaaaggagacccugauccguucgacgaucgccaccccggcagagcugacccugaaugcaugcucgggcaucugcuucggauccuguuuaagaacgaugacuucaugaaugcccucgucaacgcguaugugaugacaagccgcgagcccccucugaauaccgcugccuguagacugcuccuggauauuaugcccggacuugaaacagccguuguguuucaggagaaagagggcaucgucgaaaaccuguucaagugggcucgggaggccgaccagccucuccgcaccuacuccacggggcugcuuggaggcgcuauggaaaaucaagauauugccgcgaacuauagagacgaaaauucucagcugguggccaucguucuccggcgccugagagaacugcagcuccaggagguggcucugcggcaagagaacaagcgcccgagccccagaaaacuuuccucugaaccucugcucccccuggaugaggaagccgucgacauggacuacggcgauauggcuguggacguggucgauggggaccaggaggaagccagcggagauauggagaucuccuuucaccuugacagcggccauaagaccucuucccggguuaauagcacaaccaaaccugaggaugggggacugaagaaaaacaagucugcgaagcagggcgaccgcgaaaauuucagaaaagccaagcagaaacucggguuuuccagcucugaucccgaccggauguucguggagcuguccaacagcuccuggucugaaaugagcccgugggugauuggaacaaauuauacccuguacccuaugacgcccgcuaucgagcaaagacucauucugcaguaucuuacaccucugggcgaauaccaggagcuccugcccaucuuuaugcaacuuggcucccgcgagcugaugauguucuacauugaucucaagcagaccaacgacguccugcugacauuugaagcccucaaacaccuggcuagccuucugcuccacaauaaguucgccaccgaguuuguggcccaugggggaguucagaaacugcuggaaaucccccggccuucuauggcugcgaccggcguguccaugugccuuuauuaccucagcuauaaccaggacgccauggagagagucuguaugcacccgcauaacgugcugucugauguugugaauuacacacuguggcucauggagugcagccacgcuuccggguguugccacgccacgauguucuucucuauuuguuuuagcuuccgcgccguccuggaacuuuuugaccgguaugauggacugagacgccucgugaaccugaucuccacccuggagauccuuaaucucgaagaccaaggcgcucugcugagcgaugacgagauuuucgccucucggcagacagggaagcauaccugcauggcgcucagaaaguacuuugaagcucaccuggccaucaaacuugagcaggucaagcagucccugcaacgcacagagggaggcauucucgugcauccccagccucccuauaaagccuguagcuacacccacgaacagaucguugagaugauggaguuccugauugaguacggcccugcucagcuguauugggaacccgccgagguguuucuuaagcucucuugcguccaacugcugcuccagcugaucuccaucgcuuguaacuggaaaacguacuaugcccggaaugauacagugagauucgcgcuugacguucuggccauucucaccguggucccgaagauccagcugcagcuggcugagagcguggaugugcuugacgaagccggguccaccguuucuacagucggaauuagcaucauucucggcguggcugagggggaauuuuucauccaugaugccgagauccaaaaguccgcgcugcagauuaucauuaacugcgugugcggaccugacaaucgcaucucuagcauuggcaaauuuaucuccgggacaccccggagaaagcugccucagaaccccaaaagcucugaacacacccucgccaagauguggaaugucgugcaauccaacaauggcauuaaaguucugcuuagccugcucucuaucaagaugccuaucacggaugcugaccagauucgggcccuggcuuguaaggcccuggugggacuuucccgcagcucuaccgucagacagaucauuagcaaacugccccucuucuccagcugccagauccaacagcugaugaaggagccggugcuccaggacaaacggucugaucacguuaaguuuuguaaauacgccgcugagcugauugaaagaguguccggcaagccucuucugaucgggacagacgucagccucgcgcgccugcagaaggccgaugugguugcucaaucccggaucucuuuccccgagaaagaacugcuucugcucauuagaaaccaucugaucagcaagggacucggcgagaccgccacagugcugaccaaagaggccgaccuucccaugacggcugccucccacucuagcgcguucaccccugucacagcugccgccuccccggugucucugccccgcaccccuagaauugcuaaugggaucgccacacggcucggaagccaugcggcugugggcgccuccgcccccagcgcuccuaccgcccacccccagccuagacccccgcaggggccucuggcucugcccggcccuucuuaugccggaaacagcccccuuauuggccgcaucuccuuuauccgggaacgcccgucuccuugcaaugggagaaagauucggguccugcgccagaaauccgaucacggagcguacagccaaucucccgccaucaagaaacagcucgacagacaucugccuuccccucccacgcucgauagcauuaucacagaguaucugcgggaacagcacgcucgcuguaagaaccccguugcuaccugcccgcccuucucccuuuuuacaccucaucaaugucccgagccuaagcagagacggcaggcccccauuaacuucaccagcagacugaaucgccgggccucuuuuccuaaauacggcgggguggacggaggcugcuucgauagacaccugaucuuuagccgcuuccggccgaucuccguguuuagagaagccaacgaggacgagucuggguucaccuguugcgcuuuuagcgcgcgcgaacgguuccucaugcugggcacauguacgggacagcuuaagcuguacaaugucuuuuccggccaagaggaagccucuuauaacugccauaauagcgcuauuacccaccucgagcccuccagagaugggucucugcuccugacaagcgccaccuggucccagccucuuagcgcccuguggggaaugaaaucuguguucgacaugaagcacuccuucacagaagaucauuacguugaguuuagcaaacacucucaggaccgcgugaucggcaccaagggggacauugcucauaucuaugauauucagacgggaaacaagcugcucacacuguucaaucccgaccuugccaacaauuacaaacggaacugcgcgaccuuuaauccuaccgaugaccugguccucaacgauggcgugcugugggacguuagauccgcucaagccauccacaaguucgauaaauuuaauaugaacauuagcgggguguuccaucccaauggccucgaggucaucaucaacacagaaauuugggaccugcggaccuuucaccuucugcacacagugccggcccuggaucagugucgcguuguguucaaccauacgggaaccgucauguauggcgcuaugcuccaggccgacgaugaggacgaccugauggaagagagaaugaaguccccuuuugggucuagcuuccggacauuuaaugcgaccgauuacaaacccaucgcuacaauugacgugaagcgcaacaucuucgaucuuugcaccgacacgaaggauuguuaucuggccgugauugaaaaucagggauccauggacgcccucaacauggauaccgucugcagacuguacgagguuggccggcaaagacucgcugaggacgaagaugaggaagaggaccaggaggaagaggaacaggaggaagaggaugacgaugaggacgacgaugacacagaugaccuggaugaacuugacaccgaucagcugcuggaggccgaacucgaggaagacgauaauaacgagaaugcuggggaggacggagauaacgacuucagccccucugaugaggaacuggccaaucuucuggaagagggcgaagacggcgaggacgaggauuccgacgcggaugaagagguggaacucauccugggggacacagauagcucugacaacagcgaucuggaggacgauaucauucucucccuuaaugaguga

SEQ ID NO: 77783 - RNA, 438 nt, Artificial Sequence
  derived and/or modified sequence opt5 from VPREB1__Homo_sapiens__NP_009059
augagcugggcccccgugcugcucaugcuguucgucuacugcaccggcugugggccucagccgguucuucaccaacccccugcuauguccucugcccugggaacaacgaucagacugaccugcacacuccggaacgaccaugauauuggcguguauagcguguacugguaucagcagcgccccgggcacccucccagauuucuucugcgguacuucucccagucugacaagagccaaggaccucaggucccgccccgcuuuuccggcucuaaagauguggcgagaaaucggggguaucucagcaucuccgagcugcagccugaagacgaggcuauguacuauugugccaugggagcccgcagcucugaaaaggaggaaagagagcgggagugggaagaggaaauggagcccaccgcugcccgcacaagaguuccuuga

SEQ ID NO: 77784 - RNA, 372 nt, Artificial Sequence
  derived and/or modified sequence opt5 from VPREB3__Homo_sapiens__NP_037510
auggccugcagaugucugagcuuccuccugaugggcaccuuucuuuccgugucucagacaguccuggcucaacucgacgcccugcuuguuuuccccggacagguggcgcagcugagcugcacgcucuccccucagcacgugaccauccgggauuacggggucucuugguaucaacagcgcgcuggcagcgccccgagauaccugcuguauuaccgguccgaggaagaccaucaccgccccgccgauauuccugacagauuuucugcugccaaggaugaggcucauaacgccugugugcucacaaucagccccguucagccugaagacgaugcggacuauuacugcuccgugggguauggauucagccccuga

SEQ ID NO: 77785 - RNA, 1740 nt, Artificial Sequence
  derived and/or modified sequence opt5 from VPS11__Homo_sapiens__XP_011541201
augcuguucaagaaaaaccucuuugagauggccaucaaucuggcuaagagccagcaccuugacuccgauggccuggcccaaauuuucaugcaguacggggaccaucucuauucuaaaggaaaccacgauggcgcggugcagcaguacaucagaaccauugggaagcuggaacccagcuaugucauccggaaauuucuugacgcucaacgcauucauaaucugacagccuaccuccagacgcugcacagacagucccuggccaacgcugaucauaccacacuccugcuuaauugcuauaccaagcugaaggacucuagcaaacucgaggaguucaucaagaaaaaguccgaaucugaaguucacuuugauguggagacagccaucaaagugcugcggcaggcuggauacuauagccacgcccuuuaccuggcggagaaccaugcccaccaugaaugguaccucaagauucaacuggaggacaucaagaauuaucaggaagcucugcgcuacauuggcaaacucccuuucgagcaggccgaguccaacaugaagagauaugggaaaauccugaugcaccacauuccggaacagaccacacaacuucugaagggacucuguaccgauuaccggcccagccuggagggccgcucugacagagaagcuccuggcugccgggccaauuccgaggaauuuauccccauuuucgcgaacaauccucgcgagcuuaaagccuuucuggagcauaugagcgaaguccagcccgauucuccucaggggaucuaugacacgcuccuggagcugagacuccaaaacugggcucacgaaaaggauccccaggugaaagagaagcugcaugccgaagcuaucucccuucuuaagagcggacgguucugugacguuuuugacaaagcccucgugcugugccagaugcacgauuuccaggacggcguccuuuaccuguaugagcaagggaagcucuuucagcagauuaugcauuaccacaugcagcacgagcaauaccgccaggugaucucuguuugugaaagacauggagagcaggauccgucccugugggaacaggcccugagcuauuucgcucggaaagaggaagacugcaaggaguacguggcggccguccucaaacacauugagaauaagaaccugaugccuccccuucugguggugcaaacccucgcucauaauuccacagccacccugucugucauccgcgauuaucugguucagaagcugcagaaacagagccaacagauugcccaggacgaacucagagugcggagauaccgcgaggaaacaacccggaucagacaagagauccaggagcugaaggcuuccccuaaaauuuuccagaagacgaaauguagcaucugcaacucugcccuggaacuccccuccgugcacuuucuguguggccacagcuuccaucagcacugcuuugagucuuauagcgaauccgaugcggacuguccgacaugccuuccugagaaccgcaaggucauggauaugauucgggcucaagaacagaagagagaccugcaugaucaguuccagcaccaacucaaaugcucuaaugacagcuuuuccgugaucgccgacuacuucgggcgcggaguuuuuaacaagcugacccugcuuacagaucccccuaccgcccggcucaccagcucucuggaggcuggccugcagagagaccuccugaugcauucccgccggggcacauga

SEQ ID NO: 77786 - RNA, 9408 nt, Artificial Sequence
  derived and/or modified sequence opt5 from VPS13A__Homo_sapiens__NP_001018047
augguguucgagagcgucguuguggacgugcugaacagauuucucggcgauuacgucguggaccuggauaccucccagcuuucucuggggaucuggaagggagccguugcucucaaaaaucugcaaauuaaggaaaacgcccuuagccagcuggacgugcccuucaaagucaaggugggccacaucgggaaucucaaacugauuaucccuuggaagaaccuguauacacagccgguugaggcggugcucgaagagauuuaccugcuuaucguccccuccucucggaucaaguaugauccucugaaagaagagaagcagcucauggaggcuaaacaacaggaacugaagcgcauugaggaagccaaacagaaggugguggaccaggagcaacaucuucccgagaagcaggauacguuugccgaaaaacuggucacccagaucauuaagaaucuccagguuaaaaucagcuccauucacaucagauacgaggacgauauuacaaaccgggacaagccucugucuuucggaaucagccugcaaaaucucuccaugcagaccacagaucaguauugggugcccugccugcaugacgaaaccgagaaacuugugcgcaagcugaucagacucgauaaccuguuugcuuacuggaaugucaaaagccaaauguucuaucuuucugacuacgacaacucccuggaugaccucaagaauggcauugugaacgaaaauaucguuccugagggguacgauuuuguguuccggccgauuagcgccaacgcuaagcuggucaugaaucgcagaucugacuuugauuucuccgcccccaaaaucaaccuggagauugaacuccacaacaucgcgaucgaguuuaauaagccucaguauuucagcauuauggaacugcuugagucuguggacaugauggcccagaaccugcccuaccggaaauuuaagccugauguuccccuccaucaccacgcucgcgaauggugggccuaugcuauccauggagugcuggaggucaauguguguccgagacuuuggaugugguccuggaaacacauucggaagcaucgccagaaggucaaacaauacaaggagcuguauaaaaagaaacucacaagcaagaagccucccggcgaacugcuggugucccucgaggaacuggagaaaacccuugacguuuucaacaucacgauugccagacagaccgcggaaguggaggucaagaaagccggcuacaagaucuauaaagagggggugaaggauccugaagacaauaagggaugguucucuuggcuguggagcugguccgagcagaacacaaaugaacagcaacccgauguucagcccgagacccucgaggaaaugcugacaccugaggaaaaagcucugcuuuacgaggccaucggcuacagcgaaaccgcuguggacccgacgcuccugaagacauuugaggcccugaaauucuuuguccaccucaagucuauguccauugugcugcgggagaaccaccagaaacccgaacuuguggacaucguuauugaggaauucagcacccugaucguccagcgcccuggggcccaagcuauuaaguuugagacaaaaaucgauucuuuccauauuaccggacuccccgacaauagcgaaaagccuagacugcuguccucucuugaugacgcgaugagccucuuucagaucaccuucgagaucaacccccuggaugagacagugucccagcggugcauuaucgaagccgagccgcuggaaauuaucuaugacgcuagaacggugaauagcauugucgaguuuuuccgcccucccaaggaagugcaccucgcccagcugaccgccgcuacacuuaccaaacuggaggaguuucggucuaagacagccaccggccuccuguacaucaucgaaacgcaaaaaguucuggaucuuaagauuaaccucaaagcguccuauaucauugugccucaggacgggaucuucagccccacaucuaaucugcugcuccuggaucuuggacaucugaaggucaccuccaagagcagauccgagcucccugacgugaaacagggcgaagcuaaccugaaggagauuauggaucgcgccuacgacucuuuugauauccaacugaccagcguucagcuucucuauucccgggugggcgacaauuggagagaggcccgcaaacugucugucagcacacagcacauccuggugcccaugcauuucaaccucgaacuguccaaggcuaugguuuucauggacgugcggaugccgaaauuuaagauuuacgggaagcuuccucugaucagccucagaauuucugauaaaaagcugcagggaaucauggagcugauugaauccauccccaaacccgagccugucaccgaagugagcgccccggugaagucuuuccaaauccagacauccacgagccuuggcaccucucagauuagccagaaaaucauuccccugcucgagcugccuuccgucagcgaggacgauucugaagaggaauuuuucgacgcucccuguuccccucucgaggaaccccugcaauuuccuacagggguuaagagcauccgcacccggaagcuucagaaacaggauugcuccgugaacaugacaaccuucaagauuagauuugaggugcccaaaguccugaucgaguucuaucaccucgugggagacugugaacugucuguuguggagauucugguccuuggccugggggccgaaaucgagauccgcacguacgaucucaaggcgaaugccuuucugaaagaauucugccucaaguguccggaguaccuggacgagaacaaaaagccuguguaucuuguuaccacacuggauaauaccauggaagaccuccugacacuggaguacgugaaggcugaaaaaaacguccccgaucuuaagagcaccuauaauaacgugcugcagcucauuaaaguuaauuuuuccucucuggacauccaccuccauacggaggcccugcuuaacacaauuaauuaccugcacaacauccugccucaaagcgaggaaaaguccgcucccgugucuaccacagagaccgaagauaaaggagacgucauuaagaagcucggccuggacagcgagaugaucaugcggccguccgaaaccgagaucaaugccaaacuuagaaacauuaucgugcuggauagcgacauuacagcgaucuauaagaaagccguguacauuacgggcaaggaggucuucucuuuuaaaaugguuuccuauauggaugcuaccgccgggagcgcuuacacagacaugaaugugguggauauccaggucaaccucaucgugggaugcauugaaguuguguucgucaccaaguuccuguacucuauccucgccuuuauugacaauuuccaggccgcuaagcaagcgcuggccgaggcuacagugcaggccgccggcauggcugccaccgggguuaaagaacuugcgcagcgguccagccgcauggcucuggauaucaacauuaaggccccuguggucgugaucccccagucuccugucuccgagaacguguuuguugccgacuucggacugauuacgaugacaaauaccuuucauaugaucaccgaaagccaauccagcccccccccugugaucgaucucauuacaaucaaacugucugagaugagacuuuaucggagcagauucauuaacgacgcuuaccaggagguccuggaucuccugcucccgcugaaucuugaagugguuguggagcgcaaccuguguugggaaugguaucaggagguccccugcuuuaaugugaacgcccagcugaagccuauggaauucauccucucccaagaggacauuaccacaaucuuuaaaacgcugcacggcaauaucugguacgagaaggacgggucugcgagccccgcugugaccaaggaucaguauuccgccacaucuggcguuaccacaaacgccagccaccauuccggaggcgcuaccgucgugacggccgcuguggucgaagugcacucucgggcccuucugguuaaaaccacacucaauauuagcuucaagaccgacgaucugacaauggugcucuacuccccugggcccaaacaggcgagcuuuaccgacgucagagauccuucucugaagcuugccgaguucaaacuggaaaacaucauuuccacacugaagauguauaccgacggaagcacguucucuuccuuuagccucaagaauuguauccuggaugacaaacgcccgcaugugaagaaagcuacacccagaaugauuggccuuaccguuggguucgauaagaaagacaugauggauaucaaguaccggaaagugcgcgacggaugcgucaccgaugccguguuucaggagauguacaucugcgcuuccguugaguuccugcaaacaguggccaacgucuuucucgaagccuauaccacgggcacagcuguggagaccucugugcagacauggaccgcgaaggaagaggucccuacacaggaaagcguuaagugggagauuaaugugaucauuaaaaaccccgagaucguguucgucgccgacaugaccaagaaugacgcuccugcccuggugauuacgacccagugugaaaucugcuacaaagggaaccuggagaacuccacaaugaccgccgcuauuaaggaucuccaaguuagagccugucccuuucuuccggugaaacggaagggcaagaucacaaccguccugcagccuugcgaccuguucuaucagacgacacaaaaaggaaccgauccccaggugaucgacaugagcguuaagucucucacacugaaagugucccccgucauuaucaauaccaugauuaccaucacaagcgcgcuuuacacgaccaaggaaacaauuccugaggaaaccgcuucuagcacagcccaccugugggagaaaaaggauaccaagacgcucaaaaugugguuucuggaggaauccaacgagacagaaaagaucgcccccaccaccgagcuggugccuaaaggcgaaaugaucaagaugaauauugacucuaucuucauuguccucgaggcugggaucggacaucgcacagugccgaugcuucuggccaaaagcagauuuuccggcgaggggaagaacuggucuagccugauuaaucuccacugucagcuggaacuugagguucacuauuacaacgaaauguucggagugugggagccccugcucgagccucuggaaaucgaucagaccgaggacuuucggcccuggaaucugggcaucaagaugaaaaagaaagcgaagauggcuauuguggaauccgauccugaggaagagaacuauaaaguccccgaguacaagacaguuaucagcuuccauucuaaagaccaacucaauauuacgcuuuccaagugcgggcuggugaugcugaacaaucucgugaaggccuucaccgaagccgcuacaggcagcuccgccgauuuugucaaagaccuggcuccguucaugauccuuaacucucugggacucaccauuagcguguccccuucugauagcuuuuccguucugaauauccccauggccaagagcuacgugcugaaaaacggcgagucucucuccauggacuauauucgcacaaaggacaaugaucacuucaacgcgaugaccagccuuucuuccaaacuguuuuucauccugcucacgccugucaaucauagcaccgccgacaagaucccccugacaaagguggggagacggcuuuacaccguccgccacagagaaucuggaguggagcggagcauuguuugucagaucgauacaguggaaggcuccaaaaaggucaccauuagaucuccugugcagauccgcaaccauuuuagcguuccccuguccguguaugagggggacacacuccugggaacggcuagcccggagaacgaauucaauauuccucugggcuccuaccggucuuuuaucuuccucaaacccgaggaugaaaacuaucagaugugcgaggggaucgacuuugaagagauuaucaagaaugauggcgcccuucugaaaaagaaguguagaagcaaaaaccccuccaaggagucuuuccugauuaauaucgucccugaaaaagacaaccucaccagccuguccguguacucugaggauggaugggaccuuccguauauuaugcaccuguggcccccuauccuccugcgcaaucugcuccccuacaagaucgcuuacuauauugaaggcaucgagaacagcguguuuacacuuuccgaggggcacagcgcccaaauuugcaccgcccagcugggaaaagcucggcugcaucucaagcugcuugauuaccugaaucacgacuggaagucugaauaucauaucaaaccuaaccagcaggacauuuccuucguuagcuucaccugugucacagagauggaaaagacggaucucgacaucgcggugcacaugaccuacaauacaggccaaaccguggucgccuuucacucucccuauuggaugguuaacaaaacagggagaaugcugcaguacaaggcugauggaauucaucgcaaacacccuccgaauuauaagaaacccgugcuguucuccuuucagccuaaccauuucuuuaauaacaacaaggugcaacucauggucaccgacagcgagcuuucuaaucaguucuccaucgauacggugggcagccacggcgccguuaagugcaaagggcugaagauggacuaccaggugggagucacaaucgaucuguccagcuuuaacauuacccggaucgugaccuucacacccuuuuacaugauuaaaaauaagucuaaauaucauaucagcguugccgaagagggcaacgacaaguggcucucccuggaucuugagcagugcauuccuuucuggcccgaauacgcuucuagcaagcugcucauccaaguggagagauccgaagacccgccuaaacgcaucuauuuuaauaagcaggagaacuguauucugcugcggcucgauaaugaacuugggggaaucauugccgaggucaaccuggcggagcacucuaccgugaucacauuccuggacuaccacgauggcgcugccaccuuucuccugauuaaucauacgaaaaacgaacuugugcaguauaaucagagcucccugucugagaucgaagacagccucccccccgggaaggccgucuucuacacaugggcugacccuguuggauccagacggcugaaauggcgcugcagaaagagccacggcgaggugacccaaaaggaugacaugaugaugcccaucgaucugggcgaaaaaacaauuuaucucgugucuuucuuugaggggcuucagcggaucauucuguucaccgaggacccucgcgucuuuaaggugacguacgaauccgagaaagccgaacuggcggagcaggagaucgccguugcucuccaggaugugggaauuagccuggucaacaauuacaccaagcaagaaguggccuauaucggcaucacaucuuccgacguugugugggagaccaaaccgaagaagaaagcuagauggaagcccaugagcgucaaacauacagaaaagcuugagcgggaauucaaagaguacaccgaguccucuccuagcgaagauaaggugauucagcuggacacaaacguucccgugagacucaccccuacggggcacaauaugaagauccugcagccccacgucauugcccugcgccggaacuaucucccggcucugaaaguggaguacaacacauccgcccaucagagcucuuuuagaauccaaauuuaucgcauccagauucagaaucaaauccacggagcggucuucccuuuuguguucuaccccguuaagccucccaaauccgugaccauggauagcgccccuaagcccuuuaccgacgucucuaucgugaugcggagcgcuggccauucccagauuucuagaaucaaauauuucaaggugcuuauucaggaaauggaucugcgccucgaccugggguuuaucuacgcccuuacagaccugaugaccgaggcugaaguuacagagaacacggagguggaacucuuccacaaagauauugaggccuuuaaggaagaguacaagaccgccagccuggucgaccagucccaagugucucuguaugaauacuuccauaucagcccgaucaaacuccaccuguccguuagccuuucuuccggacgggaggaggcuaaggauagcaaacagaauggcggccugauuccugugcacucccucaaccugcuucugaagucuaucggggcgacacucaccgacguccaggauguggucuucaaacuggccuuuuucgaacugaauuaucaguuucauacaaccagcgaccuccaauccgaggugauuagacacuacucuaagcaggcuaucaagcagauguauguucugauucuuggacuggaugugcucggcaaccccuucgggcugauccgcgaauuuagcgagggagucgaggccuucuuuuacgaacccuaucagggcgccauccaagggccugaggaauucguggagggaauggcucuuggccugaaagcccucguuggcggggcggugggaggccuggccggggcugccuccaagauuacgggagcuauggccaaaggcgucgcggccaugaccauggacgaagauuaccagcagaagagacgggaggcuaugaauaaacaaccggccggguuucgcgagggaaucacaagaggcggcaaggggcuggugagcggauucgugucuggcauuaccgggaucguuacaaagcccauuaaaggagcucagaagggcggggccgcuggauuuuucaaaggcgucggcaaggggcucgugggagccguggcgcggccuaccggcgggaucauugacauggccuccagcacguuucagggaaucaaacgcgcuacagaaaccucugaggucgaaucccugagacccccucgguucuucaacgaggauggcgugaucagacccuaccgccuucgggacgggacaggaaaucagaugcugcaaguuauggaaaacggcagauuugccaaguauaaguacuucacccaugugaugauuaauaaaaccgauaugcucaugaucacacgccggggcguccuguuugugacgaaggggaccuucggacagcuuacaugugaguggcaguauagcuuugacgaguucaccaaagaaccuuuuauuguucacggcagacggcugcgcaucgaggcuaaggaaagagugaaaucugucuuccacgcccgggaguuugggaagauuaucaacuucaaaacacccgaagacgcccgcuggauccucaccaagcugcaggaggcgagagagccguccccuagccuguga

SEQ ID NO: 77787 - RNA, 2592 nt, Artificial Sequence
  derived and/or modified sequence opt5 from VPS13B__Homo_sapiens__NP_056058
augcuggagagcuacgugacccccauccucauguccuaugucaacagauacauuaagaaucugaaaccuucugaccuucagcugagccucuggggcggggauguugugcuguccaaacuugaacugaagcucgacgugcuggagcaagaacugaagcucccguucacauuucugucuggacacauccaugagcuucggauucacguccccuggacgaaacugggcagcgaaccugugguuaucaccauuaacacaauggagugcauccucaagcugaaggaugggauccaggacgaucaugaguccuguggaucuaauagcaccaaccgcuccacagccgaaagcaccaaaucuuccauuaagcccagacggaugcagcaggcugccccuacagaccccgaucuuccuccgggcuaugugcaaagccugauccgcagagucgugaauaacguuaauauugugaucaacaaucucauucugaaauacgucgaggacgauaucgugcugucugugaacauuaccuccgcggaaugcuauacggucggggagcucugggaccgggcuuucauggauaucagcgccaccgaccugguucuucgcaaggugaucaauuuuucugauuguacagugugccuggacaaaagaaacgccuccggaaagauugaguucuaccaggacccccuccuguauaaguguagcuuucggacccgccuucacuucacauacgaaaaucugaacuccaaaaugccuucugucaucaagauucauacccucguggagagccugaaacuguccaucacggaucagcagcuccccauguuuauuagaaucaugcaacugggcaucgcucuuuacuauggcgaaauugggaauuucaaggagggagaaaucgaggaccugacaugccacaacaaagauaugcucggcaacauuaccgggagcgaggacgaaacacggaucgauaugcaguacccugcccagcacaagggacaggagcuguauucucaacaggacgaggaacagccccaaggcuggguuuccugggcuuggagcuuugugccggccauugucucuuacgaugacggggaagaggauuucgugggaaaugacccugcgagcaccaugcaucagcagaaagcccagacccuuaaggaucccaucguuuccaucggcuuuuauuguacaaaggcuacggugaccuucaaacugacagagaugcaagucgaaucuagcuacuauuccccucagaaggugaaaagcaaggagguccucugcugggaacaggagggcaccacaguggaagcccugaugaugggggagcccuuuuucgacugucagauuggauucguuggcugccgcgcuaugugucugaaagggaucaugggagugaaggacuuugaggaaaacaugaauagaucugagaccgaagccugcuucuuuauuugcggcgauaaccucuccacgaagggguucacauaccugaccaauagccuuuuugacuaccggucucccgagaacaauggaacccgcgcggaguucauccuggauuccacacaccauaaagaaaccuauacagagauugccggcaugcaaagauuuggcgcuuucuacauggacuaucucuacacgauggaaaacaccagcgggaagggauccacaaaucagcaggauuuuucuagcggcaaauccgaggaccuggggaccguccaggaaaagucuacaaaaagccuggugaucggaccucuugauuuccggcucgacuccagcgccguucaccgcauucugaagaugaucgugugugcucuggagcacgaguaugaaccguacucuagacucaaguccgauaucaaagacgagaacgaaaccauucugaaucccgaggaagucgcccuucuggaggaguauaucccuacgcggcauaccagcgugacacuccugaagugcaccuguacaauuucuauggccgaauuuaaccugcuugaucaccuccugcccgugaucaugggcgagaaaaauuccagcaacuucaugaauaccacgaacuuucaaucucugagaccucuccccagcauucgcauccugguugacaagaucaaccuugaacauuccgucccgauguacgcugagcagcuggugcacguggucagcucucucacacagccuuccgauaaucugcugcauuacugcuaugugcacuguuaccuuaaaauuuucggguuccaggcgggccucaccagccuggacugcuccggaucuuauugucugcccguuccugugauccccagcuuuuccacagcccucuacggcaagcugcuuaagcugccuaccugcuggaccaaacggucucaaauugcuaucacagaagggauuuucgagcuccccaaccugacgauccaggccaccagagcccagacacugcuucuccaagcuaucuaucagagcuggucccaccugggaaaugucucuagcuccgccgugauugaggcgcugaucaacgaaauuuuucucagcaucgagauuggcucuuguuacguugcucagguggaccuggaacuucuggccuccaaugauccgccuaccagcacaucuuga

SEQ ID NO: 77788 - RNA, 10887 nt, Artificial Sequence
  derived and/or modified sequence opt5 from VPS13C__Homo_sapiens__NP_001018098
auggugcuggaaagcgucguugcugaucuccugaacagauuccuuggagauuacguggaaaaucugaacaagucccagcucaaacuggggaucuggggaggaaauguggcucuugacaaccugcaaauuaaggaaaaugcccucucugaacuggauguccccuuuaaagugaaggcggggcagaucgacaaacugacccucaagauuccuuggaagaaccuguauggagaggcuguuguggccacgcuugaaggccuguaccuccuggucgugccgggggccagcaucaaauaugaugcuguuaaggaggagaaaucccuucaggacgugaagcagaaagaacugucucggauugaggaagcccuccaaaaggcugccgagaagggaacgcacagcggcgaguucaucuacggccuggaaaauuuugucuauaaagauaucaagcccgggagaaaaagaaagaaacauaagaaacacuucaagaagccuuuuaaaggacuggaccgguccaaggauaaacccaaggaggcgaaaaaggacaccuucguggaaaagcucgccacacaggugauuaaaaacguccagguuaagaucaccgauauucauaucaaauacgaggacgaugugacagacccuaagcgcccccugucuuuuggcgugacccuuggggaacugagccuccugacagcuaaugagcacuggaccccuugcauucuuaacgaggccgacaaaaucauuuauaagcugaucagacucgauucccugagcgcuuacuggaaugucaacuguucuauguccuaccagcggagccgcgaacaaauccuggaccagcucaagaaugagauucugacgucuggaaacaucccgcccaauuaucaguacauuuuccagccuaucuccgccagcgcgaaacuuuauaugaaccccuacgccgaaucugagcugaagaccccuaaacucgauugcaacauugaaauccaaaauaucgcuauugagcugacaaagccccaguaucuuuccaugaucgaccugcucgagagcguggauuacaugguuagaaacgccccguaucggaaauacaagccuuaccugccccugcauaccaauggccgcagaugguggaaguaugcuauugacuccgugcucgaaguccacauccggcgcuacacacagauguggucuuggagcaacauuaaaaagcacagacaacugcuuaaauccuauaagaucgccuacaaaaauaagcugacccagagcaaagugucugaggaaauccagaaggagauucaggaucucgaaaagacgcuggacguuuuuaacaucauucuggcccggcaacaggcucagguggaggucauccgcuccgggcagaaacuuagaaagaaaagcgcggauacaggagagaagcggggcggcugguucucugggcucuggggcaaaaaggaaagcaagaaaaaggacgaggaaucccugauuccugagaccaucgaugaccugaugacacccgaggaaaaagacaagcucuuuaccgccauuggcuauucugagagcacccauaaucugacacuucccaaacaauacguggcucacaucaugacgcugaagcucgucuccaccagcgugacaaucagagaaaacaagaauauuccugagauccugaaaauucagaucauugggcugggaacccagguuucucagcgcccgggcgcccaagcccuuaagguggaagcuaaacucgagcauugguauaucacagggcugcggcagcaggauaucguccccucccugguggccagcauuggagacaccacgucuucccuccugaagaucaaauucgagacaaacccugaagauagccccgcggaccagacccuuauuguucaaucccagccuguggaggucaucuacgaugcuaagaccgugaaugccgugguugaauuuuuccagucuaacaagggccuggaccucgagcaaauuacaagcgccacccugaugaaacuggaagagaucaaggagagaacagcuacgggccuuacccacaucauugaaacacgcaaaguccucgaucugcggaucaaucugaagcccuccuaccucguggugccgcagaccggguuccaccaugagaaaucugaccugcuuauucuggauuuuggaacauuccagcucaacagcaaggaccagggccugcagaaaaccacaaauagcagccuggaagagaucauggauaaggccuaugacaaguuugaugucgaaauuaaaaacgugcagcuucucuucgcuagagccgaggagaccuggaagaaaugucgcuuucagcacccuucuacaaugcauauccugcagcccauggacauccacguugaacuggcgaaggccaugguggagaaagacauucggauggcuagauucaaggucuccgggggacucccucugaugcaugugcgcaucagcgaucaaaagaugaaagacguucuuuaccugaugaacucuauuccccucccucagaaguccagcgcccagucucccgaacggcaagugagcuccaucccgauuaucagcggcgggaccaaaggccugcugggaacaucucuucugcucgauaccgucgaguccgagagcgacgaugaauauuuugacgcugaggauggcgaaccucaaacgugcaaguccaugaaagggucugagcugaagaaggccgcggaagugcccaaugaggagcucauuaaccugcuucugaaauucgaaaucaaggagguuauccucgaauuuacaaaacagcagaaggaggaagacaccauucugguguucaaugucacacaacugggaaccgaggccaccaugagaacauuugaucuuacgguggugagcuaccugaaaaagaucucccucgacuaucacgagauugaaggcucuaagcgcaaaccccugcaccucaucagcuccucugauaagccugggcuggaccuucugaaagucgaguacauuaaggcugauaaaaacggaccgagcuuccagaccgccuuuggcaagacagaacagaccguuaagguggcuuucuccagccucaaucugcugcuucagacacaagcccugguggccucuaucaacuaucucaccacgaucauucccuccgacgaccagagcaucucugucgcuaaagaggugcagauuuccacagaaaagcagcagaaaaauagcacccugccuaaggcgaucguuucuucccgggauagcgacauuaucgauuucagacucuuugccaaacugaacgcuuucugugugaucgucugcaaugagaagaacaauauugccgagaucaaaauucaggggcuugacuccagccugucucugcagagccggaagcagucccucuuugcccgccuggaaaacaucauugugaccgauguugaccccaagacagugcauaaaaaggcugucucuaucaugggcaaugagguguucagauuuaaccuugaucuguacccugacgccaccgaaggagaucucuacacagacaugagcaaaguugauggcgugcugucccucaaugucggguguauucaaaucguguaucugcacaaguuccuuaugucucugcugaacuuucucaacaauuuccagacggcgaaagagagccuguccgcugccaccgcccaggcugccgagcgggcggcuacaucugugaaggaccuugcccagcgcagcuuucgcgucuccaucaacauugaccugaaggcccccguuaucgugauuccucaaagcucuaucuccaccaaugcuguggucguggaucucggacugauucggguucauaaccaguucagccucgugucugacgaagauuaccugaaucccccggucaucgacagaauggaugugcagcuuacaaaacugacccuguaucgcacgguuauccaaccuggcauuuaccaccccgacauccagcuccugcacccuauuaaccuugaguuucuggugaauagaaaccucgccgcuuccugguaucauaagguccccguggucgaaaucaaagggcaccuggauagcaugaaugugucccucaaccaggaggaccugaaucuucuguuccggauucugaccgaaaaccucugcgagggaacagaggaucuggacaagguuaaaccgcgcgugcaggaaaccggcgagaucaaggaaccucuugagaucucuauuagccaagauguccaugacuccaagaauacacugaccacagggguggaagagaucagaagcguugauauuaucaacaugcuccugaauuuugagauuaaagaaguggucgugacccugaugaagaaaucugagaagaaaggccggccccuccacgaacuuaacgugcugcagcugggaauggaggccaagguuaagacguacgacaugacagcgaaagccuaucucaagaaaaucuccaugcaguguuucgacuucaccgauagcaagggcgaaccucugcauauuaucaacucuagcaaugucaccgacgagccccuucugaaaaugcuccugacaaaggcugauuccgacgggcccgaguuuaaaaccauccacgauucuacgaagcagcgccugaaggugagcuucgccucccucgaccuugugcugcaccuggaagcucuccugucuuuuauggauuuccuuagcuccgccgccccuuuuagcgagccgucuuccagcgaaaaagaguccgagcugaagccccucgucggagaaucuagaagcauugcugugaaagcgguuuccucuaacaucagccaaaaggacguguucgaucugaaaauuacagccgagcugaaugcuuuuaacgucuucgugugcgaccagaaguguaauaucgccgauauuaagauccauggcauggacgccuccaucagcguuaaaccuaagcagaccgauguguuugcucggcucaaagacauuaucgucaugaacguggaccuucagucuauucacaagaaagccguuuccauccugggggaugaaguguuccgcuuucaacugacacucuaccccgacgcgaccgagggagaggcuuacgccgauaugagcaaggucgacggcaagcugucuuucaaaguggggugcauucagaucguguauguccauaaguucuuuaugucccuucugaauuuccucaacaauuuucagacagccaaagaggcucugagcaccgccacgguucaagcggcugagagagccgccucuagcaugaaggaucuggcucagaaauccuuccggcuccuuauggacaucaaccugaaggccccugugauuaucauuccccagucuagcguguccccuaaugcugucaucgccgaucugggccucauucgcguggaaaacaaguuuagccugguuccgauggagcacuacucccuucccccugugaucgacaaaaugaauauugaacugacccagcucaagcugucuagaacaauccugcaagcgagccucccccagaacgauaucgagauucuuaaaccugucaauaugcugcuguccauccagcggaaccucgccgcugccugguaugugcagauucccggaauggaaaucaagggcaaacugaagccgaugcaaguugcucuuucugaggacgaucugaccgugcucaugaaaauucugcuggagaaucucggggaagccagcucccagccuucucccacacagagcguccaggagaccgugagaguccgcaagguggacguuuccagcgugcccgaccaucuuaaggaacaagaggauuggacggacucuaaacuguccaugaaccagaucgugagccugcaguucgauuuucacuucgaaucucucuccaucauucuguacaacaaugacaucaaccaggagagcggagucgccuuucacaaugauucuuuccaacuuggcgagcugcggcuccaucugauggcuuccagcgggaagauguuuaaagacggauccaugaacguuagcgugaagcugaaaacaugcacccucgaugaccuuagagaaggcauugagcgcgcgacaucucggaugaucgauagaaagaaugaccaggauaacaauagcuccaugauugacaucucuuauaagcaggauaaaaacggcagccaaaucgacgccgugcuggacaagcuguacgucugugcuuccguggaguuccucaugaccguugccgacuuuuucauuaaagccgugccucagucucccgagaaugucgcuaaggagacccagauccugccucgccagacagccacggggaaagugaagauugaaaaggacgauagcguccggccgaacaugacccuuaaagcgaugaucacagaccccgaggugguuuucguggcuucccugaccaaggccgaugccccugcucucacagccucuuuucaaugcaaucugagccuguccaccagcaaacucgaacagaugauggaggcgucugucagagaccuuaaggugcuggccugucccuuccugcgcgaaaaacggggaaagaacauuacgacaguucuccagccuugcucccuguuuauggagaaguguaccugggcuagcggcaaacagaauaucaacauuauggugaaggaguucaucaucaaaauuucucccaucauucuuaauaccguccugacaaucauggccgcucucuccccgaagaccaaagaagaugggagcaaggacacauccaaggagauggaaaaccuguggggaauuaaaucuaucaacgauuauaauacgugguuucugggcguggacaccgccacagagaucaccgagagcuucaaggggauugagcacucccucaucgaggaaaacugcggagugguugucgagagcauucaagugacacuugaauguggccugggccauagaaccgugccucugcuccuggcugagucuaaauuuuccgggaauaucaagaacuggacgagccuuauggccgcggucgccgauguuacccuccaggugcacuacuacaaugaaauucacgcugugugggagccccugaucgagcgggucgaaggaaaacgccaguggaaccugagacuggacgugaagaaaaauccuguucaggacaagucucuccugcccggcgaugacuucaucccugagccccaaauggccauucauaucagcuccgggaacacaaugaauauuaccaucucuaagagcugccuuaacguguuuaauaaccuggcuaaaggauucuccgaaggcacagccucuaccuuugauuauagccucaaggaccgggccccguucacagucaaaaaugcuguggggguuccuauuaaggugaaacccaacuguaaucugcgcgucaugggauuucccgagaaguccgauaucuucgacguggaugcgggccagaaccuugagcuggaauacgccagcauggugccuucuucccagggcaaccucagcauccuguccagacaagagucuagcuucuuuacgcugaccauugucccgcacggguauacagaaguugcuaauauccccguggcccggccuggaagacgccucuacaacgugcggaaucccaacgccucccauucugacagcguccuggugcagauugaugcuaccgagggcaauaagguuaucacccuuagauccccucugcagauuaaaaaccacuucagcaucgccuuuauuaucuauaaguucgugaaaaaugucaagcuccuggaacgcaucgggauugcgcggcccgaggaggaauuucaugugccucuugacucuuacagaugccagcuguucauccaaccggccggcauucucgagcaccaguauaaagaauccacaacguacaucagcuggaaggaggaacugcaccgcucucgggagguuagauguaugcugcagugccccuccguggaggucagcuuucucccucugauugugaacaccguugcccuucccgaugaacugucuuacaucugcacacauggcgaggacugggauguggccuauaucauucaccucuacccuucccugacccuucgcaaucugcuccccuauagccugagauaccugcucgaagggacagcugagacccaugaacuggccgagggaucuacggcggacguccuucacagccggaucuccggcgagauuauggaacuggugcucgucaaguaucagggcaaaaacuggaaugggcacuuccgcaucagagacacacugccggaguuuuucccuguguguuuuagcuccgauucuaccgaaguuaccacaguggaccuuagcguccaugugcggcgcauuggauccagaauggugcugucuguuuucagccccuacuggcucaucaacaagaccacacgggugcugcaauauagauccgaggauauccacgucaaacaucccgccgacuuucgcgauauuauccuguucucuuucaagaaaaagaauauuuuuaccaagaacaaagugcagcucaagaucagcacguccgcuugguccucuuccuucagccuggacacaguuggcucuuacgggugcgugaaauguccugccaauaacauggaguaccuugucggaguguccauuaagaugagcucuuuuaaccugucccggaucgucacccucacacccuucugcaccauugcuaauaaaagcucucuggaacuugaggugggcgaaaucgccuccgaugggagcaugccuacgaacaaguggaauuauaucgcuagcuccgagugucugccguuuuggcccgaaucucucagcggaaaacugugcguuagaguggucggcugugagggcuccucuaagccuuucuuuuacaaccgccaggacaaugggacccugcucagccuggaggaucuuaacggaggcauucugguggacguuaauacagccgaacacuccaccgugaucacauucucugauuaucaugaggggagcgcgcccgcccucauuaugaaccacaccccuugggacauccugacauacaagcaguccggaagccccgaagagaugguccuucugccgcggcaagcuagacucuuugccugggcugauccuaccggcacgcggaaacugacauggaccuaugccgccaaugugggggaacacgaccugcucaaggacggaugcggccaguuccccuacgaugcgaacauucagauccauugggugucuuuucuggacggccgccaaagaguucuucuguucaccgaugacgucgcucucguguccaaagcccugcaggcugaggagauggaacaggccgauuaugagaucacacuuagccugcacucucucgggcugucccuggugaauaacgaaagcaagcaggaggucuccuacauuggaaucaccucuagcggcgugguuugggaagugaaaccuaagcaaaaguggaaacccuuuucccagaagcagauuauccuucuggagcagucuuaccaaaaacaucagauuagccgggaccacggguggaucaagcucgauaauaacuucgaggucaauuucgacaaagauccuauggaaaugcgccugcccaucagauccccgauuaagcgggacuuucucagcggaauccagauugaguucaagcagucuucccaccaacgcagccugagagcccggcuuuauuggcugcaaguggauaaccagcugccuggcgcuauguuucccguuguguuccaucccgucgccccuccgaaaucuaucgcgcucgacagcgaacccaagccuuuuauugacguguccguuaucacacgcuucaacgaguacucuaaagugcugcaguuuaaguauuucaugguccuuauucaagagauggcccugaaaaucgaucagggguuucucggagcuaucauugcccuguucacgcccaccacagacccugaagcugagagacggagaaccaagcucauccagcaagauauugacgcccugaaugcggaacugauggagacaagcaugaccgauauguccauccuuagcuuuuucgaacacuuucauauuucucccgugaagcugcaccucucccugagccuuggcuccggcggggaggagucugacaaagaaaagcaggagauguucgccgugcauagcgucaaccugcuccugaaauccaucggagcuacgcucaccgauguugacgaucugaucuucaagcuggccuacuaugaaauucgcuaccaguuuuauaaacgggaccagcuuaucuggucuguggugagacacuacagcgagcaauuccugaagcagauguacguccucgugcugggccuugauguucuggggaauccuuuuggacucauucgcggccuguccgaagggguggaggcucuguucuaugagcccuuucagggcgccguccagggaccggaagaguucgcugaaggccucgugaucgggguucggucucuguuuggacacacagugggcggggccgcgggagucgugagcagaauuaccggcuccgucgggaaaggccuugccgcuaucacaauggacaaggaguaccaacagaagcgccgggaagaacugagcagacagccucgcgauuucggagacucucucgcccggggcgggaaaggauuucugagaggcgugguugggggagugaccggcaucauuacgaagcccgucgagggggcuaaaaaggaaggcgccgccggauucuuuaaaggcaucgggaagggacuugugggcgcgguugcucgcccuacagggggaauuguggacauggccuccagcaccuuccagggcauccaacgggccgcugagucuacagaagaggucuccagccugagacccccgcgccucauucaugaggauggcaucauuagaccuuaugaccggcaggaaucugaggggagcgaucugcuggaacaggagcucgaaauccaagaguga

SEQ ID NO: 77789 - RNA, 756 nt, Artificial Sequence
  derived and/or modified sequence opt5 from VPS26A__Homo_sapiens__NP_001030337
augagcuuccugggcggguuuuucggacccaucugcgagauugacaucgugcucaacgauggcgaaaccagaaagauggccgagaugaaaacagaagacgggaaggucgagaaacacuaccuguuuuaugauggagaauccguuucuggcaaggugaaucuugcuuucaaacagccugggaagcggcuggagcaucaaggcauucgcaucgaguuugugggacagauugaacucuucaacgacaagagcaauacgcacgaguuugucaaccuggugaaagaacuugcccugccgggcgagcucacccaguccagaucuuacgauuucgaguuuaugcagguugaaaagcccuaugagagcuacaucggggcgaaugugcggcugcgcuauuuccugaaagucacaaucgugagacggcucaccgaccugguuaaggaauacgaucuuauugugcaucaacuggcuacauauccugacgucaacaauuccaucaaaauggaggugggaauugaagauugucuccacaucgaguuugaguacaacaagucuaaguaccaucugaaagacgugauugucggcaagaucuauuuccuucugguucgcauuaaaauccagcacauggaacuccagcugaucaagaaagagauuaccgggaucggacccagcacaaccacggaaaccgagacaauugccaaguacgaaaucauggauggcgccccugugaaaggggacaauuuuauggagaaguccagcuga

SEQ ID NO: 77790 - RNA, 666 nt, Artificial Sequence
  derived and/or modified sequence opt5 from VPS28__Homo_sapiens__NP_057292
auguuccacggcauccccgccaccccugggauuggagcuccgggcaacaagcccgagcuguacgaagaggugaaacucuauaagaaugccagagaacgggagaaauacgacaacauggcggaacuguuugcugucguuaagacaaugcaggcccuugagaaagccuauaucaaggauugcgugagcccuuccgaguacacggcugccuguucucgccugcucgugcaauauaaggcugccuucagacagguccaggggagcgaaauuuccucuaucgacgaguuuugccggaaauuccgccuggauuguccccuugcgauggaaagaauuaaggaggaccggccuaucaccaucaaagaugacaagggaaaucugaaccgcugcauugccgaugugguuagccucuuuaucacagugauggacaaacugagacuggagauucgggcuauggaugaaauccagcccgaccuccgcgagcugauggaaaccaugcauagaaugucccaccuuccuccggauuucgagggccggcaaacagucucucaguggcugcagacccucagcgggauguccgccagcgacgaacuggaugacucucaggugcgccaaaugcuuuuugaccuggaguccgcuuacaaugccuucaacagauuucuccaugcguga

SEQ ID NO: 77791 - RNA, 1791 nt, Artificial Sequence
  derived and/or modified sequence opt5 from VPS33A__Homo_sapiens__NP_075067
auggccgcucaccugagcuacggcagagugaaccucaauguccugcgggaggccguucgcagagaacuucgggaguuccuggacaagugcgcgggguccaaagcuaucgugugggaugaauaucucaccggacccuuuggccugauugcccaguacucucuucugaaggagcaugaaguggagaaaauguucacacucaaggggaaccgccugccugccgcugacgucaaaaauaucaucuuuuucgugagaccgcggcuggagcucauggauauuauugccgaaaacguucugagcgaggaccgcagaggacccacgcgggauuuucacauccuuuucgugccucgcagaucccugcucugugaacaacggcugaaggaccuuggcguccuggggucuuuuauccaucgcgaggaguauagccucgaucugauucccuucgacggagaucugcucuccauggaaucugagggcgcuuuuaaggaaugcuaccuggagggcgaccagaccagccuuuaucacgccgcgaaagggcugaugacacuccaggcccuguacggaaccaucccucagauuuucggcaagggggaaugugcuagacaaguggccaauaugaugauccggaugaaacgcgaguuuacaggaucccagaacagcauuuuccccguuuuugauaaucuucugcuccuggacagaaacguggaucugcucaccccucuggcuacacagcuuaccuaugagggccugaucgacgaaauuuacgggauccaaaauucuuacgucaagcucccgcccgagaaauucgccccuaagaagcagggagacggcggcaaagaucugcccacggaagcgaagaaacuucagcugaacuccgccgaggaacucuaugcugagauccgggacaagaauuucaacgccguggggagcgugcugucuaaaaaggcuaaaauuaucuccgccgccuuugaggaaagacauaaugcuaagaccgucggagagauuaagcaguucguuagccagcugccucacaugcaagcggcccgcggcucucucgcuaaccacacauccaucgccgaacugauuaaagaugugaccacaagcgaggacuuuuucgauaaacuuaccguggaacaggaguuuauguccgggaucgacacggauaaggucaauaacuacaucgaggacugcauugcccagaagcauucucugaucaaagugcuccggcugguuugucugcaaagcgugugcaacuccggacuuaagcagaagguccucgauuauuacaaaagagaaauucugcagacauauggcuacgagcacauccugacccuccauaaucuggaaaaggcugggcuucugaaaccccagacaggaggccgcaacaauuauccgaccauucggaagacccucagacuguggauggacgaugugaacgagcaaaauccuacagacaucagcuacguuuacucuggcuaugcgccccuguccgugcgccuugcccagcuccugagccggccuggguggagaucuaucgaggaaguccugcgcauucuccccggaccccacuucgaggaacggcagccucugccgacgggccuucagaaaaagagacaacccggggagaaccgcgugacccugaucuuuuuccucggaggcgucacauuugcugaaauugccgcccugcgguuccugagccagcuugaggacgggggcaccgaguacgugaucgcuacaaccaagcucaugaauggaacguccuggauugaagcccugauggagaaaccuuuuuga

SEQ ID NO: 77792 - RNA, 1854 nt, Artificial Sequence
  derived and/or modified sequence opt5 from VPS33B__Homo_sapiens__NP_061138
auggccuucccccacagaccugacgcuccggagcugcccgauuuuagcaugcucaagcggcuggcccgcgaccagcuuaucuaccugcucgaacaacugccuggcaaaaaggaucuuuucauugaggcggaccugaugucuccccucgauagaaucgcuaacguguccauucugaaacagcacgaagucgacaagcuguauaaaguugagaauaagccugcccucagcuccaacgaacagcugugcuuucuugugcggccccgcaucaagaauaugagauacauugccucucuggugaacgcugauaaacucgccgggcggacgcgcaaguauaaagucaucuucagcccucagaaguuuuacgcuugugagauggugcuggaggaagagggaaucuauggcgacguuuccugcgaugaaugggccuucucucuucugccgcucgacguggaucugcugagcauggagcuccccgaguuuuucagagacuacuuucuggaaggggaucaacgguggauuaauacagucgcgcaggcccuucaccuucucuccacgcuguauggaccuuuccccaacuguuacggcaucgggcgcugcgcuaaaauggccuacgagcuuuggagaaaucuggaagaggaagaggacggagagaccaagggccggcgcccugaaauuggccauaucuuucuccuggacagagauguggacuucguuacagcucuguguagccagguggucuaugaggggcucguggaugacaccuuucggauuaagugcggaucuguggauuucggccccgaagucacauccagcgacaaaucucugaagguucuucugaacgccgaggauaaaguguucaaugaaauccgcaacgagcacuuuuccaauguguucggguuucucagccagaaggcgagaaaccugcaagcccaguacgaccggagacgcggaauggauauuaaacagaugaagaauuucgucucucaggagcuuaaaggccugaagcaagaacaucggcuccugucccugcacaucggggcuugugagagcaucaugaagaaaaagaccaaacaggacuuucaggaacucauuaagacagagcacgcccugcuugaaggauucaacaucagagaguccaccucuuauauugaggaacauaucgaucgccaagugagcccgauugagucccugcggcucaugugccugcugagcaucacggaaaauggccuuaucccuaaagacuacagaucucucaagacccaguaucugcaguccuacggccccgagcaucugcucacauuuagcaaccugcgccgggcugggcuucugaccgagcaggccccuggagacacacucaccgccguugaaucuaaggugagcaaacuggucacggauaaggcugcgggcaaaauuacagacgccuucuccucucuggcuaagagaagcaacuuucgcgccaucuccaaaaagcugaaucucauuccccggguggauggggaguaugaccugaagguucccagagauauggccuacguguucggaggcgcuuacgucccucugagcugucgcaucauugaacaagugcucgagcggagaucuuggcaggggcuggacgaagucgugcggcuucugaacugcuccgauuuugccuucaccgacaugacaaaagaggauaaggcgagcucugagucccuccgccugauccugguuguguuucuuggaggcuguaccuucagcgaaaucuccgcucucagauuccugggccgggagaaaggguauagauuuauuuuccugaccacagccgucaccaauucugcccgccucauggaagcuaugagcgaggugaaggccuga

SEQ ID NO: 77793 - RNA, 2391 nt, Artificial Sequence
  derived and/or modified sequence opt5 from VPS35__Homo_sapiens__NP_060676
augcccaccacacagcaaagcccucaggacgagcaggaaaagcugcucgaugaggccauccaggcugugaaaguccaauccuuccagaugaagagaugccuggacaaaaacaaacuuauggaugcccugaagcacgcgucuaauaugcucggcgaacugcggacgagcaugcuuuccccgaagucuuacuaugagcuguacauggcuauuagcgacgaacuccauuaucuggagguuuaccugaccgaugaguuugccaaggggcgcaaaguggccgaccucuaugaacuggugcaguacgcuggaaacaucauucccagacuuuaucugcucaucacagucggcgugguuuacgugaaguccuucccucagucucggaaagauauucugaaggaccuugucgagaugugucgcggggugcaacacccccugagaggacucuuucugcggaauuaccugcuccagugcacccgcaacauccugccugaugaaggcgagcccacagacgaggaaaccacaggggauaucagcgacuccauggauuucguucuucugaauuuugccgagaugaacaaacucugggugagaaugcagcaucagggacacagccgggaccgcgaaaagagagagcgggaacgccaagagcugcgcauucuugucggcaccaaucuggugcggcucucucagcuggagggcgugaacgucgaacgcuauaagcagaucguucugacggggauucucgagcaaguggugaauuguagagacgcucuggcccaggaauaccuuauggagugcaucauucaggucuucccugaugaauuucaucugcagacccucaacccguuccugcgggcgugugccgagcuucaccaaaaugugaacguuaaaaauaucauuaucgcucugaucgacagacucgcccuguuugcucaccgcgaggauggacccggcauuccugccgacaucaagcuguucgauaucuuuucccaacagguggcgacagucauucagagccggcaggacaugcccucugaagaugugguuucccuccaggugagccugauuaaccuugccaugaaaugcuauccugacagagucgauuacguggacaagguccuggagaccacaguggaaaucuucaauaaacucaaccuggagcauaucgcuaccucuuccgccguuagcaaggaacugacgcgccuucucaaaauucccguggauacauauaacaauauccugaccguccugaagcucaagcacuuucauccgcuguucgaguacuucgacuaugagucccggaaaucuaugagcuguuacgugcuuuccaacguucuggacuacaauacagaaauugugagccaggaucaggucgacucuaucaugaaccucguguccacccugauucaagaucagccugaccagcccguggaggauccugaccccgaagauuuugcugacgagcagagccugguugggagauucauccaccuucuccgcucugaggaucccgaccaacaguaucugauccugaauaccgcccggaagcacuuuggagccggcgggaaccagagaauuagauucacacucccuccgcuggucuuugcugcguaccaacuugccuuccgguauaaagaaaauagcaagguggaugacaaaugggagaagaagugccagaaaaucuuuuccuucgcucaucagacgauuucugcccugaucaaggccgaacucgcugagcugccccugagacuuuuucuccagggagcccuggcggcuggcgaaauuggcuucgagaaccacgagaccguggccuacgaauuuaugagccaagccuucucccuguaugaggaugaaaucagcgacucuaaagcucagcucgccgcuauuacacugaucaucgggaccuuugagcgcaugaaguguuucuccgaagagaaucaugagccucuucggacacagugcgcccuggcggccagcaaacuccugaagaagcccgaccagggcagagcugucucuaccugugcccaccuguucugguccggacggaacacggauaaaaauggggaggaacuucauggaggcaagcgcgugauggaaugccucaaaaaggcucugaaaauugccaaccaaugcauggacccuagccugcagguucagcucuuuaucgagauucugaauagauacaucuauuucuacgaaaaggagaacgaugcggugacaauucagguccuuaaucaacugauccagaagauccgggaggaccuccccaaccuggaauccucugaggaaaccgagcagauuaacaaacacuuucacaauacccuggagcaucuuagacugcgccgggaaagcccggaguccgaagggccuaucuacgagggacucauucuguga

SEQ ID NO: 77794 - RNA, 1161 nt, Artificial Sequence
  derived and/or modified sequence opt5 from VPS36__Homo_sapiens__NP_057159
auggacagauucguguggaccagcggccugcucgagaucaacgaaacacuggucauucagcaacgcgggguucggaucuacgauggagaggaaaagauuaaauuugacgccggcacgcuucugcucuccacccacagacugaucuggcgggaucagaagaaucaugagugcuguauggcuauucuucugucucagaucguguucaucgaagaacaggccgcggggauuggaaaaagcgcuaagaucgugguccaccuccaucccgccccuccgaacaaagagcccggcccuuuucaauccucuaagaauagcuauauuaagcuguccuucaaagaacacgggcagaucgaguuuuaccgcagacugucugaagagaugacacagcggcgcugggagaacaugcccgugagccagucccuccaaaccaauagaggaccucagcccggccggauucgcgccguuggcaucguggggauugaaagaaagcuggaggaaaaacggaaggagacagacaaaaacaucagcgaggcuuucgaggaucuuucuaagcugaugaucaaggccaaagagauggucgaacucuccaagagcauugcuaauaaaaucaaggacaaacagggagauauuaccgaggacgaaacaauccgcuuuaagucuuaucugcuuuccaugggcauugccaacccugugaccagagagacguacgggagcggaacccaguaucauaugcaacuggcgaaacagcucgccggcauccugcagguuccgcuggaagaacgcgggggaaucaugucucucacagagguguacugccuggucaaucgggcuagaggcauggaacuucugucccccgaggaucucgugaacgccuguaagaugcuggaagcucuuaagcugccucuccggcugagaguguucgacagcggcgucaugguuauugagcugcaaucccacaaagaagaggagaugguggccucugcgcucgaaaccgugagcgagaaggggucccugacaagcgaagaguuugccaaacuugucggaaugucugugcugcucgcuaaggagcgccugcuucuggccgagaaaaugggccaccucugccgggaugacuccguugaggggcugagauucuaucccaaucuguuuaugacccagagcuga

SEQ ID NO: 77795 - RNA, 1119 nt, Artificial Sequence
  derived and/or modified sequence opt5 from VPS37A__Homo_sapiens__NP_001138624
augagcuggcuguucccccucaccaaguccgccucuagcuccgcugccggcucuccugggggacugacaagccuucagcaacagaaacagagacugaucgagucccuccggaacucucacagccgccugcuuccgccccaguuuccucaagaaaagcccgugauuuccgucuacccucccaucagacaucaccugauggacaaacagggcguuuaugugacgagcccucucgugaauaacuucaccaugcauucugaucuggggaagauuauccagucccugcucgacgaguuuuggaaaaauccgcccguccuggcgccuacaagcaccgcuuuccccuaccuuuauucuaacccuuccggaaugagccccuacgccucucagggcuuuccguuccugccucccuauccuccccaagaagccaaucgguccauuacaagccucuccguggcugauaccguuucuagcuccacaaccagccacacgaccgccaagcccgcugccccuucuuuuggggugcuguccaaccuuccgcugcccaucccuacagucgacgcgagcauccccaccucucagaauggauucggcuacaagaugccugaugugcccgacgccuuuccggagcucagcgaacuguccguuucucagcugacagauaugaacgagcaggaggaagugcuccuggagcaauuccuuacccugccucagcucaaacagauuaucacggacaaggaugaccuggucaaaagcauugaggaacuugcucgcaagaaucugcuccuggagcccucccuggaagccaaaagacaaacagugcucgauaaguaugagcugcuuacccagaugaaaagcacauuugaaaagaagaugcagcggcagcaugagcugucugaauccugcagcgcuucugcccuccaagcgcgccugaaaguggccgcucacgaggccgaggaagaguccgacaacaucgcugaagauuuccuugagggcaagauggaaauugacgacuuucugagcuccuucauggagaaaagaaccaucugucacugccggcgcgccaaggaggaaaaacuccagcaggccauugcuaugcauucucaguuccacgcgccucuguga

SEQ ID NO: 77796 - RNA, 858 nt, Artificial Sequence
  derived and/or modified sequence opt5 from VPS37B__Homo_sapiens__NP_078943
auggccggcgcugggagcgaggccagauucgcgggacugucccucgugcagcugaacgaacuucuggaggacgaaggccaacucaccgagaugguccagaagauggaagagacacagaauguucagcugaacaaagagaugacgcuugcuucuaaucggagccuggccgaagggaaccuccuguaccaaccccagcuggauacccucaaggcccgccugacacagaaauaucaggagcuucaagugcuguuugaggcuuaccagaucaagaaaaccaagcucgacagacaguccucuagcgccucccuggaaacacuucuggcucuccugcaggccgagggagcgaagauugaagaggauaccgaaaauauggccgagaaauuccuggacggcgaacucccucuggauucuuuuaucgacguguaucaaagcaagcggaaacuugcucacaugcgcagagucaagauugagaaacugcaggagauggugcucaaggggcagcggcugccgcaagcccuugcuccccugccuccccgccucccugaacuggcccccacagcgccucugccguaccccgccccugaggcuuccggacccccugccguugcucccagacggaucccgccucccccuccucccgugcccgccggccgccucgccaccccguucacggcugcgaugagcucuggccaggccguccccuauccugggcugcagugcccuccccuucccccgagagugggacugccuacccagcaaggcuuuuccagccaguucguuucucccuacccucccccucucccccagcggccgccuccccgccugcccccucaucagccgggguuuauucuucaauga

SEQ ID NO: 77797 - RNA, 1068 nt, Artificial Sequence
  derived and/or modified sequence opt5 from VPS37C__Homo_sapiens__NP_060436
auggagacccugaaggacaaaacacuccaggaacuggaggaacuucaaaacgauagcgaggccaucgaccagcuggcucucgaaucccccgaggugcaggaucugcagcuugagagagaaauggcccuggcgacgaaucggucucucgcugagcgcaaccuggaguuccaaggcccucuggaaauuagcagauccaaucucucugaccgguaccaggagcugcgcaaacuugucgaaagaugccaggagcagaaggccaagcuggaaaaauucagcuccgcccuccaaccggggacccugcuugaucugcuccagguugagggaaugaagaucgaagaggagucugaagcuauggccgagaaguuccuggaaggcgaggugccccuggaaacauuucucgagaacuucagcuccaugcggaugcugagccaccuucgcagagugcgggucgagaaacugcaggaagugguucgcaagccuagagcuucucaggagcucgccggggacgcgcccccuccccggccuccgcccccugugcgccccgucccucaaggaacacccccggugguugaggaacagccucagcccccucuggccaugccucccuauccccuuccguacucccccagcccuucucugcccgugggcccuaccgcucauggggcccugcccccggcuccuuuucccgucgugucccaaccuagcuucuauucuggaccccucggcccuaccuaccccgccgcgcagcugggcccgagaggggccgcuggauauuccuggagcccucagcgguccaugccuccccgccccggcuacccggggacacccaugggagccucuggcccuggguauccccucagaggaggccgggcuccuagccccggcuacccucagcaaucccccuacccggccaccgggggaaaaccucccuauccuauucagccccagcugccgagcuuuccuggccagccccaaccuucugugccccuucagcccccuuacccgcccgggccugcucccccuuauggauuucccccuccgcccggcccugccuggcccggguacuga

SEQ ID NO: 77798 - RNA, 2661 nt, Artificial Sequence
  derived and/or modified sequence opt5 from VPS39__Homo_sapiens__NP_001288067
augcacgacgccuucgagcccgugccuauccuggaaaagcucccgcugcagauugauugccuugcugccugggaggaauggcugcucgucggcaccaaacaagggcaucugcuucuguacagaauccggaaggacguugugcccgcggauguggcuagcccugaguccggaucuuguaaccgcuuugaagucacacucgagaaaagcaauaagaacuucuccaaaaagauucagcagauccacgugguuucucaguuuaagauucuggugagccugcucgagaauaacaucuauguccaugaccugcuuacguuccaacagaucaccacaguguccaaagccaagggcgccucucuguuuaccugcgaucuccagcacacagaaaccggggaggaaguucugagaauguguguggcugucaaaaagaaacuucagcuguacuucuggaaggaccgggaguuucaugagcuccaaggagauuucagcgugcccgacgugccuaaguccauggccuggugcgaaaauagcauuugugucggcuuuaaacgcgauuauuaccugaucagaguugacgggaagggaucuauuaaagagcuguuccccacaggcaagcagcucgaaccucugguggcuccgcuugccgauggcaaaguggcggucgggcaggacgaucugaccgugguucucaacgaggaaggaaucugcacgcagaagugugcccugaauuggaccgacauucccguggcuauggagcaccaaccucccuauaucauugccguccuuccucgguacguggagauccgcacauuugaacccagacugcucguucaguccaucgagcugcagcggccgcgcuucauuaccagcggcgggucuaacaucauuuauguggcuuccaaucacuuugucuggagacugaucccugugcccauggccacacaaauucagcagcuccugcaggacaaacaauucgaacuugcgcugcagcucgccgagaugaaggaugacagcgauucugaaaagcagcagcaaauccaucacaucaaaaaccuguacgcuuucaaucuuuucugccagaagcgguucgacgaguccaugcaggucuuugccaaacugggaaccgauccuacgcaugugaugggccucuaccccgaccugcugcccacagauuaucgcaagcagcuccaauacccuaacccgcugcccguucuuagcggggcugagcuggaaaaagcccaccucgcccugauugacuaucugacccagaagagaucccagcuugugaagaaacucaaugauucugaccaccagagcuccacaagcccucugauggagggaacccccaccaucaagucuaaaaagaaacugcuccaaauuaucgauacaacgcugcuuaaguguuaccugcauaccaacgucgcucucguggcgccucugcugcggcuugaaaauaaccacugccauauugaggaauccgagcacguucucaagaaagcccauaaguauagcgagcugaucauccuguacgagaaaaagggccuccacgaaaaagcucugcaagugcuugucgaccagucuaagaaggccaacagcccccugaaaggccacgaacgcacagugcaguaucuccagcaucuggggaccgagaaucugcaccuuauuuucuccuacucuguguggguucucagagacuuuccggaggauggacugaagaucuucacagaagaccugccugaggucgaaagccucccccgggauagagugcugggcuuucuuauugagaacuucaaagggcuggccaucccuuaccucgaacauauuauccacgugugggaggagaccggaucccgcuuucacaauugucugauucagcuguauugcgaaaagguccagggccuuaugaaagaguaccuccugagcuuccccgcugggaagacgccugugcccgccggagaagaggaaggcgagcugggcgaguaucggcaaaaacuccugauguuucuugaaaucucuuccuacuaugacccggggagacugaucugcgauuucccuuuugacggacuccuggaggaacgcgcgcugcuucugggccggauggggaagcaugagcaggcucucuucauuuacguucacauccugaaggauacaagaauggccgaagaguauugucauaaacacuacgaccgcaacaaggauggaaauaaagacguguaccucagccugcuucggauguaucugucuccucccuccauucauugccucggccccaucaagcuggagcugcuugaaccgaaagccaaccugcaggcugcccuccagguccuggagcuccaccacagcaagcuggauaccaccaaggcucuuaaucugcuccccgccaacacacaaauuaaugacaucagaaucuuccuggaaaaagugcuggaggagaacgcgcagaagaaacgcuuuaaucagguucuuaagaaccugcuccaugccgaauuucugcgggugcaggaggaacgcauucuccaccaacaggucaaauguaucauuaccgaggaaaaggugugcaugguuuguaagaaaaagaucggcaauuccgcuuuugccagauacccuaacgggguggucgugcauuauuucugcucuaaagaggugaaucccgcugauacauga

SEQ ID NO: 77799 - RNA, 2565 nt, Artificial Sequence
  derived and/or modified sequence opt5 from VPS41__Homo_sapiens__NP_055211
auggccgaggcugaagaacaggaaaccggcagccuggaggaauccacagacgagucugaggaagaggaaagcgaggaggaacccaagcucaaauacgagagacuguccaacggggugacggaaauccuucaaaaggaugccgcgucuugcaugaccguccacgacaaauuccuggcucucggaacacauuauggcaagguuuaccugcuugaugugcaggggaauauuacccagaaauuugacgugagcccugucaagaucaaccagauuucccuggaugagucuggagaacacaugggcguguguagcgaggacgggaagguucaaguguucggacucuauuccggcgaggaauuucaugagacauucgauugcccgaucaaaauuaucgccguccacccccauuuugugcggagcucuuguaagcaguucguuaccggcgggaaaaagcugcugcucuuugaacgcuccuggaugaauagauggaaaagcgccgugcugcacgagggagaaggcaacauccggucugucaaguggcgcgggcaccuuauugcuugggccaauaacaugggagugaagaucuucgacauuaucuccaaacagagaauuacaaaugugccucgggaugacaucagccugcgccccgauauguacccuugcucucucuguuggaaggacaacgucacccugauuaucggcugggggacguccguuaaagugugcagcgugaaggagagacaugcuuccgagaugcgggaucuucccucucgcuaugucgaaaucgugagccaguuugagaccgaguucuacauuuccggacuggccccucucugugaccaacugguugugcugagcuaugucaaagagaucucugaaaagacagagagagaguacugcgcgcggccgcgccucgacauuauccagccccuguccgaaaccugugaggaaauuagcucugaugcccuuacagugagaggcuuucaggagaaugagugccgggacuaccaccuggaauauagcgagggcgaaucccucuucuacaucguuucuccucgcgauguggucguggcuaaagagagagaccaggaugaccauaucgauuggcugcuugaaaagaagaaauaugaggaggcccugauggcugccgaaauuagccaaaagaacaucaaacggcacaagauucucgacaucgggcuggcguacauuaaucaccuggucgagagaggagauuaugacaucgccgcucgcaaaugucagaagauccucggcaagaacgccgcucugugggaauacgagguguauaaauuuaaggaaauugggcagcuuaaagccaucucccccuaccugccucggggagaucccguucucaagccgcugauuuacgagaugauccuucaugaguuccuggaaagcgacuaugagggcuucgccacccucauuagagaauggccuggggaccuguacaauaacucugugaucguccaagcugugcgcgaucaccugaaaaaggacucccagaauaagacgcuccugaaaacacuugcggagcuguauaccuacgauaagaacuauggaaacgcccucgaaauuuaccugacacugcggcauaaagacguuuuucagcuuauccacaagcauaaucucuucagcucuaucaaagauaagauugugcugcugauggacuuugauuccgagaaggcugucgacaugcuccuggauaacgaggacaaaaucagcauuaagaaagugguggaggaacuugaagauagacccgagcugcagcacguuuaucuccacaagcuguucaaacgcgaccaucacaagggccaacgguaccaugagaaacagaucucccuguacgccgaauaugauagaccuaaucuucuccccuuucugcgcgacucuacccacugcccccuggagaaggcccucgaaauuugccagcagcggaacuucgucgaggaaaccguguaccugcuuagcagaaugggcaauucccgcucugcucugaagaugaucauggaggagcuccacgacguggauaaagccaucgaauuugcgaaggagcaagacgauggggaacugugggaggaccugauucuuuauagcaucgauaaaccuccguucauuacaggacuccugaacaauaucggcacgcaugucgaccccauucugcucauccaccggaucaaggaagggauggagauuccuaaccugagagauucccuugugaaaauccugcaggacuacaaucuccagauucugcugcgggagggauguaagaagauccuuguugcugauagccucucucugcugaaaaagaugcaucgcacccagaugaaaggcgugcucgucgacgaagagaacauuugcgaauccugucugagccccauccuuccuucugaugccgccaagcccuuuuccgugguuguguuccacugcagacauauguuucacaaagagugucugccgaugccuagcaugaacucugcugcccaauucugcaauaucuguagcgcuaagaaucgggggcccggcuccgccauucucgaaaugaagaaauga

SEQ ID NO: 77800 - RNA, 1314 nt, Artificial Sequence
  derived and/or modified sequence opt5 from VPS4A__Homo_sapiens__NP_037377
augaccacaagcacgcugcagaaggccaucgaccucgugaccaaagcuacagaggaagauaaggccaaaaacuacgaggaagcgcugagacuuuaucaacacgcugucgaguacuuccugcaugccauuaaguaugaagcccacuccgacaaagcuaaggagucuauccgggccaagugcguucaguaccucgaucgcgcugagaaacugaaggacuaucuuagaagcaaagaaaagcauggcaaaaagcccgugaaggagaaucaguccgaagggaaaggaucugauagcgacuccgagggcgauaacccugagaagaaaaagcugcaggaacaacucaugggggccguggucauggagaaaccgaauauucgguggaacgacguggcgggacuggaaggcgccaaggaggcucugaaagaagccguuauccuccccauuaaguuuccucaccuguucaccgggaagcgcacacccuggagaggaauccuucuguuuggcccucccggcaccgggaaaucuuaccucgcuaaggccguggcgacagaggccaauaacagcaccuucuuuuccgucucuagcuccgaucugaugagcaaauggcuuggagagucugaaaagcuggugaaaaaucucuucgagcuggcucggcagcauaagccuuccaucauuuuuaucgacgaaguugauagccuguguggcucucgcaacgagaaugaauccgaggccgcuagacggauuaagacggaguuccucgugcagaugcagggggucggaaacaauaacgacggcacccuggugcuuggggccacaaauaucccgugggugcuggauagcgccauucgcagacgguuugaaaaacgcaucuauauuccccucccugaggaagcugcgagagcccaaauguuccggcugcaccuuggauccacaccccacaaccugaccgacgcuaauauccaugagcucgcccgcaagaccgaaggcuacucuggcgccgacaucagcauuaucgucagagauucccugaugcagccuguucggaaagugcagagcgcuacgcacuuuaagaaagugugcgggcccucuagaacaaacccguccaugaugauugacgaucugcucaccccuuguagccccggagacccuggcgccauggagaugacauggauggauguccccggggacaagcugcuugagcccgugguuugcaugucugauaugcugcgcagccucgcgaccacccggccuacagugaacgcugacgaucugcuuaaggucaaaaaguucuccgaagacuuuggacaggagucuuga

SEQ ID NO: 77801 - RNA, 1335 nt, Artificial Sequence
  derived and/or modified sequence opt5 from VPS4B__Homo_sapiens__NP_004860
augagcuccaccucucccaaccugcagaaggccaucgaccucgcuagcaaagccgcgcaagaggauaaggcuggcaauuacgaagaggcccugcagcuuuaucagcacgccgugcaguacuuccugcaugucguuaaauaugaagcucaaggggacaaggccaaacaguccauuagagcuaagugcacagaguaccucgaucgggccgaaaagcugaaagaguaucuuaagaacaaagagaagaaagcgcagaagccugugaaggaaggacagccgucucccgccgacgagaaaggcaaugauagcgacggggaaggagaguccgaugacccugagaagaaaaagcugcaaaaccagcuccagggcgcuaucgugauugaacgccccaaugucaaauggucugauguggccgggcuggagggagcuaaggaagcccugaaagaggcgguuauccucccuauuaaguuuccccaccuguucacgggcaagagaaccccuuggcggggcauccuucuguuugggccgcccggaacaggcaaaagcuaccucgccaaggcuguggccaccgaagcuaacaauuccacauucuuuagcaucucuuccagcgaccuggucucuaaauggcuuggggaguccgagaagcuggugaaaaaccucuuccagcuggcccgcgaaaauaagccuagcauuaucuuuauugaugagaucgacucucuguguggauccagaagcgaaaacgaguccgaagccgcucggcgcauuaagaccgaguuccucguucaaaugcagggcgugggggucgauaaugacggaauccuggugcuuggcgcgacaaacauucccugggugcuggacucugccaucagacggcgcuuugagaaaagaaucuauauuccucuccccgaaccgcaugcucgggccgccauguucaagcugcaccuuggcaccacgcagaauagccugaccgaggcugauuuucgcgaacucgggagaaaaacagacggauacuccggcgccgauaucagcauuaucguccgggacgcgcugaugcaaccuguucgcaaggugcagucugcuacccauuucaaaaaggugagagggcccucccgggccgauccuaaccaccuggucgacgaucuccugacacccugcagccccggagacccuggcgccauugagaugaccuggauggaugugccgggggacaaacuucuggaacccguugugucuaugagcgauaugcucagaucccugucuaauacgaagccuacagucaacgagcacgaccuucugaagcucaaaaaguuuaccgaggacuucggacaggaaggcuga

SEQ ID NO: 77802 - RNA, 2349 nt, Artificial Sequence
  derived and/or modified sequence opt5 from VPS51__Homo_sapiens__NP_037397
auggccgcugccgcggcugccggccccagcccuggguccggaccgggcgacucucccgaggggccugaaggagaggcccccgaaagacggcgcaaggcucacggcaugcugaaacucuacuaugggcugagcgagggagaagccgcuggcagaccugccggccccgauccucuugacccgaccgaucugaacggggcgcauuucgaccccgagguguaccucgauaagcugcggcgcgagugcccucuugcccagcugauggacuccgaaacagauauggucagacaaauccgggcucucgacucugauaugcagacgcugguuuaugagaauuacaacaaauuuauuagcgccaccgacacaauccgcaagaugaaaaaugauuucagaaagauggaagacgagauggaucggcuggcuaccaacauggccgugauuacagacuuuuccgcgcgcaucucugccacccuccaggacagacacgagcggauuacaaagcuggcuggagugcaugcccuucugcgcaaacuccaguuccuguuugaacuucccagcagacugaccaagugugucgagcucggcgcuuaugggcaagccgugcgguaccagggacgcgcccaggcuguucugcagcaauaucagcaucugccuuccuucagagcgauccaggaugacugccaggugaucacggcccggcucgcucaacagcugagacagcgcuuucgggaaggcgggagcggagcccccgagcaagccgaaugugucgagcuucugcucgcucugggcgagccggccgaagaacuuugcgaagaguuccuggcgcacgcuagaggccgccucgaaaaagagcugcggaaucuggaggccgaacucgggccuucucccccugcccccgaugugcuggaguuuaccgaccacggaggcuccggguucguuggaggccuuugucagguggcugccgcuuaccaggaacuguuugccgcgcaggggcccgccggagcugagaagcucgccgcuuucgccagacaacugggcagccgcuacuuugcgcuugucgaacggagacuggcccaggagcagggcgggggagauaacucucuccuggugcgcgcucuggaccgguuccacagacgccuccgggccccuggcgcucugcuugccgccgcugggcuggcggaugccgcuacagagauuguggaaagagucgcccgggagcgccucggacaucaucugcagggccugagagccgcuuuccuugggugccucaccgacguucggcaagcccuggcggcuccgagaguggccggcaaagaaggacccggccuggccgagcuccuggcuaauguggccuccagcauccuuucucacauuaaggcgucccuggcugccguccaccucuuuacagccaaggaggugagcuucuccaacaaaccuuauuuucgcggggaguucuguucucagggaguucgggagggccugaucgugggguuuguccacagcaugugccagaccgcucaguccuucugugauagccccggagaaaagggcggggccacgccucccgcucugcuucuccugcugucuagacucugccuggacuacgagacagccaccauuuccuauauccuuacacugaccgaugaacaauuucucgugcaggaccaguucccgguuaccccugugagcacacugugugcggaggcccgcgagacggcuagacggcugcuuacccauuacgucaaagugcagggccucgucauuucucaaaugcugcgcaagagcguggaaacaagagacuggcuguccacccucgagccccggaauguucgcgccgugaugaaaagagucguggaagauacaaccgcuaucgacguucaggugggacugcuuuaugaggaaggcguccggaaggcccagucuagcgauuccagcaaacgcacguuuucuguguacuccagcucuagacaacaggggcgguaugccccuuccuacacacccagcgcuccuauggacaccaaccugcucuccaauauccagaagcuguucucugagcgcauugauguguuuagccccguugaguucaacaaggucuccgugcugaccggaaucauuaaaaucucucuuaagacacuccuggaaugcgugagacugcggaccuuuggcagauucgggcuccagcaaguccagguggacugccacuuccugcagcuuuaccuguggcgcuuuguugcggaugaggaacucgugcaucugcugcuugacgaggucguggccagcgcugcccugcgguguccggauccuguucccauggaacccuccguggucgaggugauuugcgagagaggauga

SEQ ID NO: 77803 - RNA, 1605 nt, Artificial Sequence
  derived and/or modified sequence opt5 from VPS52__Homo_sapiens__NP_001276105
auggagcagaugcugggcgccuuccaaagcgaccucuccucuaucagcuccgaaauuagaacccugcaggagcagucuggggcuaugaacauccggcuucgcaauagacaggccgugcggggaaagcugggcgaacucgucgaugggcugguugugcccagcgcgcuugugacagcuauucuggaggccccugucacggaaccgcgcuuucucgagcaacugcaggagcuggacgccaaagcugccgcugugagagaacaggaggcccggggaaccgcggccugcgcugauguucgcggcgugcucgacagacugcgggucaaggccgugacaaaaauccgcgaguucauucuucagaagaucuacuccuuuagaaaacccaugaccaacuaucaaaucccucagacagcucugcucaaguaccgguucuuuuaucaguuccugcuugggaaugagcgcgccaccgcgaaggagauuagagaugaauacguugagacacugucuaaaaucuaucucagcuacuaucgguccuaccugggacgccugaugaaggugcaguaccccuuugaagcccucuucagaagccaacacuaugcucugcuugacaacucuugucgggaguaccuguuuauuugcgaguucuuugucguguccggcccugccgcucaugaucucuuccacgccgugaugggcagaacccugagcaugacgcuuaaacaucuggacucuuaucucgccgauuguuacgacgcuaucgcggucuuucugugcauucacaucguucugcgcuuccggaauauugccgcuaagagagaugugcccgcccucgaccgcuauugggaacaggugcuggcccuucuguggccucgguucgagcucauccuggaaaugaacguccaguccgugagaagcaccgauccgcaacgccuugggggacuggacacacggccccauuacaucaccagacgcuaugcugaguuuucuuccgcccucguuagcauuaaucagacaaucccuaacgaacggaccaugcagcugcugggccagcuccaaguggaggucgaaaauuucgugcugagaguugcggcugaguuuuccucucgcaaagagcagcuuguguuccugauuaacaauuacgacaugaugcucgggguccugauggaacgggccgccgaugacagcaaggagguggaauccuuucagcagcugcuuaacgcuagaacgcaagaguucaucgaagaacuccugucucccccuuuuggaggccuggucgccuucgugaaggaggcugaagcccucauugagcgggggcaggcggaacgccugagaggagaggaggcccggguuacacagcuuaucagaggcuuuggcagcuccuggaaaagcucuguggaaagccugucccaggaugucaugcgcucuuucaccaauuuucggaacgggacaagcaucauucaaggagcucucacccagcugauccagcuguaccacagauuccaccgcgugcuuucccagccccaacucagagcccugccggcucgggccgagcugauuaauauccaucaccucaugguugaacugaagaaacauaagccuaacuuuuga

SEQ ID NO: 77804 - RNA, 2499 nt, Artificial Sequence
  derived and/or modified sequence opt5 from VPS53__Homo_sapiens__NP_001121631
augauggaggaagaggaacuggaguucguggaggagcucgaggccguccugcagcuuacccccgaaguucaacuggcuaucgaacagguguuuccuagccaggacccgcucgauagagccgacuucaacgcgguggaauacauuaauacacuguuucccacggagcagucccuugcuaacaucgaugaggucgugaauaagauucggcugaaaauccgcagacucgacgauaacauucggaccguugugcgcggccaaacaaaugucgggcaggacggaagacaggcccuggaagaggcccagaaggcuauccaacagcuguucggcaaaaucaaggauauuaaagacaaggccgaaaagucugagcagauggugaaagaaaucacccgggauauuaagcagcucgaccacgcuaaacgccaucugacaaccagcaucacaacccuuaaccaucugcacaugcucgccgggggaguugauucccuggaggcgaugacgagacggcgccaauauggcgagguggccaaucuucugcagggggucaugaacgugcucgaacacuuucauaaguacaugggcauuccucagaucagacaacugucugagcgggugaaagcugcccagaccgaacugggacagcagauucucgcugacuucgaggaagccuuucccagccaaggcacaaagcgcccugggggacccuccaauguccugagagaugcgugccuuguugccaacauccuggacccucggaucaagcaggagauuaucaaaaaguucauuaaacagcaccucucugaguaucuggugcuuuuucaggaaaaucaagacguggcuuggcuggauaagaucgaccgcagauacgccuggauuaaacggcagcucgucgauuaugaggaaaaguacggcagaauguucccgcgcgagugguguauggcugaacggaucgccguggaguuuugccacguuaccagagccgagcuggcuaaaaucaugcgcacacgggcgaaggaaauugaggugaagcugcuccuguucgccauccagagaaccacgaacuuugaaggguuccuugcuaaacgcuucagcggauguacacugaccgacggcacacucaagaaacuggagagcccuccucccuccaccaaucccuuucuugaggaugaacccaccccggagauggaggagcuggccacagaaaagggggaccucgaucagccuaaaaagcccaaggccccugacaaccccuuccauggaauugucucuaaaugcuuugagccccaccuguauguguacaucgagucccaagauaagaaucugggcgaacucauugaccgguucguugcugauuuuaaagcccagggcccuccgaagcccaacacggacgaagggggagcggugcugccuagcugugcugaccuuuucgucuacuauaaaaagugcauggugcaguguucucagcuguccaccggcgaacccaugaucgcccucacaaccaucuuucaaaaguaccugagagaguaugccuggaaaauucugagcgggaaccuuccuaagacaaccacgucuuccggaggccucacaaucagcucccugcugaaagaaaaggaggggucugaggucgcuaaauucacccucgaggaacugugccuuauuuguaauauccugagcaccgccgaauacugccucgcuacaacccagcagcuggaggaaaagcugaaggagaaaguggauguuucccuuauugagcgcaucaaccucacaggagaaauggacacguuuagcaccgugauuucuuccagcauccaacugcugguccaggaucucgacgccgcgugugaucccgcccugacagcuaugucuaagaugcaguggcagaauguggagcauguuggcgaccaaagcccguaugugaccuccgucauccuucacauuaaacagaacgugccuaucauucgggauaaucuggccucuacaagaaaguacuucacccaguuuugcgugaaauucgcuaacagcuuuauccccaaguucauuacgcaccucuucaaaugcaagccuaucuccaugguuggcgccgaacagcugcugcuugacacccauagccucaagaugguccugcuggaucuccccucuaucuccagccaaguggugcgcaaagcgccugccucuuauacaaagauugucgugaaagggaugacccgggcugagaugauccugaagguugugauggcuccccacgagccgcuugucguguuuguugacaauuacauuaaacugcucacagauuguaacaccgaaacguuccagaagauccuggacaugaagggacugaaaagauccgagcagagcuccaugcuugaacuccugcggcagcgccugccugccccucccucuggcgccgagagcuccgggucucucagccugacagcccccaccccggaacaagaguccagccggauuagaaaacuugagaagcugaucaagaaaagacucuga

SEQ ID NO: 77805 - RNA, 2898 nt, Artificial Sequence
  derived and/or modified sequence opt5 from VPS54__Homo_sapiens__NP_001005739
auggccagcucccacucuagcucccccgugccucagggcucuagcuccgacgucuucuuuaagaucgagguugauccgucuaaacauauuagacccgugccuagccugcccgacgugugcccuaaggaacccaccgucacagaucaacaccgguggacgguguaccauuccaaaguuaaccucccugcugcccugaaugacccgcgccuugcgaagagagagagcgauuucuuuaccaaaacaugggggcuggacuucguggauaccgaagucauccccucuuuuuaucucccucagauuuccaaggagcacuucacaguguaccagcaggaaaucagccaacgggagaagauucaugagcgcuguaaaaacaucugucccccuaaggacaccuuugaaagaacacugcuucacacccacgauaaaucucggacggaccuggagcagguucccaagaucuucaugaaaccggauuuugcucucgacgauucccugaccuucaauagcgugcugccuuggucucauuuuaacacagccggaggcaaggggaaucgcgacgccgcuuccagcaagcuccugcaggaaaaacuuucccacuaucuggacauugucgaggugaacaucgcccaucagauuucucucagaagcgaggcuuucuuucacgccaugaccucccaacacgaacugcaggauuaccuucggaagacaagccaggcggugaaaaugcugcgcgacaagaucgcccagauugauaaagucaugugcgagggaucucuccauauccugagacuggcucucacccggaauaacugcguuaagguguauaauaaacugaaacuuauggccacggugcaccaaacacagcccaccguccaggugcugcucuccacaagcgaguucguuggcgcucuggaccuuauugccaccacccaagaagugcugcagcaggaacuccaggggauccauucuuuccgccaccugggaagccaacugugugagcucgagaagcugaucgauaagaugaugauugcggaauuuuccacauacucucauagcgaccuuaacagaccucuggaggaugacugccagguccucgaagaggaacggcugaucucccuuguguucggccugcucaagcagcgcaaacugaauuuucuggagauuuauggcgagaagaugguuaucacggccaaaaacauuaucaagcagugugugaucaauaaggucagccaaaccgaagagauugauacagacguggucgugaaacucgcugaucagaugagaaugcugaacuucccccagugguuugaccuucugaaggacaucuucucuaaauuuaccauuuuccuccagcggguuaaggccacacugaauaucauucacuccgugguccugagcgugcuugauaaaaaccaaagaacccgcgaacucgaggaaaucucucagcagaagaacgcugccaaggacaauucccuggauacggagguugccuaccugauccacgaggggauguuuauuagcgacgcuuucggagaaggcgagcucacacccaucgcgguggauaccaccucccagcggaacgccucuccuaauagcgaaccgugcuccucugacagcgucuccgagcccgaguguacaaccgauucuagcuccagcaaagaacauacaucuuccagcgcuauuccugggggaguggacaucauggugucugaggauaugaagcugacggacagcgaacuuggcaaacuggccaacaauauucaagagcuccuguacuccgccagcgauaucugccacgacagagcuguuaaguuucugaugucucgcgccaaagauggguuccuugaaaagcucaacuccauggaguuuauuacccugagccggcugauggagacauucauccucgacaccgaacagaucuguggaagaaaguccacaucucugcuuggcgcgcugcagagccaagcuauuaaauucgucaaucgcuuucaugaggaacggaagaccaaacucucccugcugcuugacaacgagagauggaagcaggccgaugugcccgccgaguuccaggaccucguggauucucugagcgacggcaaaaucgcucugccugaaaagaaauccggggccacggaggaacgcaagcccgcugagguccucauuguggaaggacagcaauaugccguugugggcaccguccugcuucugauccggauuauccucgaguacugccagugcguggauaauaucccgucuguuacaaccgacaugcugacaagacugagcgaucuucucaaguauuuuaacucccgcagcugucagcuggugcugggggcgggagcccuccaggucgugggccugaaaaccauuacgacaaagaaucuugcucugucuucccggugccuccaacugaucguucacuacauuccugugaucagagcccacuucgaagcucggcugcccccuaaacaguauagcaugcuucgccauuuugaccacauuaccaaggauuaccaugaccacaucgccgagaucucugcgaaacuggucgccauuauggauucccucuucgacaagcugcucagcaaguaugaggugaaagcucccgugccuucugccuguuuuagaaacaucugcaagcagaugacaaaaaugcaugaagcuauuuucgaucugcuucccgaggaacagacccaaaugcuguuucuccggaucaaugccuccuacaagcugcaccugaaaaagcagcuuagccaccugaacgucauuaaugacgggggaccgcagaacggccucguuaccgccgacguggcuuucuacacaggcaaccugcaagcgcucaaggggcugaaagaucuugaccugaauauggccgagaucugggagcagaagagauga

SEQ ID NO: 77806 - RNA, 1128 nt, Artificial Sequence
  derived and/or modified sequence opt5 from VPS72__Homo_sapiens__NP_001258016
augagccuggccggcgggagagcuccccggaagaccgccggaaaccgccucuccggccugcuugaggcggaagaggaagacgaguucuaccagacaacguaugggggauuuaccgaagagucuggcgaugacgaguaccaaggggaucagagcgacacagaagaugagguggacuccgauuucgacaucgaugaaggagacgagccuucuagcgauggcgaggcugaagaaccgagacggaaacgcagagucguuaccaaggccuauaaagaaccccugaagucccuccggccucgcaaagugaauacacccgccggcucuagccagaaggcuagagaggaaaaggcccugcuuccucuggagcuccaggacgauggguccgacagccggaaaucuaugcgccaauccaccgcugagcacacaagacagaccuuucugcgggugcaggaacgccagggacaaagcagacggcgcaagggcccccauugcgagagaccucugacgcaggaggagcuccugcgggaagccaaaauuaccgaggagcuuaaccugagaucucucgaaacauacgagcgccuggaagcggacaagaaaaagcagguccacaagaaacggaaguguccggggcccaucauuaccuaucauuccgugacaguuccucuugugggagagcccggcccuaaagaagagaaugucgauaucgaggggagccugugcuucucucucuccuuugugcugagacuggaccccgccccgagcguuuccgcucucaccccucacgccggaacgggccccgugaacccucccgcucgcuguucucggacauucauuaccuuuagcgaugacgccacauucgaagagugguuuccccagggcagaccuccgaagguccccgugcgcgaagugugcccugucacccaucggcccgcgcuguacagagauccuguuaccgacauccccuaugccacagcucgcgccuucaaaaucauucgggaggcuuacaagaaauacaucacggcccacgggcuuccgccuaccgccuccgcucugggacccggcccucccccucccgagccgcucccugggagcggacccagagcgcugcgccaaaagauugugaucaaguga

SEQ ID NO: 77807 - RNA, 4287 nt, Artificial Sequence
  derived and/or modified sequence opt5 from VPS8__Homo_sapiens__NP_001009921
auggagaacgaacccgaccacgagaauguggaacagagccugugcgccaagaccuccgaggaggagcucaacaaaucuuucaaucuggaggcuagccuuuccaaguuuucuuacaucgauauggacaaagaacuggaguucaagaacgaucucauugacgauaaagaauuugacaucccucaagucgauacaccgcccacgcuggagagcauucuuaaugagaccgacgaugaagacgaguccuucauccuggaagauccuacacuccugaacauugacaccaucgauucucauagcuaugacacauccagcguugccucuuccgacagcggcgauagaaccaaucugaagcggaagaaaaagcuccccgacucuuuuucccugcacgggagcgugaugcgccauucucuucugaaaggaaucuccgcgcagauugugagcgcugccgauaaggucgacgccggccucccuacagcuaucgccguguccucucugauugcuguugggaccagccacggacuugcccugaucuucggcaaagaucagaaccaggcgcucagacugugucugggguccacgagcgugggaggccaauacggcgccauuucugcucucuccaucaauaacgacugcagccggcugcuuuguggguuugccaagggacagauuaccaugugggaucuggcuucuggcaagcuccugcgcagcaucacagacgcccaucccccugggaccgcgauccuucacauuaaauucacagaugacccgacccuggccaucugcaaugauuccggaggcucugucuuugagcucacguucaagagagugauggggguucggacaugugaaagccgcugccuguuuuccggaagcaaaggcgagguguguugcauugagccccugcacucuaagccugaacucaaagaccaucccaucacccaguucucccugcuugcuauggccagccugacaaagauucucgucaucggccugaaaccuucucuuaagguguggaugaccuuucccuaugggagaauggacccguccagcgugccucugcucgcuuggcacuucgucgccguucagaacuacgugaaucccaugcuggccuucugucggggagaugugguccauuuucugcucgugaagcgcgacgaguccggcgcuauccacguuaccaaacaaaagcaccuccaucuuuauuacgaucugauuaacuucacauggaucaauucuagaacggugguccuccuggacagcguggaaaaacugcacguuauugaucggcagacccaggaggaacuugagacaguggagaucuccgaaguccagcucguguauaacucuagccauuuuaagucccuggcgaccgggggaaacgucagccaagcccuggcucucgugggcgagaaagccugcuaccagucuauuuccagcuacgggggacagaucuucuaucugggcacaaagucuguuuacgugaugaugcuucgcuccuggagagaacgggucgaccaucugcucaagcaagauugucugaccgaggcccuggcucuugccuggagcuuucacgaaggcaaagcgaaggcugugguugggcucucuggagacgccagcaaacgcaaggccaucguggcugauagaauggucgagauucuguuccacuaugccgaccgggcucugaaaaagugcccugaucagggcaagauccaggugauggagcagcacuuucaagacauggugcccguuauugucgauuacugccuccugcuucagagaaaagaccugcuguucucccagauguaugacaagcugagcgaaaauucuguggccaaagggguguuucuggagugucuugaacccuacauccucuccgauaagcuggucggaauuacgccucaggugaugaaagaccugaucguucauuuccaagauaagaagcucauggagaacguggaggcgcugauuguccacauggacaucacaagccuugauauccaacaggugguucugaugugcugggaaaaucgccucuaugacgccaugauuuacguguacaaccggggcaugaaugaguuuaucuccccgauggaaaaacuguucagagucauugcucccccucugaacgccgggaagacccuuaccgaugaacaggugguuaugggcaauaaacuccugguguauaucucuuguugccuggcuggacgcgccuacccccucggcgacauuccugaagaucuggucccccuugugaagaaccagguguuugaguuccugauccggcuccauagcgcggaggccuccccggaagaggaaaucuauccuuacauuagaacacugcugcacuucgacacccgcgaguuucuuaauguccuggcucucacauucgaagauuuuaaaaacgacaagcaggccguugaguaucagcagcggaucguggauauucugcucaaagugauggucgaaaauucugacuucacgcccagccaaguggggugucuguuuaccuuccuugcuagacagcuggccaagccugacaacacacucuuuguuaaucgcacccuguucgaucaggugcuggaauuucuuugcucccccgacgaugacucucggcacagcgagagacaacagguccugcucgaacugcuccaggccggaggcaucgugcaguucgaggaaucccgccugauucggauggcugagaaggcggaguuuuaccaaaucugugaguucauguaugagagagaacaucaguacgauaaaaucauugacugcuaccuucgggauccucugcgcgaggaggaaguuuuuaacuauauccacaauauucucagcauccccgggcauucugccgaggaaaagcaguccguguggcagaaagcuauggaccacauugaggaacuggucagccugaagccguguaaagccgccgagcuuguggcuacacauuucucuggacacaucgagaccguuaucaagaagcugcaaaaccaggugcuccuguucaaauuucucagaucccugcuugauccucgggaaggcauucacgucaaccaggagcugcugcagaucagccccugcauuacggaacaauucaucgagcuccugugucaguuuaaucccacccaggugauugaaacacuucaagugcuggagugcuacagacucgaggaaaccauccagauuacacagaaguaucagcugcaugaggucaccgccuaccuccuggagaaaaagggggacauccacggcgcguuccuuaucaugcuggaacgccugcaaucuaaacuccaggaaguuacgcaucagggagagaacacaaaggaggauccuucccugaaggacguggaagacaccaugguggagacaauugcucuuugccagcggaauagccacaaccugaaucaacagcagagagaagcccucugguuuccgcugcucgaggccaugauggcuccccagaaacuguccagcucugccaucccucaucuucacagcgaggcgcugaagucccugaccaugcaaguccucaacucuauggcugccuucauugcccugcccagcauccuucagcgcauucugcaggauccuguguauggcaaagggaagcucggagaaauccagggccugauccucgggaugcuggacaccuuuaauuacgagcaaacacuucuggaaacgaccacaucccugcucaaccaggaucugcacuggucucuuuguaaucugagagcuagcguuacccggggacucaaccccaaacaggacuauugcuccauuugucugcaacaguacaagcgcagacaggagauggccgaugaaaucauuguguucucuugcggccaucuguaccacagcuuuugucuccagaauaaggagugcacagucgaguucgaagggcaaacccgguggacguguuauaaaugcuccagcucuaacaaggugggcaaacuuuccgagaauagcucugaaaucaagaaaggacgcauuacaccuucccagguuaagaugagccccuccuaccaucagucuaaaggcgacccgaccgcuaagaaggggaccagcgagccugugcuggauccccagcaaauccaggccuuugaccagcuguguagacucuaucggggauccagccgccuggcgcuucugacagaacucucucagaacagauccagcgagucuuaccggccuuucagcggcucccaaucugcccccgcuuucaauagcaucuuucagaacgagaacuuccagcugcaacugauuccgccucccgucaccgaagauuga

SEQ ID NO: 77808 - RNA, 1191 nt, Artificial Sequence
  derived and/or modified sequence opt5 from VRK1__Homo_sapiens__NP_003375
augcccagagugaaggccgcucaggccggccggcaaagcuccgcgaaacgccaccuggcugagcaguucgccgucggggaaaucauuaccgacauggccaagaaagaguggaagguuggacucccuaucggccaagggggauuuggcugcauuuaccuggcugauaugaacucuagcgaauccguggggucugacgccccguguguggucaaaguggagcccagcgauaauggaccucuuuucacagaacugaaguuuuaucagagagcugccaagcccgagcagauccagaaauggauucggacgcgcaagcucaaauaccugggcguuccuaaguauuggggcuccgggcuucaugacaaaaacggaaagucuuacagauucaugaucauggaucgguuuggcagcgaccugcagaagaucuaugaggcgaaugccaaacgcuucuccagaaagaccgugcuccagcugagccugcggauucucgauauccuggaauacauucacgagcaugaauauguccacggggacaucaaggcuucuaaccuucugcucaauuacaagaaccccgaucaaguguaccugguugacuauggacuugccuaccgcuauugcccugagggcgugcauaaagaguacaaggaagauccgaaaagaugucacgacgggacaauugaguuuaccuccaucgaugcucacaauggagucgcccccagccggcgcggcgaccuggaaauucucggcuauugcaugauccaguggcugacagggcaucugccuugggaggacaaccucaaggaucccaaguacgugagagacucuaaaauccgguaucgcgaaaauauugcgucccugauggauaaguguuucccugagaaaaacaagcccggagagaucgccaaauacauggaaaccgugaaacuucuggacuacacagagaagccgcucuaugaaaaucugagagauauucuucugcagggccucaaagcuaucgggagcaaggacgauggaaaacuggaccugucugucguugagaacggcgggcucaaggccaaaaccauuacgaagaagcggaaaaaggaaaucgaggaguccaaagaaccuggaguggaggauaccgaauggagcaauacacagaccgaggaagcuauccaaacaagaucccgcacccggaagagagugcagaaauga

SEQ ID NO: 77809 - RNA, 1527 nt, Artificial Sequence
  derived and/or modified sequence opt5 from VRK2__Homo_sapiens__NP_001123953
augcccccuaagagaaacgagaaauacaagcugccgauccccuucccugaaggcaaagugcucgacgauauggaggggaaucaguggguccugggaaagaaaauuggcagcgggggauuuggccuuaucuaucuggccuuccccaccaacaagccugaaaaggacgcucggcacguugugaaaguggaguaccaagaaaaugggccccucuuuuccgagcugaaguucuaucagcgcgucgccaaaaaggauugcauuaaaaaguggaucgagagaaagcagcuugacuaccugggcauuccucucuuuuauggaucuggccugacagaguucaaagggcggagcuaccgcuuuauggugauggaaagacugggaaucgaucuccagaagaucuccggccaaaacgggacguucaaaaagucuaccguucugcagcuuggcauucggaugcuggacgugcucgaauauauccaugagaaugaguacguccacggagauauuaaagcggcuaaccugcuucugggguacaagaauccggaccagguguaucucgccgauuacggacugagcuaucgcuacugucccaacggcaaucauaaacaguaucaagaaaacccuagaaagggccacaaugggacaaucgaguuuaccucccuggacgcccauaagggaguugcucucucucggcgcagcgauguggaaauucugggcuacugcaugcuuagauggcugugugggaaacuccccugggagcagaaccugaaggacccugucgccgugcagacagcuaaaaccaaucuucuggaugaacucccccaguccgugcugaagugggccccgagcggaucuuccugcugugagaucgcgcaauuccuggucugcgcccacagccucgcuuaugacgagaaaccuaacuaccaggcccugaagaagauucuuaauccccacggcaucccucuggggccccucgacuuuucuacaaaaggacaguccaucaacguucauacccccaacagccaaaagguggauucucagaaagcugccacgaaacaggugaauaaagcgcacaaccggcugauugaaaagaagguccauuccgagcgcagcgccgaauccugugcuaccuggaaagugcagaaggaggaaaaacuuaucggccugaugaauaacgaggccgcucaagagucuacaagacggcgccagaaguaccaggaaagccaggagccucucaaugaaguuaacuccuucccgcaaaagauuagcuauacccaguuucccaauucuuucuacgagccucaccaggacuucacaucccccgauaucuuuaaaaagagcagaucuccuagcugguauaaguacaccuccacggugucuacaggcauuaccgaccuggaaagcuccacagggcuguggcccaccaucagccaguucacccucucugaggagacaaacgccgaugucuauuacuaucggaucauuaucccggugcugcuuaugcugguuuuucucgcccuguucuuucuguga

SEQ ID NO: 77810 - RNA, 1623 nt, Artificial Sequence
  derived and/or modified sequence opt5 from VSIG10__Homo_sapiens__NP_061959
auggccgcuggcgggagcgcccccgagccuagagugcuggucugccucggagcgcugcuugcuggcuggguugccguggggcuggaagccguggucaucggagaggugcacgaaaacguuacccuccauuguggcaauauuuccgggcugcggggacaggugacaugguaccgcaacaauucugagccggucuuccuucugagcuccaacucuagccucagacccgcugaaccucgguuuucccugguggacgccacgucucugcacaucgagagccucucccugggcgaugagggcauuuauaccugccaagaaauccuuaauguuacacagugguuccagguguggcugcaggucgcuagcgggcccuaccaaauugaggugcauaucguggccaccggaacacucccuaacggcacccuguaugcggcccgcgggucucaggucgacuuuuccuguaauagcagcuccagacccccuccgguuguggaauggugguuccaggcucuuaacucuucuuccgagagcuuuggacacaaucugacagugaacuucuuuucccuccugcugaucucucccaaucuccagggcaacuauaccugccuggcccuuaaucaacugagcaagcggcaucgcaaagucacgaccgagcuccugguguacuacccucccccuuccgcuccccaguguugggcccagauggcgagcgggucuuucaugcuucagcugacaugcagaugggauggaggcuauccggacccugauuuucucuggauugaagaacccggcgggguuaucgugggaaaguccaaacugggcgucgaaaugcugagcgagucucaacucagcgacgggaagaaauucaagugugugaccucccacauuguuggaccugaaucuggcgccagcugcauggugcagauccgggggcccucccugcuuagcgagcccaugaagacauguuuuaccggaggcaacgucacgcugacaugccaggugucuggcgcuuacccuccggccaaaauucucuggcugcgcaaucuuacccaacccgaggucaucauucagccuuccagcagacaccugaucacacaggaugggcagaacucuacccucaccauccauaacuguucccaagaccuggaugaaggauacuauauuugccgggcugacagccccgugggcguucgcgagauggaaaucuggcuguccgugaaggagccucucaauauugggggaaucgucggcacaauugugucucugcuucugcucgggcuggccaucaucagcggccugcuucuccacuacucccccguuuucugcuggaaagugggaaacacgucuagaggccagaauauggaugacgucauggugcugguggauagcgaagaggaggaagaggaagaggaagaggaggaagaggacgccgcuguuggggaacaggagggagcgcgggagcgcgaggagcugccgaaggaaauuccuaaacaggaccauauccacagagucaccgcccucgugaacggcaauauugagcaaauggggaacggauuucaggaucugcaggacgauuccagcgaggaacagucugacaucgugcaagaggaagaucggcccgucuga

SEQ ID NO: 77811 - RNA, 1272 nt, Artificial Sequence
  derived and/or modified sequence opt5 from VSIG1__Homo_sapiens__NP_001164024
augguguucgccuuuuggaaggucuuccugauccucagcugccuggcuggccagguuuccguggugcaagucaccauucccgacggguuugugaacguuacagugggaucuaaugucacgcuuaucuguauuuacaccacaaccguggccagcagagagcagcuguccauccaguggucuuucuuucacaaaaaggaaauggagccuauuagccauuccucuugccucagcacagaaggcauggaggaaaaagcgguuucccagugucugaagaugacccacgcucgggaugcccgcgggagaugcagcuggacaucugagaucuauuucucccaaggaggccaggccguggcuaucgggcaguuuaaagaccggauuaccggaagcaacgauccgggcaaugccucuaucacgauuucccauaugcagcccgcugacagcggcaucuacauuugugaugucaacaauccucccgacuuccuugggcaaaaccagggaauccugaaugugucugugcucgucaagccuuccaagccccugugcagcguucagggccgcccugagaccgggcacacaauuucccugucuugucucagcgcccugggaaccccgucccccguguauuacuggcauaaacuugaaggcagagauaucgugccugucaaggagaacuuuaaucccacaaccgggauccuggugauuggaaaccucacgaauuucgaacagggcuauuaccaaugcacagcgaucaaccggcugggcaauagcucuugugagauugaccuuaccuccagccacccugagguugggaucauugugggagcccugaucggcucucucgucggggcugccaucauuaucagcgugguuugcuuugcucgcaacaaagccaaggcgaaagccaaggaaagaaauuccaagacaauugcugagcuggaacccaugaccaaaaucaacccgcggggagagucugaagccaugccucgcgaggaugcuacccagcuggaggugacacuccccagcuccauucacgaaacgggcccugacaccauccaggagcccgauuaugaacccaagccuacacaagagccggcccccgaaccugcccccgggagcgagccuauggcuguccccgaccuggauaucgagcuugaacuggagccggaaacccagucugagcucgaaccugagcccgagccugaacccgaguccgaaccuggaguggucguggagccccugagcgaggacgaaaaaggcguugugaaggcguga

SEQ ID NO: 77812 - RNA, 984 nt, Artificial Sequence
  derived and/or modified sequence opt5 from VSIG2__Homo_sapiens__NP_055127
auggccgagcugcccggcccuuuccucugcggggcucugcuuggauuucugugucucagcggccuggccguggaagucaagguuccgaccgagccccuuuccacaccucuggggaaaacggcggaacuuaccugcacauacucuaccagcgugggagacuccuucgcucuggaguggucuuuugugcagcccggcaagccuaucagcgaaucccaccccauucuguauuucacaaacgggcaucucuacccuaccggaucuaaaagcaagagagucucccugcuucaaaauccgcccacagugggcguugccacccugaaacucacggaugugcacccuagcgacaccggcacauaucugugucaggucaacaaucccccugauuuuuacaccaacgggcuuggacugaucaaucucacagugcugguucccccgucuaacccucugugcucccagagcggccagaccucugucgggggauccacggcccuccgguguucuagcuccgagggcgcucccaagccuguguauaauugggugcgccuggggacauuccccacccccagcccuggauccauggugcaagacgaggucucuggccagcuuauucugacaaaccucagccugaccuccagcggcaccuacagaugcguugccacaaaucagauggggucugcuuccugugaacuuacgcugagcgugaccgagccgucucagggacggguggccggcgcgcucaucgggguccugcugggagugcuccugcuuagcguugccgcuuuuugccuggugcgcuuccaaaaggaaagaggcaaaaagcccaaagagacauaugggggauccgaucuccgggaggacgccauugcuccuggcaucucugaacauaccuguaugcgcgccgauagcuccaagggcuuucuggagagacccagcucugcguccacagucaccacgacaaaaagcaagcucccuauggugguuuga

SEQ ID NO: 77813 - RNA, 918 nt, Artificial Sequence
  derived and/or modified sequence opt5 from VSIG4__Homo_sapiens__NP_001093901
augggcauccugcucgggcugcuucugcucggacaccugaccguggacacauacggcagacccauucuugaggucccugaaagcguuacggggccguggaagggagaugugaaccugcccugcaccuaugacccucuccagggcuacacacaagugcuggucaaauggcuggugcagcggggguccgaucccguuaccaucuuccuccgcgacucuagcggagaucauauucagcaggccaaguaucaaggcagacugcacgugucccauaaagucccuggcgacgugucucuucagcugagcacacucgagauggaugaccggucccacuacaccugugaaguuacauggcagacccccgaugggaaucaggugguccgcgacaagaucacggagcugagagugcaaaaacauucuagcaaacuucugaagaccaagacagaagcuccuaccacaaugaccuauccgcucaaggccacguccacagugaaacagagcugggauuggaccacagacauggauggauaccugggcgagaccucugcggggcccggaaagucccugccugucuuugcuauuauccucaucauuagccugugcuguaugguuguguucaccauggccuauaucaugcuuugccggaaaacaucucagcaggagcacguguacgaagccgcucgcgcccacgcuagagaggccaacgacuccggcgaaacgaugcgggucgcgauuuuugccagcggguguucuuccgacgagcccaccagccaaaaucugggaaacaauuacuccgaugagccuugcaucggccaggaauaucagauuaucgcucaaauuaacggcaauuacgcccgccuccuggacacagugccccuugauuaugaguuccuggcuaccgaagggaagucuguuuguuga

SEQ ID NO: 77814 - RNA, 576 nt, Artificial Sequence
  derived and/or modified sequence opt5 from VSNL1__Homo_sapiens__NP_003376
augggcaagcagaacagcaaacuggcccccgaggugauggaagaccucgucaaguccaccgaguucaaugaacacgagcugaaacaaugguacaagggguuucuuaaagauugcccuucuggaagacugaaccucgaagaguuccagcagcuguauguuaaguuuuucccguacggcgacgcuagcaaguuugcccagcaugcguuccggacauuugauaaaaauggggacggaacgaucgauuuccgcgaguuuauuugugcucuuuccaucaccucuagaggcagcuucgaacaaaagcugaacugggccuuuaauauguaugaccucgauggggacggaaaaauuacacggguggagaugcuggaaaucauugaggccaucuacaagauggugggcaccgucaucaugaugaaaaugaacgaggauggccugacacccgaacagcgcguggacaagauuuucuccaagauggauaaaaauaaggacgaucagaucacccucgacgaguuuaaagaagcugccaagucugacccuagcauuguucugcuucugcagugcgauauccaaaaauga

SEQ ID NO: 77815 - RNA, 447 nt, Artificial Sequence
  derived and/or modified sequence opt5 from VSTM1__Homo_sapiens__NP_001275720
augagaaagcggaugggccccacccgccugccuagacucgagugcagcggggccaucacagcucacuguucccuggaccuuccgggacccgauaaacaugacgaacuggaggccccuucuaugaagacggauacccggacaauuuucguggcgaucuuuagcugcauuuccauccuccugcuuuuccugucugucuuuauuaucuaccgcuguagccagcacuccucuagcuccgaagagagcaccaaaagaacaucucauuccaagcuccccgaacaagaggcugccgaggccgaccugagcaacauggaacggguuucucuguccaccgcugauccucagggcgugacauaugccgagcucagcaccucugcucuguccgaagccgcgagcgacacgacccaggagcccccugggucccacgaguacgccgcucuuaaaguguga

SEQ ID NO: 77816 - RNA, 711 nt, Artificial Sequence
  derived and/or modified sequence opt5 from VSX1__Homo_sapiens__NP_001243200
augaccggcagagacagccuguccgaugggcggacaucuagccgcgcccucgugcccggaggcuccccuagagggucucggccgcgcggauucgcuaucacggaccugcuuggccuggaggccgaacuccccgcgccugcugggcccggacagggcagcggcugcgaggggccugccgucgcccccuguccuggaccgggccuggauggguccucucuugcuagaggagcccugccccucggccuggggcugcucugcggauuuggcacccaaccucccgcugccgcgcgggccccuugucugcuucuggcugacguucccuuccucccgccucgcggccccgaaccugccgcuccccuggcccccagcagaccuccgcccgcgcuugggcggcagaagcgcuccgauagcgugucuacauccgacgaggauagccagucugaagacagaaacgaucugaaggccuccccuacccucggaaagcggaaaaagcgcagacaccggacaguguuuaccgcucaucagcuggaggagcuggaaaaagccuucagcgaggcucacuaccccgacgucuaugcccgcgaaaugcucgccgugaagacagagcugccugaggaucggauucaaugcaaacuucugcuccuggaagcucccguucauuggacccuucaggagacgcacagacugccgagaccucgcggcggggcguga

SEQ ID NO: 77817 - RNA, 1086 nt, Artificial Sequence
  derived and/or modified sequence opt5 from VSX2__Homo_sapiens__NP_878314
augaccggcaaggccggggaggcucugagcaaacccaaguccgaaacaguggccaaaucuacgagcggaggcgcgccugcuagaugcaccggguucggaauccaggagauucucggccugaacaaggaaccgcccuccucucacccucgggccgcccuugacgggcuggcucccggacaucuccuggccgcucgcagcguccuuuccccugccggcguuggcgggaugggacugcucggccccgggggacugccuggcuuuuacacacaaccgaccuuccuggaggugcucucugauccccagagcgugcaucugcagccucuugggagagcguccggaccccuggacacaagccagaccgccucuuccgauagcgaagacgucucuuccagcgaucggaaaaugucuaaguccgcucucaaucaaacaaagaaacgcaagaaaagacggcaccgcaccaucuuuacgagcuaucagcuggaggagcuugaaaaggccuucaacgaggcucacuacccugacguguaugccagagaaaugcuggcgaugaaaaccgagcuccccgaggaucggauucagguuugguuucagaaucgcagagccaaguggcggaagcgcgaaaaauguuggggcagauccucugugauggcugaguacggccuguauggggccaugguccggcauagcaucccgcugccugaauccauucucaagagcgcuaaagacggaaucauggauucuugcgcccccuggcugcuuggcaugcacaagaaaucccuggaggccgcugcggaaagcgggcgcaagccugagggagagagacaagcccuccccaaacuggacaagauggaacaggaugagcggggccccgacgcucaggccgccaucucucaggaggaacuuagagaaaacagcauugcugugcugcgcgccaaggcgcaagagcacuccacaaaaguucucgggaccgugucuggaccugauagccuggcucgguccacagagaagccggaagaggaagaggccauggacgaagacagacccgccgagcgccugagcccuccccagcucgaggauauggcuuga

SEQ ID NO: 77818 - RNA, 843 nt, Artificial Sequence
  derived and/or modified sequence opt5 from VTA1__Homo_sapiens__NP_001273300
auggccgcucuggcgccccucccuccgcugcccgcccaguucaagagcauccaacaccaucuuagaaccgcucaggagcacgacaaacgggauccuguggucgccuacuauugccgccuguacgccaugcagacaggcaugaagauugacuccaaaacgcccgaauguagaaaguuucucucuaaacugauggaucagcuugaggcucugaagaagcaacucggggacaacgaagccaucacccaggagauuguuggaugcgcucaucuggaaaauuaugcccugaaaauguuccucuacgcggauaacgaggaccgggccggccgcuuucacaagaauaugaucaagagcuucuauacagcuucccugcuuauugaugugaucaccguguuuggggagcugacagacgaaaacgucaaacauagaaaauacgcccgguggaaggcuaccuauauccacaauugucucaagaacggagagacaccucaggccggccccguggggauugaagaggauaaugacaucgaggaaaacgaggaugcgggagccgcuucucugccuacccagccgacgcaacccagcuccucuagcaccuacgacccuuccaauaugcccagcggcaacuacacaggcauucagaucccucccggggcccacgcuccggccaauaccccugccgaaguuccccauucuacaggagaugugcgccuuaccccugaggacuucgcuagagcgcagaaauauugcaaguacgccggcuccgcucugcaguaugaagacgucagcacggccgugcaaaaccuccagaaagcccugaagcugcucacaaccgggcgggaguga

SEQ ID NO: 77819 - RNA, 900 nt, Artificial Sequence
  derived and/or modified sequence opt5 from VTCN1__Homo_sapiens__XP_011540445
augggcagcgugaugcugcucaaggaguccugcgggaacgucuucuuuucugccguuagaauccggcgcagcagaaaacacuccauuaucucuauuaucauuauccuggcuggagccaucgcgcuuauuaucggcuucgggauuagcggacggcauuccaucaccgugacaacgguggcuucugccggcaauauuggggaagacggaauccugagcuguaccuuugagcccgauauuaagcucuccgacaucgucauccaguggcugaaagaaggcgugcuuggccugguucacgaguucaaggaagggaaagaugagcucagcgagcaagacgaaauguuucgcggaagaacagccguguucgcugaucaggucauugugggcaacgccucucugcggcugaagaauguucagcucaccgacgcugggacauacaagugcuauaucauuaccuccaaaggaaagggcaacgccaaucuggaguacaaaacaggggcguuuagcaugccugaagugaacgucgauuauaaugccucuuccgagacccuucgcugugaggcuccgagaugguucccccagccuacgguggugugggccagccaagucgaccagggagcuaacuuuucugaaguuuccaauaccagcuucgagcugaacuccgaaaaugugacaaugaagguggucucugugcucuacaacguuaccaucaauaacacauauagcugcaugauugagaaugauaucgccaaagcgaccggcgacaucaaggugacggaauccgagauuaagcggcgcagccaucugcagcuucugaacucuaaagccucccucugugucagcagcuuuuucgcuaucucuugggcccugcugccccucuccccuuaccugaugcuuaaguga

SEQ ID NO: 77820 - RNA, 654 nt, Artificial Sequence
  derived and/or modified sequence opt5 from VTI1A__Homo_sapiens__NP_660207
augagcuccgacuucgagggcuacgaacaggauuuugccgugcugaccgcugagaucacaucuaagauugccagagucccccggcucccuccggacgagaaaaagcaaaugguugcgaacguggaaaaacagcuggaagaggcuaaggagcuucuggaacagauggaucucgaggugcgcgaaauucccccucagagcagagggauguauuccaaucggaugcgcucuuacaaacaagagaugggaaagcuggagacggacuucaagagaagccggaucgccuauuccgaugaaguccgcaacgagcuucugggcgacgauggaaauucuagcgaaaaccagagagcccaccuccuggacaauaccgagcggcuggaacgcuccagcagacggcucgaggcuggguaccagaucgccguggagacagaacagauuggccaagagaugcuggaaaaccuuucucaugaucgcgagaaaauccagagagcucgggaacgccugagagagaccgacgccaaucucgggaaguccagccggauccugacaggaaugcuuagacgcauuauccagaaccggauucugcucguuauccugggcauuaucguggucauuaccauccugauggcgaucacauuuucugugagacgccacuga

SEQ ID NO: 77821 - RNA, 699 nt, Artificial Sequence
  derived and/or modified sequence opt5 from VTI1B__Homo_sapiens__NP_006361
auggccagcuccgcugccucuagcgagcacuucgaaaagcugcaugagaucuuuagaggccuccacgaagaccugcagggggugcccgagcggcuucugggaaccgcgggcacagaagagaaaaagaaacucauucgcgauuucgacgagaagcaacaggaagcuaacgagacgcuggccgaaauggaggaggaacuuagauacgccccucuguccuuucggaauccgaugaugucuaaacuccgcaacuauagaaaggaucuggcuaagcugcaucgggagguccgcagcacaccccucaccgccaccccugggggaagaggcgacaugaaauacgggaucuaugcuguugaaaaugagcacaugaaccggcugcagucccagcgcgccaugcuucugcaaggaacagaaucucucaauagagcgacccagagcauugagcggucccaucgcaucgccacagagaccgaucagauuggcagcgaaaucaucgaggaacugggcgagcagagagaccaacuugaacggacgaagucucgccuggugaacaccuccgagaaucucagcaaaucuagaaagauucugcgguccaugagcagaaaagugacaaccaacaagcugcuccugucuaucauuauccuucuggagcucgcuauucuugggggacuggucuacuauaaguucuuucgcucccacuga

SEQ ID NO: 77822 - RNA, 1437 nt, Artificial Sequence
  derived and/or modified sequence opt5 from VTN__Homo_sapiens__NP_000629
auggcuccccugagaccucuccugauccuugcccugcucgccuggguggcgcuggcugaccaggagagcugcaagggccgguguaccgaaggguucaacgucgauaaaaagugccaaugugacgagcuuugcuccuacuaucagucuuguugcacagauuacacggccgaauguaaaccgcagguuacccgcggagacguguuuacaaugcccgaggaugaauauaccguguacgacgauggcgaggagaagaauaacgccacaguccacgaacaggugggcggaccuagccugaccuccgaccuccaagcucagucuaaaggcaaucccgagcagacaccuguucugaagcccgaagaggaggccccugcuccggaagugggggccagcaagcccgagggaauugauuccagaccugaaacccugcaucccggccggccucagcccccggcggaggaggaacucugcucuggcaaaccuuucgacgccuuuacggaucugaagaacgggagccuuuucgcuuuucgcggacaauauuguuacgagcuggacgaaaaagccgucagacccggcuauccuaagcucauccgggaugugugggggauugagggacccaucgacgcugccuucacccgcauuaauugccagggcaaaacauaccuguuuaaggggucccaguacuggagauucgaagacggaguucuugaucccgacuauccucggaacaucagcgauggcuuugacggcaucccggauaauguggacgcggcccuggcucuccccgcccacucuuacuccgggcgcgagagagucuauuucuuuaagggaaaacaguacugggaauaucaauuccagcaucagccuagccaagaggagugugaagggucuucccugagcgcuguguuugagcacuucgccaugaugcagcgggauucuugggaagacauuuucgagcugcucuuuugggggcgcaccuccgccggaacaagacagccccaguucaucagccgggauuggcauggcgugccugggcaagucgacgcugcgauggccggacgcauuuacaucuccggcauggcucccagaccgucucuggccaagaaacagcgguuuagacaccgcaaccggaagggcuauagaagccagcgcgggcacucccggggaagaaaucagaacagccgccggccuucuagagccaccuggcuuucccuguucagcucugaagagagcaaucucggcgcuaacaauuacgaugacuaccgcauggacuggcugguucccgccacgugcgagccuauucaauccguguuuuucuuuucuggggauaaauauuaccgggugaaccuuagaacacgccgggucgacaccguggaucccccuuaucccagaagcaucgcgcaguacuggcugggaugcccggcuccuggccaucucuga

SEQ ID NO: 77823 - RNA, 2268 nt, Artificial Sequence
  derived and/or modified sequence opt5 from VWA2__Homo_sapiens__NP_001258975
augcccccuuuccugcuccuggaggccgugugcgucuuucuuuucagcagaguuccgcccucccugccucuccaggaagugcacgugucuaaggagaccaucggcaaaauuagcgcugccuccaagaugaugugguguucugcggcugucgacaucauguuucugcuugaugggagcaacuccgugggaaaaggcucuuucgaacggagcaagcauuuugccauuacaguuugcgacgggcuggauaucucccccgagcgcgugagagucggagccuuccaauuuagcucuacgccucaccucgaguucccccuggacuccuuuagcacccagcaggaggugaaagcucggauuaagcgcaugguuuucaagggcgggagaacagagaccgaacuggcccucaaauaccugcuucaucggggacugccuggcggccgcaaugcuucugugccgcagauccucaucauugucacagaugggaagucccaaggagacguggcccugcccagcaaacagcuuaaggagagaggcgugaccgucuuugcgguuggggugcgguucccucgcugggaagaacugcacgcccucgcuucugagcccagaggacagcaugugcugcuggccgaacaggucgaggaugcuacaaacggccucuuuuccacccugagcuccucugccaucuguagcuccgcgacgccugacugccggguggaagcccaccccugugagcaccgcacccuugaaaugguuagagaguucgcugggaaugccccgugcuggcggggaagccgcagaacacuggcugugcucgccgcccauuguccuuucuauucuuggaaacgggucuuucugacccaccccgcuacaugcuacagaaccacguguccuggccccugcgauucccaacccugucagaacggcgggacaugcgugccugagggacuugacggcuaucagugccuguguccgcucgcguucgggggagaagccaauugcgcucugaagcugagccucgagugucgcguugaucugcuuuuucugcucgacucuagcgccggcaccacacuggauggguuccuucgggccaagguguuugucaaaagauucgugcgcgcuguccuguccgaagacucucgggccagagugggaguugcgaccuacagccgcgagcuccugguggcuguccccgugggcgaauaucaggacguuccugaucugguguggucccucgacggcauucccuuuagagggggaccuacccugacaggcagcgcccuucggcaagccgcugagcgcggguucggaucugccacgcggaccggccaggauagaccccgccgggucguggugcugcucacagagucccauagcgaagacgagguugcugggccggccagacacgcgcgggcccgcgaacugcugcuucucggcgucggaucugaggcugugagagccgaacuggaggagaucaccggcuccccuaagcacgugauggucuacagcgauccccaggaccuguuuaaccaaauuccugaacuccaggggaaacugugcucccggcagagacccggaugucgcacacaggcucuugaucugguguucaugcucgacaccucugccagcguuggcccugagaauuuugcgcaaaugcaguccuucgugcggucuugcgcccugcaguuugaagucaaccccgaugugacgcagguugggcugguggucuauggaagccaagugcagacagcuuucggccuugacaccaagccgaccagagccgcuaugcuccgcgccaucucccaggccccuuaccucgggggcguuggaagcgcuggcacagcgcugcugcauauuuacgauaaagugaugaccguccagagaggggcccggcccggagugcccaaggcuguggucguucugacaggcgggcgcggagccgaggacgccgcugugccugcccaaaaacuuagaaauaacggcaucucugugcuggucguggggguuggcccggugcucuccgagggacugcggcgccuggcgggccccagagacagccuuauccacgucgcugccuaugccgaucuccgguaccaucaggacgugcugauugaauggcuguguggggaggcuaagcagccuguuaaucucugcaagcccucuccuuguaugaacgaaggauccugcgugcugcagaauggcagcuaucgcuguaaaugcagagaugggugggagggaccccacugcgaaaaccgguuccuucgcagaccuuga

SEQ ID NO: 77824 - RNA, 3555 nt, Artificial Sequence
  derived and/or modified sequence opt5 from VWA3A__Homo_sapiens__NP_775886
augaagaaauacagaaagaucagcauuggcugcuucgccauggcuacccagacaucccacguguuucaugggcaagagaacauguuccuggaaaaucacuguauccggcgcaacacgggaagagacucuaaaaagccccucaaacagaagaauaugaacggccuggggcagaauagcgauaacggacuucuggucacccauguuaaucagacacaagaccuccugcggcuucagggcuccgagacccagucuagcgauugggaagacuccgaggauuggcugucugcccacagccucaagugccagaaacugacacuggcggaccucauuucccaagggaccgaagugcuggaggagggaacaaacgugguccagaagaucuguuuuagcacccagauuauccgccauuucgaaucuaaacuuuccgauacgaucgagguguaucaggaacggauucaauggcugaccgagaauagcaagaaggcuuuuggccucaucaagggcgccagaguuucuauucugaucgacguguccgccauuagcucugggccucagaaggaggaguuccagaaagaucuuaugucccugaucgacgaacaacucagccacaaggaaaaacuguuuguccuguccuucggaacaaacgcuggcucucucuggccggaucccauggaggugagcgccuccacccugcaggaacuuaagcuguggguuaaaacacuccagccugacgggggaagcaaucugcuucaggcucugaagaaaauuuuuacccucaagggccuggauucucugguggccaucaugcgcuccugccccgaccaaccuagcgagauccucucugacuacauucagcagagcacgauggggagagaucugaucauucacuucaucacauaucggugugacgaucagaugcccccugcgguccuuaagaaccuggccgaggcugugcgcggauacuaucauugcuacuccccgaaaauggaacacuauaccucuagagacauggaugagcuccuggccgaaauucaaaaggcucagagccuucugucccaugugcaggcccuccagcacagcucucccugugaggcgcugacaugcaccauggaagagaucuccaccgagaucacaaauggcccucugauuagccuccugcccaaaccucccaagcacgacgccccgcuuacgaucgaauuuccuaaccuggauaaaaccucugcugaguggcucaaggucaauggccugaaggccaaaaagcugucccuuuaccaaguucucgcucccaacgccuucagcccuguggaagaguuugugcccauucugcagaaaacagucuccucuaccauccaugaaaaggccaugauucaguucgaguggcacgacgggacagugaaaaacauccauguugaucccccuuuccuguacaaguaucagcaacagcucagccgggcuaugcgcauguacgagagacggaucgaauggcugucccuugcgucucgcagaauuuggggaaccgugugugagaagcgggucgugguucugcucgacaucagcgccaccaauuccauguauauuauccacauucagcauagccugagacugcuucucgaggaacaacugucuaacaaagauugcuuuaaucugaucgcuuucggcuccacaauugagagcuggcgcccggaaauggugcccgucucucacaacaaucuccaguccgccuggcggugggcccugaaccuuagaugucgcgggagccggaaugugcugucugcucucagaaaggccgucgagguggacuuuaaagacaaggauaaacaccagagccagggaaucuaccuguucaccggcgggaucccugaccaagauaugcccacccuguccgcguauauggcugaagccugcggaggcugcgaccuucagcucaacguuugucuguuuuacgugggcgagccuaagauggauacaacgcccccggcccgcuaugcuagccauacagacacggccgcugccuacaaggaagucacccgggcggccgggggaagauuccacugguuuggcgauacagggauuuacgagucugacgauaucaauuccauuaugagcgagauggaaaaagcucugaacuauucccagaagugcgccuuccucauggcuucucugaaaaaucauagcggaaaggugcuuggcuccucugcccugccuaaagagaagcccaaaacccuccagcugcgcagccaaccuaagaagcugugucccccucggcccacaguuccgcuuggggcgagaauguccaucaaagacgauccugaccgcgaaaagucuccuccccucaaaagccugaaguggcggccccuguccagcagagugggcauuucuccggccgcugcccagcccaccaaagagggaaugauggaacuccggcgcaagacgaaguccagagaggcugagaccagccugcuucuguuuuacacagaaaaaggcaacgaugucgggucuguguauaagaaauacccucagggacggggccucagacgcaccuccagcucuaucgaccugccccggaaggacacagugugcuccagccaggaguggguugccaaauaugggcugaagaaacuuaaacuggaaaucuccagauguaugggaccuaauugcacccaccaaaagagcggccagcgcucugccagcgcuaaacacuguuccauuuuccccucugucgagauccaugggguggugagacacauucaguggacgccucgggaaauggaggucuacauccgccaucucgagaaggugcugagacgguauguucaacgccuccaguggcugcuuagcggcuccagacggcuguuuggaacagugcucgaaucuaaagucugcauucugcuggauaccagcggcuccauggggcccuaccuucaacaggugaagacagagcugguucuccugaucugggaacagcuccgcaaguguugcgacucuuucaaccugcuuagcuuugcggaguccuuccagagcuggcaggauacccugguggagaccacagacgccgcuugucacgaagccaugcagugggucacgcaucuccaagcccagggaucuaccuccauccugcaggcucugcuuaaagccuucagcuuucacgaucuggagggccucuaccugcucacagacgggaagccggauaccucuugcucccuggugcuuaaugaaguucagaaacugagagagaagcgggacgugaaaguccacacaauuagccugaacugcuccgaucgcgcggcuguggaguuccucagaaagcuggccucuuuuaccggaggccgguaucauuguccugugggggaagacacgcuuagcaaaauccacucccugcucacaaagggcuucauuaacgagaaggaucccacccugccucccuuugaaggagacgaucucagaauccuggcccaagagauuaccaaagcucgcagcuuccuuuggcaggcccagucuuuucggucccagcugcaaaagaaaaaugacgcggaaccgaaggucacacugagcuga

SEQ ID NO: 77825 - RNA, 3885 nt, Artificial Sequence
  derived and/or modified sequence opt5 from VWA3B__Homo_sapiens__NP_659429
auggagaaaagcggccccuccucuaccaucagcgaacagcaacugcagagacaggagggguggauuaacacaaaaacggaccucgccgaacagucccugaucucuagcgagaaguggcuucaacugcacggacucaaauccaauaagcugacccuuaaacagauucugucucagaucggcuucccucauugcgaagauuacguggcuagccucgggcggccggucgccucccgcuaugcggacggacuguuuccccagcuguacagagcugaggauggccggguuuauaaccucacagccaagagcgagcugauuuaccaauucguggaacaccuuacccaggccguggagucuuauaagcagcgcauggacuggcugacauccaaaagcagacagaucuuuggggucauccucgaacaaugugugaccauuguucuggauuucggaggcauccuugagggcgagcuggaccucugccgggaagcucugacaauggugcugcaggagcaggucgcccauauuaccgaauuuaauaucauucgcgugucucaagagccuguuaaguggcaggaaaacgcuacgcccgugaccgagcaguccaucgccacagcgauuagcugggucgagaaacucaccguggaacugacagugucugaggccgggagacuugaugcucugcucgaagccggacgggacaagaccaucgaguccaucuacuauuucgucguuggcgaugugccugaagagagcaaagagcugcuucugcagcgcgcucucgaaauucccuguccuguguacacggucuccuuuaaugccagaggggagggaacaaucgcguuccugaaggaccugucugccaagacccacagccgguuucaugcuuucgccgaacgcacagagugcguggaauuuccggcuuucuccaccaaagauggcgacaacguuaugaccuggaauagcagaaagcucaaagggaagcugcccccuggagccggcgugcgggaggaugucuuucuuguguggcaagagauggaagaggccuguucuacacuggcucagauucagcgccucguugcggaacccccuaaacccgacguggccacggucgacugcgaguccgagaccacaagcguggaaaucgcuucuaacccggaggauaccugggacagcaagacauggcugcagaaauacggccuuaaggcccaaaagcugucccucuaugauguccuggccgacuguucuuucagacacgcugauggggugguugacauuaaagccaagccugaaaaugagagcgugcagaccuccgcggaaacgaacaaaaagacaguccacgcuaaauacugcagccgguucgugcaugcccccuggaaggauggaucucugguucacgugaauaucaccaaggagaaauguaagugguauuccgagagaauccauaccgcccucgcucgcauucggagacgcaucaaauggcugcaggacggcagccagucucuuuuugggcggcugcacaacgauugcauuuacauccucauugacacaucccacagcaugaaguccaaacuggaucuggucaaggacaagaucauccaauucauucaggaacagcuuaaauauaagucuaaauuuaauuucgugaaguuugacggacaggccguggcuuggagagagcaacucgccgaaguuaacgaggauaaucuggaacaggcgcagagcuggauccgcgacauuaaaaucggcuccucuaccaacacacugagcgcccucaagacggcuuucgccgauaaggagacccaagcuauuuaccugcuuacagacgggcggccugaucagccucccgagaccgucaucgaccaggugaaaagauuucaggaaauucccaucuauacaaucuccuucaacuacaaugaugagauugccaaccgcuuucugaaggaaguggcggcccucaccggaggcgaguuccauuuuuacaauuucggcuguaaagacccgacgcccccugaagcuguccaaaacgaggaucugacccugcuugugaaggagauggaacaggggcacagcgaccucgagaaaaugcaggaucuguauucugaaucccugaucauggacuggugguacaaugccgagaaggauggagacagcaaacaucagaaggagauuugcucuaugaucuccacacccgaaaagugcgcuaaaccucaaagcgacguugauucuacccagacaagcucccucaacaugcugaagggccccugggggcuuagcgaccagaaagugcagaagaaaaagguccugcacgccgagucuaccaagacgucccuccugcggagccaaauguccucucugagaagcuccgccuguucugaacgcaaagauggacuuagcaaugcuuccucucggagaacagcgcucagcgacaaggagauguccauucugcuggccgaagaguggcucgaugacaaaagcucugagaaggugacccgggaaggcucccagguuuaugaucaugacagcucugauguguccagcgagaacuggcugaaaacauacgggcuugucgcuaagaagcugacccucauggacgcccugucuguggccgcuguuccgcacuccagcaccuaugugccuguccuggauaaacacgugguguccaaggucuuugacgaaguuuucccccuugcccaugugugcaaugauacaaacaaaaugacgcucaucaauccucagggcgcgaagcugaacaucuacaaacgcaagguggagcaagcuauucagagcuaugaaaagagacugaauaaaaucgucuggcgggcccucucucaggaggagaaggaaaaacuggacgccaacaagcccauucaguaccuugagaauaaaaccgugcugaaccaagcucucgaaagacugaacuggccuaucagccugaaggagcuuuccaugcuggaaucugagauucucgccggaaaaauguacauccagcaggcgauggagcugcaggaagcugccaagaagaauuaugccaacaaagcucccggcgagcaacagaagcuccaggggaauccgacaaagaagaccaaaagcaagcgcccugacccccugaagggacagaaaguuaucgcccggugugaugaaaacggcuucuacuuucccgggguggucaagaaaugcguguccagaacacaagcucuuguuggauucucuuauggcgacaccaagguggucagcacguccuuuauuacaccuguugggggcgccaugccguguccccugcuccaggugggagauuacguguucgcgaaaaucgucauuccuaagggcuuugacuucuaugugcccgccaucgugauugcucugccuaauaagcacgucgccaccgagaaauuuuacaccguucugaagugcaacaaucgcagagaguucuguccccggucugcucuuaucaaaaucagccagaacaaguaugcccuguccugcagccauauuaaaucuccucccaucccggaagauccugagguggaagacguggaggcccgcaauuccgcuuuucucuucuggccccugaaggaagcggauacacaggacagcagagagccucggcgcgagaagcccagacggaaaaagcgcccggccaaacaaccucuccagcaggcugcccccucugauuccgacgggagcucccacggaauuucuagccacggcuccugucaagggacccauccugaacccagaacagcccaucugcacuuucccgcugccggacggcuuggccugagcucucacgcgaucauugcuacgccuccgccccgcgccgcccucccuugcacccugcaggcuacacauuccagcaaggggcugagaucuguccccgagacccuuuga

SEQ ID NO: 77826 - RNA, 2361 nt, Artificial Sequence
  derived and/or modified sequence opt5 from VWA5A__Homo_sapiens__NP_055437
auggugcacuucugcggccugcucacccugcauagagagcccgucccucuuaagagcaucuccguuucugugaacauuuacgaauuuguggccggggucagcgcuacacugaauuaugagaacgaagagaaagugccgcucgaagccuucuuuguuuuccccauggacgaggauuccgcgguguacucuuuugaggcucuggucgacggaaagaaaaucguggccgaacuucaggauaagaugaaagcccggacgaauuaugagaaggcuauuagccaaggccaccaggccuuccugcucgaaggggacuccucuagccgcgauguguuuuccuguaacguuggaaaucugcagccuggcagcaaggcugccgucacccugaaauacgugcaggagcucccccuggaggcggacggggcccuuagauucgugcugccugcuguccucaacccccgguaucaauuuucuggauccagcaaggauucuugccugaauguuaaaacaccuaucgugccgguggaagaccuucccuacacccuguccauggucgccacaauugauagccagcauggcaucgagaaggugcagucuaacuguccucucucccccaccgaauaucugggcgaggacaaaacaagcgcucagguuucccuggccgcggggcacaaguucgaucgcgacguggaacuccugaucuacuacaaugagguccauaccccuucugugguucuugagaugggaaugcccaacaugaagccgggccaccugaugggggauccuagcgccaugguguccuuuuaucccaauauuccugaagaccaacccagcaacacgugcggagaguucaucuuucucauggacagaucuggcuccaugcagagccccaugucuagccaggauaccucccagcugcggauucaagcugccaaagaaacacuuauccugcuccugaagucucugccuauuggguguuacuucaauaucuauggauucggcagcuccuacgaggcuugcuuuccggaaagcgucaaauauacccagcagacaauggaggaggcccucggccgcgugaagcugaugcaagccgaccuugggggaaccgaaauucuggcuccccuccagaacaucuacagaggcccuucuauccccgggcacccucugcagcuuuucgucuuuacggauggagaggugacagacaccuucuccguuauuaaagaagugcggaucaaucgccagaagcauagauguuuuagcuucggcauuggggagggaacaucuaccucccugaucaaaggcauugcgcgggccagcggcgggaccuccgaauuuaucacaggaaaggaucgcaugcaaucuaaggcucucagaacgcugaaacggagccugcagcccgucguggaggacguuucccucucuuggcaucugccgccuggccuuagcgccaagaugcugucccccgagcagaccgugaucuuccgcgggcagagacucauuagcuaugcccaacugacaggacggaugccugcugccgaaaccacaggcgaggucugccugaaauacacccuucaggggaagacguuugaagauaaagugacauucccccuccagccuaagcccgacgugaaccugaccauccacagacuggcggcuaagucucuccugcagaccaaagauaugggccuucgcgagacaccggccuccgacaagaaagaugcccugaaccucagccuggagucuggaguuauuuccagcuuuaccgcuuucaucgccauuaauaaggaacugaacaaaccuguccaaggcccccuugcucaccgggacgugcccagaccuauccuccugggggccucugcgccgcugaagaucaagugucagagcggauuucgcaaagcccuccacuccgaccggcccccuagcgcuucucagcccagaggcgagcugaugugcuacaaggccaaaacauuccagauggaugacuauucccuuugugggcugauuagccauaaggaucaacacuccccuggauucggcgaaaaucaucucgugcagcugaucuaccaccagaacgcuaaugggucuugggaccugaacgaggaucuugccaaaauucucggcaugagccuggaagagaucauggcggcccaacccgcugagcuggucgacuccucuggaugggccacgauucucgcugugaucuggcugcauagcaauggcaaggaucuuaagugcgaaugggagcugcucgaacgcaaagccguugccuggaugcgggcucacgcgggguccaccaugccuucuguggucaaggccgcuauuacauuucugaaaagcuccguggaccccgccaucuucgccuuuuga

SEQ ID NO: 77827 - RNA, 3648 nt, Artificial Sequence
  derived and/or modified sequence opt5 from VWA5B1__Homo_sapiens__XP_011538989
augcccggccugcucaacuggaucaccggggccgcucugccucuuacagccagcgacgugacguccugcgucucuggauacgcgcugggccucaccgcuagccugacauaugggaaucuugaggcccagccguuccaaggacuguuuguuuacccccucgaugaauguaccacagugauuggcuucgaggccgugaucgcugacagagucgugaccguucagauuaaggauaaagccaagcuggaauccgggcacuuugacgcuucucaugugcggagcccuacagucaccggaaacauccugcaggauggcguguccauugcgccccacucuugcacgccuggcaaaguuacccucgacgaggaucuggaacgcauccuuuucguggcgaaucuggggacaaucgcccccauggagaacgucaccauuuuuaucagcacauccagcgagcucccuacccugccgucuggagcugugagagugcuucugcccgccgucugugcuccuacgguuccccaguucugcacaaaguccaccggcacaagcaaucaacaggcccaggggaaagaccggcauuguuuuggagcgugggccccuggcucuuggaacaagcucugccuggcuacccugcucaauaccgaaguguccaaccccauggaguaugaguucaauuuucagcuggaaauucgcgggccgugucuucuggccggaguggagagcccuacacacgaaaucagagcugaugccgcccccucugcucgguccgccaagagcauuaucauuacgcucgccaacaaacauaccuucgaccgcccugucgagauccugauccaccccuccgaaccccacaugccucaugugcuuauugagaagggcgauaugacacugggcgaauuugaccaacaccucaaagggagaaccgauuucaucaagggaaugaaaaagaagucucgggcugagcgcaaaacagagauuaucagaaagcggcugcauaaagacauuccgcaccacagcguuaucaugcugaauuuuugccccgaccuccaguccgugcagccuugucugcgcaaggcccauggcgaguucaucuuccuuauugauagauccucuuccaugagcgggaucucuaugcaccgggucaaagacgccaugcugguggcucucaagagccugaugcccgccugccuuuuuaacauuaucggauucggcuccaccuuuaaaucucuguucccuagcucccagacguacagcgaagauucucucgcgauggcuugugacgauauucaacgcaugaaggccgacaugggagggacaaauauccugagcccccugaaguggguuaucagacagccggugcaucggggccacccuagacuccuguuugucauuaccgauggcgccgugaacaauaccgggaaaguccuugaacuggugcgcaaccaugcuuucagcacacggugcuauucuuuuggaaucggccccaacguuugccacagacucgugaaggggcuggccuccgucagcgagggauccgcugaacugcuuauggagggcgagcgccuccagccuaaaauggugaagucucugaaaaaggccauggcgcccguucugagcgacgugaccgucgaauggauuuucccugagacaacggaagugcucgugucccccguuucugccagcucccuguuuccgggggagcggcuugucggcuacggaaucgugugugaugcuagccugcacauuucuaauccuagauccgacaagcgccggagauauagcaugcuccauucucaagaauccggcagcucuguguucuaccacagccaggaugacgggcccggacuggagggcggggacugcgccaaaaacuccggagcucccuuuauccugggccaggccaagaaugcgcgccuugccagcggggauucuaccacaaaacaugaccucaaccugucccagcggagacgcgcuuacagcaccaaucaaauuacaaaccacaagccucugccgcgggccaccauggcuuccgaucccaugccugccgccaaaagauauccccuccggaaggcucgccugcaggaccuuacgaaucagaccucucuggauguccagagauggcaaaucgaccuccagccucugcugaacagcggccaggaucuuaaucagggacccaagcuccggggcccuggggcgagacgccccucccugcugccgcaaggaugucagccuuuccuccccuggggccaggagacacaggccuggucuccugugcgggaaagaaccagcgacucccgcucucccggggaucuggagccgagccaccauccuuccgcuuuugaaacagagaccagcucugacugggaucccccugccgagucccaagaaagagccagccccucucggcccgcuacgccugccccgguucuuggaaaagcgcuggugaagggccuccacgacucccagcgccugcagugggaggucagcuucgaacuggggacacccggcccugagagaggaggcgcucaagaugccgaccuuuggucugaaaccuuccaucaccucgccgcucgggccaucauucgcgacuuugagcagcuggcggagagagaaggggagaucgaacagggauccaaccggcgcuaccaggugagcgcucugcauacauccaaagccugcaauauuaucagcaaguauaccgccuucguucccguggaugucucuaaaagcagauaccucccuaccgugguugaguaucccaacuccggcgcugcccugcggaugcuugggucucgcgcucuggcccaacaguggagaggaacaagcuccggcuuugggcggccucagacgaugcucggcgaagacucugcgccgggaaaugauauggaggccagccccaccgcucuguucuccgaggccagaucuccuggccgcgaaaagcacggggcuagcgagggaccccagcggucccuggccacaaacacccuuagcucuaugaaggccuccgaaaaucuguuuggcagcuggcucaaccugaacaaaucuagacuccugacacgcgcugcgaagggguuccuuuccaaaccucugauuaaggccguggagagcaccuccggaaaucaaucuuuugacuacaucccccucgucagccugcagcuggcuuccggcgccuuccuucugaacgaagccuuuugugaggcuacgcacaucccgauggagaaacucaaguggacaagcccuuuuaccugccaucgggugucucugaccacaagacccuccgaaagcaaaacccccucuccucagcucuguacaagcucucccccucgccacccguccugcgauagcuucucccuggagccccuugccaagggcaagcuggggcucgaaccucgggcgguggucgagcauacgggaaaacugugggcuaccguugugggccuggccuggcuugagcacucuagcgccuccuauuucacagaaugggagcugguggcugccaaggcgaauagcuggcucgaacagcaagagguccccgaagggagaacccagggaacacugaaagcugccgcccgccagcucuuugugcugcuucggcauugggacgagaaccuggaguucaauaugcuguguuacaacccuaauuacguuuga

SEQ ID NO: 77828 - RNA, 2676 nt, Artificial Sequence
  derived and/or modified sequence opt5 from VWA7__Homo_sapiens__NP_079534
augcugcccaccgaggugccucagagccacccgggccccuccgcccuccugcuucugcaacuccugcuuccucccacaucugcuuucuuuccuaacaucuggagccugcucgccgcgcccggguccauuacgcaucaggaccugaccgaagaggcugcccugaaugucacacuccagcuguuccuugaacagccuccgcccggaagaccuccccugcggcucgaggauuuucugggccgcacccuucuggccgacgaucucuucgcugccuacuuugggccuggaucuagcagacgguuccgcgcugcccugggcgaaguuuccagagcgaacgccgcucaagacuuucugcccacaucucggaaugauccggaccuccacuucgaugccgagcgccuggggcagggcagagcucggcuugugggcgcccugcgcgagaccguggucgcggccagagcucucgaccauacacuggcccggcagcgccuuggcgcugcccugcacgcccuccaggauuuuuauagccauuccaacuggguggaacugggggagcaacagccucacccccaccuucucuggccuagacaggaacugcagaaucuugcucaaguugcggacccuaccugcagcgauugugaggagcugucuugcccccggaacuggcucggauucacgcugcuuaccuccggcuacuuugggacacaucccccgaagcccccuggaaaauguagccacggcgggcauuucgacagaucuuccagccagcccccuagaggaggcaucaauaaggauucuaccucccccggcuuuagcccgcaccacaugcugcaucuccaggccgcuaaacuggcccugcucgccuccauucaggcuuucucucugcuucggagcagacugggggaccgcgacuucucccggcuccuggauaucaccccugccagcucucuguccuuugugcuugacacaacgggaagcaugggcgaagagauuaacgcggcuaagauccaagccagacaccucgucgaacagcgccgggggucucccauggagccugugcauuauguucuggugcccuuccacgauccuggauuuggccccgucuucacaaccagcgacccggauuccuuuuggcagcaacugaaugaaauccaugcccucgggggaggcgacgagccugagaugugccugucugcucugcagcuggcccuccugcacacaccuccccugagcgauauuuucguguuuaccgacgcuucccccaaagaugccuuccuuaccaaccagguggaaagccucacacaggagagacgcugucgggucacguuucugguuaccgaagacacaucuagagugcaaggccgcgcgcggagagagauccuguccccgcuccgcuucgaacccuacaaggccguggcucuggccagcgggggagaggucauuuuuaccaaggaucagcacauccgggacguggcugccauuguuggcgagucuauggcggcccuugugacacugccucucgaucccccugucgugguucccgggcagccucugguguucuccgucgacggacugcuucagaaaaucaccgugcgcauucauggcgacaucagcuccuuuuggaucaagaaucccgcuggggucucucaaggccaggaagagggaggcgggccgcucggacacacgcggcgcuucggccaguucuggauggugacaauggaugacccuccccagaccgggaccugggaaauucaaguuacagccgaggauaccccuggagugagaguccaggcucagacaagccuggacuuucuguuccauuuuggcauccccauggaagaugggccgcacccuggccucuauccccugacgcaaccuguggccggacuucagacccagcugcucguugaggugacaggccuggggucccgggccaaccccggagacccccagccucacuucucucaugucauucugagaggcgugccggagggggcugaacuuggacaagugccccucgagccuguuggacccccugaacgcgggcugcuggcggccagccucucccccacccugcuuagcacaccucggccguuuucucuggagcucaucggccaggaugcugccggaagacgccugcacagagccgcuccccagccuuccaccgucgugcccgugcugcuugagcugagcggcccuucuggguuccucgcccccggauccaaagucccgcugagccuccggauugcgucuuuuagcggcccucaggaccuggaucuucgcacguucgugaaucccuccuuuagccugaccucuaaccucuccagagcucaucuggaacugaaugagagcgccugggggcggcuuuggcuggaaguucccgacuccgccgcuccugauucuguggucauggugacaguuaccgccggaggccgcgaggcgaaccccgugccuccgacacacgcuuuccucagacugcucgucagcgcccccgccccucaagaccggcauaccacgcccacaggguccucugacccuauccugaccacagcuacccccgccuuuagcccguucacccuugugacacagggccgcgcuggagccggccuggcggccggguccccuugguggggaacgguuggcggggugcuccugcugcuuggacuggcuucuugguga

SEQ ID NO: 77829 - RNA, 3120 nt, Artificial Sequence
  derived and/or modified sequence opt5 from VWA8__Homo_sapiens__NP_001009814
augcagagcagacugcuccugcuuggcgcccccgggggacacggcgggccugcuucccggcgcaugagacugcuccugcggcaagugguccagcgcagaccgggaggcgaccggcagcgccccgagguuagacuucugcaugccgggucuggagcggauaccggcgacacagugaacaucggcgaugugagcuacaagcucaaaauuccuaagaaucccgaacuggucccucagaacuauaucuccgacucucuggcucaaagcgugguucagcaccuccgguggauuaugcagaaagaucugcuugggcaggacguguuccugaucggacccccuggcccgcuccgcagauccauugccaugcaauaccuggagcuuacgaagcgggaagucgaguauaucgcccugucucgcgauaccacagaaaccgaccucaaacagagacgggagauccgcgcugggacagccuuuuacauugaucagugcgcugugagagccgcgaccgagggacggacacugauccuggaaggccucgagaaggccgaaagaaauguucugcccgugcuuaacaaucugcucgagaaccgcgagaugcagcuggaagacgggcgguuccuuaugagcgcugagagauaugauaagcugcuccgcgaccauaccaaaaaggaacuggauuccuggaaaauuguccgggugagcgagaauuuuagagugaucgcccugggacucccugucccccgcuacucuggcaacccucuggaucccccgcuucgguccagauuccaagcucgcgacauuuauuaccugccuuuuaaggaccagcucaaacugcuuuacagcaucggcgccaauguuucugcggaaaaggugucccagcugcucagcuucgccacgacccuguguucucaagaguccagcacacuggggcuccccgacuuuccucuggauucccuugcugccgcugugcagauucuggacucuuuccccaugaugcccaucaagcacgccauccaguggcucuauccuuacagcauucugcugggacaugagggcaaaauggccgucgaaggggugcuuaagcgguuugagcuccaggauuccggaagcucucugcugccgaaagaaaucguuaagguggagaaaaugauggaaaaccacgucucccaagcuagcgugaccauuagaaucgcggacaaggagguuacaauuaaagugcccgccggcacccgccuccugucucagccuugcgcuagcgaucgguucauccagacgcuuucccacaagcagcugcaagccgagaugaugcagucucauauggucaaggacaucugucucauugggggaaaaggcugcggcaagacagugaucgccaaaaauuuugcugauacccugggguauaacauugaacccaucaugcuguaccaggacaugacagccagagaucuucuccagcaacgguauacccugccuaauggagacaccgcguggcgcagcagcccccuggucaacgcugcccucgagggcaagcuggugcuucuggacgggauucacagaguuaaugccggaacacucgcugugcugcagcggcugauccaugauagagaacuuucccucuacgacggcucucgccugcugcgggaggauagauauaugcgccucaaagaggaacugcagcuuuccgacgagcagcugcaaaagagaagcaucuucccgauucacccuucuuuucggaucauugcccucgcugaacccccugucaucggguccacggcccaccaguggcugggccccgaguuccugaccauguucuuuuuccauuacaugaagccucuugugaaaagcgaagagauucagguuaucaaggagaaagugcccaacgucccgcaagaagcgcucgauaagcugcuguccuuuacacacaaacuccgcgagacccaggacccuacagcccagucucuggcugccagccuuuccaccagacagcugcuccggauuucucgcagacugagccaauaccccaacgaaaaucugcauuccgcugugacgaaggccugucuuagccgguuccugcccucucucgcgcgcuccgcccuggagaagaaccucgcugaugccacaaucgaaaucaauaccgacgauaaccuggagccugagcuuaaagacuauaagugcgaagugaccagcggaacacugagaauuggcgcuguuucugccccgaucuacaaugcccacgagaaaaugaagguccccgaugugcucuuuuaugacaacauucagcaugugaucgucauggaagauaugcugaaagacuuccugcuuggggagcaucugcuccuggugggaaaucagggcguugggaagaacaagauuguggaccgguuucuccaucugcuuaaucgcccuagagaauacauccagcugcaccgggauaccacaguccaaacgcucacccugcagcccuccgugaaagacggacugaucguuuaugaggauagcccucuugugaaggcugucaaacugggccacauucucgugguugacgaggcggauaaggcccccacaaacgugaccuguauccugaaaacacucgucgaaaauggggagaugauucuggcugacggcagacgcaucguggccaacucugccaaugugaacggacgggaaaaugucguugugauucacccugauuucagaaugaucgugcuugcuaaccgccccggcuuuccguuccuggggaacgacuuuuucggaacccugggcgauaucuuuagcugccacgccgucgacaauccuaagccccacuccgagcucgaaaugcugcggcaguacgggccuaacgugcccgagccgauucuucagaaacugguugcggcuuucggagagcucagaagccuggccgaucaaggcaucauuaauuauccuuacucuacgcgcgaaguggucaacaucgugaagcaucuccagaaguuccccaccgaggggcuguccagcguugugcggaaugucuuugacuucgauuccuacaacaaugacaugagagaaauucuuaucaacacacugcacaaauauggcaucccuauuggagccaagcccaccucugugcagcuggcuaaagaguga

SEQ ID NO: 77830 - RNA, 2868 nt, Artificial Sequence
  derived and/or modified sequence opt5 from VWCE__Homo_sapiens__NP_689931
augugggccggccugcuccugagagcugccugcguggcgcuucugcuccccggggcuccugcccggggauacaccggccgcaagccgcccgggcacuucgccgcugagagacggcgccugggaccucaugucugucuuagcggcuuuggguccggaugcugucccggcugggccccuucuaugggcgggggacacugcacacugccccucuguagcuucggcugcggguccggaaucuguauugcuccuaacguuugcucuugucaggacggcgaacaaggggccacgugcccggagacccauggacccuguggcgaauauggcugcgaucugacaugcaaucacgggggaugucaggagguggcgagagugugcccugucggcuuuagcaugaccgaaacagccguggggauccgguguaccgacauugaugagugcguuacauccucuugugagggacauugcgugaacaccgaaggcggguucgucugugagugcggacccggcaugcagcugagcgcugaccgccacuccugucaggauacggacgaaugccucggcaccccuugucaacagagaugcaaaaauagcaucgggucuuacaagugcuccugucggacaggauuucaucugcacggcaaccgccacagcugcguggauguuaaugaguguagacggccccuugagcgcagagugugccaucacucuugucacaacaccgucggguccuuccugugcacaugucggccgggauuucgccucagagccgaccgggugagcugcgaggcuuucccuaaagccgugcuggcgcccucugccauucuucagccuagacagcaucccuccaagaugcugcuccugcugcccgaagcuggccgcccugcccucagcccggggcacucucccccuuccggcgcucccggaccucccgccggcguccggaccacgagacugccgagcccuacaccccgccuuccuaccuccagccccucugccccuguuuggcugcucuccacacugcuugcuacccccgugccgaccgcgagccugcucgggaaucugcggccucccucucugcuccaaggagaagugaugggcacacccagcuccccuagagggccggagucuccccgccuggccgcuggaccuagccccuguuggcaucuuggcgccaugcacgaaucccggagcagauggacggagccugggugcucucaguguuggugcgaggauggcaaagugaccugcgaaaagguccgcugugaggccgcuugcucccaucccaucccuagccgggacggaggcuguugccccucuuguacagggugcuuucacuccggaguugugagagccgaaggcgaugucuucagcccgccuaacgagaauuguaccgugugcguuugucuggcggggaacguguccugcaucucucccgaauguccuagcggacccugccagacaccgccucagaccgacugcuguacgugcguccccgugcgcuguuauuuucacggccggugguacgcugauggggccgucuucuccggcggaggcgacgagugcacaaccugugugugccaaaauggggagguugaauguucuuuuaugccuugccccgagcucgccugucccagagaagaguggcggcugggaccuggccagugcuguuuuaccugccaggaaccgacacccagcaccgggugcucccuugacgauaacggaguggaguucccuauuggccaaaucuggagccccggggacccuugugagcugugcauuugucaggcugauggcucugucuccugcaagcgcacagacuguguggauagcugcccccauccuauccggauuccgggacaguguugccccgacuguucugccggcugcacguauaccgggagaaucuucuacaauaacgaaacauucccuuccguucucgaucccugucugagcugcauuugccugcucggaucuguggcuuguagcccugucgacugccccaucaccuguacauauccguuucacccugauggcgagugcugucccgugugcagagacuguaauuacgaagggcgcaaaguggccaacggacagguuuucacccuggaugacgagcccugcacgcgguguaccugccaacuuggcgaggucuccugugaaaaggugccuugccagagagcgugugccgaccccgcucugcucccuggcgauugcugcagcucuuguccggacucccugagcccccuggaggaaaaacaggggcuuuccccucauggaaacguggccuuuucuaaggcuggccgcagccuccacggggauacagaggcccccgucaauugcuccucuuguccuggacccccgaccgcgagcccuuccagacccgugcugcaucugcuccagcugcuucugcggacaaaccucaugaaaacccaaacgcugccuacaucucccgccggcgcucacgggccucacagccuggcccuuggacucaccgcuacauuccccggcgaaccgggcgccuccccucgccugagccccgggcccucuaccccuccgggagcccccacccugccucucgcuucccccggcgcgccucagcccccuccgguuacacccgagcggagcuuuucugccuccggggcucagaucgugagcagauggccuccccugccuggaacgcuucugaccgaggccucugcccucuccaugauggaccccagcccguccaagacaccuauuacccugcugggcccccgcguccuuagccccacaaccucuagacucagcacggcucuggccgcgacaacccauccugggccccagcaaccuccggugggagcuucccggggcgaagagucuaccauguga

SEQ ID NO: 77831 - RNA, 4773 nt, Artificial Sequence
  derived and/or modified sequence opt5 from VWDE__Homo_sapiens__NP_001129396
augcccggcggggccugcgugcuggucaucgcucucauguuccuggccuggggagaggcgcaggaauguagcccuggcgggcaccaauuucuuagauccccguaccggucuguucgcuucgacagcuggcaucugcagcaguccgcugugcaggaucucauuugcgaccacucucugagccccggaugguauagauuucuuauccuggaucggccugccgagaugcccaccaaguguguggaaaugaaccauugcggcacacaagccccuauuuggcucucccugcgcgacucugagacgcugcccagcccuggggaaaucaaacagcucaccgcuugugccacauggcaguuccuguuuuccaccacaaaggauugcugucuuuuccagauuccggucagcgugagaaauugcggaaacuuuucuguuuaccugcuccaacccacccagggcuguaugggcuauugcgcugaggccaucuccgacgcgcggcugcacccuugugggagcgaugagacagaaaccggaggcgacugcgugcgccagcuugccgcuucucugcccccucccccggccgggagaccugagguccucguggaacugaucgagucccggcuguucugccgcuguagcuuugauguucccgcuacgaaaaauucugugggauuccauauugccugguccagacucagcucccaggaggucaaggaagaacugacccaagaaacaaccgugcaggcguuuucucuucuggagcucgacggcaucaaccugcggcuuggggaucgcauuuucugcagcgccuccguguuuuuccuggaaaauccucacguccagagcguugcuaucgagucucaagaguucuuugccggauucaaacuccagcccgaacuguccacaauuagcgaggacggcaaggaauacuaucugagaaucgagucuaccgugcccauuaucuguagcgaauuuuccgagcucgaucaggagugcaagaucucucugaaacuuaagacgauuggccaggggcgggaacaccugggacucaaccuggcucuuagcuccugucauguggaccugcuccaaacaagcucuugcgccaauggcaccuguucccacacauucgucuacuauaccgccgugaccgacuuuagccgcgauggggacagaguuucuaacaucgugguccagccuauugugaaugaggauuuccuguggaacaauuacaucccggacuccauucagaucaaaguuaaggaugugcccacagcuuacugcuauacguuuaccgacccucauaucauuacauucgauggacgggucuacgacaacuuuaaaaccggcacauucgugcuguauaagagcauguccagagauuuugaaguccacgugcgccagugggacugucggucucuccacuaccccguuagcugcaauuguggguucguggcgcaagagggaggcgauaucgucaccuuugacaugugcaacggccagcugagagaaucccagccuuaucuuuucauuaagucucaggacgugacgcgcaauaucaaaauuagcgaguccuaccuggggcggaagguuacaaucugguucagcucuggagccuuuaucagagcugaucucggcgagugggggaugucccugaccauucgcgcccccagcguggacuaucggaacacccugggacuuugcggcacauucgaugaaaacccggagaaugacuuucaugauaaaaacgggaugcaaaucgaccagaauuucaacaauuacgucgccuuuauuaacgaauggagaauccucccuggcaagucuauguccgauacccugcccgugagcaugacaucuccuggaaaacccagcuacuguuccugcagccuggacacggcugccuauccuucuuccgaggaucucgacagcgugucccgcucugagauugcgcugggcuguaaggaucuuaaucacguuagccuguccucucucauccccgaacuggacgucaccagcgaguacauuaacuccgauacacuggugcgggaaaucaauaaacauaccucuccggaggaauauaaccuuaaucucuuccugcaggagaagaagcacaucaaccugacaaaacucgggcugaaugugcagaagcauccuggaaacgagaaagaagacagccuucaauaccuggcuaauaagaaauauacccagggcagagggucccacagccaggagaugcgcuacaaccggcaaaacagauggaagcggcagaauuuucacgaauuuccuccccucuuugccuuccccucucugucccagacggaccuggaggaacuuaccuauuucuucccggaggaucaugccgaggacguccagcaagaauuuuuccccagcuggccuacacccucuggacucaccgaguacuccacacugacccugugccaggaaacgcucgcuaacagcucuauuggccgccugugucuugccuuccuggggaagagacucgauuccgugaucgagaugugcguuaaagacgugcugcugaaggaugaccuuagcugggcugaagccggcgucgcgcuccuggagaaugagugugaaaaacggauuguggaggaaggaaaguacaacacagaggaguauggcaccuccaucgaagauauucugagcguucucaaaugcccuaaucuguguucugggaacggacagugcauggaguggggcugugccugcagccccuccuuuucuagcuacgacugcuccgauucuuaugacaaggcuccugaaaucacagagcuugggaaugccggauucugugaugugcagaaguacaacugcaugauggucagaguguuuggcaaaggguucaaggaacugcccagcaucaaaugugagguuaccaagcuccaauauaauuccucugaguggaugccgggcgaaccuauuuacacccagacaguguuucacaacagccgcgcugucgacugccagcugcccacggaugugcagcaauucgacaccauggaccuggugggaggcaaaccuacagggaaguggcagcuuaaggucuccaaugauggauauaaauuuagcaaccccaagaucaccguuauuuacgacggcgccugucaggugugcgggcuguacaaaaaugauucuuguacaaucaaggagaacgugugcauuaucgacggacucuguuaugucgaaggcgauaaaaauccgaccuccccuugccugaucugucggcccaagauuagcagauucacguggucuuuucucgagaacaaccaaccucccgugauccaggcgcugcaggacaaacuucagacauucuacggggaaaauuuugaguaucaauucguugccuucgaucccgagggcuccgacauucauuuuacccuggauagcggaccugaaggcgcuuccgugucuagcgccggacucuucauguggaagaccgaccugcugacaacccagcagaucacaguccgccuuaacgaugacugcgacgcugagacgagagugaccauugaaguuacagugaaguccugcgauugucugaaugggggcagcugcgucucugaccggaacuuuuccccggggagcggaguguaccucuguguuugccugcccggcuuccacggcucucucugugagguggauaucagcgggugccaguccaauccuuguggacugggcucuuauaucagcggguuucacuccuacucuugcgacugucccccugaacuuaaagucgagacccaauucgugaaccaguuuacaacccagacggugguccugacccgcagcgauaaguccguuaauaaagaggaagacgauaagaacgcccagggaagaaaacggcaugugaagcccacaagcggcaaugccuucaccauuugcaaguauccuugugggaaaucucgcgagugcguggcuccgaacaucugcaaguguaaacccggauacauuggcuccaauugccaaacagcgcucugugacccugauugcaagaaccacggcaaauguaucaagcccaauauuugccagugucugccugggcauggaggcgcuaccugcgacgaggagcacuguaaucccccgugccagcaugggggaacaugucuggccggcaaccuuuguaccugcccuuacggguuugucggacccagaugcgagacgauggugugcaaccggcacugugaaaacggcggccagugccugacacccgauaucugucaaugcaagccugggugguauggacccaccuguagcaccgcccucugcgacccuguuugucugaauggcggguccugcaacaaaccgaauacaugucucugccccaacggauucuuuggcgagcacugucagaaugccuucugccauccucccugcaagaacgggggacacuguaugcgcaauaacgugugcgucuguagagaaggcuacaccggccggcgcuuucagaaaucuauuugcgauccuacguguaugaaugggggaaagugcgugggccccagcacauguuccugcccgucuggguggagcggaaaaagauguaacaccccuaucugccugcaaaaguguaagaauggcggggagugcaucgcucccuccauuugccauuguccuagcucuugggaaggaguucggugccagauccccauuuguaacccuaaaugccuuuauggcggcagauguaucuuccccaaugugugcuccugucgcacagaguacagcggggucaagugcgagaaaaagauucagauccggagacacuga

SEQ ID NO: 77832 - RNA, 8442 nt, Artificial Sequence
  derived and/or modified sequence opt5 from VWF__Homo_sapiens__NP_000543
augauccccgcccgguucgcuggcguccugcucgcccuggcgcuuauucugccugggacccucugcgcugaaggaacccggggccgcagcuccacggccagaugcucucuguuugggagcgacuucgucaacaccuuugauggauccauguacucuuucgccggcuauugcagcuaccuucuggcugggggaugccagaaacgguccuuuucuaucauuggcgacuuccaaaauggcaaacgcguuagccucuccguguaucugggggaauuuuucgauauccaccuguuugugaacggaacagucacccagggcgaccagagagugagcaugccguacgccucuaaggggcucuaucuggaaacagaagcuggauacuauaaacuuuccggcgaagccuacggguucguugcccggauugauggaagcggcaauuuucaggugcugcucucugaccgcuacuucaacaagaccugcggccugugugggaauuuuaacaucuucgccgaagaugacuucaugacacaagagggaacccuuacguccgaucccuaugacuuugcuaauagcugggcccugucuuccggcgagcaguggugcgaaagagcuagcccucccuccucuagcuguaacaucuccagcggggagaugcagaaaggacucugggaacagugccaacugcugaagucuaccuccgucuucgcccggugucauccucucguggaucccgagccuuuuguugcgcugugcgagaagacacuuugugaaugcgccggcgggcuggagugcgcuuguccggcccuccuggaauacgcuagaaccugcgcccaggagggaauggugcuuuauggcuggacagaccacagcgccuguucucccgucugcccugcuggcauggaauacagacagugugugagccccugcgcgcggaccugucagucccugcauauuaaugagaugugccaagagcgcuguguggaugggugcucuuguccugaaggacagcuccuggacgagggccugugcgucgaaagcacggagugccccuguguucacuccgggaaaagauauccgccuggaacaagccucucucgggacugcaacaccuguaucugccgcaauucccaguggauuuguagcaacgaagagugccccggcgagugucuggugacagggcaaucucauuucaaguccuuugauaauagauacuucaccuuuagcggcaucugccaguaucuucuggcccgggacugucaggaucacuccuucucuauugugaucgaaaccguccagugcgcugacgauagagacgccguguguacacgcagcguuacggugcggcucccuggacugcacaacucccuugucaaacugaagcauggcgccgggguggcuauggauggacaagacguucagcucccccugcugaaaggcgaucuccggauucagcacaccgugacagccucuguccgccugagcuacggggaggaccuucagauggauugggacggacggggcagacugcucgugaagcugucccccgucuacgcggggaagaccugcggccugugcggaaauuauaacggcaaccaaggggacgauuuucuuacaccuagcggacucgcugaaccgcgcguggaggacuucggcaaugccuggaaacugcauggggauugucaggaccugcagaagcagcacucugaucccugcgcccucaacccucggaugaccagauuuuccgaagaggcuugugccguucugacgagccccacauucgaggcuugccaccgcgccgugucuccucuucccuaccugcggaauuguagauaugacgucugcuccuguagcgauggacgcgaaugccucuguggcgcgcuggccucuuacgcugccgcuugcgccgggcggggcgugagaguugcguggcgggagccgggacgcugugaacugaacugcccuaaaggccaaguguaucuucagugcgggacccccuguaaucugaccugcagaagccuguccuacccugacgaggaguguaacgaagccugccuggagggauguuuuugucccccuggccucuauauggaugaaagaggggacuguguccccaaggcucagugcccguguuacuacgauggagagaucuuccagccugaagacaucuucagcgaucaucacacaaugugcuauugugaggacggcuuuaugcauugcaccaugucuggggugcccggcucccugcuucccgacgccgugcugagcuccccucucucucacagaagcaaacgcucccugucuugccggccgcccaugguuaagcuggucuguccugcugauaaucuuagagccgagggacucgaaugcacaaaaacgugucaaaacuacgaccuggagugcaugagcaugggcuguguguccgggugccugugucccccuggaauggugcgccaugaaaauagaugcgucgcccucgagcggugucccugcuuccaccagggcaaggaauaugcuccuggggagaccgugaagauuggauguaacacaugcguuugccgcgauagaaaauggaauuguaccgaccacgugugcgaugcgacauguucuaccaucggcauggcccauuaccugacguuugacggccuuaaguaucuguuccccggggagugccaguacguccucgugcaagauuauuguggaagcaacccgggcaccuuucggauucugguugggaauaaaggaugcucccacccuagcgugaaguguaaaaagcgcgucacaauccugguggaaggcggggagauugaacuuuucgacggagagguuaacgugaagagacccaugaaagaugaaacccauuuugaggucguggagucuggccgguacaucauccuccugcugggcaaggcucucuccguggucugggaccgccaccugagcauuucuguugugcuuaaacagacauaccaggaaaaggugugcgggcuguguggaaauuucgauggcauccagaacaacgaccucaccuccagcaaucugcaagucgaggaagauccuguggacuuugggaacucuuggaaaguuuccagccagugcgccgacacgagaaaggugccccuggauuccagcccggccacaugucacaauaacauuaugaagcagaccauggucgacucuagcugccggauccuuacauccgauguguuccaggacuguaauaaacugguugauccugagcccuaucucgacgugugcauuuacgauaccugcucuugugagagcaucggagacugcgcuuguuuuugcgauaccaucgccgcguaugcucaugucugugcccaacacggcaaggugguuacauggcgcacggccacccugugcccucaguccugugaagagagaaaccuccgggaaaauggguacgagugcgaauggagauauaacucuugugcucccgccugccaggugacaugucagcaucccgagccucuggcgugcccgguccaaugcguggagggaugucacgcucauugucccccuggcaaaauucuugacgaacugcuccagaccuguguggaucccgaggacugcccugucugugaaguugccggccgccgguucgccagcgggaagaaagugacacugaaucccuccgacccugagcacugccagaucugucacugcgauguggucaaccugaccugugaggcuugccaagagccgggaggccuugugguucccccuacggacgcccccgugucuccuacaacccuguacgucgaggauauuagcgaacccccgcuccaugacuuuuauuguuccagacugcucgaucugguguuccuucuggacgggagcucucgccucuccgaggcugaguucgagguucugaaggccuuuguggucgauaugauggaacggcugagaaucagccagaagugggugcgcgucgcggugguugaguaccacgacggaucucaugccuacauuggccuuaaagaucggaagagaccuuccgagcugcgccggaucgcuagccaggugaaauaugccgggucccaggucgcuucuaccagcgaagugcucaaguacacacuguuccaaauuuuuagcaaaaucgacagacccgaggccagccggaucacccuccugcuuauggccucucaggaaccccagcgcauguccagaaauuucguucgguaugugcagggacugaagaaaaagaaggucauugugaucccugugggcauuggcccccacgcuaaccugaaacaaauccgccucauugagaagcaggcgccugagaauaaagccuuuguucugagcucugucgaugaacuugagcagcagagagacgaaaucgugagcuaccugugcgaucucgcuccggaggcgcccccucccacacugccucccgacauggcccaagugacggucgggccgggacuccugggcguguccacccuugggccuaagcggaacucuaugguucuggacguggcuuucguccuggaaggaagcgauaaaaucggcgaggccgacuuuaauagauccaaggaguucauggaagaggugauucagcgcauggauguugggcaggacucuauccaugugacaguccuccaguauagcuacauggugaccguugaauaucccuuuuccgaggcgcaaagcaagggagauauucugcagcgggugagagaaauccgcuaccagggcggcaaccggacaaacaccgggcuugcucugagauaccucucugaccacuccuuccuggucagccaaggagaucgcgagcaggccccuaaucucguguauauggugacgggcaaccccgccuccgacgagauuaaacggcugccuggggauauccaggucguucccaucggagugggcccgaaugcuaacgugcaggaacuugagagaauuggguggccuaaugcccccauccugauucaagacuuugaaacccugccccgcgaggcgccugaucucguccugcagagaugcuguucuggagaaggccuucagaucccgacacugagccccgcuccugacugcucccagccccucgaugugauucugcuccuggacggcucuagcuccuucccugccagcuacuucgacgagaugaagucuuuugccaaggcuuucaucuccaaggccaacaucgggccccggcuuacccaaguuagcgugcugcaguauggaucuauuacaaccaucgaugucccuuggaaugugguuccggagaaagcucaccuccucucccugguggacgucaugcagcgcgaaggcgggcccagccagauuggagaugcccuuggcuuugcggugagauaccugacaucugagaugcauggggcccggccuggagcuagcaaggccgucgugauccucguuaccgacguguccguggauucugucgacgcugccgccgaugcugcgcgcagcaacagaguuacgguguuccccauuggcaucggcgaccgguaugaugccgcucaacugcgcauucuggccgggccugccggagacuccaauguggucaagcuccagcgcaucgaagaucuucccacaauggugacccugggcaacagcuuucugcacaaacucuguuccggguucguucggaucugcauggacgaggacggaaaugagaagagaccgggcgauguguggacccugccugaccagugucauacagugaccugccaacccgaugggcagacgcuucugaaaucucaccgcgugaacugugaccggggccucagacccagcugcccuaauucccagucucccgucaagguggaagagacauguggaugccgguggaccuguccuugcguuugcacaggcagcuccacccgccacauugugacauuugaugggcagaacuucaaacugaccggaucuuguagcuacguccuguuucaaaauaaggaacaggaccucgaggugauccuucauaacggcgcuugcuccccgggggccagacagggauguaugaaaagcauugaaguuaagcacucugcgcuguccguggagcugcauagcgauauggaggucacggugaacggccggcucgugucuguucccuaugucgggggcaauauggaagugaacguguacggagcuaucaugcacgagguccgcuucaaucaucugggccacauuuuuaccuucacaccucagaacaaugaauuucaacuucagcugucccccaagaccuucgccagcaaaacauacgggcucugcggaaucugugacgagaacggcgccaaugauuucaugcugagagacgggaccguuacgacagauuggaagacccuggugcaggaauggacagugcagcggccuggacaaaccugccagcccauccucgaggagcagugucuugucccggacucuucccacugccaggugcugcugcucccucuguuugcugaaugucauaaaguucuugcccccgcgaccuucuaugccauuugccaacaggauagcugucaccaggagcaagugugcgaagucaucgcuuccuacgcccaucugugccgcacaaacggcguguguguugacuggagaacgccugacuuuugcgcuaugagcugucccccuucucucguguauaaucacugcgagcacggguguccccggcauugcgauggcaacgucagcuccuguggagaccacccgucugaaggcugcuucuguccucccgauaaggugaugcuggaggggagcugcgugcccgaggaagccuguacccagugcauuggagaggacggcguccagcaucaguuucuggaggcuuggguuccugaucaccaaccgugccagaucuguacaugccucuccgggcgcaaagugaauuguaccacacagcccugcccuaccgccaaggcgcccacguguggacuuugcgagguggccagacugcggcagaacgcugaccaauguugcccugaguacgaaugugucugcgaucccgugucuugugaccugccucccguuccgcauugcgagagaggccuccagccuacacugaccaaucccggcgaaugccgcccuaacuucaccugugccugccggaaggaggaauguaaaagagugucucccccguccugcccuccccaccgccuucccacacugcggaagacccaguguugcgaugaguaugagugugcuugcaauugugucaacuccacagugagcugcccucucggguaccuggccuccacggccaccaaugacuguggaugcacaaccacaaccugccugcccgauaaaguuugugugcacagaagcacgauuuauccugucggccaguuuugggaagaggggugcgacguguguaccugcacagacauggaagaugcuguuaugggacuccgcguggcgcaauguucucagaagccgugcgaggacuccugucggagcggcuucaccuacguccuucaugaaggggagugcuguggaagaugccugcccucugccugugagguggucacaggcuccccucgcggcgauagccaguccucuuggaaaagcguggggucccaaugggcuagccccgaaaacccuugccugaucaacgagugcguucgggugaaggaagaggucuuuauccagcagagaaaugugucuuguccccagcucgaagugccuguuugcccguccggauuccaacugagcuguaagaccucugccugcugucccagcugccgcugugagcggauggaggccugcaugcuuaacggcacagugauugggccuggaaaaacggucaugaucgacguguguaccacaugcagauguaugguucaggugggcgucauuuccggguuuaagcuggaaugccgcaaaacaaccugcaaucccuguccucucggauacaaggaggaaaacaauacaggcgagugcuguggcagaugccugcccacggcuuguaccauccagcugagagggggacagauuaugacacucaaacgcgaugagacccuucaagacggcugcgauacacacuucuguaaggugaacgaaagaggggaguauuuuugggaaaagcgggucaccggaugcccgccuuucgacgagcauaaaugucuggccgaaggcgggaagaucaugaaaauucccggaacgugcugugauacaugcgaggagcccgaaugcaaugacaucaccgcgagacugcaguacgugaagguuggcucuuguaaaagcgagguggaagucgauauccacuauugccagggcaagugugccuccaaggcuauguacucuauugacaucaacgaugugcaggaccaaugcagcuguugcuccccuacccggacagagcccaugcagguugcccuccacuguaccaaugggagcguggucuaucaugaagugcugaacgcuauggagugcaaauguucuccucgcaagugcuccaaauga

SEQ ID NO: 77833 - RNA, 3573 nt, Artificial Sequence
  derived and/or modified sequence opt5 from WAPAL__Homo_sapiens__NP_055860
augaccagcagauucggcaagacauacucccggaaagggggaaacggcucuagcaaguuugacgagguguucuccaauaaacgcacgacccugucuacaaaguggggagaaaccacauuuauggccaaacucgggcagaagagacccaacuucaagccugauauccaagagauuccgaaaaagcccaaagucgaagaggaaagcaccggcgacccuuuuggguucgauuccgacgaugagucucugcccguuagcuccaagaaucuugcucaggugaaaugcagcucuuauuccgagagcucugaagccgcgcagcuggaggaagugacauccguccucgaggcuaacagcaagaucucucacgugguuguggaggacaccgucguguccgauaaguguuuuccucuggaagacacgcuucugggaaaagaaaagagcaccaaucggauuguugaagaugacgccuccaucucuagcugcaacaaacucauuacauccgauaagguggagaauuuccaugaagaacacgagaaaaacagccaucacauccauaagaaugccgacgauucuaccaaaaagcccaacgcugaaacaaccgucgccuccgagaucaaggaaacgaaugacacauggaacagccaguuuggcaaacgcccugagucuccgagcgaaauuucccccaucaagggcucugugagaaccgggcuguucgagugggacaaugauuuugaggacauucggagcgaagauuguauccugucccucgacagcgauccucugcuugagaugaaagacgaugacuucaagaaccgccuggaaaaucucaacgaggcuauugaagaggauaucgugcaaucuguccugagacccacaaacugccggaccuacugucgcgccaauaaaaccaaguccagccagggagcgucuaacuuugacaaacuuauggauggcacaucccaggcccuggcuaaagccaauagcgaguccucuaaggacgggcucaaccaggcuaaaaagggaggcguuagcugcgggacguccuucagaggaaccgugggccggacacgcgacuauaccgugcugcacccuucuugucugagcgucugcaaugugacaauucaagauaccauggaaagauccauggacgaguucacggccagcacacccgcggaucucggcgaagccgggcggcugcgcaaaaaggcugacaucgccaccucuaagaccacaaccagauuucggccguccaacacaaaaagcaagaaagauguuaaacuugaguucuuuggauucgaggaccacgaaacgggcggggaugagggaggcucuggguccagcaauuacaagaucaaguauuuuggauucgacgaucugucugaaagcgaggacgaugaagacgaugacugucagguggagagaaagaccuccaaaaagcgcacaaaaaccgcuccuagccccucucuccagccuccucccgaguccaacgacaauagccaggauucccaaucuggcacaaacaaugccgaaaaccuggacuuuaccgaggaucuucccggcgucccggaaagcgugaagaaacccauuaauaagcagggggacaaauccaaggagaacacgcggaagaucuucucuggaccuaaaagaagccccaccaaggccguuuacaaugcucgccauuggaaccacccugauuccgaggagcugcccggcccgccuguggucaaaccccagucugugacaguccggcucagcuccaaggagccuaaccaaaaagacgaugggguguuuaaggcgcccgccccucccagcaagguuauuaaaaccgugacaaucccgacccagccuuaucaggacauugucacggcucugaagugcagacgcgaagauaaagagcuguacacagugguucagcaugugaagcacuucaaugacgucguggaauuuggagagaaccaagaguucaccgaugacaucgaguaccuccugucuggccuuaaauccacacagccccugaauacccggugucucagcgugaucucucuggccaccaagugcgccaugcccuccuuuagaaugcaccuucgcgcucaugggaugguugccauggucuucaagacacuggaugacagccagcaccaucagaaccucucucugugcacggcggcucugauguauauucucucccgggacagacugaauauggaucuugaccgcgccagccuggaucucaugauccggcugcuggagcuugaacaagacgccuccagcgcuaaacuccugaacgagaaggauaugaauaaaauuaaggaaaagaucagacggcugugugagaccgugcacaacaagcaucucgaccuggagaauauuacaaccggccaccuugccauggaaacacugcucucucugaccagcaagcgcgcuggagauugguucaaagaggaacugagacuucucggcgggcuggaccacaucguggauaaggucaaagagugcguggaccaucugucccgggaugaagacgaggagaagcucguugccucucuguggggagcggaaagaugucuucgcgugcuggagagcgucacggugcacaacccugaaaaucaguccuaccucaucgccuauaaagacucucagcugauuguuagcuccgcuaaggcccugcagcauugcgaggaacuuauccaacaguacaaccgggcugaggauucuauuugucucgccgacagcaaaccgcugccccaccagaaugugacaaaccacgucggcaaggcgguggaggauugcaugagagccaucauugggguucugcucaaucugaccaacgacaacgaauggggauccaccaagacaggcgagcaggaugggcuuaucggcaccgcucugaauugugugcuccaagucccuaaauaucugccccaggaacagcgcuuugacauuagagugcugggacuuggccuccugaucaaccugguggaguacagcgcccggaaucgccauugccucgucaacauggaaacaucuuguuccuucgauagcucuaucugcuccggggagggagacgauagccugagaauuggcgggcaaguucacgcugugcaggcccuugugcagcuguuucucgagcgggaacgcgccgcucagcuggcggaguccaagacggacgaacugaucaaagaugccccuaccacacaacaugacaagucuggagaguggcaggagaccagcggcgaaauucagugggucuccacagagaaaaccgaugggacggaagagaagcacaagaaagaagaggaggacgaggaacuugaccugaauaaggcucuccagcaugccggcaaacacauggaagauuguaucguggccagcuauaccgcucugcuccugggaugccuuugccaagagucucccauuaacguuacaaccgugagagaauaccugccugagggcgacuucuccaucaugacagagaugcucaagaaauuucugagcuucaugaaucugaccugugccgucgggacaaccggacagaagucuaucagccgggugauugaauaccuugagcacugcuga

SEQ ID NO: 77834 - RNA, 1014 nt, Artificial Sequence
  derived and/or modified sequence opt5 from WARS2__Homo_sapiens__XP_011538796
augaugguggccuggaccacaaaggacagcaaaaagagagucuucuccggcauccagcccacggggauucugcaccucggaaacuaccugggcgcuaucgagucuuggguucggcuucaagaugaauaugacagcgugcuguacuccauuguggaucuccauucuaucaccgucccucaggacccggccgugcugcgccagagcauucuugauaugacagcgguucugcucgcuugcgggaucaaucccgagaaauccauccuguuucagcaaucucaggugagcgaacacacccagcuguccuggauucucagcuguauggucagacugccucggcuucagcaucugcaccaauggaaggccaaaacaaccaagcagaagcaugacggaacagugggccuccugaccuaucccguucuucaggccgcugauauccugcucuacaaaucuacgcacgugccugucggggaggaccaggugcaacacauggaacuggugcaggaucuggcccagggauucaacaagaaauauggcgaguuuuuccccgucccugaguccauucucaccagcaugaagaaaguuaagucucugcgcgacccguccgcuaagaugagcaaaucugaucccgacaaacuugccacagugagaaucaccgauuccccugaagagauugugcaaaaguuucggaaggcggucacagacuucaccagcgaagugacguacgaccccgccggccgcgcugggguuuccaauaucguggccguccaugcugccgugacaggacugucuguugaggagguggucagacggagcgcgggcaugaacaccgcccgcuauaaacucgcuguggccgaugcugucauugaaaaguuugccccuaucaaaagagagaucgaaaagcugaaacuugacaaggaucaccuggagaaggugcuccagauuggguccgccaaagcuaaggaacuggcguacacaguuugccaggaggugaaaaagcuggucggauuccucuga

SEQ ID NO: 77835 - RNA, 1416 nt, Artificial Sequence
  derived and/or modified sequence opt5 from WARS__Homo_sapiens__XP_006720312
augcccaacagcgagccugccucccugcucgaacuguucaauucuaucgcuacccagggcgagcuugugagaagccugaaggccgggaacgcguccaaagacgaaauugauucugcugucaagaugcucguuagccugaaaauguccuacaaggccgccgcuggagaggacuauaaagccgauugcccgcccggcaauccugcucccacaucuaaccacgggccugacgccacggaagcggaggaggauuuuguggaccccuggaccgugcaaacaagcuccgccaagggaaucgauuacgacaaacuuauuguccgguucggcagcucuaagaucgauaaggaacugauuaaucgcaucgagagagcuaccgggcagcggccucaucacuuucuccgcagaggaaucuucuuuucccaucgggacaugaaccaggugcuggaugccuaugaaaauaaaaagccguucuaccuguauacaggccgcggccccagcucugaggcuaugcacguugggcaucucauuccuuuuaucuucaccaaauggcugcaggacguguuuaacgucccccuugugauucaaaugacagaugacgagaaguaccuguggaaggaccucacccuggaucaggccuauuccuacgcgguugaaaaugccaaagacaucauugcuuguggauucgauaucaacaagacguuuauuuucagcgaccuugauuacaugggcaugucuuccggguuuuauaaaaauguggucaagauccagaaacacgugaccuucaaccaggugaagggaaucuucggcuuuacagacagcgauugcauugggaaaaucuccuucccugccauucaagcugcccccucuuuuagcaauuccuucccgcagaucuuuagagaccggaccgauauucagugucugaucccuugcgccaucgaccaggaucccuacuuccgcaugacaagagacgucgcuccucggauuggauaucccaagcccgcgcuccugcacagcaccuuuuucccugcccugcaaggcgcucagacgaagaugucugccuccgacccgaacagcucuaucuuucucacagauaccgccaaacagauuaagacaaaaguuaauaagcaugcuuucagcggcgggcgcgacaccaucgaggaacacagacaauuuggaggcaacugugauguggacguguccuucauguaccugaccuuuuuccuugaggaugacgauaaacuggaacagauucggaaggacuauacaucuggggccaugcucacgggagagcugaagaaagcgcuuaucgagguccugcagccccucaucgcugaacaucaggcccgcagaaaggaggugaccgaugaaauuguuaaagaguucaugacaccucggaagcugagcuuugacuuccaauga

SEQ ID NO: 77836 - RNA, 1680 nt, Artificial Sequence
  derived and/or modified sequence opt5 from WASF1__Homo_sapiens__NP_001020106
augccccuggugaagagaaacaucgacccucggcaccucugccauaccgcccugccgcgcggcauuaaaaaugagcuugaaugugucacaaacaucagccuggcuaauauuaucagacagcucuccucucugagcaaguacgccgaggauauuuucggggaacuuuuuaacgaggcgcacuccuucucuuuucggguuaauagccugcaagaacgcguggacagacucuccgugucugucacgcagcuggaucccaaagaggaggaacugagccuccaggacaucaccaugcggaaggcuuuccgcuccagcacaauccaggaucaacagcuguuugacagaaaaacccuuccuauuccccugcaggagacauaugaugugugcgaacagccucccccucucaacauccugaccccguaccgggacgauggaaaggagggccuuaaguucuauacaaaucccucuuacuuuuucgaccuguggaaagagaagaugcuccaagauaccgaagacaaacgcaaggagaaaagaaagcagaagcagaaaaaccuggaucggccucaugaacccgagaagguuccucgcgcuccccacgacagacggcgcgaauggcagaaacuggcccaagggccggagcucgccgaggacgaugccaaucugcuucauaagcacauugaaguggcuaacggaccugccucccacuuugagacgagaccccagaccuaugucgaccauauggauggcagcuacucucuguccgcgcucccuuucagccagaugucugaacugcuuacacgggccgaggaaagagugcugguucgcccccacgagcccccuccgcccccucccaugcauggggcuggagacgccaaaccuauccccaccuguauuuccagcgcuacaggccucaucgagaaucggccgcaauccccugccaccggcagaacgcccguguuugucucuccuacacccccucccccgccuccuccccugcccagcgcgcuguccaccagcucucuccgcgccuccaugacaagcaccccgcccccucccgugccucccccucccccgccucccgcuaccgcccugcaggcuccugccgugcccccgccucccgccccucuucagauugcucccgggguccugcaccccgcgccuccgcccaucgccccuccccucguucagccuucucccccuguggcucgggccgccccggugugcgaaacaguccccgugcacccucugccccaaggagagguucagggccuuccucccccgccuccuccuccgccccugcccccucccgggaucagacccagcucccccgugacggucaccgcucucgcccauccucccucuggacugcacccgacaccuagcaccgcgcccggcccucaugugccccugaugccucccuccccgccuagccagguuauucccgcuucugaacccaagcgccacccuuccacacucccggugaucagcgaugcccggucuguccugcuugaggccauuagaaaagggauccagcugcgcaagguggaggaacaacgggagcaggaagcuaagcaugagagaauugaaaacgacgucgccaccauccucucccgccggaucgcuguggaguauagcgauuccgaggacgauucugaguucgacgaaguugauuggcuggaauga

SEQ ID NO: 77837 - RNA, 1500 nt, Artificial Sequence
  derived and/or modified sequence opt5 from WASF3__Homo_sapiens__NP_001278894
augccccuggugaagagaaacaucgagccucggcaccucugccgcggcgcccugccggaagggauuaccagcgagcuugaaugugucacaaauuccacgcuggcugccaucauuagacagcucucuagccuguccaaacaugcggaggacaucuucggagaacuuuuuaacgaggcuaauaacuucuacauucgggccaauucucugcaagaucgcaucgacagacucgccguuaaggugacccagcuggauagcacaguggaggaagucucccugcaggacaucaacaugaaaaaggcuuuuaaaucuagcaccgugcaggaucaacagguuguguccaagaauagcauucccaacccugucgccgacaucuauaaucagucugauaagcccccuccccucaacauucugacaccuuaccgggacgauaaaaaggacggccuuaaauucuauaccgauccguccuacuuuuucgaccuguggaaggagaaaaugcuccaggauacagaagacaagcgcaaggagaaaagacggcaaaagcgcgagaaacacaagcugaaucccaacagaaaucagcaggucaacguucggaaagugcgcaccagaaaggaagagugggaacggcgcaaaauggggaucgaguuuaugagcgacgcuaagaaacuugaacaggccggaucugcgaaggaggauagagucccuuccggcagccaugccucugacgugacggauuauuccuaccccgcuaccccuaaucacagccugcauccccaaccggugacaccuuccuaugccgcuggggacgugcccccucacggacccgccucucaggcggccgagcacgaauaccggcccccuagcgcuuccgccagacauauggcucucaaccgcccgcagcaacccccucccccucccccgccucaggcccccgagggcagccaggccucugcuccuauggcgcccgccgauuacggcaugcugccugcucagauuaucgaauauuacaaccccuccgggccgccucccccucccccgcccccuguuauucccagcgcccaaaccgccuucgugucuccucugcagaugcccaugcagccucccuuuccggcuagcgccuccucuacacacgcggcuccuccccauccucccagcaccggacuccuggugacggccccgccucccccuggacccccucccccgcccccugggcccccuggacccggcuccagccuuucuuccagcccuaugcacgggccgcccgucgccgaggcuaagcggcaggaaccugcccaacccccuaucucugacgcuagauccgaucugcucgccgcgauccgcaugggcauucagcugaaaaaggugcaggagcagcgggagcaagaagccaaaagagagcccguuggcaaugacguggcuacaauccuuagccgccggauugccgucgaauauuccgauucugacgaugacagcgaguucgacgaaaacgauugguccgacuga

SEQ ID NO: 77838 - RNA, 1440 nt, Artificial Sequence
  derived and/or modified sequence opt5 from WASH1__Homo_sapiens__XP_011515960
augggcgccgugugcaccagcggggcuagauccgagcggacaaugacgcccguccgcaugcagcacucucuggccggacaaaccuacgcgguuccuuucauccagccggaccucagacgggaagaggcugugcagcagauggccgaugcccugcaauaucuucagaaggugagcggcgacaucuuuucccgcaucucucagcaggucgaacaaagcagaucccaggugcaggcuauuggggagaaaguuucucuggcccaggcuaagaucgagaaaauuaagggaagcaaaaaggccaucaagguguucuccagcgcgaaauaccccgccccuggccggcuccaagaguaugggucuaucuuuacaggagcucaggaucccggccugcagcgcagaccucggcaucgcauucaauccaagcacagaccccuugacgagcgggcccugcaggaaaaacucaaggauuucccugucugugugagcaccaaaccggagcccgaagacgaugcugaggagggccuugggggacugccuucuaacaucuccagcguuucuucccuccugcuuuuuaauacaaccgaaaaccuguacaagaaguauguguuccucgacccccuggccggcgcggucacaaaaacccaugugaugcuuggggccgagacggaagagaagcuguuugaugcuccucucagcauuuccaaacgcgaacagcuggagcagcaagugcccgagaauuacuucuaugucccggaccugggacagguuccugaaauccacgugcccucuuaccucccugaucugcccggcauugccaacgaccuuauguacagcgcugaucuggggcccggaaucgccccuuccgccccgggcaccauucccgagcucccuacauuucauaccgaaguggcugagccccugaaggucgaccuucaggacggcgugcugacaccucccccgccucccccucccccucccccggcgccugaaguucucgccagcgcuccuccccugcccccgucuaccgccgcccccguggggcagggagcuagacaagaugacuccagcucuagcgccuccccuucuguccagggcgcgccccgggaggugguugauccuagcgggggaugggcuacgcugcucgaguccauccgccaggccggcgggaucggaaaagccaagcugagaagcaugaaagaacggaagcuggagaagcagcaacagaaagaacaggaacaggugagagcuacaucucaaggcggccaccugauguccgaccucuucaauaagcuggucaugcgccggaaagggauuagcggaaagggccccggggccggagaaggcccugggggcgcuuuugugagagucucugauuccauucccccgcuuccucccccucagcagccccaagccgaggaggacgaagaugacugggagagcuga

SEQ ID NO: 77839 - RNA, 1509 nt, Artificial Sequence
  derived and/or modified sequence opt5 from WAS__Homo_sapiens__NP_000368
augagcggcgggcccaugggaggcagaccugggggacggggcgccccggcugugcagcaaaacauccccuccacccugcuccaggaccacgagaaucagcgccuguucgaaaugcuugggagaaagugccugacacucgccacggcggucguucagcuguaccuugcucugccucccggagccgagcauuggaccaaagaacacuguggcgccgugugcuuugugaaggauaacccucaaaaaucuuauuucauucggcucuacggccugcaggcugggcgccugcucugggagcaggaacuguauagccagcuugucuacuccacacccacccccuuuuuccauacauuugccggagacgauugucaagcuggccugaauuucgccgacgaggaugaggcgcaggccuuuagagcucucgugcaggaaaagauccagaaacggaaccaacgccagucuggggacagacggcagcugccgcccccucccaccccugccaaugaggaacgcagaggaggccuucccccgcugccucuccaccccgggggagaucaaggcggcccucccguugggccccugagccugggacucgcuacaguggacauucagaacccugauaucaccuccucucgguaucgcggccugccggcccccgggccuagccccgcggacaagaagagauccggcaaaaagaaaauuagcaaggccgauaucggcgcuccuucuggguucaaacaugucucccacgugggaugggacccccagaauggcuuugauguuaacaaucuugacccggaccugcggagccucuucucucgcgccggcaucuccgaggcucagcugacggaugccgagaccagcaaacuuauuuacgacuuuaucgaagaucaagggggacuggaggccgugagacaggaaaugcggagacaggagccucugcccccucccccucccccgucucgcggcgggaaccagcucccucggccucccauugucggaggcaauaaggggagauccggcccucugccgcccgugccucucggaaucgcucccccucccccuacaccccgcggcccgccucccccugggcggggaggacccccgccucccccuccucccgcgaccgggagaagcggaccccugccgcccccucccccuggcgccgggggacccccuaugccgcccccucccccucccccgccucccccucccuccucuggcaacggccccgcuccuccgccccuuccucccgcccuggugccugccgggggacucgcucccggcgggggacgcggcgcccugcuugaccaaauucggcaggggauccagcugaauaagacaccgggcgcgccugaaagcuccgcucuccagcccccuccccaaagcucugagggacuggucggcgcccugaugcacguuaugcagaagagaucccgcgccauucauagcucugaugagggggaagaccaggcuggagaugaggacgaagaugacgagugggaugacuga

SEQ ID NO: 77840 - RNA, 1518 nt, Artificial Sequence
  derived and/or modified sequence opt5 from WASL__Homo_sapiens__NP_003932
augagcuccgugcagcaacagcccccuccgcccagacgggucaccaacguuggcucucugcuccugacaccucaggagaaugaaagccuuuucacguuucuggggaagaaaugcgugaccauguccucugccgugguccagcucuacgcugccgaccgcaacuguauguggagcaagaaaugcuccggaguggcgugucugguuaaggauaauccccaaagaucuuauuuccuucggaucuuugacauuaaagauggcaagcugcucugggagcaggaacuguacaacaauuucguguauaacagcccucgcggguacuuucacacauucgcuggagauaccugccaggucgcccugaauuuugccaacgaggaagaggcuaagaaauucagaaaggccgugacagaccuccugggccggcgccagagaaaauccgagaagcggcgcgaucccccuaaugggccgaaccuucccauggcuaccguugacaucaaaaauccugaaauuacaaccaacagauuuuauggaccccaagugaauaacaucagccauacgaaggagaagaaaaagggcaaagccaagaaaaagcggcugaccaaagcggacauuggcacaccuucuaauuuccagcacaucgggcaugucggaugggaucccaacaccggcuuugaccucaacaaucuggauccggaacuuaagaaccuguucgacaugugugggaucuccgaggcccagcucaaggaucgcgagacaagcaaagugauuuacgacuuuaucgaaaagaccggaggcguggaggcugucaaaaaugaacugagacggcaggccccucccccucccccucccucucgcgggggaccgcccccucccccucccccgccucacaacuccgggcccccucccccucccgcuagaggccggggcgccccgccucccccucccagcagagcgccgacggccgcucccccucccccucccccuucucgccccuccguugccgugccgccucccccucccaaucggauguauccgccucccccucccgcucugcccagcuccgccccuucuggaccgcccccucccccucccagcgugcucggcgucgggccuguggccccgcccccucccccucccccgccucccccucccggacccccuccgcccccuggccugcccuccgacggggaucaucaaguuccuacaaccgcuggaaacaaggcggcccuucuggaccagauuagagagggcgcucagcucaaaaagguggaacaaaauagccgccccgucucuugcuccggccgggaugcccugcuugaccagaucagacaggggauucagcucaagagcguggccgauggacaagagucuacaccgccuacccccgcuccuaccagcggcaucguuggggcccugauggaggugaugcagaaacgcuccaaggcgauucacucuagcgacgaagaugaggacgaagaugacgaggaagauuucgaggacgacgaugagugggaagacuga

SEQ ID NO: 77841 - RNA, 1092 nt, Artificial Sequence
  derived and/or modified sequence opt5 from WBP1L__Homo_sapiens__NP_001077382
auggagagacggcgccugcucggcgggauggcccugcuucugcuccaggcucugcccagcccucuuuccgccagagcggaaccgccccaagacaaggaggcuugcgugggaaccaacaaucagucuuacaucugugauacaggccacugcugugggcagagccagugcuguaacuauuacuaugaacuguggugguucuggcucgucuggacgauuaucauuauccuguccugcuguugcguuugucaccaccggcgcgccaaacauagacugcaagcccagcagcggcagcacgagauuaaucucaucgcuuaccgcgaagcccauaacuauucugcucugccuuuuuacuucagauuucuucccaauuaucugcucccucccuacgaggagguggugaaccggccuccgaccccgccucccccuuacagcgccuuccaacugcagcagcagcaacuucugcccccgcagugcggaccugcgggcgggucucccccuggaaucgaccccacacgcggcucccagggcgcccaaagcagcccccucuccgaaccuucuagauccagcacccggccgcccucuauugcugauccugaccccuccgaucugccugucgaccgcgccgcuacaaaggcccccgggauggagccgagcggaucuguggcgggccugggggaacucgauccuggagccuuucuggacaaagaugcugaguguagagaggaacuucugaaggacgauuccagcgagcacggcgcccccgacuccaaagaaaagaccccugggcggcaccgcagauucacaggagauucuggcaucgagguuugcgugugcaaucggggccaucacgacgacgaucucaaggaauuuaacacccugauugacgaugcucuugacgggccccuggauuucugugacagcugccaugucagaccucccggagaugaggaggaaggccucugucaguccagcgaggaacaggcccgcgagccggggcacccucaucugccccggcccccugccugccugcuccugaauacgaucaacgaacaggacucucccaauucccaaagcucuagcucccccucuuga

SEQ ID NO: 77842 - RNA, 786 nt, Artificial Sequence
  derived and/or modified sequence opt5 from WBP2__Homo_sapiens__NP_036610
auggcccugaacaagaaucacagcgagggcgggggagugaucgucaacaauaccgaauccauucucaugucuuacgaccauguugagcugacauucaacgauaugaaaaaugugcccgaggcuuuuaagggcacgaaaaaggggaccguguaucuuacaccuuacagagucaucuuccugagcaaaggaaaggacgccaugcaguccuuuaugaugccguucuaucucaugaaggauugcgaaauuaaacaacccguguuuggcgcgaacuacaucaaggggaccguuaaagcugaagccggaggcggcugggaggggucugccagcuauaagcugacauucaccgcuggaggcgccauugaguuugggcagcggaugcuucagguggcuucccaggccucucgcggagaagucccuagcggcgcguacggguauuccuacaugcccagcggagccuacguguauccucccccuguugcuaauggcauguacccgugucccccuggcuaucccuacccucccccgccucccgaguucuauccugggccucccaugauggacggagccaugggcuacgugcaacccccgcccccucccuauccugggcccauggaaccgccugucucuggacccgaugugccuuccacacccgcugccgaggcgaaagccgcugaggccgcugccagcgccuacuacaacccuggcaauccccacaacguguauaugccgaccucucagccucccccucccccguacuaucccccugaagacaagaagacgcaguga

SEQ ID NO: 77843 - RNA, 1797 nt, Artificial Sequence
  derived and/or modified sequence opt5 from WBSCR17__Homo_sapiens__NP_071924
auggccagccugagacgggugaagguccuccugguucuuaaccugaucgcuguggccggcuucgugcucuuucuggcgaaaugccgccccauugcugucagauccggggacgccuuccacgagauccggccucgcgccgaaguggcuaaucuuucugcccauagcgcuuccccgauucaggaugccguucugaagagacucucucugcuggaggacaucguguaccggcaacucaacggacugagcaaaucccuuggccugauugaaggguauggaggccgcgggaagggaggccuccccgcgacccugucuccugccgaggaagagaaagcuaagggcccccacgagaaguacggguauaauagcuaccuuuccgagaaaaucagccuggauagaucuaucccugacuaucggcccacaaaguguaaagagcucaaguacuccaaagaucugccucagauuagcaucauuuuuaucuucgucaacgaagcccugucugugauucuccgcuccguucauagcgcugugaaucacacgccgacccaucugcuuaaggagaucauucuggucgacgauaacucugacgaggaggaacucaaggugccccuggaagaguaugugcacaaaagauacccuggacuugucaagguugugcggaaucagaaacgcgaaggccugaucagagcccggaucgagggguggaagguggcgacaggacaggucaccggcuuuuucgaugcccacguggaguuuacagcugggugggccgaacccguucucucccgcauucaagagaacagaaaacgggugauccugccuagcauugacaauaucaagcaggauaacuucgaaguccagagauacgaaaauuccgcucauggauauucuugggaacuguggugcauguacauuagcccgcccaaagacuggugggaugccggcgacccuucccuccccauccgcaccccugccaugaucggcuguagcuuugugguuaaccggaaguucuuuggggagauuggacugcuugaccccggcauggauguguaugggggagagaauaucgaacugggcauuaaggucuggcucugcgggggaucuauggaggugcugcccuguuccagagucgcucacaucgaacgcaaaaagaaaccuuacaacagcaauauuggcuucuauacaaagcggaacgcgcuuagaguggccgagguuuggauggacgauuacaaaucucauguguauaucgcuuggaaccugccgcucgaaaaucccggcaucgacauuggggaugucagcgagcgccgggcccugagaaagucccugaagugcaaaaacuuucagugguaccucgaccacguguacccugagaugcgccgguauaauaacaccguugccuacggagaacugagaaauaacaaggcuaaagaugugugucuugaccaaggcccccuggagaaucacacggccauccucuauccuugccauggguggggaccccagcuggcgcgcuacaccaaggaaggcuuccugcaccuuggggcucucggcacaaccacacugcugccggauacccggugucucgucgacaacucuaaaagcagacugccucagcuucuggauugcgacaaggugaaguccagccucuauaaacgguggaauuucauucagaacggagccaucaugaauaagggcacggggcgcugucuggagguggagaacagaggacuggccggcauugaccuuauccuccggucuugcacagggcaaagauggaccauuaaaaauuccaucaaguga

SEQ ID NO: 77844 - RNA, 897 nt, Artificial Sequence
  derived and/or modified sequence opt5 from WBSCR22__Homo_sapiens__NP_001189489
auggccagcagaggccggcgccccgagcacgggggaccuccggaacuguucuacgacgagaccgaagcuagaaaguaugugcggaacucccgcaugaucgauauucagacaagaauggccggccgggcgcucgagcugcuuuaccugcccgaaaauaaaccuugcuaucuccuggacaucggguguggaacgggccuuucugggagcuaccuguccgaugagggacauuauugggucggccucgacauuucucccgcuaugcuggaugaggccguugaccgcgaaaucgagggcgaucugcuccugggggacaugggacaaggcauuccuuuuaagcccgggaccuucgauggaugcaucagcaucuccgccgugcaguggcuuuguaacgcuaauaaaaagucugaaaacccugccaaaagacuguacugcuuuuucgcuagccucuuuuccgugcugguccggggcagccgcgccgugcuucagcuguauccggaaaauucugagcagcucgagcugauuacaacccaagcgacaaaggccggguucuccggaggcaugguuguggacuaccccaacagcgcuaaggccaaaaaguuuuaccugugucucuucucuggcccuuccaccuuuauccccgaggggcugagcgaaaaucaggaugaggucgaaccuagagagucuguguucacaaacgagcgggaaggaggcgcuuuugagcgcagagggauucggggacaccagacccgcagauucccccuucggauguccagacgcggcaugguucggaaaagcagagccugggugcuggaaaagaaagagcgccaucggagacaggggcgcgaaguccggccggacacgcaauauaccggaagaaagcgcaagccucgguuuuga

SEQ ID NO: 77845 - RNA, 1203 nt, Artificial Sequence
  derived and/or modified sequence opt5 from WDFY2__Homo_sapiens__NP_443182
auggccgcugagauccagcccaagccucugaccagaaaaccgauucuccugcaacggauggaaggcagccaggagguggucaacauggccguuaucgugcccaaggaagagggggugauuuccgucucugaagaccgcacagugagaguuuggcuuaaacgggauagcggacaguacuggccuuccguguaucacgcgaugcccucuccuugcagcuguauguccuucaaucccgagacgcgcagacugucuaucggccucgacaacgggaccauuagcgaguuuauccuguccgaagauuacaauaagaugacaccugucaaaaacuaucaggcucaucaaagccgggugaccaugauccuuuucguucuggagcucgaaugggugcugucuacaggacaggacaagcaguuugccuggcacugcuccgagagcggccagcgccuugggggauacagaaccucugccgucgcuuccggccuccaauucgauguggagacacggcauguguuuauuggcgaccacagcgggcaggucaccauccugaagcuggaacaggagaauuguacgcugguuaccacauuccgcggacauaccggcggggugacagcccucugcugggauccggugcagagaguccuguuuucuggauccagcgaccacuccgugauuaugugggauaucggcgggcggaaaggaaccgcuauugaacuucaaggccacaacgaccgcguucaggcccugucuuaugcgcagcauacgagacaacucaucagcuguggcggggauggaggcauuguggucuggaauauggacguggagcggcaggaaacacccgaguggcuggauuccgacagcugccagaagugugaccagccuuucuuuuggaacuucaaacaaaugugggauucuaagaaaaucgggcugcgccagcaccauugcagaaaguguggaaaggccguuugcggcaaauguuccagcaagcggucuagcaucccccucaugggguuugaguucgaagugagagucugcgacuccugccacgaggcuauuaccgaugaggaacgcgccccuacagcuaccuuucacgacucuaaacauaauaucgugcacguccauuucgaugccacccggggauggcugcuuacaagcggcacggacaaggugauuaaacugugggauaugacccccguuguguccuga

SEQ ID NO: 77846 - RNA, 9555 nt, Artificial Sequence
  derived and/or modified sequence opt5 from WDFY4__Homo_sapiens__NP_065996
auggaagccgaagaccugagcaaggcugaggaucggaacgaagaccccggcuccaaaaaugaggggcagcucgccgcggugcaaccugaugucccgcacgggggccagucuagcucccccaccgcucugugggacaugcuugaacggaaguuccuggaguaccagcagcucacacauaaaucuccuaucgagcgccaaaagagccugcuuucccugcucccccuguuucugaaagccugggaacacucuguugggauuauuugcuucccuagccuccagagacuggccgaggauguguccgaccagcuugcucagcaacugcagaaggcccucgugggaaagcccgcugaacaggcccggcuggcggccggccagcuucugugguggaaaggggaugucgaccaagauggauaucuccugcucaaauccguguacguucucacgggcaccgacucugagacacugggccgcguggcugaguccgggcuuccugcccugcuccugcagugucuuuaucuguuuuucgucuuuccgcucgauaaagacgaacugcuggagagcgaucuccaggugcaaaagauguucguucagaugcugcuuaacauuugcucugacucccagggacuggaaggccuccugagcgggucugagcuucagucccugcucaucgcuaccacaugucugagagaacauagcugcuguuuuuggaaagagcccaccuucugcgugcugcgggccauuuccaaggcgcaaaaucucucuaucauccaguaccugcaggccacagacuguguccgccuuagccugcagaaccucuccagacugaccgauacgcugccugcucccgaggugagcgaagccgugucucuuauucucggauuugucaaggacuccuauccuguuagcucugcucuguuccuggaguuugaaaauagcgagggcuacccccuccugcuuaaagugcugcuccgguaugaugggcugacccaauccgaaguggacccgcaccuggaggagcuucucggacuggucguguggcugacaaccugcggccgcucugaacucaagguuuucgauagcaucacauacccucagcuggagggcuuuaaauuccaucacgaagccuccggggugaccgucaagaaccuucaggccuuccaggugcugcaaaauguuuuucacaaagcuagcgacucugugcucuguauucagguccuguccgugaucagaacgaugugggcguggaacgcccggaauuucuuucugcuugaguggacacuccagcccauuagccaguucgucgaaaucaugccucugaagcccgcucccgugcaagagcacuucuuccagcugcucgaggcccugguuuuugaacuucacuacgugccucaugagauucugcgcaaaguccagcaccucaucaaggaaucuccgggacccuccugcacccugauggcccugcaaagcauccuuuccauugcuggcggggauccucucuucacagacaucuuuagagauucuggacugcugggccuccugcuugcccagcugcggaagcaggcgaaaauuaugcgcaagagcgggaacaaaguguccacccccggaguucaggacccugagagagagcucaccugugugaugcugcggaucgucgugacacugcuuaagggcucugugagaaaugcuguuguccugaaagaucacggcauggugcccuucauuaagaucuuucucgacgacgaaugcuaucgcgaggccagccuguccauccucgaacaacugagcgccauuaacgcugaggaauacaugucuaucauugugggggcccuuugcuccagcacgcagggagagcugcagcucaagcuggaucugcuuaaaucucugcuccggauccuggucaccccgaagggcagagcugccuuccgcguguccagcggguuuaauggacuccugucucuucugagcgaccucgagggcucccugcaggaaccuccccugcaagcguggggagcuguuagcccucggcagacacuugagcuggugcucuauacccugugugcugucucugccgcucuccauugggaucccgugaacggcuacuucuucagacgcaauggacuguuugaaaaacuugccgaggaccugugccugcucggcuguuucggggcgcuggaagaggagggaaaccuucugcgguccuggguugauacaaaggccagaccuuuugcugaccuccugggcaccgccuucagcuccucugggagccugccuccccgcauucaguccugccugcagauccuuggauuucuggauucuauggcuagcggcacgcugcaccucagaggggaccugaaagaaucccuuagaacaaagcaaggccccguggucgaugugcagaagggagagaccggcucugacccccagcgcaacuucaaacaauggcccgaucuggaagaacggauggacgaaggggaugccgccaucaugcauccuggaguuguguguauuauggucagacuccugccgcggcucuaucacgaggaccauccccagcugagcgaggaaauccagugcucccuugcuagccacauucagucucuggugaaguccgagaaaaaucgccaagugaugugugaagcgggccugcucgggacccugauggccagcugccacagagcucuugucacaucuggauccccucugcauagccggcucaucagaauuuuugagaagcuggccucucaggccaucgagcccgacguucuccgccaguuccugggccuugggauuccuuccagccuguccgcuaccacaaaaauccuggauagcucucacacgcaucggggcaaccccggauguagcggcucccagaccgcccaagggcucgcggaaggaccuuggcccgcugccccggacgccggccugcacccuggggugacacaggcuccccagccucuuggagagucucaggauagcaccacagcccugcaaaccgcgcucucccugaucucuaugacgagccccagaaaucugcagccgcagcgcgcugcccucgccccuuccuuuguggaguucgacaugucugucgagggcuacgggugccuuuuuauucccacccugagcacagugaugggcaccuccacagaauauagcguuucuggaggcaucgggaccggagcuacgagaccuuuuccgcccccuggcgggcugacauuuuccuguugguuccucauuagccggcacggagccgcuaccgagggccauccgcugcgcuuccuuacacuggugagacaccucgcccggaccgagcagcccuuugucugcuucucugugucccugugcccugaugaccugagccucguuguguccaccgaagagaaggaauuucaaccccuugaugucauggagccugaagacgauucugagcccagcgcgggcugucagcugcaagugcgcugcgggcaacugcucgccuguggacaguggcaucaccuggcuguuguggucacaaaggagaugaaaagacauugcacgguguccaccugucuugacggccaggugaucgggagcgccaagaugcuguacauucaggcucucccuggaccguuccugucuauggaucccuccgccuuugucgacguuuacggcuauaucgccacaccucggguguggaaacaaaagagcucucugaucuggcgccucgggcccaccuaccuuuucgaagaggcuauuagcauggaaacacuggaggugaucaacaaacugggaccuagauauugcggcaauuuucaggcgguccacgugcagggcgaagaucucgacuccgaggccacccccuucguugcugaggaacgggugucuuuugggcugcacauugccagcuccucuaucacgagcgucgccgacauucgcaacgcuuacaaugagguggauuccagacuuaucgccaaggaaaugaacaucagcucucgggacaaugcgaugccgguuuuccugcucagaaacugugcuggacaucuguccggcagccugcgcacaauuggggccguggccgucggacagcucggcgugcgggucuuucacuccucuccugcugccagcucccuugauuucaucgggggacccgcgauucugcugggccucaucucucuggcuaccgacgaucauaccauguaugccgccgugaaaguucuucacagcgugcugacauccaaugcuaugugcgacuuccucaugcaacauauuuguggcuaccagaucauggccuuucugcugagaaagaaggcuagccuccuuaaccaccgcaucuuccagcugauucugucugucgccgggaccguggagcucggauuucgguccagcgcgaucacaaauacgggcguuuuccagcacauucugugcaacuuugagcuuuggaugaauaccgccgauaaccuggaacucucucuguucucccaucugcucgagauccuucaaagccccagagaagggccucgcaacgcugaggccgcucaccaggcccagcugauucccaaacugaucuuucucuucaaugaaccuucucugauuccgagcaagaucuccacaaucauuggaauccuugccugucaacugcggggccauuuuucuacccaggaccuccugagaauugggcuguucguggucuauacacucaaacccagcuccgugaacgagcgccagaucugcauggauggagcucuugacccuagccugcccgcgggcucccagaccucuggcaagacgauuuggcugcggaaucaacuccuggagaugcuucugagcgugaucuccucuccucagcuccaccugagcuccgaaucuaaagaggaaauguuucugaagcucgggcccgauugguuccuucugcugcuccagggacaucugcaugccagcaccacaguucuugcucugaagcuccugcuguacuuucucgccuccccgagccuuagaacccgguuccgcgacggccugugcgccgggucuugggucgagagauccacagaaggaguggacaucgugauggauaaccugaaaagccagucuccucuccccgagcaauccccuugucugcuucccggcuuccggguccugaaugacuuucucgcucaccaugugcacauuccugagguuuaccugaucgugagcaccuucuuucugcagacaccccucaccgaacugauggaugggccgaaggacucucuugaugccaugcugcaguggcuccugcagcgccaucaccaagaggaaguccuucaggcgggacugugcacggagggcgcucuccugcugcucgaaaugcugaaagccacaaugucccagccucuugccggcagcgaggacggggcuugggcccagaccuuccccgcguccgugcugcaauuucucagccugguucacagaaccuauccccaggauccugccuggcgggcuccggaguuccuucagacacuggccauugcugccuuuccccucggagcucaaaagggcgugggggccgaaucuaccagaaacacgagcuccccugaggcggccgcugaaggagacucuacagucgagggccugcaggcccccaccaaagcucauccugcccgccggaagcugagagaguucacacagcuccugcuucgcgaacugcuccugggggccagcucccccaagcaguggcuuccucuggaggugcuccuggaggcuucuccggaucacgcgaccagccaacagaaacgggacuuucaguccgagguucugcucucugccauggaacuguuccauaugacaagcggaggcgaugcugccauguuuagagacggcaaggagccccagccuuccgccgaggcugccgcggcccccagccuugcuaauaucucuuguuucacccaaaaacugguggaaaagcucuacuccgggauguuuagcgccgauccucgccacauucugcuuuucauccuggagcacaucauggucgugauugaaacggcuucuucccagcgggacaccgugcucagcacacuguauuccucucugaacaaagucauccucuacugccugagcaagccccagcagucccuuagcgagugucugggacuccugucuauucuuggcuuccugcaagaacauugggacguuguguuugccaccuauaauuccaacaucagcuuccuccugugccugaugcacugucuccugcuucugaaugagagaucuuacccggagggguuuggacucgaaccuaagccccgcaugagcacauaucaucagguguuccugucccccaacgaggaugucaaagaaaagagagaggaccuuccuucucugagcgaugugcagcacaauauucagaagaccguucagacgcucuggcagcagcugguggcgcaacggcagcagacacuggaagacgccuuuaagaucgaucucuccgucaaacccggcgagcgcgaggugaagauugaagagguuaccccucugugggaagagacaaugcuuaaggcuuggcagcauuaccuggccucugagaaaaagagccucgcuuccagaagcaacguggcccaccacucuaaagucacccugugguccgggagccuuuccucugcuaugaagcugaugccgggacggcaagccaaagaccccgaaugcaagaccgaggauuucgugagcuguaucgaaaauuaccgcagacggggccaggagcucuaugcgucccuguacaaagaccauguccagagacgcaagugcggcaacaucaaggccgcuaacgccugggcucggauucaggaacaacuguuuggggagcuuggacuguggucucagggcgaggaaacaaaaccuuguagccccugggagcucgauuggagagaagggccugcccgcaugcggaagagaaucaaacggcugagcccccucgaggcccugagcucuggacgccacaaggaaucccaggacaaaaaugaucauauuagccaaacgaacgcggagaaucaggacgagcuuacccugagagaagcugagggcgaaccggaugagguggggguugacugcacacagcugaccuucuuuccugcccuccacgaaucucugcacuccgaggacuuccuugagcugugccgggaacgccaggugauccuccaagagcugcucgauaaggaaaaggugacacagaaauuuagccuggucauuguucagggccaucuggugucugagggagugcuucuguucggccaccagcauuuuuauaucugugagaacuucacccucucccccacgggggacgucuacugcacaagacacugucugagcaauaucucugauccuuucauuuuuaaccuuugcagcaaggaccgguccaccgaucauuauagcugucaaugccacuccuacgcugacaugcgcgaacugagacaggcccgguuccuccugcaggauaucgcccucgagaucuuuuuccacaauggauauucuaaauuucugguguucuacaacaaugaccgcagcaaggcuuuuaaauccuucuguucuuuucagcccagccugaagggcaaggccaccuccgaagauacacuuucucugagacgguacccugggagcgacagaaucaugcuccaaaaauggcagaagcgcgauauuuccaacuucgaguaucugauguaccuuaauaccgcggccggacggacaugcaacgacuauaugcaguaccccguuuuuccgugggugcuggcugacuauacgagcgaaacccucaaucuggccaacccuaaaaucuucagagaucugucuaagcccaugggcgcucagacaaaagagcgcaagcucaaguuuauccaacgguucaaagaggucgaaaagaccgagggggacaugacagugcagugucauuacuauacccacuacuccagcgccauuaucgucgcgucuuaccuggugagaaugcccccuuucacgcaggccuuuugcgcccuucagggcggauccuucgauguugccgaccgcauguuucauagcgugaaaucuaccugggaauccgcuagccgggagaauaugucugaugucagagaacugacaccggaguucuuuuaucuccccgaguuccugaccaacuguaacggcguggaauuugggugcaugcaggacggaacaguucuuggcgaugugcagcugccucccugggccgacggggauccucgcaaguucauuucccuccaccggaaagcucuggagagcgacuuugucagcgccaaucugcaucacuggaucgaucucauuuucggauacaagcagcaaggccccgcggccguggacgcugugaacaucuuucacccuuauuucuacggggauagaauggaccuguccucuauuaccgacccccuuaucaaaagcacaauccugggcuuuguuuccaauuucggacaggucccgaagcaacucuucacgaagccucaucccgcccgcaccgcugccggcaaaccucugcccgggaaggaugugucuacaccggugagccuuccuggacacccccagcccuuuuucuauucccugcaaucucuccggccuagccaggucaccguuaaagacauguaccuguuuucccugggcagcgaaucucccaagggggccauuggacauaucguguccaccgagaaaacaauucucgcgguggaaagaaacaagguccugcuuccuccgcuguggaaucgcacguucagcuggggcuuugaugacuucucuugcugucucggcuccuaugggagcgauaaggugcugaugaccuuugagaaccuugcugccuggggaagaugccugugugccguuugccccuccccuacaaccaucgugacaucuggcaccagcacggucguguguguuugggagcucuccaugacaaaagggcggccccgcggacugagacugcggcaggcucucuacggccacacccaggccgugaccugccuggcugccucugucacauucagccuucugguguccgggagccaagacuguaccugcauucucugggaucuggaccaccuuacacaugugaccagacugccugcgcaccgggaaggaaucucugccaucacgauuuccgaugucagcggcacaaucguuucuugugcuggcgcccaucucagccuguggaaugugaacgggcagccccuggcuuccauuaccacagccuggggaccugagggcgcgauuaccugcuguugccucauggaagggccggccugggacacgucucagaucaucaucaccggaagccaagauggcauggugcgcgucuggaagacagaggacgugaaaauguccguucccgggagaccugcuggagaggaacccccugcccagcccccgagcccucggggccacaagugggagaaaaaucuggcucuuucucgcgaacuggacguguccauugcccucaccggcaagcccagcaagacaucccccgcugucaccgcccuggcggugucuagaaaccauacaaaacuucugguuggggaugagcggggacgcaucuuuugcuggagcgccgacggcuga

SEQ ID NO: 77847 - RNA, 3021 nt, Artificial Sequence
  derived and/or modified sequence opt5 from WDHD1__Homo_sapiens__NP_001008397
auggacagcucccagcaaaagaccuucagaggccacgaugcccccgugcugucucucagcuuugacccuaaagauaucuuccuggcuuccgccucuugcgacgggagcguccggguuuggcagauuuccgaucagacaugugcgaucucuuggccgcuucugcagaagugcaacgacgugauuaaugcuaaaagcaucugucgccucgccuggcaacccaaguccggaaaacugcuugccauuccuguggaaaagagcgucaagcuguacagacgggaaucuuggucccaucaguuugaucucagcgacaacuucaucucucagacgcugaauaucgugaccuggucccccugcggccaguaucuggcugccgggagcauuaacggacucaucauuguuuggaauguggagacaaaagauuguauggaacgcgucaagcacgagaaaggcuacgcuaucugcgggcuggccuggcauccuaccuguggaagaauuucuuauacagacgcggaaggcaaccuuggccugcucgagaaugugugcgaucccuccgggaagaccagcuccucuaaaguuagcucccggguggagaaggacuacaacgaucuguuugacggagacgauaugagcaaugccggcgacuuccuuaacgauaaugcugucgaaaucccuucuuuuuccaaggggauuaucaacgacgaugaggacgaugaagaccugaugauggccagcggacgcccgagacaacggucucacauccucgaggaugacgagaauagcguggauauuuccaugcugaaaacaggcucuagccugcucaaggaagaggaagaggacgggcaggaaggauccauccauaaccugccccuugugaccagccagcgcccuuucuaugacggccccaugccuacgcccagacagaaaccguuucaaucuggcuccaccccucugcaccucacacaccgguucauggucuggaauagcauugggaucauucgcuguuacaacgaugagcaggacaacgcuaucgauguugaguuucaugacaccucuauccaccaugccacacaccuguccaauacccuuaacuauacgauugcggaucugagccacgaagccauccuccuggcuugcgaguccacagacgaacuggccucuaagcuccauugucugcacuucagcuccugggauucuagcaaagaguggauuaucgaccuuccccagaaugaagauauugaggcuaucugccugggacaaggcugggccgccgcugcgaccuccgcccuccugcuuagacuguuuacaaucgggggagugcagaaggagguguucagccucgcuggcccugucgugucuauggccgggcauggagaacagcuguucauuguuuaccaccggggcaccggcuuugacggggaucagugccugggagugcaacuccuggagcuuggcaaaaagaagaaacagauccugcauggggacccccucccccugacccgcaaguccuaccuggccuggauuggauucagcgcugaaggcacaccuuguuaugucgauucugaggggaucgugagaaugcuuaaccggggccucggaaauacguggaccccgauuugcaacacaagagaacacuguaaaggcaaguccgaccacuacuggguuguggggauccaugagaauccccagcagcugcgcugcauuccuuguaaaggaagccgguuucccccuacccugcccagaccggccgucgcgauccucucuuucaagcugccuuauugccaaaucgcuacagagaagggccagauggaggagcaguuuuggcgcagcgugauuuuccacaaccaucuugacuaccuggccaaaaauggguaugaauacgaggaguccaccaagaaccaggccacgaaagaacaacaggagcuccugaugaagaugcuggcucuuagcuguaaacucgaacgggaguuuagaugcgucgaacuggccgaucugaugacacagaaugcugugaaccucgccaucaaguaugcgucucgcucccggaagcugauucuugcccagaaacugagcgagcucgcuguugagaaggccgcugaacugaccgccacccaaguggaggaagaggaagaggaggaagacuucagaaagaagcugaaugcgggauacuccaacacagccaccgaguggucucagccccgcuuucggaaucaggucgaagaggaugcugaagacagcggcgaggccgaugacgaggaaaaaccugagauccacaagcccgggcaaaacuccuucucuaagagcacaaacuccucugaugugagcgcuaaauccggcgccguuacguuuagcucucagggaagagugaauccuuucaaggucuccgccagcucuaaagaacccgcuauguccaugaacagcgcgcgcucuaccaauauucuugacaacaugggcaaguccagcaaaaaguccacagcccucagccggaccacaaauaacgagaaaucuccgaucaucaagccucugauucccaagcccaaaccuaagcaggcuagcgccgccuccuacuuucagaaaagaaauucucaaaccaacaagacggaggaagugaaagaggaaaaucugaagaacgugcucagcgagaccccggcuaucugucccccucagaauacagaaaaccagcggcccaagaccggguuccagauguggcuggaggagaaucgcuccaacauucuuucugauaauccugacuucagcgaugaagccgacaucauuaaagagggaaugaucagauuucggguucuguccacagaagagagaaaggucugggcgaacaaagcuaagggcgaaaccgccucugaggggacggaggccaaaaagcgcaagcgggugguggaugaaagcgacgagacagaaaaccaagaggaaaaagcuaaggagaaucucaaccuguccaaaaagcagaaaccccuggacuucagcaccaaucagaaacuuucugccuuugcguucaagcaggaguga

SEQ ID NO: 77848 - RNA, 2241 nt, Artificial Sequence
  derived and/or modified sequence opt5 from WDPCP__Homo_sapiens__NP_056994
augagacgggaguucugcugggacgccuacagcaaggcugccggcucccgcgcgucuagcccccugccuagacaggaucgggacuccuuuugucaccaaaugucuuucugccucaccgaacugcaucuuuggagccugaaaaacacacuccacaucgcugaucgcgacauugggaucuaucaguacuaugauaagaaagacccgcccgccacggagcauggaaaucuggaaaagaaacagaagcuggccgaguccagagauuacccuuggacccugaagaaccggcgccccgaaaaacucagagacucucugaaggagcuggaggaacucaugcagaauagccggugugugcuguccaaauggaagaacaaauaugucugccaacuucuguuuggcagcgggguucucgugucucugucccuuagcggaccucagcuggagaagguggucauugaucgcucucucgugggcaagcugaucuccgacacaauuagcgaugcucugcucaccgacucuuucaucauccuguccuuucuugcccagaauaaacuguguuucauucaguuuacaaagaaaauggaaagcuccgauguuaacaagagacucgagaaacugucugcucuugacuacaagaucuucuauuacgagauucccgggccuaucaauaaaaccacagaacggcaccuggccauuaacugcgugcaugaccgcgucguguguugguggccgcucguuaaugaugacgcguggcccugggccccuaucagcuccgagaaggauagagcuaaccugcugcuccugggauacgcccaaggccggcuugaagugcugagcucuguccgcaccgagugggacccccucgaugugagauuuggcacgaagcagccuuaucagguguucaccgucgaacacuccguuagcguggacaaagagcccauggcugauucuugcauuuacgaguguauccggaauaagauccagugcgugagcgucacacgcauuccgcugaaauccaaggccaucucuuguugcagaaacgugaccgaagacaaacuuauucuggggugcgaggauagcucccucauccuguaugaaacacaccggagaguuacccugcucgcgcaaacggagcugcuuccuagccugauuucuugucaucccuccggagccauccuccuggugggcagcaaucagggggaacugcagaucuuugacauggcucuuucuccuauuaacauccaacuccuggccgaggaucgccugccccgggagacacuccaguucuccaagcuguuugacgcuagcuccucucuuguccagaugcaguggauugcuccccaagugguuagccagaagggagaaggcuccgacaucuacgaucuucucuuccugagauucgagcgcgggccucugggagugcuucucuuuaaacugggcgucuucacccggggccagcuggggcucauugacaucaucuuucaguauauucacugcgaugaaaucuacgaggccauuaauauccugucuagcaugaacugggacacacuuggacaucaauguuucauuuccaugagcgccaucgugaaccaucugcucagacagaagcugaccccggaacgcgaggcgcagcuggagaccucucuuggcacauuuuaugcccccacgcggccucuccuggauuccaccauucuggaauacagagaccagaucagcaaauacgcucgccgguucuuucaccaccuccugagauaucaacgguucgagaaggccuuucuucuggccgucgaugugggggcucgcgaccucuucauggauauccacuaccuggcccuggacaaaggagaacuugcgcucgcugagguugccagaaagcgggccucugauauugacgcugaguccaucacaagcggcguggaacugcuggggccccucgauagaggagacaugcugaaugaggccuuuauuggccuuucucuggcuccucagggcgaagacagcuuccccgauaaccucccgccuuccugccccacccaucgccacauccugcagcagcggauucugaaugggagcucuaacagacaaaucaucgaccgcagaaaugagcuugaaaaggauauuuguuccggauuucugaugacaaauaccugcaacgccgaggacggcgagcuccgggaagaugggcgcgagcaggaaaucagagacggaggcagccugaaaaugauucauuucgggcucgucuga

SEQ ID NO: 77849 - RNA, 3675 nt, Artificial Sequence
  derived and/or modified sequence opt5 from WDR11__Homo_sapiens__NP_060587
augcugcccuacaccgugaacuucaaggucagcgccagaacacucacgggcgcucugaaugcccacaacaaagcggcuguugacuggggguggcagggacuuaucgccuauggcugccauucccuggugguggucauugauucuaucaccgcccaaacacuccaggugcuggagaagcacaaagcugacguugugaaggucaaaugggcccgggaaaauuaccaucacaacauugggagcccuuauugucuucgccuggcuuccgccgaugugaauggaaagaucauuguuugggacguggcggccggcgucgcucagugcgagauccaggaacaugccaagccgauccaagaugugcaguggcucuggaaccaggacgcuucuagagaucugcugcucgccauucaucccccuaauuacaucgugcuguggaacgcggacaccgggacaaaacuuuggaagaaaagcuaugccgauaauauucuguccuuuucuuucgaccccuuugauccuagccaccucacccugcuuacauccgagggaaucgucuucauuagcgacuuuucucccuccaagccuccgagcggccccggcaaaaagguuuacaucucuuccccucacagcucucccgcucacaacaagcuggccaccgcuacgggggccaaaaaggcccucaauaaagugaagauucugaucacccaggaaaaaccuuccgcugaguucaucacacugaacgauugucuccaacuggcguaucuucccagcaagcggaaucauaugcugcuccuguacccgcgcgagauucuuauccuggaccucgaagugaaccagaccgucggagugauugccaucgagagaacaggcguuccuuuucuucaggugauucccugcuuccagcgggacgggcuguuuugucuccacgaaaauggaugcaucacccugcgcgucagacgguccuacaacaacaucuucacgacaucuaaugaggagccugaucccgaccccgugcaagaacuuaccuaugaucugcgcagccagugugacgcuauuagaguuacaaaaaccgugcggccuuuuuccauggucugcuguccggugaacgagaaugccgccgcucucgucgugagcgauggccgcguuaugaucugggaacugaagucugccgugugcaacagaaauucccggaacagcucuagcggggucagcccccuuuacucuccugugagcuucugugggauucccguuggcgugcugcagaauaagcucccugaccugucccuggauaacaugaucggccaaagcgcgauugcuggggaggaacacccccgcggaucuauccucagagagguccaucugaaauuucuucugaccggccuccuguccgggcugccggccccucaguucgccauccggaugugucccccucuuacaacgaagaauauuaaaauguaucagccccuccuggcugugggaaccagcaacggcucugugcugguuuaccaccucacauccgggcugcuucauaaggagcugagcauccacuccugcgaagucaaaggaauugaguggaccucucucacauccuuccuguccuuugccaccucuacgccuaauaacaugggccuggugagaaaugaacuucagcucguggaccugcccacaggccgcagcaucgcuuucagaggggagcggggaaacgaugaauccgccauugagaugaucaaggucagccaucugaagcaauaucucgcggugguuuuucgcgacaaaccgcuggagcuuugggaugugcggaccugcacccugcucagagaaaugucuaagaauuucccuacaauuaccgcccuggaguggucccccagccacaaccugaaaucucuucgcaagaaacagcucgcuacacgggaagccauggcuagacagacggucguguccgacaccgagcugagcaucguugaaucuagcgugaucucccugcuccaggaggccgagagcaagucugaacugucccaaaacauuagcgcgcgcgagcacuuugucuucacagacaucgauggccagguguaccaucuuaccguugaaggaaauuccgugaaggacucugcccggauucccccugauggaagcaugggcuccaucacaugcauugcuuggaaaggggacacccugguccucggcgauauggacggaaaccugaauuuuugggaucugaagggcagagugucucgcgggaucccgacgcaccggagcugggugagaaaaauccgguucgcccccggaaagggcaaccagaaacuuauugcuauguauaaugacggggccgaggucugggauaccaaggagguucagaugguguccucucuccgcagcggaagaaacgugacauuucggauccuggacgucgauugguguaccuccgacaaggugauucuggccagcgaugacggcugcaucagaguucucgaaaugucuaugaaauccgcuuguuuccgcauggacgagcaagaacugacagagccuguguggugccccuaccuucuggucccucgggcgagccucgcccugaaggcuuuucugcuucaucagcccuggaaugggcaguacucucuggauauuucccacguggacuauccugaaaacgaggagaucaaaaaucuccugcaggaacaacucaacagccugucuaaugauaucaagaaacuucugcucgaccccgaguucacccugcugcagagaugucuucugguuucccgccucuacggcgaugaaagcgagcugcacuuuuggacgguggccgcccauuaucuccacucccugagccaggaaaagucugcuagcacaaccgccccgaaagaggcggcuccuagagacaagcuguccaacccccuggauauuugcuacgacguccucugugagaaugccuauuuccaaaaguuccagcuggaacgggugaaccugcaggagguuaaacgcucuacauacgaucauaccagaaagugcaccgaccagcuucugcuccugggacaaacagaucgggccgugcagcuccugcuugaaacgagcgcugacaaucagcacuauuacugugauucccugaaagccugccuggucaccacagugaccucuagcggcccuucccagucuacaaucaagcucguggcgaccaacaugauugcuaacgggaaacuggccgagggaguccaacuucugugccucaucgacaaggccgcugacgccugucgcuaccugcagacguauggcgaauggaauagagcugccuggcucgcgaagguucggcugaaccccgaggagugcgccgaugugcuucgcagauggguggaccaucuguguagcccgcaggucaaucagaaauccaaggcucugcucgugcugcuuagccuggggugcuuuuucucuguugccgaaacacuccacuccaugcgguacuuugaucgcgcugcccuguucguggaggccugucucaaauauggagcuuuugaagucaccgaggacaccgagaagcugauuacagcgaucuacgccgauuaugcuagaagccuuaaaaaccugggcuucaagcaaggggccgugcuguuugccucuaaggcuggcgccgcgggaaaagaccuccugaaugaacuugaguccccuaaggaggaacccaucgaagaguga

SEQ ID NO: 77850 - RNA, 1272 nt, Artificial Sequence
  derived and/or modified sequence opt5 from WDR12__Homo_sapiens__NP_060726
auggcccagcugcaaaccagauucuacacagacaacaagaaauaugcuguggaugacguccccuuuagcaucccugccgcguccgagauugcugaucucucuaauaucauuaacaagcugcuuaaagacaagaaugaguuccacaaacauguugaauuugauuuccugaucaagggccaguuucuccggaugccgcuggacaagcacauggaaauggagaacauuagcuccgaagaggugguggagaucgaauacgucgagaaauauacggcuccccagccugaacagugcauguuccaugaugacuggaucucuagcauuaagggggccgaggaguggauccuuaccggauccuacgauaaaacaucucgcauuuggagccuggaaggcaaguccaucaugaccauuguggggcacacagacguugugaaagaugucgccugggugaagaaggacagccucucuugucugcugcucuccgccagcauggaucaaaccauccugcuuugggaguggaauguugaaagaaacaaagugaaggcucugcauugcugucggggacacgccggcucugucgacuccauugcgguggacgggagcggaacaaaauuuugcucuggcuccugggauaagaugcucaaaaucuggagcaccgugcccacggacgaggaagaugagauggaggaauccaccaaucgcccuagaaagaaacagaagacagagcagcugggccuuacccggacacccaucgucacccugucugggcacauggaagccguuagcuccgugcucuggagcgacgcugaggaaauuuguucugccuccugggaucauacgauccgcgugugggacgucgagagcggaucucucaagagcacacugaccggcaacaaaguguucaauugcauuuccuauucuccucuguguaagagacuggcuagcggguccacagaucggcacauccgccuuugggacccgagaaccaaagauggaagccugguuucucucucccugaccagccauacaggcugggugacgucugucaaguggucccccacccacgagcagcaacuuauuagcgggucccuggacaacaucgugaaacucugggauacacggucuugcaaggccccucuguacgaccuggcggcccacgaagacaagguucucagcguggauuggaccgacacaggacugcuucuguccggcggcgcugauaauaaacucuauucuuaccgcuacagccccaccacgucccaugucggggccuga

SEQ ID NO: 77851 - RNA, 3969 nt, Artificial Sequence
  derived and/or modified sequence opt5 from WDR17__Homo_sapiens__NP_733828
auggccuggaugaccuacaucagcaacugguucgagcaggacgauugguaugaaggccugcaaagagcuaauaugucccaggugcggcaggucgggcuccuggccgcgggaugccagcccuggaacaaggacguuugugcugccucuggcgaucgcuuugccuacugcgcuacacuugccauuuauaucuaccaacuggaccacagauauaaugaguucaaacuccaugcuauuaugagcgaacacaagaaaacgaucaccgccauuuccugguguccucauaacccggaucuguuugcgucugggagcacagacaaucuugugaucaucuggaacguggccgagcagaaggucauugcuaaacuggauuccaccaagggaauccccgccucucucagcuggugcuggaaugcugaagacgugguugccuucgugucccaccggggcccucuguuuauuuggacaaucagcgggcccgauucuggagucauugugcauaaggacgcgcacuccuuccugagcgauaucuguauguuucgcuggcacacccaucagaaaggcaagguuguguucggccacauugacgggucucucuccaucuuucauccuggaaacaaaaaucagaagcacguccugagacccgagagccuugagggcacagaugaagaggacccugugaccgcccuggaaugggacccgcucucuacggauuaccugcuuguggucaaccugcacuaugggauccggcucguugacuccgagagccuguccugcauuaccacauucaaucugcccucugcugccgcuagcgugcaaugucucgccugggugccuuccgcccccggaauguuuaucaccggcgauagccaggucggggugcugcgcauuuggaacguuucuagaacaaccccuaucgacaaucuuaaacugaagaagacgggauuccauugccuccacgugcugaacuccccgccccggaaaaaguuuagcguccagucuccuaccaaaaaucauuacacaagcuccacaucugaggcugugcccccucccacccuuacccagaaccaagcguucagccugcccccuggccacgccguuuguugcuuccucgauggcggggugggacuguacgacaugggcgcuaagaaaugggauuuucugcgcgaccucgggcaugucgaaacaauuuucgauuguaaguuuaaaccggacgaucccaaccugcuugccacggccuccuucgacggaaccaucaaggugugggacaucaauacacugaccgcugucuauacaagcccuggcaacgagggggugauuuacucucucuccugggcccccggaggccugaauugcaucgcgggcgggaccagcagaaacggagcuuuuauuuggaauguucagaagggcaaaaucauucagcgguucaacgaacacgggacgaauggaaucuuuugcaucgccuggucucacaaggauuccaaacgcauugccacauguagcuccgacggcuucugcaucauuagaaccaucgaugggaaggugcuucauaaauauaagcacccugcugccgucuuuggcugugacuggucucaaaacaauaaggauaugauugcuaccggaugcgaggacacaaacgugcggguuuacuauguggccaccagcuccgaucagccccugaaagucuucucuggccauacagcgaagguguuucacgugaaauggagcccgcuccgcgaagggauccuguguuccggaagcgacgauggcacgguuagaauuugggacuacacccaggaugccugcaucaauauccugaacgggcacacagcuccuguccggggacucauguggaauaccgagauucccuaucugcuuaucucuggcuccugggacuacacaauuaaggugugggauaccagagaggggacguguguggacaccgucuacgaccauggcgccgauguguauggacugacaugccacccuagccgccccuucaccauggcuucuuguucccgggacagcacaguuagacucuggucucugaccgcccuggugacgccuguccagaucaacauucuugcggaucgcagcugggaagagaucaucggcaauacagacuacgccauugaacccgggaccccgccucuccugugcggaaaagugucccgggauaucagacaagagauugaaaagcugacagcuaacagccagguuaagaaacuccgcugguuuucugagugucuguccccucccggcgggagcgacaaccuuuggaaucugguggccgucaucaagggacaggaugacucccuccugccccagaacuauugcaaaggcauuaugcaucugaagcaccuuaucaaauuccggaccucugaggcucaagaacucaccacagugaagaugagcaaguucgggggcggaaucggcguuccggccaaagaggaaagacugaaggaggccgcugaaauucaucugcgccucgggcagauccagcgguacugcgagcugaugguggagcuuggagaaugggauaaagcgcuguccauugcccccggcgucucugugaaguauuggaaaaagcucaugcagagacgcgcugaccaacugauccaggaggauaaagacgaugugauuccuuacuguaucgccaucggggacgucaagaagcugguucacuuuuucaugagccggggacagcuuaaagaagcccuccugguggcucaggccgcgugcgagggcaauaugcaaccccugcacguguccgucccuaagggggcuucuuauagcgacgauauuuacaaagaggacuuuaacgaacuccugcauaagguguccaaagagcuugccgaaugguacuuccaggauggcagagccguucuggcugccuguugccaccucgcgaucgacaauauugagcuggcuauggccuaucugauccggggaaacgaacuugagcucgccgugugugucggcacggugcugggggagagcgcugcccccgcuacccauuacgcccuggaacuccuggcgcgcaagugcaugaugauuucuguuuguuuuccuugcgugggauauuccguccccuucuguuacgugaauagaaaccuugccgcugaucugcuccugaugaucccggacaaugagcugcaccuuauuaagcugugcgccuuuuauccuggcuguacagaagagaucaacgaucuccaugacaaaugcaagcugcccaccguugaagagugcaugcagcucgcugagacagcccgggccgaugacaauaucuucgaaaccgugaaauacuaucugcuuagccaagagccugaaaaggcucugcccauugggaucucuuuugucaaagaguacauuuccagcucugauuggacgcucgacacaaucuacccggugcuggaccugcuuuccuauauuagaaccgaaaagcugcuccugcacaccuguacagaggcgcgcaacgagcuccugauccuuugcggauacaucggcgcccugcucgcuauucggagacaguaucagagcaucgugccugcccuguacgaauauaccucccagcugcuuaagcgcagagaggucagcguuccccugaaaauugaauaccucucugaggagcuggaugccuggcgggcuuguacacaaagcacgaaucgcucccucgaagacucuccuuauaccccucccagcgauucccagagaaugaucuacgccacacugcuuaagcggcugaaagaggaaucucugaagggcauuaucgggcccgacuacgugaccggaagcaaccucccgucccacucugauauccauauuagcugccugacaggccuuaaaauccaggggcccguguucuuucuggaggacggaaaguccgcgauuagccucaaugaugcucugaugugggccaaggucaacccuuucucuccccucggcaccgggauccgccugaacccuuuuuga

SEQ ID NO: 77852 - RNA, 4029 nt, Artificial Sequence
  derived and/or modified sequence opt5 from WDR19__Homo_sapiens__NP_079408
augaagagaaucuucagccugcucgagaaaaccuggcugggcgcccccauucaguuugcuuggcaaaagacauccgggaacuaccuugccgugacgggagcggacuauaucgucaaaauuuucgaucggcacggccagaagcgcucugaaaucaaucugccugggaacugcguugcuauggacugggauaaagacggagaugugcucgccgugauugccgaaaagagcuccuguaucuaccugugggacgcuaauaccaacaagacaucucagcuugauaauggcaugagagaccagaugagcuuucugcucugguccaaagucgggucuuuccuggccgugggaaccguuaagggcaaccugcucaucuauaaucaucaaacaagccggaaaauuccggugcugggcaagcacaccaaacgcaucacaugcggguguuggaacgcugaaaaucuucuggcccucggaggcgaggauaagaugauuaccgucuccaaccaggaaggggacacgaucagacagacccaggugcggagcgagcccucuaauaugcaauuuuuccugaugaagauggaugaccgcacauccgcggccgagagcaugauuucuguugugcuuggcaaaaagacccuguuuuuccucaaccugaaugaaccugauaaccccgcugaccuggaguuucagcaggacuucggaaauaucgucugcuacaacugguauggggauggaagaauuaugaucggcuuuuccuguggccauuucguggugaucagcacacacaccggggaacucggacaggagauuuuucaagcccggaaccauaaagacaaucugacgucuaucgcugucucccagacacuuaacaagguugcuaccugcggcgauaauuguauuaaaauccaggaccugguggaucucaaggacauguacgugauucugaaccuugaugaggaaaauaaagggcugggaacacucagcuggaccgacgauggccaacugcuggcgcucuccacccagcgcgggucucugcacgucuuccuuacaaagcugccuauccucggagacgccugcagcacgagaaucgcuuaucugaccucccuucuggaggugacaguugccaaccccguggaaggcgagcucccuauuaccgucagcguggauguugaaccgaauuucguggcugucggccuguaccaccuggccguggggaugaacaaucgggccugguuuuacguccucggagagaacgcugugaagaaacugaaggacauggaguaucuuggcacaguugcgucuaucugucugcauuccgacuacgccgcugcccucuucgaagggaaagugcagcugcaccugauugagagcgaaauccuugaugcccaggaggaacgcgagaccagacucuuucccgcugucgacgauaagugccggauucugugucaugcccugacgucugacuuccucaucuauggaacagauaccggcgugguucaauacuuuuauaucgaggacuggcaguucgugaaugauuaccgccacccugucagcgugaaaaagauuuuucccgacccuaacgggaccagacugguguucaucgaugaaaaguccgacggcuuuguuuauugccccgucaaugaugcgacauacgagauuccggacuucucuccuaccaucaaaggagugcuuugggaaaacuggcccauggauaagggcguguuuauugcuuacgacgacgauaaagucuauacauacguguuccacaaggacacgauccagggggccaaaguuauucuggccggaagcaccaaggugccuuuugcucauaagccccuccugcuguauaauggcgagcuuacaugccagacccaauccgggaaagucaacaacaucuaccucagcacacacggauuccugucuaaucugaaggauaccggccccgacgaacuccggccuaugcuggcccagaaccuuaugcugaaaagauucuccgaugcuugggagaugugucgcauccucaaugacgaggccgcguggaacgaacuggcccgggcuugccugcaucacauggagguggaauuugccauuagaguuuaucgccggaucgggaaugugggcauugucaugagccuugagcagaucaagggaauugaggauuacaaccuccuggcuggccaucuggccauguucacgaaugacuauaaccucgcgcaggaucuguaccuugccucuuccuguccgaucgcugcccuggaaaugagacgcgaccuccaacacugggauagcgcucugcagcuggccaaacaccuugcccccgaccagaucccuuuuauuuccaaggaguacgcuauccagcucgaguucgcgggggauuaugugaaugcccuggcucauuacgagaagggaauuaccggcgacaacaaagaacacgacgaggccugccuggccgggguugcucaaaugucuauccggaugggagauauuagacgcggcgugaaucaggcccucaagcaucccagccggguccugaaaagagacuguggggcgauccuugagaacaugaagcaguuuuccgaagcugcccaacuguaugagaaaggccucuacuaugauaaggccgcuucuguguacauccgcagcaaaaauugggccaaggugggagaccugcugccucacgucuccagccccaagauucaccuucaguaugcgaaagcuaaggaagccgauggccgguacaaagaggccguuguggcuuacgaaaacgccaagcaguggcagucugugaucagaauuuaucuggaccaucucaauaacccggagaaagcugucaacaucgugcgggagacacaaucccuggauggggccaagaugguugcgcgcuucuuucuccagcugggagacuacggcagcgccauucaguuccuugugaugucuaagugcaauaacgaagccuuuacccuggcccagcaacacaauaaaauggagaucuaugcugauaucauuggguccgaagacacaaccaacgaggauuaccagagcaucgcccucuauuucgaaggagagaagagauaccugcaggccggcaaauuuuuccugcuuugugggcaguauucucgggcucugaagcauuuucucaaaugcccuagcuccgaggacaaugucgcgauugaaauggccaucgagacggugggccaagcuaaggacgaacugcucacaaaccagcugauugaucaccuucugggagagaaugacggcaugcccaaggaugccaaauaccucuucagacuguacauggcccugaagcaguaucgcgaggcugcccaaaccgcgaucauuaucgcucgggaagaacagagcgccgggaacuacagaaaugcccaugacguucuuuucucuauguaugcugaacugaaaucccagaagaucaaaauuccuagcgagauggccacaaaccucaugauccugcacuccuacauucucgugaagauccacgucaagaauggagaucauaugaaaggcgcgcgcaugcugauuagaguggcuaacaauaucucuaaguuucccagccacaucguuccuauucuuaccuccaccgugaucgaaugucaucgggccgggcugaaaaacucugccuucagcuuugcugccaugcugaugcgccccgaguauagauccaagauugacgcuaaauacaagaaaaagaucgagggaaugguccggcgcccggauauuucugaaaucgaggaagccacaacgccuugccccuucuguaaguuucuccugcccgagugcgaacuucugugcccuggcuguaaaaauagcaucccguauugcauugcgaccggcagacacaugcucaaggacgauuggacaguguguccccauugcgacuucccugcccuguacuccgagcucaaaaucaugcugaacaccgagagcacaugucccaugugcucugaacggcuuaacgcugcccagcugaagaaaauuuccgauuguacccaauaccugcgcacggaggaggagcucuga

SEQ ID NO: 77853 - RNA, 1401 nt, Artificial Sequence
  derived and/or modified sequence opt5 from WDR1__Homo_sapiens__NP_005103
augcccuacgagaucaagaaaguguucgccagccugccucaggucgaaagaggcguuuccaagauuaucgggggagacccgaaaggcaacaauuuucucuauaccaacgggaagugcgugauucugcggaauaucgaugaccacucucgcuucgugaacugugucagauuuagccccgauggaaaucgguucgcuacagccuccgcggacggccaaauuuacaucuaugaugggaaaacgggagagaaggugugcgcucuuggcggcucuaaggcccaugacgggggaaucuacgccauuagcugguccccugauucuacccaucugcucagcgcuuccggcgacaaaacaagcaagaucugggauguuucugugaacuccgucgugagcaccuuucccauggggucuacaguucuggaccagcagcuuggaugucuguggcagaaagaucaccuccuguccgugagccugucuggcuauauuaauuaccucgaccgcaacaauccuuccaagccccugcacgucaucaaagggcauagcaaguccauucaaugccuuaccgugcacaagaacggaggcaaaucuuauaucuacagcggcucccacgaugggcauauuaauuacugggacagcgaaacaggagagaacgacucuuucgccggcaaggggcacaccaaucagguguccagaaugacggucgaugaaagcggacagcugaucucuuguagcauggacgauaccguucgguauacaucccucaugcugcgcgacuacucuggccaggggguggugaaacuugauguccaaccuaagugcguggcuguuggaccgggcggcuaugccguggucguguguaucgggcagauuguucugcucaaagaccagagaaagugcuuuagcaucgauaaccccggauacgagccugagguggucgcggugcaucccggcggggacaccgucgccauuggaggcguggaugggaauguucggcuguauuccauccugggcacaacccucaaagacgaaggaaagcugcuugaggcuaagggcccugugacggaugucgccuacagccacgacggggcuuuccuggccgugugugacgcgucuaaaguugugacagucuuuuccguggccgauggauauagcgaaaacaacguguucuacggccaccaugcuaagauuguuugccucgccuggucucccgacaaugagcacuuugcuuccgggggaauggauaugauggucuacguguggacccugagcgacccggagacacgcgugaaaauccaggaugcccauagacuucaccaugucuccucucuggccuggcucgacgaacacacccuggugaccacaagccacgaugcuuccguuaaggaguggacgaucaccuauuga

SEQ ID NO: 77854 - RNA, 588 nt, Artificial Sequence
  derived and/or modified sequence opt5 from WDR20__Homo_sapiens__NP_001229344
auggccaccgagggcgggggaaaggaaaugaacgagaucaaaacacaguucacgaccagagaaggccuguacaagcuccugccccacagcgaguauucccggccuaaucgcgugccguuuaacucucaagggagcaaucccgucagaguuuccuucgugaaccuuaaugaccagucuggaaacggcgaucggcugugcuuuaauguggggcgcgaacucuacuucuauauuuacaaaggagucagaaaggcugccgaccugagcaaaccuaucgauaagcggauuuauaagggcacacagcccaccugucaugacuuuaaccaccuuacagcgaccgcugaguccgugucucugcucguuggcuucagcgccggacaggugcaacugaucgauccuauuaaaaaggagacauccaaacuguuuaaugaagagaacagcugccagcaucucuggaaggucgacuggaaugaggaacgccagaacgaggggucuaaaaccuccgaagaggcccuggugacgguucagcccgcugaacacuucuguagacaagaggaucggaugcagggcgugcuucaggaccagaauuga

SEQ ID NO: 77855 - RNA, 1938 nt, Artificial Sequence
  derived and/or modified sequence opt5 from WDR26__Homo_sapiens__NP_001108585
augcaggccaacggcgcugggggaggcgggggaggcgggggaggcggcgggggaggcgggggaggcgggggaggccaaggccagacccccgagcuggccugccucagcgcgcagaauggggaauccucuccuagcuccucuagcuccgcuggagaccuggcccacgccaacggccuucugccgucugcucccagcgccgcuuccaauaacagcaauucucucaacgugaauaacggggucccuggaggcgccgcggccgcuuccagcgccacaguugcugccgcgucugccacgaccgcugccuccagcucucuggcuacacccgagcuuggguccagccugaagaaaaagaaaagacucucccagucugaugaagacgugauccggcugauuggacaacaucugaauggccucggccugaaccagaccguggaucuucugaugcaggagagcgggugucgccucgaacacccuuccgccacaaaguucagaaaucaugucauggagggagacugggauaaagccgagaacgaccugaaugaacuuaagccccuggugcacagcccucaugcuaucguucggaugaaguuucuccugcugcagcaaaaauaccucgaguaucuggaagauggcaaggugcuugaggcgcugcagguccuccgcugcgagcugaccccgcuuaaauacaacacagaacggauucacgugcugucuggguaucucauguguucccacgccgaggaccugagagcuaaggccgaaugggagggaaaaggcaccgccagccgcucuaagcugcucgauaagcugcagacguaccuucccccuagcguuaugcugcccccuagacggcuccagacccugcuucgccaagcuguggaacugcagagagaccggugccucuaucauaauacaaaacuggauaacaaccuggacuccgucucucuccugaucgaucacguguguagccgcagacaguuccccugcuacacccaacagauucuuacagagcauuguaaugaggugugguuuugcaaguucuccaacgacgggaccaaacuggccacgggcagcaaggacacaaccgucaucaucuggcagguugauccggacacacaccuccugaaacugcuuaagacccucgaaggacacgcguauggcgugucuuacauugcuugguccccugaugacaauuaccugguggccugugggcccgaugacugcagcgagcuguggcucuggaacguccagaccggagaacugcggacaaaaaugucucaaucccaugaggauagccuuacguccguggccuggaauccugacggcaagcgcuuuguuaccgggggacagagaggccaguucuaucagugugaucuggacgggaaccuccuggauucuugggaaggcgugcggguccaaugccuguggugccuuagcgacggaaagacagugcucgcuuccgacacccaccagagaauccgcggcuacaauuuugaggaucugacagaccggaacauuguucaggaggaucaucccaucaugucuuucaccauuagcaaaaaugggagacuggcccuccugaacguggcuacgcagggaguccaccuuugggaccugcaagaucgcgugcucguccggaaguaucagggcgugacacagggguuuuacaccauccauuccuguuucggaggccacaaugaagacuuuauugccagcgggucugaggaucacaaaguuuauaucuggcauaagagauccgaacugcccaucgcggagcugaccggccacacacgcaccgugaacugcgucagcuggaauccucagauuccgucuaugauggccuccgcuagcgacgauggaacagugcggaucuggggccccgccccuuucauugaccaucaaaacaucgaagaggaguguucuagcauggauuccuga

SEQ ID NO: 77856 - RNA, 1104 nt, Artificial Sequence
  derived and/or modified sequence opt5 from WDR31__Homo_sapiens__NP_001012361
augcugcuccugagaugccagcuuaagcaagcucccccucagaaagugagcuuccgguuuugugucguuaugggcaagcagcaguccaaacugaagcacucuaccuacaaauaugggcgcccggacgagaucauugaagagagaauccaaacaaaggccuuccaggaauacagccccgcccauauggauacgguguccguggucgcggcucucaacucugaccugugcgugagcggaggcaaggauaaaaccguuguggccuauaauuggaagacagggaacgucgugaaacgguuuaagggacacgagcaugaaauuaccaaaguugccuguaucccuaaguccucucaguucuuuagcgcuucccgcgacagaauggugaugaugugggaucuucacggcagcucucagccccggcaacagcugugcgggcaugccauggucgugacaggacucgcuguguccccugacagcucucagcuguguaccggcucccgcgauaauacacugcuccugugggacgucguuaccggccagagcguggagagagccucugugucccggaacgucgugacgcaccuuugcuggguuccccgcgagccuuacauucugcaaaccagcgaagauaagacacucagacugugggacucccgggggcuucagguggcgcacauguucccggccaaacagcauauccaaaccuauugugaggucucuguggauggacacaagugcaucagcuguuccaauggcuuugggggagaaggcugcgaggcuacacugugggaccuccgccagaccagaaaccggauuugugaguacaaagggcauuuccagacgguugccagcugcguguuucugccccgcgcucuggcccucaugccucugaucgcgacaucuucccacgauugcaaggucaaaauuuggaaucaggacaccggagccugucuuuucacacugagccucgacggcucuggcccccugaccagccuugcugugggggaugccaucucccugcucugcgcuucuuuuaacagaggcauucaucugcugcggauggaccacagccaaggacucgaacugcaggaggucgccgccuucuga

SEQ ID NO: 77857 - RNA, 1611 nt, Artificial Sequence
  derived and/or modified sequence opt5 from WDR34__Homo_sapiens__NP_443076
auggccaccagagcucagcccggcccucugagccaagccggguccgcgggaguggcugcccucgccacagucggcguugcuucugggccgggacccggccggccugggccccugcaggacgagacgcuuggaguggccagcgugccuucccaguggcgcgcuguccagggcaucagaugggaaaccaagucuugccaaacagccagcauugcgaccgccuccgcuucugcccaggcucggaaccacguggaugcccagguucagacagaggcgcccgugccugucagcgugcaaccgcccucccaguacgacaucccucgccuggccgcuuuccucagacggguugaagccauggugauucgcgagcugaauaaaaacuggcagagccaugcuuuugauggcuucgaagucaauuggaccgagcagcaacagauggugucuugucuuuauacacugggguaucccccugcccaggcccaaggacuccacgugaccuccaucagcuggaacucuacgggcuccgucguugcuugcgcguacgggagacuggaccauggagauuggagcacccugaagucuuuugugugugccuggaaucucgaccggcgcgaucugagaccccagcagccguccgcuguggucgaggugccuagcgccguucuuugccuggccuuccaccccacacagccuucccauguggcuggcgggcucuacucuggagaaguccuggugugggaccuuagccggcuggaggauccccuccuguggcgcaccggccugacagacgauacccacacggaccccguuucccaaguggucuggcucccugaaccgggccacagccauagauuucaggugcugucugucgccacagaugggaaagugcuucuguggcagggaauuggcguugggcagcuccaacugaccgagggauucgcgcuugugaugcagcagcugccccgguccacaaagcucaaaaagcacccucgcggcgagaccgaagucggggcuaccgccguggccuuuagcucuuucgaccccagacuguuuauccugggaacagagggcggcuucccucucaaguguagccuggcugccggggaagcugcccuuacgcggaugcccuccucuguuccgcugagagcgccugcccaguuuaccuucagcccccauggaggcccuaucuauuccgugagcugcucucccuuucaccgcaaccucuuccuguccgcugggacagacggacacguccaucuuuacagcaugcugcaagccccuccccucaccucucugcagcugucccucaaauaucuguucgcugugcgguggagcccggugagaccucuuguuuuugccgcggccuccggcaagggggauguccagcuguucgaccuccagaaaucuagccaaaagcccacagugcugauuaaacagacccaggaugagucccccguguacugucuggaauuuaauucucaacagacgcagcuucucgcugccggcgacgcucagggaacagucaagguguggcaacugagcaccgaguucaccgagcagggcccucgcgaagccgaggaucuggacugccucgccgcugaaguugcggccuga

SEQ ID NO: 77858 - RNA, 3546 nt, Artificial Sequence
  derived and/or modified sequence opt5 from WDR35__Homo_sapiens__NP_001006658
auguucuuuuaccugagcaagaaaaucuccauucccaacaaugugaagcuccagugcgucucuuggaacaaagagcaaggcuucaucgccugugggggagaagacggccugcuuaagguucugaaacucgagacccagacagaugacgcuaagcugagagggcuugccgcgccuagcaaucuguccaugaaccagacgcucgaaggacacucuggcagcgugcaaguggucaccuggaaugagcaauaucagaagcugacaaccuccgaugaaaacgggcugauuaucguguggaugcucuacaaaggaucuuggauugaggagaugaucaauaaccggaauaagagcguugugcgcuccaugagcuggaacgcugacggccagaaaaucugcauugucuaugaagauggcgccgugaucguugggucuguggacggaaauagaauuuggggcaaggaucugaaagggauccagcuuucccaugucacauggagcgccgacucuaaggugcugcucuuuggaauggcuaacggcgagauucacaucuacgauaaucaagggaacuucaugauuaagaugaaacuguccugucuugugaaugucaccggagccaucagcaucgcuggcauucauugguaucacggcacagaaggguacguugagccggacugccccugucuggccgugugcuuugauaacggacggugucagaucaugcgccaugagaacgaccagaauccugugcucauugauaccggcauguaugucguggggauccaguggaaccacaugggaucuguucuggcgguggccggcuuccaaaaggcugccaugcaggacaaagacgucaauauugugcaguuuuacacgcccuucggggaacaccugggaacccucaagguuccuggcaaagagaucuccgcucugagcugggaaggcgggggacuuaagaucgcccuggcgguggauuccuuuauuuacuucgccaacaucagacccaauuauaaauggggcuacugcucuaacacagucguguaugcuuacacccggccugaccgcccggaguauugugucguguuuugggauacaaagaauaacgaaaaguacguuaaauaugugaaggggcucauuagcaucaccacgugcggagacuucuguauucuggccacaaaagcugaugagaaucauccccaagaggaaaacgagauggaaaccuuuggcgccacauucguccuugugcugugcaauuccaucgggaccccucucgaccccaaguacaucgauauuguuccucuguucguggccaugaccaaaacacacgucaucgcugcgagcaaggaggccuuuuacacguggcaguauagaguggcuaagaaacugaccgcccucgaaauuaaccagaucacacggucucgcaaggagggcagagagcggauuuaccauguggacgauacccccuccggaagcauggacggcguucuggauuauucuaaaacaauccaggggacccgcgacccgauuugcgccaucacggcuagcgacaagauccuuauugucggaagagaauccggcacaauccaacgguacucucugccuaauguggggcucauucagaaauauagccugaacugucgcgccuaccagcuuucccugaauugcaacagcucuagacucgcgaucauugauaucuccggagugcugaccuucuuugaccuggaugcucgggucaccgacagcacaggccagcaagugguuggggagcuccugaaacuugaaagacgcgaugugugggacaugaagugggccaaggauaaccccgaccuguucgccaugauggagaagacccggauguaugucuuuagaaaucucgauccugaggaacccauccagacaucuggcuacauuuguaacuucgaggaccuggaaaucaaauccgugcugcuugaugagauucucaaggaccccgaacacccuaauaaagauuaccugaucaacuuugagauucgcagccugcgggacuccagagcucucaucgagaagguuggaaucaaggacgccucucaguucauugaagauaauccgcacccccgccuguggcggcuucuggcugaggccgcgcuccagaaacuggaccuguauacggccgaacaggcuuuugugagaugcaaggauuaccagggcaucaaauucgucaagcgccuugggaaacuccugagcgaguccaugaagcaggccgaagugguuggauauuuuggccgguucgaggaggcugaaagaaccuaccuggagauggaccgccgggaucucgccauugggcugagacuuaaacugggagacugguuucgggugcuccagcugcugaagacaggcucuggggaugcggacgauagccuucucgaacaagccaacaaugcuaucggcgacuauuucgccgaucgccagaaguggcugaacgcuguccaguacuaugugcaaggaagaaaucaggagcggcuggccgaauguuacuacaugcucgaggacuaugagggccuggaaaaccuugccauuucccugccugagaaucauaaacuccugcccgaaaucgcucagauguucgugagagucgggaugugcgagcaggcgguuaccgccuuucugaaguguagccaaccuaaagcugccguggauacaugcgugcaccuuaaccaguggaauaaggccgucgaacucgcuaaaaaccauucuaugaaggagaucggaucccugcuggcccgcuacgcgagccaccuccuggagaagaauaaaacccuugacgcuauugaacuguaucggaaggccaacuacuucuuugacgccgcuaaacucauguucaagaucgccgaugaggaagcgaaaaagggcucuaagccccugagagugaaaaagcuguauguucuuuccgcucugcucauugagcaguaccaugagcagaugaaaaacgcccaacgcgggaaggugaaaggaaagagcucugaagccacgagcgcucuggccggccuccuggaggaagagguccuuuccaccacagacagauuuaccgauaaugcuuggcgcggggccgaagcguaucacuucuuuauccuggcccagcggcagcucuacgagggcuguguggacacagcucugaagaccgcccugcaccuuaaagauuacgaggacauuaucccgccuguugaaauuuauagccugcucgcucugugcgccugugccucuagagcuuucggaacgugcuccaaggcguuuaucaaacucaagagccuggagacacuuuccucugaacagaaacaacaguacgaggaucuggcccucgaaaucuucaccaagcauacaagcaaagacaaccggaagcccgagcuggauucccugauggagggcggggaaggaaaacuuccuaccugcguggcuaccggcucucccauuacagaguaucaguuuuggauguguagcgucugcaagcacggggugcuggcccaagaaaucucccauuacucuuucuguccucucugccacagccccguuggauga

SEQ ID NO: 77859 - RNA, 2856 nt, Artificial Sequence
  derived and/or modified sequence opt5 from WDR36__Homo_sapiens__NP_644810
augugcuguaccgagggcagccugagaaagcgggacucccagcgcgcccccgaagcugugcucugccugcaacuuuggcagagaacagucccucuggauacgcucaaagggcugggaaccuguuucccgucuggccccgagcuucgcggggccggaaucgcggcugccauggaacgggccagcgagagacggacagcuuccgcccuguuugcuggcuuccgcgcccucgggcuguuuucuaacgacauuccucacguugugagauucagcgcgcugaagcggcgcuuuuacgugaccacaugcgucggaaaauccuuccauaccuaugaugugcagaagcucucucugguugccgugagcaauuccgucccccaggacaucuguugcauggcugccgauggcagacuuguguuugcugccuacggcaacguuuucagcgcguuugcccggaauaaagaaauugugcacacauucaaggggcauaaggcugagauccacuuucugcaaccuuucggagaccauauuaucucugucgauaccgacggcauccucauuaucuggcacauuuauuccgaggaagaguaccugcagcuuacguuugauaaaagcguguucaagaucucugccauucugcaccccuccaccuaucucaacaaaauccugcuggggagcgaacagggaucucuccagcuguggaaugugaaguccaacaaacuucuguacacauucccuggcuggaaggucgggguuaccgcucuccaacaggccccggccguggacguggucgcuauuggacugaugagcggccaggugaucauccauaauauuaaguuuaacgagacacuuaugaaauuccgccaggauuggggccccaucaccuccauuucuuuuagaacggacgggcacccuguuauggcggccggaagccccuguggccauaucgggcugugggaucucgaggacaagaaacugauuaaucaaaugcggaacgcucacuccacagccaucgccggacugaccuuccuccaccgcgaaccucugcuugugacaaauggcgcugacaacgcccugagaaucuggauuuuugaugggcccaccggagagggccggcuccugagauuccgcaugggccauagcgcgccgcuuaccaauauccgguauuacgggcagaacggacagcaaauucugucugcuucccaggacggcacacuccagagcuuuucuacgguccacgaaaaguucaauaaaagccuggggcauggacugaucaacaagaaaagagugaagcgcaagggccuccagaacaccauguccguucggcugccucccauuacaaaauuugccgccgaggaagcuagagagucugauugggacgggaucaucgccugccaccaaggcaagcugagcuguuccaccuggaauuaccagaaaagcacaauuggagcuuauuuccuuaagccuaaagagcucaagaaggaugacaucaccgccacggcgguggauauuacaucuugcggcaacuuugccgucaucgggcuguccagcggaaccguggacgucuacaauaugcagucuggcauucaucgcggguccuucggaaaagaucaggcucacaagggcagcgugagagggguugccguggacggccugaaccaacuuaccgucacaaccggauccgaaggccuccugaaauuuuggaauuucaagaacaaaauccugauucacucugugagccucuccucuagccccaauaucaugcugcuucaucgggauuccgggauccugggacucgcucuggacgacuucagcauuucuguucuggauaucgagacacgcaagauugugcgggaauuuuccggccaccaggggcagaucaacgacauggccuucagccccgauggaagauggcuuauuucugcggccauggacuguuccauccgcacgugggaucucccuagcggcugccugaucgacugcuuucugcucgauucugcuccgcugaaugucagcaugucccccaccggggacuuccuugccacaagccauguggaucaccugggcauuuaucucuggucuaacaucucccuguacagcgugguuucccugcggccucuucccgcugacuaugucccuucuauugugaugcuccccggaaccugucagacacaagauguggaggucagcgaagagaccguggagccguccgacgaacugaucgaguacgauucuccugaacagcugaaugagcagcucguuacgcugagccuucugcccgaauccagauggaagaaccuccugaaucuggacgugauuaaaaagaaaaacaagccuaaagagcccccuaagguccccaagucugccccguuuuucaucccuaccauccccggccuugugccccgguaugccgcuccugagcagaauaacgacccgcaacagagcaaaguugugaaccucgggguccuggcgcagaaguccgauuuuugccugaaacucgaagagggacuggugaauaacaaguacgacacagcccuuaaucugcucaaagaaagcggccccucugggauugagaccgagcugcgcucccugagcccugauuguggaggcucuaucgaaguuaugcaauccuuccuuaagaugauugggaugaugcuggacagaaaacgggauuuugagcucgcucaggccuaccuggcccucuuccugaaacuucaccugaagaugcuccccagcgaaccugugcugcuggaggaaaucacaaaccuuucuucccaggucgaggagaauuggacccaucugcagagccucuuuaaccaauccaugugcauucugaauuaucucaagagcgcucugcuuuga

SEQ ID NO: 77860 - RNA, 1485 nt, Artificial Sequence
  derived and/or modified sequence opt5 from WDR37__Homo_sapiens__NP_054742
augcccaccgagagcgccuccugcucuacagcuagacagacgaagcaaaaacgcaagagccacucccugucuauccggagaaccaacagcuccgaacaggagcggacaggccucccucgcgacaugcuggaagggcaggauucuaaacuuccgagcuccgugagaagcacccugcucgagcuguucggacagauugaacgggaguuugagaaucuuuacaucgaaaaccuggagcuccgcagagaaauugacacacugaaugagcggcuggccgcggagggccaagcuaucgauggggccgaacucucuaagggacagcugaaaaccaaggccucccauagcacaucucagcuuucccagaagcugaaaaccacguauaaggcuagcaccucuaaaauugucuccagcuucaagacaaccacaucccgcgccgcuugucaacucguuaaagaguacaucggccacagagacgggaucugggaugugucuguggccaagacccagcccgucgugcugggaacggcgagcgccgaccauacagcucugcugugguccauugaaaccggcaagugccucguuaaauaugccggccacguggggagcgucaacucuaucaaguuucauccuuccgagcagcuggcucugacagccagcggagaucagaccgcgcacauuuggcgguacgccgugcaacuccccaccccucagcccguugcugacacaucuaucagcggcgaagaugagguggaguguuccgacaaagaugaaccugaccuggauggggacgucucuagcgacugcccgacgauucgcgugccccuuaccucccuuaagagccaccagggaguggucaucgccucugauuggcucguuggcgggaaacaagcugugacagccuccugggacagaaccgccaaucuguaugauguggagacaagcgaacuuguccauucucugaccggacacgaccaggagcucacgcauuguugcacacacccuacccagcggcuggugguuaccuccagccgcgauacaaccuucagacugugggacuuucgggaucccuccauucacucugugaacgucuuccagggccauacagacacggugaccagcgcuguuuuuacagugggcgauaaugucguguccgggucugacgauagaaccgucaaggugugggaccucaaaaacaugcgcagcccuaucgcgacaauccggaccgacuccgccauuaauagaaucaacguuugugugggacaaaagauuaucgcucugccccacgauaaucgccagguccggcuuuucgacaugagcggcgugagacuggcccgccucccgcggucuuccagacaggggcaucgccggaugguuugcuguagcgccuggucugaagaucacccugugugcaaccuguuuacguguggauucgacagacaggcuauuggcuggaauaucaacauccccgcccuucugcaagagaaguga

SEQ ID NO: 77861 - RNA, 2034 nt, Artificial Sequence
  derived and/or modified sequence opt5 from WDR43__Homo_sapiens__NP_055946
auggccgcuggcgggggaggcagcugcgacccccuggccccugcgggggugccgugugcuuucucuccccacucccaggccuacuuugcccucgcuagcaccgauggacaucugagagucugggagacagccaacaaucggcuucaccaagaauauguuccuuccgcucaucugucuggcacgugcaccugucucgccugggcgcccgcccgccugcaggcuaaggagagcccucagagaaagaagcggaaauccgaagccguggggaugucuaaccagacagaccuucuggcucucggaaccgccgugggcagcauccugcuguacuccacagucaagggcgagcuccacagcaaacugauuucugggggacaugauaaucgcgugaacugcauccaauggcaccaggacuccggcugucuuuauagcugcucugaugacaagcacauuguugaauggaaugugcagaccuguaaggucaaaugcaaguggaaaggggauaacuccagcgugucuucccuguguaucagccccgacggaaagaugcuccuguccgcgggcagaacaauuaaacuuuggguucuggagaccaaggagguguaccggcauuucacggggcacgccaccccugucucuagccucauguuuacaaccauccgcccgcccaaugaaucccagccuuucgauggaaucacaggccuguauuuucugagcggcgcugugcaugacagacuccugaacguguggcaaguccggucugagaauaaggaaaaauccgccguuaugagcuucaccgugacggaugagcccguguacauugaccuuacacugucugagaacaaggaggaaccugucaaacucgcugugguuugccgcgauggacaggugcaccuguuugaacacauccuuaauggguauuguaagaaaccccugaccagcaacugcacaauucagaucgccaccccgggcaaggggaaaaaguccaccccuaagcccauuccuauccucgccgcuggauucugcucugacaaaaugagccugcugcucgucuacggcuccugguuucagcccacaauugagagaguggcgcugaauagccgggaaccccauaugugucuuguucgcgacaucucuaacugcugggccccuaagguggagacggcuaucaccaaagucagaacaccggugaugaacuccgaggccaagguccuggugcccgggauuccuggacaccaugccgcuaucaaacccgccccuccccaaaccgaacagguugagagcaagcggaagucuggcggcaaugaaguguccauugaggaacgccucggggcgauggauaucgacacacacaaaaagggaaaagaggaucugcagaccaacagcuucccgguccuucugacgcaaggccucgaguccaaugacuuugaaaugcugaacaaggugcugcagacaagaaauguuaaccucauuaaaaagaccgugcugcggaugccucuucauaccaucaucccccugcuccaggagcugacaaagagacugcaggggcacccuaauucugcuguccuuauggugcaauggcucaaaugugugcugaccguucacgccagcuaccuguccacacuccccgaucuggucccucagcuuggaacgcuguaucagcucauggaaucucgcgugaagaccuuccagaaacugagccaucugcacggcaaacuuauucuccugaucacacaagugaccgccuccgagaaaacaaagggggcuaccagccccggccagaaggccaaacuggucuacgaagaggagucuuccgaagaggaaagcgacgaugagauugcugacaaggauucugaggacaacugggaugaagacgaggaagaguccgaaagcgagaaagacgaggauguggaagaggaagacgaggaugccgaaggaaaggacgaggagaauggcgaagaucgggacacggcgucugagaaagaacucaacggggauagcgaccuggauccggagaaugaauccgaggaggaauga

SEQ ID NO: 77862 - RNA, 1035 nt, Artificial Sequence
  derived and/or modified sequence opt5 from WDR45B__Homo_sapiens__NP_062559
augaaccugcuccccugcaauccucacggcaacgggcugcuuuacgccggauucaaucaggaccauggcuguuuugcuugcgggauggagaacggauucagaguguauaauaccgauccgcugaaggaaaaagagaagcaagaauuucucgagggcggggucggacacguugaaaugcuguuccgguguaacuaccuugcccuggugggcggcgggaaaaagcccaaauauccucccaauaaggugaugaucugggacgaucucaagaaaaagacagucauugagaucgaguuuagcacggaagugaaagcgguuaagcugcgcagagaccggauuguggucgugcuggauuccaugaucaaaguuuucaccuuuacacauaacccucaccagcuccauguguucgagaccugcuacaaucccaagggacuguguguccuuugcccuaacucuaauaacagccugcucgcuuuuccgggcacacacaccgggcacgugcagcugguggaccuugccuccacagaaaagcccccugucgauauucccgcccaugagggaguucugucuuguaucgcucucaaucugcagggcacccgcaucgccacggcuagcgagaaagggacccugauuagaaucuucgacacauccucuggacaccucauucaagaacugcggcgcggcagccaggccgcgaacaucuauugcauuaauuuuaaccaggaugccucccuuaucugugugagcucugaccauggcaccgugcacauuuucgcugccgaggauccuaagagaaacaaacaguccagccuggcuucugccuccuuucuccccaaguacuucagcucuaaaugguccuucagcaaguuucaagucccguccgggucuccuugcaucugugcguucggaacagaacccaaugccgugaucgcuauuugcgccgacggcagcuauuacaaauuucuguucaacccuaagggggagugcauccgggauguuuacgcucaguuucuugaaaugaccgacgacaagcuguga

SEQ ID NO: 77863 - RNA, 1083 nt, Artificial Sequence
  derived and/or modified sequence opt5 from WDR45__Homo_sapiens__NP_001025067
augacccagcaaccccugagaggcgugacaagccuccgguucaaccaggaccaguccugcuuuuguugcgccauggagacggggguccgcaucuacaauguugaaccucugauggagaagggacaccuugaucaugaacaggugggcucuauggggcugguggagaugcuccacagaagcaaccugcuugcucuggucggaggcggguccucuccgaaauucagcgaaauuuccgugcucaucugggacgaugcccgggagggaaaggacucuaaagagaagcugguucuggaauuuaccuucacaaaacccgugcucagcguccgcaugagacaugauaagauugugaucguucugaagaaucggauuuauguguacuccuuuccugacaacccccgcaaacuuuucgaguuugauaccagagacaauccuaagggccugugugaucucugccccagccuggaaaaacaacuucuggucuucccuggccacaagugugggucucuccagcugguggaccuggcguccacaaaaccgggaaccagcucugcucccuuuacaaucaacgcccaucaguccgauaucgccugcgugagccucaaucagccuggcaccgucguugcuucugccucccaaaaggggacgcugauucggcuuuucgacacccagagcaaggagaaacugguggagcuccgcagaggaacagaucccgcuacccuguauuguaucaacuuuucccacgacucuagcuuccuuugcgccuccagcgacaagggcacagugcacauuuuugcgcugaaagauacccggcucaaucgcagaucugcccuggcucgggucgggaaggugggaccuaugaucggccaguacguugacucccaguggagccuggccucuuucacggugcccgcugaaagcgccuguauuugcgcguucggccgcaacacauccaaaaaugucaacucugugaucgccauuuguguugaugggaccuuucauaaguauguguucacaccggacggaaauugcaacagagaggcuuuugaugucuaccucgacaucugcgaugacgaugacuucuga

SEQ ID NO: 77864 - RNA, 1833 nt, Artificial Sequence
  derived and/or modified sequence opt5 from WDR46__Homo_sapiens__NP_005443
auggagaccgcccccaagccuggcaaagacgugccgcccaagaaagauaagcugcagacaaaaagaaagaagccucggcgcuacugggaagaggaaacgguccccaccacagcuggggccagcccuggacccccuagaaacaaaaagaaucgggagcuccgcccgcaaagacccaaaaacgcguauauccugaagaaaucccggauuucuaagaagccucagguucccaaaaagccucgcgaauggaaaaaucccgagagccagagaggccuuuccgggacccaggacccguucccuggacccgcuccugugcccguggaggucgugcaaaaguuuugccggaucgauaaaucucgcaagcugccccacagcaaagccaagacaagaucccggcucgaaguugccgaggcugaagaggaggaaaccucuauuaaggccgcucgcagcgagcugcuucuggccgaggaaccuggcuuccucgaaggggaggacggagaggauacagcgaaaaucugucaggccgacauuguggaagcugucgauaucgccuccgcugccaagcauuuugaccugaaccugagacaguucggcccguaccggcucaauuauagccgcaccggcagacaccuggcguuugggggacggagaggccauguggccgcucuugauuggguuacgaaaaagcugaugugcgagaucaacgugauggaagccguccgcgacauucgguuccuccacucugaggcucugcuugccguggcccagaauagauggcugcauaucuacgauaaccaagggauugaacuccacuguauccgccggugcgacagagugacccgccuggaguuucugcccuuccacuuucuccuggcuacagcguccgagaccggauuccuuacauaucuggaugucagcguuggcaaaauuguggccgcucucaaugcccgggccgggagacuggacgugaugucucagaacccuuacaaugcugucauccaucuuggacacuccaacggcaccgugagccuguggucucccgccaugaaggaaccucucgcgaagauucugugucaucgcggcgggguucgggcuguggccgucgacuccacgggaacauauauggccaccagcggccuggaucaccagcucaaaaucuuugaccugagagggacauaccagccccuuuccacccgcacccugccgcacggagcuggccaucucgccuucucucaacgggggcugcuuguggcuggaaugggcgauguugugaauaucugggccggccaggggaaggcgagcccucccucccuggagcagccuuaccucacacacagacugagcggacccguccauggccugcaauuuugcccuuucgaagacgugcucggggucggacacacgggcgggauuaccucuaugcuggugcccggcgccggagagccgaacuucgauggccuugaauccaauccuuaucggagccgcaaacagagacaggagugggagguuaaggcucugcucgaaaaagugcccgccgagcugaucugucuggacccccgggcucuugccgaagucgaugugauuucucucgagcaggggaagaaggagcaaaucgaaagacugggauacgacccucaggcgaaagccccguuucagcccaagccuaaacagaagggccgcagcuccacagcuucucugguuaaacggaagagaaaggugauggaugaggaacaucgcgacaaagucagacaaagccuccagcagcagcaccacaaggaggccaaagcuaagcccaccggggcccggccuuccgcccuggaucgcuucgugagauga

SEQ ID NO: 77865 - RNA, 1788 nt, Artificial Sequence
  derived and/or modified sequence opt5 from WDR48__Homo_sapiens__NP_001290331
auggagugccagagcgcccaagugaucuccgcuucuagcgacaccacagucaagguuuggaacgcccacaaaggcuucuguauguccacgcugagaacccauaaggauuacgugaaagcgcucgcuuaugccaaggacaaagaacugguggccucugcugggcuugaucggcagauuuuucugugggacgucaauacacucaccgcccugacagcuagcaacaauaccgugacaaccuccucucuuagcggaaacaaggauuccaucuacagccuggccaugaaucagcucggcacgauuaucguuucuggguccaccgagaaggugcugcgcgucugggaccccagaacaugcgcgaaacugaugaagcucaaaggacacaccgauaacgugaaggcccugcuucugaaucgggacggcacacagugucucagcgggucuuccgauggaaccauucgccuguggagccuuggccaacagagaugcaucgcuacguaucggguucaugacgaaggcgugugggcccugcaggucaacgaugcuuucacacacguguacucugggggacgcgacagaaaaaucuauuguaccgaucuccggaauccugacauucgcgugcugaucugcgaggaaaaggccccgguccugaagauggagcucgacagauccgcggaucccccucccgccauuuggguugcuacaaccaaaagcaccgugaacaaguggacacugaaaggcauccauaauuuucgggccuccggggacuacgauaacgacuguacgaauccuauuacaccccuuugcacccagccugaucaagugaucaagggaggcgcuucuauuauccagugucacauccugaacgacaaacgccacauucucaccaaggauacaaauaacaacgucgccuauugggacgugcugaaagccugcaagguugaggaucuugggaagguggacuucgaagaugagaucaaaaagagauuuaaaauggucuacgugccgaauugguucagcguugaccugaagaccggaaugcucacgauuacacuggacgaauccgauuguuuugcugcgugggugagcgccaaagacgcuggcuucucuucccccgauggcagcgacccuaagcugaaccucgggggacugcuucugcaggcccuccuggaguacuggccccggacccaugucaauccuauggaugaggaagagaacgaagugaaucacgucaacggcgagcaggaaaaucgcgugcaaaaggggaacggauauuuucagguucccccgcauaccccugugaucuucggcgaggccgggggaagaacacuuuuucggcugcucugcagagacucuggcggcgagaccgaaagcaugcugcugaaugagacagucccccagugggugauugauaucacgguugacaaaaacaugccuaaguucaauaaaauccccuuuuaccuccaaccccacgcuuccucuggggccaagacccugaaaaaggaucgccuuagcgcguccgacaugcuccaggugcggaaggucauggaacacguguaugagaaaauuaucaaccuggauaaugaaagccagacaaccucuuccagcaacaaugagaagccuggagagcaggaaaaagaggaagacauugcugugcuggccgaggaaaagaucgagcugcuuugccaagaucagguucucgacccgaacauggaccugagaacagucaaacauuucauuuggaagucuggcggggaucugacccuccacuaccgccagaaguccacguga

SEQ ID NO: 77866 - RNA, 2094 nt, Artificial Sequence
  derived and/or modified sequence opt5 from WDR49__Homo_sapiens__NP_849146
auggccuggagagaaaagagcaaaaagcggcugaacaugaccuccuucaauaucgcucagggcauucacgccuuugacuaccauucucgccucaaccugaucgcgacagcugggauuaauaacaaagugugccuuuggaaucccuaugucguuagcaagccugugggagugcuguggggccacuccgccucugucaucgccgugcaauucuuuguugaaagaaaacaacucuucagcuuuuccaaggauaaggugcugcggcuuugggacauucagcaucagcugucuauccagcgcaucgcuuguagcuucccgaaaucccaggauuuuagaugccucuuccacuuugacgaggcccaugggcggcuguucauuagcuuuaacaaucagcuggcucuccuggccaugaagucugaagcguccaaacgcgucaagagccacgagaaagccgugacguguguucuuuacaacucuauccugaaacaggugauuuccagcgauaccggaucuacagucuccuucuggaugaucgacaccggccaaaagauuaagcaguuuacagggugccacggaaaugcugaaaucagcaccauggcccucgaugcuaacgagacaagacugcuuaccggcuccacggacggcaccgugaagauuugggauuucaauggguauugucaucacacacugaacgugggacaggacggcgccgucgauaucucucagauccucauucugaaaaagaaaauccugguuaccgggugggagcgggcgauuacaguguuccgcccccaaaauuuuaaccaguucuuuauccagccugaagaguggaagggaggcauucaacaucacgacgauauccucugcgccgcuuuccugcccccucagacccuugugacggggagcuacgacggagaaaucguccuguggaauaacuccacagagaacgcccaccaugugcuccaccccgacuaucagagacugcuuaaaagcaagcuggauaccaagccucagaaacuccugucugcuggccggucccaaccgagccaucccauggccgaccacucuacaaccggcguucgcaauuuugagauugauaccgaagggaagaacgccgugaugagacuguguuuccucaaagcucggaagaauacagcggucacgggaggcgccaaccuggugagcugcgggggauccggcuacguucgcuuuugggacaucuauaaaaagcagcuucuggcugaguuccucgcccauucuggggugggaagcauuaucauguccaccgauaagaugaauagauaccugacaaccggcgaccuugauggcuggcugaaaauuuggaacaucgaagaguacugucucaauagcucuaagaacaaaaucacaaaggccccuacccugauucgguccuuucagccccacgaagacagaaucagcucucuggagaugugcgagccugggggacagcuccugauuaucuccagcuccgcugauuguucuauuugcgucacgggcgugugcaaugcccccgucuggaucuucgggcaagcgaaacacuggcauauugaaaacugucuuuuucugccgaagcgcgacacaaaucucguggagagcgaaauccagaaggagaucucccuguucucuaaagaagagagcugccuggauccuaccgagcacucccuucucaacaagaaaaauaaggacgacagcaccuauaacguucggcccucugaagauauuaaucuggacaucaaauacaaggagagauccacauguaugaaggaaacccagaaaccuuauuacggagaggugauuaagaaaucuuuuagcacauuccgcucccugaacaucggcgcucucgaggagcugcccgaggucaacaagcccgccuuccuucuggauccugaaaaauauuuucggaaggagccggaagaggagagaccccagauucucgaagccccuagccuguucaaaacgcugaaggcuguguuugacgagaagaaucuuuuccccaaagaaauccuccaucacgagcgcaaggccaaacaacugugccaggaaaagucuugugagguuaaaaagaacaagaaauga

SEQ ID NO: 77867 - RNA, 1239 nt, Artificial Sequence
  derived and/or modified sequence opt5 from WDR4__Homo_sapiens__NP_387510
auggccggcagcguggggcuggcucucugcggacagacccuggucguuagaggcgggucccgguuccuugccacaucuaucgcgagcuccgacgaugacucucuguuuauuuacgauuguagcgcugccgagaagaaaucccaagaaaacaagggagaggacgcuccccucgaucagggcucuggggccauccuggccagcacguucuccaaaagcggaucuuauuuugcucuuaccgacgauuccaagcgccugauucucuucagaacaaaaccuuggcagugccugagcgugcggaccguggcccgcagauguacagcgcugaccuuuaucgccucugaagagaagguccucguggcugacaaguccggcgauguuuacagcuucucugugcuggaaccgcacggcugcgggcggcuugagcugggacaucucuccaugcugcuugacgucgccgugagccccgaugaccgcuuuauucugacagcugauagagacgagaaaauccggguuuccugggccgcggccccucacucuaucgagagcuucugucucggccauaccgaauuugugucccgcauuagcgucgugcccacgcagccugggcugcugcucucuuccagcggagacggcacccugagacuuugggaauaucggucugggcgccaacugcacugcugucaucucgcuagccugcaggagcuuguggauccccaggccccucagaaguucgcugccuccagaaucgccuuuuggugccaagagaauugugucgcucugcucugcgacggaacaccgguuguguacauuuuccagcuggaugcgcggcgccagcagcugguguauagacaacagcucgccuuucagcaccaagucugggacguggcuuucgaagagacccagggccuguggguucuucaggauugucaggaagcuccccuggugcucuaccggccugucggcgaccaauggcagucugugcccgagagcacaguucugaaaaagguguccgggguccuuagaggaaacugggccaugcuggaaggcagcgccggggccgaugcgucuuucuccagccucuauaaagcuaccuuugacaaugugacgucuuaccugaagaagaaagaggagcgccugcagcagcaacucgaaaagaaacagcggagacgcuccccucccccgggaccugauggccacgccaagaaaaugcggcccggggaggccacacugagcugcuga

SEQ ID NO: 77868 - RNA, 1152 nt, Artificial Sequence
  derived and/or modified sequence opt5 from WDR55__Homo_sapiens__XP_005268526
auggacagaaccugcgaggaacggcccgccgaggauggcagcgacgaagaggauccugacuccauggaagcuccgacacgcaucagagauacgcccgaggacauugugcuggaggccccugcgucugggcucgcuuuccaccccgcccgggaucugcuugccgcuggagacgucgauggcgacguuuuuguguucagcuacuccugucaggaaggggagaccaaggaacuguggucuagcggacaucaccucaaagccugccgcgcuguggccuuuuccgaggauggccaaaagcugaucacagucucuaaagacaaggcgauucaugugcuugauguugagcaggggcagcuggaaagacgggugagcaaagcccacggagcuccuaucaacucccuccugcuggucgacgagaaugugcucgccaccggcgacgauacaggcgggauuugucugugggaccagcgcaaggaaggaccccuuauggauaugagacaacaugaggaauauaucgcugacauggcccuggauccugcgaagaaacuccugcuuaccgccagcggcgacgggugccugggaaucuucaacauuaagcggcgcagauuugagcuccugucugagccgcaguccggcgaucugacaagcguuacccucaugaaaugggggaagaaaguggcuuguggaucuuccgaaggcacgaucuaccuguucaauuggaacggcuuuggggccaccagcgaccgguucgcccuucgcgcugagucuauugauugcaugguccccgugacagaaucccugcucuguaccggaagcacagacggcgugaucagagccgucaauauucugccuaaccggguugugggguccgugggacagcacaccggcgagcccgucgaggaacuugcucugucucacugcgggcgcuuucucgcgagcuccggacaugaucagagacugaaguucugggacauggcccaacugcgggcugugguuguggacgauuauagacgccggaagaaaaagggcggcccucucagagcccugagcucuaaaacgugguccacagacgacuuuuucgccgggcuucgcgaggaaggagaggauagcauggcucaggaagagaaggaagagaccggcgaugacucugauuga

SEQ ID NO: 77869 - RNA, 1005 nt, Artificial Sequence
  derived and/or modified sequence opt5 from WDR5__Homo_sapiens__XP_005272220
auggccaccgaggaaaagaaacccgagacagaagcugccagagcgcagccuacgccgagcuccucugcuacccaaagcaagcccacaccugugaaacccaacuacgcccugaaguucacccucgccggccacacaaaagcugucuccucuguuaaguuuagcccuaauggggaguggcuggccuccucuagcgcugacaaacuuaucaaaauuuggggagccuaugauggcaaguucgaaaagaccaucuccgggcauaagcugggaauuagcgacguggcguggucuuccgauagcaaccuccuggugucugccuccgacgauaaaacacuuaagaucugggacgucagcucuggcaagugccugaaaacccucaaggggcacuccaauuacguguuuuguugcaacuucaauccccagagcaaccugauuguuuccggaucuuuugaugagagcgugcggaucugggacgucaaaacgggcaagugucugaaaacccucccugcucauuccgauccggugagcgccguucacuucaaucgcgacggcucucugaucguguccagcucuuaugaugggcuuugcagaauuugggacacagcuagcggacagugucugaagacccucaucgaugacgacaaucccccugucuccuuugugaaauucucucccaacggcaaguacauucuggccgcgacacuugauaacacccugaagcucugggacuauagcaaagggaagugccugaaaacguacacaggacauaagaaugagaaauauuguaucuuugccaacuucuccgugaccggcgggaaguggauugucagcggaucugaagauaaucugguuuacaucuggaaccuccagacaaaggagauugugcaaaaacugcagggccacaccgacguggucaucuccaccgcuugccacccuacagaaaauaucauugccagcgcugcccuugagaacgauaagacgaucaaacuguggaagucugacuguuga

SEQ ID NO: 77870 - RNA, 3201 nt, Artificial Sequence
  derived and/or modified sequence opt5 from WDR60__Homo_sapiens__NP_060521
auggagcccggcaagagacggaccaaagacgauacauggaaggccgacgaucugcgcaaacaccucugggcuauccagagcgggggauccaaggaagagagaaaacaucgggaaaagaagcugcgcaaagagucugaaauggaccuuccugagcacaaggagccgagaugccgggaucccgaccaagaugcccgcagcagagaccggguggcggaaguccauacggcuaaagaguccccucgcggcgaaagagaucgggaccgccagagagagcggcgcagagaugccaaggaccgggagaaagaaaagcugaaggagaaacacagagaagccgagaagucucauagccgcgggaaagaucgggaaaaggagaaagacagacgcgcucggaaggaggaacucagacagaccguugcccaccacaaccugcuuggacaggagacacgcgaccggcaacugcucgaaagagcugagcgcaaaggccgguccgugucuaaggugagaagcgaagagaaggaugaggacuccgaacgcggggaugaggaccgggaaagacgguaccgcgagagaaaacugcaguauggagauagcaaggacaauccccugaaauacuggcucuauaaggaagagggcgagcggagacaucgcaaaccucgggaacccgauagagacaacaagcaccgcgagaagucuuccaccagagaaaaacgggagaaguacagcaaagagaagucuaauuccuucagcgauaaaggcgaggaacgccauaaggaaaagagacacaaagagggguuucacuucgacgaugaacggcaucagucuaacgucgaccgcaaggagaaauccgccaaggacgagccuagaaaacgggaaagccagaauggagagcaccgcaacagaggcgcguccucuaagcgggaugggacaagcucccaacaugccgaaaaucuggugcgcaaccacggaaaggacaaagauagcagacggaagcauggccacgaggaagggucuuccguuugguggaaacuugaccagagaccgggaggcgaggagaccguggaaauugagaaggaagagacagaucuggaaaaugcucgcgccgacgcuuauaccgccagcugugaggaugacuuugaggauuacgaagacgauuucgaggucugcgacggcgaugacgacgaaucuagcaacgagcccgagucccgggaaaaacucgaggaacugccucuugcgcagaagaaagagauccaggaaauucaaagagccaucaaugcugagaacgagcgcauuggggaacugucucucaagcuguuucagaagcggggaagaacggaguucgaaaaagagccccgcaccgauacaaauagcuccccuagccgggccucuguguguggcaucuuuguugacuucgcuuccgccagccacagacagaagucucgcacccaagcccugaaacagaagaugcgguccacaaaacuccugagacuuaucgaucuggacuuuagcuucaccuuuucccuccuggaucuucccccggugaacgaauaugacauguacauucggaauuucgggaagaagaacacgaaacaggcuuacguccagugcaacgaggauaauguggagcgcgacauccaaacagaagagauugaaaccagagagguguggacacagcauccuggagaaucuaccgucguuagcggcggguccgagcagcgggauaccucugacgcgguggugaugcccaagaucgauacaccucgccuguguagcuuucucagagccgcuugccaggucauggccgugcugcuggaggaagaccggcucgccgcugagcccuccuggaaccugagagcccaagaucgcgcgcuuuauuucagcgacucuuccagccagcugaauacgucucuccccuuccugcagaaccggaaaguuuccagccuucacaccucuagagugcagcgccaaauggucgugagcguucaugaccugccugaaaaguccuuugugccgcuccuggauagcaaauacguccugugugugugggacauuuggcagcccucuggaccucagaagguccucaucugcgagucccaggugacauguugcugucugagcccccuuaaggcuuuccugcucuuugccggcaccgcccacggcuccguuguggucugggaucugcgggaggacucuagacugcacuauagcgugacacuuuccgauggguucuggaccuuucgcacggcuacauucucuaccgacggcauucucaccagcguuaaucaucgguccccucugcaagccguggaacccaucucuacaagcguccacaaaaagcaguccuuugugcugagcccguucucuacccaggaggaaauguccggacucagcuuucauaucgcuucucuggaugaguccggggugcuuaacguuugggucgugguggaacugccuaaagccgacauugcgggaagcaucucugaucucggccugaugcccgggggcagagucaagcuggugcacuccgcccuuauucaacucggagacagccugucccauaaaggcaaugaguucugggggacaacgcagacccugaacguuaaguuucucccuagcgaucccaaucacuucaucauuggaacagacaugggccugaucucucacgggacccgccaggaccuuagaguggcuccuaagcuguuuaaaccccagcaacauggaauccggccggucaaggugaacguuauugauuucagcccuuucggcgagcccaucuuucucgccgggugcuccgacggcucuauucgccugcaccagcugagcuccgcuuucccccuucuccagugggauucuagcacagacucccaugccgugaccggacugcaguggucuccuacgagaccggcggucuuucuggugcaagaugacaccagcaauaucuacauuugggaucuccugcaguccgaccuuggccccguugccaaacaacaggugagcccuaaccggcuggucgcuauggccgcugugggggaacccgagaaggccggaggcucuuuccucgcccuggugcuggcucgcgcguccgggagcaucgauauccagcaccuuaaaagacggugggccgcuccugaagucgacgagugcaauagacuccgccugcugcuccaggaagcccuguggcccgagggaaaacuucauaaguga

SEQ ID NO: 77871 - RNA, 4572 nt, Artificial Sequence
  derived and/or modified sequence opt5 from WDR62__Homo_sapiens__NP_001077430
auggccgcugugggcagcgggggauacgccagaaacgacgcgggcgagaagcugcccuccgucauggcugggguuccugcccggcgcggacagucuagcccgcccccugcucccccuaucugccucagacggcgcaccagacuguccacagccucugaagagacggugcaaaaucgggugagccuugaaaaaguccugggcauuaccgcccagaacuccucugggcucacaugugaucccggaaccggccacguggcuuaucuggccggcugcguuguggucauccuugacccuaaggagaauaaacagcagcauauuuucaacacagcgcgcaagagccuguccgcccucgcuuuuagcccggaugggaaauacaucgugaccggagaaaauggccacagacccgccguucggauuugggacguggaggagaagaaccaagucgcugaaaugcuggggcauaaguauggaguggccuguguggcguucucuccuaauaugaaacacaucgucuccaugggcuaccagcaugauaugguucugaacgugugggacuggaagaaagauaucguggucgccagcaauaaggugucuugccgcguuauugcucucuccuuuagcgaggacucuuccuauuucgugacagucgggaacagacacgugcgguuuugguuccuggaaguuagcaccgagacgaaagugaccuccacagucccccuugugggacgcucuggcauccugggcgagcuccacaauaacaucuuuuguggggucgccugcggaagaggccggauggcugggagcaccuucuguguguccuacagcggacugcuuugccaguuuaaugaaaagcgcguucuggagaaguggauuaaccucaaagugucucuguccagcugucugugcgucucucaggaacucauuuucuguggcugcacagaugggaucgugagaauuuuucaagcccauagccugcacuaucuugccaaucugccuaagccccauuaccucggaguugacguggcucagggccuggagccguccuuccuuuuucaccggaaagcggaagccgucuacccugauaccguggcucugacguucgaccccauccaccaguggcucucuugcguguauaaggaucauagcaucuacauuugggacguuaaagacaucaacagagucggcaaggugugguccgagcuguuccacagcucuuauguguggaacgucgagguguacccugaauuugaggaucagcgcgccugucugcccuccgggagcuuccucacauguucuuccgacaauaccauucgguuuuggaaccuggauagcucccccgacucucauuggcagaaaaauaucuucagcaacacacuucugaagguuguguaugucgaaaaugauauucaacaccuccaggacaugucccauuuuccugauagaggaucugagaacggcaccccgauggacgugaaggccgggguucgcgugaugcaagucagccccgauggacagcaccuggcuuccggcgaccggagcgggaaucuuagaauccacgaacugcauuucauggaugagcucgugaaaguugaggcccacgacgcggaagugcugugccuggaguacucuaagccugaaaccggccucacacugcuugcuuccgccagccgcgaccggcugauccauguccucaacguggagaaaaauuauaaccuggaacagacgcuggaugaccacucuuccagcauuaccgccaucaaguuugcuggaaauagagauauucagaugaucucuugcggcgccgacaaaagcauuuacuuccgcuccgcucaacaggggagcgauggacuucacuuugugcggacacaucacgucgccgagaagaccacacucuacgacauggauaucgacaucacccagaaguauguugcgguggccugucaggauagaaacgugcgcgucuacaauacggugaacggcaaacaaaagaaaugcuauaaggggucucagggagacgagggcucccugcugaaaguucauguggaucccagcgggacauuccucgcuaccuccuguucugacaagagcauuuccgucaucgauuuuuacucuggcgaaugcauugccaagauguucggacacagcgagaucauuaccuccaugaaauuuacauaugacugucaucaccugaucaccgugucuggcgacagcugcguuuucauuuggcaccuugggccugaaaucacaaauuguaugaagcagcaucugcucgagaucgaucaccggcagcaacagcagcauacgaacgacaaaaagagauccggacacccccggcaggauaccuacgugagcacaccgucugagauucauucccugagcccuggcgaacaaaccgaggacgaucuggaagaggaaugcgagcccgaggaaaugcuuaaaacaccuucuaaggacucccucgaucccgacccucgcugccugcugaccaacgggaagcucccccugugggcuaaaagacuucugggagaugacgaugucgccgacggccucgcguuccacgccaagcggagcuaucagccgcacgggagaugggcugagcgcgccggccaggaaccucugaaaacgauccuggaugcucaagaccuugacuguuacuuuacccccaugaagcccgagucucucgaaaauuccauucuggauagccuggagccucagucccucgccagccugcuuucugagagcgaauccccgcaggaggccggacggggccaucccucuuuccugccucagcaaaaagaaagcuccgaggcuucugaacucauccuguacagccuggaggcggaggugacaguuaccgggacagacucccaguauugcagaaaggaaguggaggccggacccggcgaucagcagggggacucuuaccuucgcgucagcuccgauagcccuaaagaccaaucucccccugaagauuccggagagagcgaggcugaccucgaauguucuuuugccgccauucacucccccgcuccgccucccgauccugcccccagauucgcgaccagccugccgcauuuuccuggcugcgcugggcccacggaggacgaacugucccucccugagggccccucugugcccagcuccagccugccucagacaccggaacaggagaaguuccuucggcaccacuuugagacccugacagaaucucccugucgcgaacucuucccugccgcccugggagauguggaggcuuccgaggccgaagaccacuuuuucaaccccagacugagcaucucuacccaguuucuuagcucccugcaaaaggcgucucgguucacccauacauuuccuccccgcgcuacgcagugccucgucaaaagcccugagguuaagcugauggacagaggcgggucccagccgcgggccggaaccggcuaugccucucccgaucgcacacaugugcucgcugccgggaaagcugaggaaacccuggaggccuggagaccucccccucccugucuuacaagccuggcguccugcgugccggccagcucuguccucccuaccgaccggaaucugcccacgcccacauccgcuccuacccccggacuggcccaaggcgugcacgcuccuagcaccuguuccuacauggaagccacagccucuagccgcgcuagaaucucccggucuauuagccuuggcgauuccgaggggccgaucguugcgacccuggcccagccccucagacgcccuagcucugugggagaacuggcuucccucggccaggagcugcaggccauuacaacggccaccacacccagccuugacucugaggggcaagaaccugcucugcgguccuggggaaaccaugaggccagagcgaaucuccgccugacccugagcucugcuugcgauggccuucugcagcccccggucgacacacagccuggggugaccguucccgccgugagcuucccugcccccuccccugucgaagagucugcucuccggcugcacggaagcgccuucagacccucccucccggcgccugagagccccggccugcccgcucacccuuccaacccgcagcuucccgaagcccgcccuggcauccccgggggaacggccucucugcuggagccuaccagcggcgcucucgggcugcuucaaggaucccccgcccgguggucugaaccuugggugccggucgaggcucugcccccuagcccccucgaacuguccagagugggcaauauucuccaucgccugcagacaaccuuucaggaggcccuugaucuguaucggguucuggugucuagcgggcaggucgacacaggacaacagcaggcgagaaccgagcucguguccacauuccuguggauccacagccagcuugaagccgagugucugguuggcaccucuguggcuccugcccaagcucuccccuccccgggcccucccucucccccuacgcuguacccccucgccagcccugaucugcaggcccuucuggaacauuauuccgagcugcucguccaggcugugcggcgcaaggcgagagggcacuga

SEQ ID NO: 77872 - RNA, 3246 nt, Artificial Sequence
  derived and/or modified sequence opt5 from WDR64__Homo_sapiens__NP_653226
auggacaucagaaaggagaaacggcugaacauggcccuccagaugagcaauuucaagaaagcucugaaccgcuuugaaaagcugguggagcaaaccgccgcgcagaaaagagaugaacgggcuggccuguucauucacaaggaggacgccaucggguacgauaaguuuuaugccuccguccagaaacucuucggacccgacguuaagaaucaggaugugaaacgcuuuuacagaaagcugugcaacaauacagacgcuucugccgauuggugugaaauuuucggcuauuuuagcuccgaggaggacccuaucgcuucucaacuugaugaagagaaccugguguucuuugucagccggaaacgccggauucucaucuccgggucuagacgcagagacgugaucaagagcauuguuaagaucccgcaucuggaucugcucauuacggccacccagaaaggacugaucacaguguucaauaaccaggacaccuccuggauuacaggcugcgauuaccuucugcagcucaagcggaucgucgcgaccacagaacgcaccauuaucgugugggacuauaaagcccaagggagcucucaggagaauuacuuuguuaucaagcccauggaccacugucugcuuugcgugugugucgugccucugcccgaucaucucugcagagacgauauucugcugggagacgauggcggcuucgugaaccgguuuacggucaauuccgacgauuucgggaucaaacaggcuaagagcaaacgcaagcuccagaaccaaguucuggacucuaagaauuucaaauccgugaagagaaaacuucacaacgauugggugaugaagauucgguauaucagcgcccugaauuguuuuggaucuugcucccucgacagcaaccauucccugguccuugagucucugaaaagacucgaagauaaccugccugugcgcgaguucagcaugccccggggcgcuaauaccuuuuguuacugcguuaaggccaacgugauugucacagggggagacgacaaggugaucagacuguggcacccuaauaucuccaccaaaccgguuggcaagcucguggggcacauguucagcauugcggaaaucgucacaaacgagaaagaucagcauguggucucucuguccagcgccaagguguuucgcguuugggacauucagacccuuucucugcuccaaguguuccacgauagccagggaggccccggcgacaugcagaucuacuccaugauuuaugaugcuaaucaugggaugcugaucacgggaucuagcgucauggacauguacccucuuacacggaugauccaggauaccaaacaagugccccacacacacgaaagagagauuaacguuaugcuguauaauaaguacuuucaucaggugcucaccaucuguuccgagagcauuauccgcgucugggaacuggagaccggccuucagguguaucagauucucgaaccucacggguucaacacagaggugacgucugccgcuguugacgaauccggauuucuguucgccaccggcgccuacaaugggacaguccggaucugggauuuuggaagcggccaagagaugaaggugcuucccgagggcaaagacuggaaggaagaugagcauugccugagacgccucauuuuccugaaagcucaggaaaagcaccagcagcuggugcuugcgcucgagcggaacgggaccaucaaaaugauccaaggaaaggaagacgauauuuaucugauggucaucugggagcugccggacgugguuccuuuucuccaggacggcaagcaugccgugcaccugagaaugucuacacgcgaucggaauauggcuauucccuucccugacgucgagcuuaucguggaaagaaacuucucccagcccaccgauaaucccacgauggaccugcuccggguuaacugcauugaucugcuucagguggagggguacaaucugaucgccgccggaacacucaacggcgucaucauucuguggaacuuugugaccagcaccguuaaaaagguguaccgcccugaagacuguuucacagucaauccggaucugcaccccaaacauuuuaagaucaacgacauucucuuccuguuuagaaccccugagugcgcucggagauccucucaagauagcaucuguuccucuagccagugcgaguccagcaaagggccccagucuuccaagggcagcaaacaaucuauucacgacuccgaagugaagggagagcagacagaugugauggucggcaagcagcagccuauggacaaaaagcaucccgggaucgccaaucuuccggaagcgcaaccucccauccugguuacggcucacgaggauggacaccuccgccuguggacccuggaaggccggcuucucaaagacaugcugccuuucacaaagcauagcgccauuucucugaccagccucuauacagacuccuguaccagaauccugcuugccgggaacguggagggacacgugauucugugcaauaucagcucuuuucucgaucccccucaugacgagaaaaaguucaagcagcugcuguccuggcgcgcucacagccuugaaauuauccaggucaucuacguggaggaaaaacagguugugcucacggccuccauugauggcucugucagacuguggcaugcucugaacgggcacuauuguggcuacuuuggacaacggcgccucuucgagcugagccagaccagagacuuuauccuucccugcgaugugacagaauauccgauugagaucaaggaggaauccaaauucaccgagaagcagaaauacgaauauccucugauuuuugaccgggagaaguggcgcaagaugucuagcguuucccuccuguucaaaagaacaccucccaaggccuucgaaguggagcaggauuuuaaauucuuuaagucucugagcucccccaaaauccggcgcuacccgcuugagggcuucgucaccgaaaauagagaggcggggauuguguuuggaagccugcccaucuacucuaucuccagcccuacgucucuccgguuccugccccucauuggcguugaagcccaaaaggacuccagcgaugggaucacaggaaagaaaaagggcgggcacgugcagcgcgagaaagcuccuagacggagaucucugaagaaaaaccuugucccccagauuaaucuggccuccagcuuuuucccugcuauccccaaguga

SEQ ID NO: 77873 - RNA, 2826 nt, Artificial Sequence
  derived and/or modified sequence opt5 from WDR66__Homo_sapiens__NP_001171474
augagcgacgccgcugaggcccccagagaagcgaccggcgagaacggggaaacagagaugaaggaagaggaggaaccuaauccgaacuacaaagagguggaagauccccagcaagaguccaaggacgauacgaucgcuuggcgggagucucaggaagaggaacgcaaaaccggagaggaagagggcgaggaagaggggaaggaagacaaaaagauugucauggaggaaacagaggagaaggccggagaaguucaggagaaagaagccagcggcauccaggaggaaaccacaguggagccucaagaggugaccgcuuccaugauuagacuggaaacacagaucaccgauucucagagcauuacguccgggaucuuccccaagacccagcggggaucuaaaagcaagcucucccugcaacuugaggacgccgaaacagaugagcugcuccgcgaccugagcacccagaucgaguuucuugaucuggaccagauuucuccugaggaacagcaaaucuccagccccgaaagacagccuucuggcgagcucgaagagaaaacagaucggaugccgcaggacgagcugggccaagaacgcagagaucuggagcccgaaaaucgggaggaagggcaggagcgcagagucuccgacauucagagcaaggcuggaaucucucgggagucccucgugagcuccaccacggaagacauucuguuccagaaggauaaaucuacaccuguuuauccccuuaccaugacauggagcuuuggcuggaacuccagccugccuguguacuauauccgcgaggaaagacaacggguccuccuguacgugugcgcccacaccgcgauuaucuauaauguuuuccgcaacaaucaguaccaucuucaggggcacgccaacaucauuucuugucugugcguguccgaggacagacgguggaucgcuaccgccgauaagggacccgacugucucgucauuaucugggauagcuuuacaggcauuccggugcauacgaucuucgacucuugcccugaagggaauggaaucauggcuauggccaugacccacgaugcgaaauaucuggccacaauuagcgacgcugaggugcagaaggucuguaucuggaaauggacccuggccguugagacacccgcuugcacccucgaacugccuacggaguacggcgugcaaaacuacgugacauuuaaucccaccaacaauaaggaacuugucuccaacucuaaaaccagagccauuuauuacgccugguaugaggagcgcgauacacuggcucauagcgcgccccuccugaccgaaaagacauucaauaaacuugugggcaaguuuucccagagcaucuuccaccugaaccucacgcagauucugucugccaccauggaggggaagcugguugugugggacauccaccggccuccguccagcgcuucuacauuucucggauuccccuacaucaaaccuuguaagcugguccaucuucagaaagaaggcauuaccgugcugacaaccaucgauuccuauauuguuacgggggacaucaagggaaacauuaaguuuuacgaccacacccucagcaucgugaauugguauucccaucugaaacuuggcgccauuagaacacugucuuucagcaagacccccgccacaccucccaccgagaaauccaacuacccgccugauugcacgcucaagggggaccuguucguccugcgcaauuuuaucaucggaacaucugaugcugccguguaccaccucaccacagacggcaccaaacuggaaaaacuuuucgucgagcccaaggaugcgauuugugcuaucagcugccacccuuaucaaccccugauugccaucggcuccauuugugggaugaucaagguguggaacuacgagaauaagcaguaucucuuuagccggguuuucgaaaaaggacugggcgugcagucucugaccuacaacccugagggggcccuucucggagcuggcuuuacagaagggacggucuauauccuggacgccaugucccuggagaaugaaagccccgagccguucaaguacucuagaaccuccgugacacauauuagcuuuucucacgauagccaguauauggcuaccgccgaccgcuccuucacaguugcgguguacaugcucgucgugcggaacggccaaagagugugggaguaccuggcccgccuucggagccauagaaaaucuauccgcucccugcucuuuggaguuuaucuggauagcaaugaaccucggcugcuuucccucggcaccgacagacugcugauugaguacgaucuccugcggucuuauaaggaccaccuugaaguccuggauauccaucacacggaccaggggugcuaccccacaugcauggugugguaucccccucucacccgcgagcuguuccugcuuauuuguaacagcggauacaaggugaaacucuuuaaugcuaccacaaagaugugcagaaaaacccugcugggcccggccuaugggucccccaucgaacagacacaaguccucccugugcggucuauggcugagcugcagaagagauaccuuguuuucaucaaccgcgacaaagugggacugcagauucuccccgucgauggcaauccucacaagacgagcgccaucgugugucaucccaacgggguugcgggcauggccguguccuacgacggaugcuaugcuuuuaccgccggcgggcacgaucggucugucgugcaguggaaaauuacacugagccauccuggaucccaagcucccauccugagcccgucugacaccuccagaagcuga

SEQ ID NO: 77874 - RNA, 1965 nt, Artificial Sequence
  derived and/or modified sequence opt5 from WDR70__Homo_sapiens__NP_060504
auggagagaagcggccccuccgaagugaccgggucugacgccagcggaccugauccgcagcuggcugucacaaugggcuucacgggguuuggaaagaaagcccggaccuucgaccucgaggcgauguuugaacaaacacgcagaaccgcuguugagcggucccgcaagacacuggaagccagagagaaagaggaagagaugaaccgggaaaaggagcuucgcagacagaaugaggauaucgaacccaccucuagccgguccaacguggugcgcgacugcucuaaaagcuccagcagagauacaucuuccagcgagucugaacaguccagcgacucuuccgaugacgagcugauuggcccuccccucccucccaagauggucgggaagccugugaauuucauggaagaggauauccugggaccgcuucccccuccccugaacgaggaagaggaagaggccgaagaggaggaagaggaagaggaagaggaggaaaauccuguucacaaaauucccgacagccaugagaucacccucaagcacggcacgaaaaccguguccgcucugggccuggauccgucuggggcccggcucgucacaggaggcuacgacuaugaugugaaguuuugggacuucgcugggauggacgccagcuuuaaagcguuccgcucccugcagccuugugaaugccaucaaauuaagagccuucaguacucuaacaccggagauaugauccugguuguguccggcagcucucaggccaaggucaucgacagagauggguuugaggugauggaguguauuaaaggagaccaguauaucguggauauggcuaauacaaagggccacaccgccaugcuccauacgggcagcuggcaccccaaaauuaagggggaguucaugacaugcuccaacgacgcuaccguccggacaugggaaguugaaaauccuaaaaagcaaaaaucuguguuuaagccccgcaccaugcagggaaagaaagugauccccaccacauguacguacagcagagauggcaaccugauugccgcggccugccagaauggguccauccagauuugggaccggaaccuuaccguccacccuaaguuccauuauaaacaagcucacgauagcggaacagacaccucuugugugacauuuuccuacgauggcaauguucuggccagcagagggggagacgacucucucaagcugugggauauccgccaguucaacaaaccgcuguucuccgcuagcggccuccccaccauguuuccuaugacggacugcuguuucucccccgaugacaagcugaucgugacaggcaccucuauucagcgggggugcggaagcggcaaacuugucuuuuucgagagacgcaccuuucaacggguguaugaaaucgauauuacagacgccuccguugugagaugucuguggcauccuaagcucaaucagaucauggucgggaccggaaacggccuggccaagguguacuacgaucccaacaaaucucagcgcggggcuaaacuuugcgucgugaagacacagcggaaggcgaagcaagccgagacgcugacccaggacuauauuaucacaccgcacgcucucccuauguucagagagccccgccagcggagcaccagaaaacagcuggaaaaggaucgccuggacccucucaaaucccacaagcccgagccucccguugccggcccgggacggggcgggagagugggaacacauggcgggacccugagcucuuacaucgucaaaaauauugcccuugauaagacggacgauuccaacccucgggaagcuauccugcgccacgccaaggcggcugaggacagccccuauugggugucucccgccuacuccaaaacccaaccuaagacaauguuugcccagguugaaagcgacgaugaggaggcuaaaaaugaaccggaguggaagaaaagaaagauuuga

SEQ ID NO: 77875 - RNA, 3309 nt, Artificial Sequence
  derived and/or modified sequence opt5 from WDR72__Homo_sapiens__XP_011519737
augagaaccagccugcaggccguggcucucuggggccaaaaggcgcccccucacuccaucacagccauuaugaucacggacgaucagcggaccauugucacagggucucaggagggacagcugugccuuuggaaccugagccaugaacucaaaaucuccgcuaaggagcugcuuuucggccacucugccagcguuaccugucuggcccgcgcuagagacuuuuccaaacaaccguacauugugucugccgcugaaaauggggagaugugcguguggaacgucacaaauggacaguguauggaaaaggccacccuccccuaucggcauacagcgaucugcuacuaucacuguagcuuccgcaugaccggcgagggguggcugcugugcuguggagaguaccaggaugugcucaucauugacgccaaaacgcuggcuguugugcauuccuuuagaagcucucaguucccugauuggaucaacugcauguguauuguccacuccaugcggauccaagaagacagccuucuggugguuucuguggccggcgagcucaaggucugggaucuguccagcucuauuaauuccauccaggaaaagcaggacguguaugagaaagagagcaaguuucuugaaucccugaacugccagaccauucgcuucuguacauacaccgagagacuccugcugguggucuuuucuaaaugcuggaagguuuaugauuacugcgacuucagccuccugcuuacagaagugucccggaauggccaauuuuucgcugggggagaggugaucgccgcgcaccgcauccugauuuggaccgaagauggccauagcuacaucuaucagcuccugaacucugggcuuuccaaaagcauuuaccccgccgacggaagaguccugaaggagacgaucuauccucaccuccuguguucuacaagcgugcaggagaauaaggaacaaucccggcccuuuguuaugggcuacaugaacgagcgcaaagaaccuuucuauaaggugcuguuuucuggggaggucagcggaagaauuacccucuggcauaucccggaugugcccguuuccaaauucgacggcagcccucgggaaauccccgugacagcuaccuggacccugcaggacaauuucgauaagcacgacacaaugucucaguccauuaucgauuacuuuagcggccuuaaagacggggccggaacggcugucgugaccucuuccgaguauauuccuagccuggauaagcucaucugcggcugugaggacgggacaauuaucaucacccaggcccugaacgccgcuaaagcgcgccuucuggaaggaggcucccucgucaaggauucucccccgcacaaggugcugaaagggcaucaccaaagcguuacaucccugcucuacccucauggacugucuagcaaacuugaccaguccuggaugcugagcggcgaucucgacucuugcgugauucugugggauaucuucaccgaggaaauucugcacaaauuuuuccuugaggccggccccgucacgucccuccugaugagcccugaaaaguuuaaacugagaggggagcagaucauuuguugcguguguggagaccauucuguugcucuccugcaccuugagggcaaguccugccugcuccacgcccggaagcaucuguuccccgugagaaugaucaaauggcaccccgucgaaaauuuucugauuguggggugugccgacgauagcguguacaucugggagaucgaaacaggaacccuugagcgccaugagaccggcgaacgggcuagaauuauccucaacugcugugacgauucucagcugguuaagagcguccugccuauugccuccgagacacucaaacacaagagcaucgaacaacggucuuccagcccguaucagcuggggccccuuccuugccccggccuccagguggaguccucuugcaaagugaccgacgcgaaguucuguccucggcccuuuaauguccugccggugaagacaaaauggagcaacguuggauuccacauucugcuguuugaucuugaaaaccucguggagcugcugcucccuacgccccuguccgacgucgauucuagcuccucuuucuacggcggggaggugcuuagacgcgcuaagagcaccguugaaaagaagacacugacccuccggaaauccaagacagccugcggaccucugagcgccgaggcucuggccaagcccaucaccgaaucucuugcucagggcgacaauacgaucaaauuuuccgaggaaaacgaugggauuaagagacagaaaaagaugaaaaucagcaagaaaaugcaaccuaagcccucucgcaagguggacgccucccucaccauugauacagcgaaacuguuccugagcugucuccugccguggggagucgacaaggaucuugacuaucugugcaucaaacaucucaauauucugaagcugcagggcccuaucucucuugggaucucccugaacgaggacaauuucagccucaugcugcccggcugggaucucuguaacuccggaaugauuaaagacuacagcggcgugaaucuguuuucucggaagguucuugaucugagcgacaaguauaccgccacacuccccaaccagguggggaucccuagaggacuggagaauaacugcgauucccugcgcgaaucugacaccauugucuaccuucugagccgccucuuccuggugaauaaacucgugaacaugccgcuggagcuugcuuguagagucggcuccucuuuucggauggaaagcauccacaauaagaugcgcggggccggaaacgauauucugaauauguccucuuucuauagcugccucagaaacggcaaaaacgagucccauguucccgaagcugaccugagccugcuuaagcugaucucuuguuggcgggaucaauccguccaggugacggaggccauccaggcggugcuccuggccgaggugcaacagcacaugaaaagccucgggaagauuccuguuaauucucagcccguguccauggcugaaaacggcaauugcgagaugaagcagaugcugccuaaacuugaauggacagaggagcuggaacugcaaugugucagaaacacccucccccugcagacaccugugagccccguuaagcaugacuccaauucuaacagcgccaauuuucaggauguggaggacaugccggaucgcugcgcucuugaagaguccgaaagcccuggagagccccggcaccacucuuggaucgccaaagucugcccuuguaagguguccuga

SEQ ID NO: 77876 - RNA, 1158 nt, Artificial Sequence
  derived and/or modified sequence opt5 from WDR74__Homo_sapiens__NP_060563
auggccgcugccgcggcuagauggaaccacgugugggucggcaccgagacagggauccugaagggaguuaaucuccagcggaaacaagccgccaacuucacggcuggcgggcagccccgcagagaagaggccgugagcgcucugugcuggggaaccggcggggaaacacagaugcuugugggaugugccgaccggaccgucaagcauuuuuccacagaggauggcauuuuccagggccaacgccacugcccugggggagaaggcauguuuagagggcuggcgcaggccgacggaacccucaucacauguguggauucuggcauucugcggguuuggcaugacaaagauaaggacaccagcuccgauccgcuucuggagcuccgcguggggcccggagucugcagaaugcggcaggacccugcucacccccaugugguugccacgggcggcaaagagaaugcucugaagaucugggaucugcaggggucugaggaaccuguguuccgcgccaagaacgucagaaaugacuggcucgaucugcgggugcccauuugggaccaagauauccaguuucuuccuggaagccagaaacuggugaccuguacaggcuaccaccagguccgcguuuaugacccggcgucuccccaaagacggccugugcucgaaaccacauacggggaguauccccugaccgccaugacgcuuacaccuggaggcaacuccgugaucgucgggaauacccacggacagcuggcugagauugaccuccgccagggcagacugcugggcugccucaaggggcuggccggaagcgugcggggccuucaaugucaucccuccaaaccgcugcucgcuagcugcgggcuggauagaguucuucgcauccaccggauucagaacccuagaggacuggaacauaagguguaccucaaaucucagcugaauugucugcuccuguccggccgcgacaacugggaggaugaaccccaggagccucaagaacccaauaaggucccccuugaggacacagagaccgaugaacugugggccagccucgaggccgcugcgaagcggaaacugucugggcuugaacagccucagggcgcccugcagaccagacgccggaagaaaaagagaccgggauccacaagccccuga

SEQ ID NO: 77877 - RNA, 1881 nt, Artificial Sequence
  derived and/or modified sequence opt5 from WDR76__Homo_sapiens__NP_079184
augagcagauccggcgccgcugccgaaaaggcggacucucggcagcgcccccaaaugaaagugaacgaauacaaggagaaucagaacaucgcuuaugucagccugagaccugcccagaccacaguucucauuaaaacggccaagguguaccuggcuccguucucccuuucuaauuaucagcuggaucaacucaugugccccaaaagccuguccgaaaagaacucuaauaacgagguggccuguaagaaaaccaagaucaaaaagacaugccggcgcauuaucccucccaaaaugaagaauaccagcuccaaggcugaaagcacacuucagaacucuuccagcgccguccacaccgagucuaauaaacugcagccuaagagaacagcggacgccaugaaccucuccguggauguugagagcucucaggacggggauuccgacgaagauaccacgcccagccuggacuuuuccggacugucuccuuacgagcggaaacgccucaagaauauuagcgaaaacgcugauuucuuugccucccugcaacuuagcgagucugcugccagacugcgggagaugaucgaaaaacgccagccgcccaaguccaaaagaaagaagccuaaacgggagaauggcaucgggugucgcagaagcaugcggcuccugaagguggaccccucuggagucagccuuccugcggcccccaccccgccuacacugguggcugaugaaacaccccuccugccucccggcccccuggagaugaccuccgaaaaccaggaggacaauaacgagcgcuucaaaggguuucuccauaccugggccggaaugucuaagccuagcuccaaaaacacggaaaagggccugagcucuauuaaguccuauaaagcuaaucuuaacggcaugguuaucagcgaggauacaguguacaaggucaccacagggccgauuuucucuauggcccugcaccccuccgaaaccagaacccucguggccgugggagcuaaauuuggccaggucgggcugugcgaccuuacacaacagccuaaggaggacggaguuuauguguuccauccccacagccagccuguguccugucuguacuuuucucccgcgaauccggcccauauccucagccuguccuacgauggcacgcugcggugcggggacuucucuagagcuauuuuugaagaggucuaucgcaacgagcggagcuccuucagcucuuuugauuuccucgccgaagacgccuccacccugaucgugggacacugggauggcaauaugagccuuguugacagacgcacaccuggcaccucuuacgagaaacugacauccagcucuauggggaagauucggaccgugcacguccaucccgugcacagacaauauuucaucacggcuggacuccgcgauacacauaucuacgacgcccggagacugaacagccgccggucccagccucuuauuagccugaccgaacacaccaagucuaucgcguccgcuuauuuuagcccccucacaggcaauagaguugugaccacaugugccgauugcaaccugcgcauuuucgacuccucuuguaucagcuccaaaauuccucugcucacgaccauccggcacaauacauuuaccgggagauggcugacacgguuccaggccaugugggaucccaagcaggaggacugcgucaucgugggaucuauggcucauccgcgcagagucgaaauuuuucacgagaccggcaaacgggugcauagcuucgggggagaguaccuuguuuccguguguucuaucaacgccaugcacccuacgagauauauucuggcuggcggcaauagcuccgggaagauccaugucuuuaugaacgagaaaagcugcuga

SEQ ID NO: 77878 - RNA, 2448 nt, Artificial Sequence
  derived and/or modified sequence opt5 from WDR78__Homo_sapiens__XP_011540464
augacccccggcaagcacagcggggccuccgcuagagccgcgaacggaggcgcuuggggguaccgggacuuccgcggaggccagaaaaagggguggugcacaacgccucaacugguggccaccaugccggucucucccgccggaagccauaaacagcagaauuuuggccucaacaaugcuacacagccuaagaaauccaucucuuucuuugccaccaugaaggcuacaagcguuaagggcuauaccggggccaaccaauccagaauggcggugucuaaaacagugcugauucccccugagcuuaagaccgucgaaaaacccaauccuaacaucaagacgacccagguguucgauauuaauggaacagacguuaccccgcggccccuguaccacccugauccccucacaggcaccgccaaaccuagcaagcugcuuacgucccaggaggggagccugggaucugaauuuaucuccagcuauucucucuaccagaacacaauuaaucccuccacccugggccaauucacacgcagcgugcuggggucuuccaccgucagcaaguccucugugagcgcuuccgagagcaucgccgaagaccucgaggagccgucuuauaaaagagaacggcugaccuccuuuacagaucuucagguuauccgcgcugccccugagaagauugugacgaaagaagaccuggagaagaacaucgagauuauccucaccgaaacagagacccugagauucuuugaucuucccacagucauggugagcguggaaucugaggaagcggagaaagucacccagcggaauaagaacuacgagguucugugucgcaauagacucggaaacgaccuguauguggaacggaugaugcagacguucaauggcgccccuaaaaacaaggaugugcaaugcgacaagauuaucauggaggauaaaggcauuaugagcacagcuugggaccuguacgauuccuacaacgccauggaacucgucucucugagcgugaagcaguccguuguggagucuagcuccaaagcuaauguccuucccaaggaccaggaccaacgccugcccgggagcaccaccgagaaaaacucugagacauccagccucauggauaucgagaaugugauccuggccaagauucaugaagacgaggaagaucacuccgacgccauccuuaagucugauaaauuucaucaggaccuguucuuuauggagagaguucucauggaaaacauuuuccagccuaagcuggcugcguaucggcagcugccggugcucaaagagcccgagccugaagaacccgaagauguccuggagagcgccaagcacgaggaaguggaggaagaguccaaaaaggaagaggaggaagagauccacgcugaagagucuaccauuccugccaaucuugaacgccuguggagcuucuccugugaccucacaaagggacugaacgucagcucucuugccuggaauaaaacgaaccccgaucugcucgcugugggcuacgggcauuuuggauucaaggagcagaaaagaggccuggccugcuguugguccaucaagaauccgauguggccugagcggaucuaucagagccccuacgggguuaccgcgguggacuuuucuauuggagcuccuaaccugcucgccgucggcuaucacaauggcacaaucgccauuuacaacgugagauccaauagcaacguucccgugcuggauucuagcgaauccccucagaaacaucuugggcccgucuggcagcugcaauggaucgagcaggaccgcggaaccacaggcgacgggaagcgggaaauucucgugagcaucucugcugauggaagaaucuccaagugggugauucgcaaaggccuggacugcuaugaucugaugcggcuuaagagaaccacggccgcuagcaauaaaaagggcggggagaaagaaaagaaagacgaggcccucaucucccgccaggcgccgggaauguguuucgccuuucacccuaagggccccguuuacaaggucaccuggaaccccuucugccacgauguguuucugucuuguagcgcugacuggggagugauuaucuggcagcaagagaacgucaaaccuucccugucuuucuacccggccacaagcgugguuuaugauguggcuuggucccccaagucuagcuacauuuuugccgcggccaaugaaaaccgggucgagaucugggaccuccauauuuccacccuggauccucuuaucgugaauacagcuaaccccgggaucaaauucaccacgauucuguuugccaagcagacagacugccuccugguuggcgauagcgacgggcaagugucugucuaugaacugagaaauaugccuaccgugcuugagacaggacgcggcgauaucauggacacccuccugggguccaaaagcaaccagucugcuuga

SEQ ID NO: 77879 - RNA, 4473 nt, Artificial Sequence
  derived and/or modified sequence opt5 from WDR7__Homo_sapiens__NP_056100
auggccggcaacagccuggugcuccccaucguccugugggggagaaaggcuccuacccacugcauuuccgccguucuucugacagacgauggagcgacgaucgugaccggcugucaugacgggcagauuugccucugggaucugucuguggagcuucaaaucaauccgcgggcucuccuguucggacacacagccagcauuaccugucuguccaaagccugcgcuucuagcgacaagcaguacaucgucuccgccucugaaagcggcgagaugugucugugggauguguccgacgggcgcugcaucgaauuuacaaaacucgcuuguacccauacagggauucaguucuaucaguuuagcguuggcaaccaaagagagggccggcugcuuugccacgggcauuaccccgaaauccugguggucgaugccaccucucucgaggugcuguauucccuuguuagcaagauuucuccugacuggaucuccagcaugucuauuauccgcucccacagaacgcaggaggauaccguggucgcgcugagcgugacaggcauucucaaaguguggaucgucaccuccgaaaucucugacaugcaggauacagagcccauuuucgaagaggagagcaagccuaucuacugucagaauugccaauccauuagcuuuugugccuucacccagcggucucugcugguugugugcuccaaguauuggcgcguguuugacgcuggagauuacagccuccugugcucugggcccagcgaaaacggacagacguggacaggcggggacuucgucuccucugacaaagugaucauuuggaccgagaauggacagagcuauaucuacaaacuuccugccuccugucugccggcuagcgauucuuuuagauccgacguuggcaaagccguggaaaaccucauucccccuguccaacacauccugcuugaucggaaggacaaagagcugcucaucugucccccugugacacgcuucuuuuacggcugcagagaauauuuccauaagcugcugauucagggggauagcucuggacggcucaauaucuggaacauuuccgacaccgcggauaagcagggcagcgaggaggggcuggccaugaccacauccaucucucuucaagaggcuuuugacaaacugaaucccugcccggccggaaucauugaucagcucagcguuaucccuaacuccaaugaaccccugaaggugacggcuucugucuacauuccugcccacggccgccuugugugugggagagaagacggaagcaucgucauugugcccgccacccagacagcuaucguucagcugcuccaaggcgagcauaugcugcggcgcggcuggcccccucacagaacccugcgggggcacagaaacaaagugacaugccuccuguauccgcaucaggucuccgcgcgcuacgaucagcgguaucuuauuagcggaggcguggacuucucuguuaucaucugggacauuuucuccggggaaaugaagcacaucuuuugugugcauggaggcgagauuacccagcugcucgugcccccugagaauugcagcgccagaguccaacacuguaucugcucuguggcuuccgaucauagcguugggcugcugucucuucgcgaaaagaaguguauuaugcucgccagccggcaccuguuccccauccaggucaucaaauggagaccuuccgacgauuaccugguggugggcugcagcgacggaucugucuauguguggcagauggauacgggcgcccucgaccgcugcguuauggggauuacagcuguggagauccugaacgccugugaugaagcgguccccgcugccguggacucccuuagccacccggccguuaaucugaagcaggcuaugacccggagaucccucgccgcucugaagaacauggcccaucacaaacugcaaacccuugcgacaaaccuccuggccucugaggcuagcgauaagggaaaucugccuaaauacucccauaacucucucauggugcaggccauuaagaccaaucugacagaccccgauauccacguccuuuucuuugacguggaagcucugauuauccagcuccugacggaggaggccagccgcccuaacaccgcgcugaucucccccgaaaaucuucagaaagccucuggcagcuccgauaagggaggcagcuuucucacaggaaagcgggcugccguucuguuccaacaggugaaagagaccauuaaggaaaacaucaaagagcaucugcucgacgacgaggaagaggaugaagagauuaugagacagcgccgggaagagucugacccugaguacagauccagcaagucuaaaccccugacacuucuggaauauaaucucaccauggauacggcuaagcuguuuauguccugccugcacgccugggggcuuaacgagguccucgacgaagugugucuggaucggcugggcaugcucaagccgcacugcaccgugagcuucggacugcuuucucgcggcgggcauaugucccugaugcucccuggauacaaucaacccgccuguaaacugagccacggcaagacagaggucgggagaaaacugcccgcuuccgaaggaguuggcaaggggaccuauggcgugagccgggcggugacaacccagcaucuucugucuaucauuagccucgccaacacgcugauguccaugacaaaugcuaccuuuaucggagaccacaugaaaaagggcccuacaagaccgccccgcccuucuacccccgaucucagcaaggcccggggguccccucccaccucuagcaacaucguccagggacagauuaaacaaguggccgcuccuguuguguccgccagaucugacgcggaucacagcggcuccgaucccccgagcgcuccugcccugcauacaugcuuccuugucaaugagggguggucucagcuggccgcuaugcacugugugaugcuccccgaccugcugggacuugacaaguuucgcccuccccugcucgagaugcuggccagacgguggcaggaucgcugccucgaaguuagagaggcggcucaggcccugcuucuggccgaacuccggcgcaucgagcaagcuggcagaaaagaagccauugacgcuugggccccguaccugccucaguauaucgaccaugugauuucccccggggucacgagcgaggcggcccagaccaucacaaccgcuccugaugccucuggccccgaggcuaaggugcaggaagaggaacacgaccugguugaugacgauauuacaaccggaugucuuuccagcgugccccaaaugaaaaagaucuccacgucuuacgaggagcggcgcaaacaggccacagccaucguccugcucggcgugauuggggcugaguucggagcggaaaucgaaccuccgaagcugcucaccagaccccggagcuccagccagauuccugagggcuuugggcugaccucuggaggcuccaacuauagccuugcccgccauacaugcaaggcucugaccuuccugcuccugcaacccccuucucccaaacuuccuccgcacagcacaaucagacggacggccauugaccugaucggcagaggguucaccgugugggaacccuacauggaugucuccgccguucucaugggacugcucgagcugugugcugacgccgagaagcagcuugcgaauaucacaaugggccugccucugucucccgcugccgauagcgcccgcuccgcucggcacgcccucucucugauugcgaccgcuagaccucccgccuuuaucacaaccauugccaaagaagugcaucgccacacggcucuugccgcuaacacccagagccagcaaaacaugcauacaaccacacuggcccgggcgaagggggagauccucagagugauugaaauccugaucgagaaaaugccgaccgacgucguggaucuccugguugaagugauggacauuaucauguacugccuugagggaucccuggucaagaagaaaggccugcaggagugcuucccugccauuugucgcuuuuauauggugagcuacuaugaacggaaucacagaaucgcuguuggggcccgccacggaucuguggcucucuacgacauucggacaggcaagugccagaccauccauggccacaaagggcccauuacggccgucgccuucgcucccgauggaagauaucuggcgacauacuccaacaccgacagccauaucuccuuuuggcagaugaauaccucucuucugggcagcaucgggaugcucaacuccgccccucaacugcgguguauuaagacauaucaggugcccccuguccagccggcuucucccggaagccacaaugcccucaaacuggcccgccuuaucuggaccuccaacagaaaugugauucugauggcucaugauggcaaggagcaccgguucaugguuuga

SEQ ID NO: 77880 - RNA, 2217 nt, Artificial Sequence
  derived and/or modified sequence opt5 from WDR81__Homo_sapiens__NP_001157145
augcuggugagagucguucucagccugacccccuccuucccugagccgucugcccuuuacacagcuugcaagauggugcgguggcugagcgccaaacucggccccacgguggcgucccgccacgucgcuagaaaccugcuucggcugcucaccucuuguuauguggggccuacacgccagcaauuuaccguuagcuccggagaaucucccccucugagcgccggcaauaucuaccagaagagacccgugcugggggacauugucuccggaccugugcucagcugccugcuucauaucgcccggcuguauggcgagccgguucucacauaccaguaucugcccuacauuucuuaucuuguggcuccuggguccgccagcggacccucucgccugaacuccagaaaagaagcuggccuccuggccgcggucacccugacacagaagaucauuguguaccucagcgauaccacgcugauggacauccuuccucggaucucucacgaggugcugcuccccguccuguccuuccuuaccagccugguuacaggcuuuccguccggggcccaagcucgcaccauucucugugugaaaacaaucucucugauugcccugaucugccucagaauuggacaggaaauggugcagcagcaucugagcgagccugucgcuaccuucuuucaaguguucucccagcuucacgagcugcggcagcaggaucucaagcuggaccccgccggccgcggggaaggacaacuuccucagguuguguuuagcgauggccagcaaagacccgucgaccccgcgcugcucgaugagcugcagaagguguucacgcuggaaauggccuacacaaucuauguuccuuuuucuugucuccugggggacauuauccggaaaaucauuccgaaucaugagcuugugggagagcuggcugcccucuaccuggaauccaucagccccucuagccgcaacccugcuuccgucgagcccaccaugccuggcacaggccccgaaugggauccgcacgggggaggcugcccucaggacgaugggcacucuggaaccuucggcagcgugcuggucgggaaucggauucagauccccaacgacuccagaccugagaaucccggaccucuuggccccauuagcggcguugggggaggcgggcucggaucuggcuccgaugacaacgcccugaagcaagaacugccgagaagcgugcaugggcucucuggcaauuggcuggccuauuggcaguacgagaucggagugucccagcaggacgcucacuuucauuuccaccaaauccgccuucagagcuuuccuggccacuccggggcggucaaauguguggcuccccugucuagcgaggauuucuuccucuccggaucuaaggaccggaccguuagacuguggccccuguauaacuacggcgaugggacaagcgaaacggccccucgccuuguguauacccagcaucggaaauccgucuuuuucgugggacagcucgaggccccgcaacacgugguuagcugcgacggcgccguccaugugugggaucccuuuacagggaagacccugagaacaguggaaccucuggacucucgcgucccccucaccgcuguggccguuaugccugcgccccacacguccauuacaauggcuagcucugauuccacccugcgguucguggacuguagaaagccuggccuucagcaugaguuucgccugggaggcgggcucaaucccggacugguccgggcccuggccaucagcccgucuggcagaagcgugguugcuggguucuccagcggauuuauggugcuucucgauacccgcacaggccugguccugcggggguggccugcccacgaaggcgacauucuccagaucaaagcuguggagggaucuguucugguguccagcuccucugaucacagccuuaccgucuggaaggagcuggaacagaaacccacacaucacuacaaguccgccucugacccuauucauacguucgaccucuacggcagcgagguggugaccgggacagucuccaacaaaaucggaguuugcucucugcuggaacccccgagccaagcgaccacaaagcuguccagcgagaauuuuagaggcacccucacgucucuggcccugcucccuaccaaacggcaccuucuucugggguccgauaacggagugauccgccuccuggcuuga

SEQ ID NO: 77881 - RNA, 948 nt, Artificial Sequence
  derived and/or modified sequence opt5 from WDR83__Homo_sapiens__NP_115708
auggccuuccccgagccuaagccgagacccccugaacugccccagaaacggcucaagacccuggacugcggccaaggggcugugcgcgccgucagauuuaacguugauggaaauuacugucuuacaugcggcagcgacaaaacgcugaagcucuggaacccucugcgggggacccuucugcgcacauauuccggacacggcuacgaggugcucgaugcggcugggucuuucgacaauagcucccuguguucuggaggcggcgauaaagccgugguccugugggacguggccagcgggcagguugugagaaaguuucggggacaugcuggcaaggucaacaccgugcaguucaaugaagaggccacaguuauccucuccgggucuauugauagcuccauccgcugcugggacuguagaagccggcgccccgaaccugugcagacccuggaugaggcuagagacggagucucuuccgugaaagugagcgaucacgagauucuugccggcucugucgacgggcggguucgcagauaugaucugcggaugggacaacucuuuuccgacuacgugggcagcccgaucacaugcaccuguuucucucgcgacggccagugcacgcugguguccagccuugauuccacccugagacuccuggacaaggauacaggggaacugcucggagaguauaaaggccauaagaaccaggaauacaaacuggacuguugccuuucugagcgggauacccacgucgugagcuguuccgaggacgggaagguguuuuucugggaucugguugaaggagcgcucgcccuggcccuucccgucggcagcggggugguucagucucuggcuuaucauccuacagagcccugccuccugaccgcuaugggaggcuccgugcaaugcuggagagaagaggccuacgaagcggaggacggcgccggguga

SEQ ID NO: 77882 - RNA, 834 nt, Artificial Sequence
  derived and/or modified sequence opt5 from WDR86__Homo_sapiens__NP_001271190
augagcagagaguuccggggccaccgcaacugcgugcugacccucgccuacuccgcucccugggaccugccuucuacaccgugugccgaagaggcggcugccgggggacuucuggucacgggcagcaccgaugggacagccaagguuuggcaaguggcuuccggaugcugucaucagacccucagaggccacacaggggccgugcugugccuuguccuggacacccccggacauacagcuuuuaccggcucuacggaugccaccauccgggcgugggacauucucagcggcgaacagcugcgcguguucagagagcaccggggguccguuaucugucuggaaugcucucgcgccgcuggaacacucgccccuggccccagcaccagaucccuggagagcugugggggaugcucuggcgcuacacauuccagcucuaccgccucccgguguacggcgcgcugcagcacaccucccagaaccacagccccuugugcuucugggaccugcgccggauccgaggugccgcggggcccccuucgcccuugcgcugccagcagaggcuccucugccacccggugggcugcgcccccucgccccuguagcagaccggauccugccgggccccugcagacacccgcucagacgcccuccggaagccaaucugccccuccuugcuauccgcggugguggagacccauggccggcgaagggcgcggagcucggaaaccuggcagagaggaaucccccagccaggccucuggguuuagccucgucgcgcgccggagaugggagcgcgaguguuccccuuggggacccccgccuuuccccuuuuga

SEQ ID NO: 77883 - RNA, 1977 nt, Artificial Sequence
  derived and/or modified sequence opt5 from WDR93__Homo_sapiens__NP_001271324
augagcuuccccagaggcucccagacccaaaagaucaaacacccuauugggacacggaagggaccgcuggaggugcccccucccacggaaaaagacuggccuaaggaugacgagcaggaucauguccucguugaccccgaugaagaacuggacucucuuccucagccguaccgcaugaucaacaaacuggugaaucuccuguuugaucagagcugggaaauuaucgaggagagaaacgcccuucgggaagcugaguccucucaaauucagcccaccguguauccuccccugggcgaaauccagcucaauaagaugccuaacugcauggccgucagccaggacuacguguucaucgggggagcgaagggcuuuuccauuuauaaucuguacucugcuaaacaaaucuaugccugggagaagcugaaaguugaugugacaagcauuugggccaccgaccucgggaacgagauccugauugcucccgucgaugaaaugggaaucauucgccuuuucuacuuuuauaaggagggccuguaccucgugaaagccaucaaugaaguugacgauacauccaagcagaccacauguaucaagauggagauuagccagggcggggacuucgcugccuuucugcuucagggagcgggcgacaucuggcuggauguguacaaacucccgaaggaaaccuggcugaaaaagcuggagcacccucaacucacgucuaaccccaaaaagaaagucagacagccucagcuuaauucccuggggcccauuagcgccgacccccuggagauggaugcuaacgugucuuucaagggagacaucaagcucucccugccuguguauauuaugaaaaucaagccgcccaaaccugucaccggcacaaccuuuaagagcccccuugaaguuuucgccaaaaucaaggauugcuacgggcugggaucuggccaaaaucauuuuauuaaggacucccagugggagcagcaggcugaaaucuucaacgccagcuauaaaaaguaccucgaucgggagugggaagaggagccucuguccacagcgaccuuuuauuuccugcuccccucuugucuguucgccaugccgccugaagugaaaggccccagcgggauggcuugcgugcuuggcauucacuggacgcgcucccauaacuuuuuccuguacagccucaauagaacacugaaggacaaagccgauccugagggagucuggcccugugcugccccuaucgccgugucucaacuuuccugcagcucuagcuaucugguucucgcuugugaagacggggugcugacccugugggaucucgcgaagggacagaauauguaccccgagggccaggucaagucccagaugaaaugcgugguucuguguacagacgccucucuucaccugguggaagcuagcgggacccaaggaccgaccauuuccguccucguggagcggccugucaagcaccuggacaaaacaaucugcgccguggcccccguucccgcucugccuggcauggugcuuaucuuuagcaagaacggcucugucugucucauggauguggccaaacgcgagauuaucugcgcguucgcuccgcccggggccuuuccucuggaaguucccuggaagccuguguucgccgucucccccgaccauccuugcuuucugcucagaggagauuacagccacgagacggcuucuaccgacgaugccggcauucaguauuccguguucuacuuuaacuucgaggcuuguccccugcuugagaauaucagcaagaacugcacaauuccgcagcgggaccuggauaauauggccuuuccucaggcgcucccccuggagaaacgcugugaaagauuccugcaaaaguccuaucggaaacuugagaagaacccugaaaaagaggaggaacauugggcccgccuccagagauacucucugagccugcagcgggagaauuuuaagaaauga

SEQ ID NO: 77884 - RNA, 1299 nt, Artificial Sequence
  derived and/or modified sequence opt5 from WEE1__Homo_sapiens__NP_001137448
auggacaccgaaaagagcggcaaaagagaguucgaugugcggcagacaccccaagucaacaucaauccuuuuacgccggacucccugcuccugcacucuagcgggcagugccgcagacggaagcgcaccuacuggaacgauuccuguggagaggacauggaagccucugauuaugagcuugaagacgagacaagacccgcuaaacggauuaccaucacagagagcaauaugaagucccgcuacaccacagaguuccaugaacuggagaaaauuggcucuggggaauuuggaagcguuuucaagugcgugaagagacucgauggcuguaucuaugccauuaaacgguccaagaaaccucuggcggggagcguggacgagcagaacgcccuucgcgaagucuacgcucacgccgugcugggacagcauucucacguugugagauauuuuuccgcuugggccgaggaugaccauaugcucauccaaaaugaauacugcaacggcggcagccuggcugaugccaucucugagaauuaucggauuauguccuacuucaaggaagcggagcugaaagaccuccugcuucaggucgggcgcggacugagauacauccacagcaugucucucgugcacauggauauuaagcccuccaacaucuuuauuagccggaccuccaucccuaaugccgcuucugaggaaggcgacgaggacgauugggccagcaacaagguuauguucaaaauuggggaccugggacaugugacgcgcaucuccagcccccaggucgaagagggcgauucuagauuucuugcuaaugaagugcugcaggagaacuauacccaccucccuaaggccgacaucuucgcgcuggcccugacaguggucugugcugccggggcugagccgcucccccggaauggagaucaauggcaugaaauuagacagggccgccugccucggaucccccagguucuuucccaggaguuuaccgaacugcucaaagugaugauucacccugaccccgagagacgcccgagcgccauggcccuggugaagcacucuguccuucugagcgcuucccggaaaucugcggaacaacucagaaucgagcugaacgccgagaaguucaaaaauagccugcuccagaaggaacugaagaaagcucagauggccaaggccgcugccgaggaacgcgcgcuuuuuacagaucggauggcuaccagauccacgacacaaagcaaccgcaccucucggcugauuggcaaaaagaugaacagauccgugagccucacaaucuacuga

SEQ ID NO: 77885 - RNA, 663 nt, Artificial Sequence
  derived and/or modified sequence opt5 from WFDC1__Homo_sapiens__NP_001269395
augccccugaccggcguggggccuggaagcugcagacggcagaucauucgcgcccucugucugcuucugcuccugcuucacgcuggcuccgccaagaacaucuggaaaagagcgcugccggcucggcucgccgagaagucucgcgccgaagaggcuggggcccccggaggcccuagacaaccccgggcugaccgcugcccucccccuccgagaacacugcccccuggggccugucaggcggcccggugccaggcugauagcgaauguccccgccauagacggugcuguuacaauggaugcgccuaugcuugucuggaggccgucccucccccgccuguucucgacuggcuggugcagcccaaaccucgcuggcuuggcggcaacggguggcugcucgauggacccgaagaggugcugcaagcggaggccugcuccacgaccgaagacggcgcugagccccuucuguguccuucuggguacgaaugccacauucucagcccgggagaugucgccgagggcauccccaauagagggcagugcgugaagcagcggcgccaggcugacggacggauucugagacauaaacuguauaaggaguacccugaaggcgauuccaagaacguugccgagcccggcagagggcaacagaaacacuuccaguga

SEQ ID NO: 77886 - RNA, 375 nt, Artificial Sequence
  derived and/or modified sequence opt5 from WFDC2__Homo_sapiens__XP_011526797
augcccgccugcagacugggcccucucgcugccgcgcugcuucugagccuccugcuuuucggguuuacccugguguccggaacaggcgcugagaagacgggggucuguccggaacuccaggccgaccaaaacugcacccaggaguguguuucugauagcgaaugcgccgacaaucugaaauguugcuccgcuggaugugccacauucugcucucugcccaacgauaaggagggcagcuguccucaggugaauaucaacuuuccccagcucgggcugugccgggaccaaugucagguggauucccagugcccuggacagaugaaaugcugucgcaauggcugcggcaaggucucuugugugacccccaacuucuga

SEQ ID NO: 77887 - RNA, 2673 nt, Artificial Sequence
  derived and/or modified sequence opt5 from WFS1__Homo_sapiens__NP_001139325
auggacagcaacaccgccccucugggcccuuccugcccgcagcccccucccgcuccucaaccccaggccagaucucggcucaaugcgacagcuagccuggagcaggaacgcuccgagagaccucgggccccggggccccaggccggaccuggccccggggugcgcgaugcugccgcuccugccgaaccccaagcgcagcacacgagaucucgggagcgcgccgacggaaccggcccgacaaagggggauauggaaaucccuuucgaggagguccuugaaagagcuaaagccggagaccccaaggcucagaccgagguuggcaaacauuaccugcagcucgccggcgauacagacgaagaacugaacagcuguaccgcgguggauuggcuugugcuggccgcuaagcaagggcggcgcgaggccgucaaacuccugagacggugccuggcugaccgcagaggaauuacauccgaaaaugagcgggaagugcgccagcucucuagcgagaccgaucuggaaagagccguucggaaggccgcucuugugauguauuggaagcugaacccuaaaaagaaaaagcaggucgcgguggccgagcuccuggagaauguuggccaggugaacgaacacgacgggggagcucaacccggccccgucccuaaaucccuucagaagcagagacgcaugcuggagcggcucgugagcucugaauccaagaauuacaucgcccuggaugacuuuguggagauuacgaaaaaguaugccaaaggggucaucccgagcucucuguuccuccaagaugacgaagacgaugacgagcuggcuggaaagucccccgaggaucuuccucugagacucaaaguugugaaguacccccugcaugccauuauggaaaucaaagaguaucuuaucgacauggcgagccgcgcuggcaugcacuggcugucuaccauuaucccuacacaucacauuaacgcccucaucuuuuucuuuauuguguccaaucugaccaucgauuucuuugccuucuuuauuccccuggucaucuucuaccucagcuuuaucuccauggugauuuguacacugaagguuuuccaggacucuaaggcuugggaaaacuuucggacccuuacggaucugcuccugagauucgagccgaaucuugacguggaacaggccgaggucaacuucggcuggaaucaccuggagccuuaugcucauuuucuccugagcguguucuuuguuaucuucuccuuucccauugccagcaaagauugcaucccuuguucugaacuggcggugauuacaggguucuuuaccgucacauccuaccucagccugucuacccacgccgagcccuacacccgccgggcucuugccacagaagugacggcuggacugcucagccugcugccuuccaugccccuuaacuggccguaucucaagguccugggccagaccuucaucacagugccuguugggcaucuggugguccucaaugugucuguucccugccugcuuuacguguaucugcucuaccuguuuuucagaauggcccaacugcgcaacuuuaaaggaaccuauuguuaccuuguccccuaucucgugugcuucauguggugugagcugagcgugguuauccugcucgaguccacaggccuggggcuucugcgggcgagcauuggauacuuucucuuccuguucgcccugccuauccuugucgcuggccucgcccuggugggcgugcugcaguuugcuagaugguucaccucucucgaacugacgaagauugccgucacaguggccguuugcuccgugccgcuucugcuccgcugguggaccaaagcuagcuuuucugucguggggaugguuaagucccugacccggagcuccauggugaagcugauccuugucuggcucacagcgauugugcuguucuguugguuuuacguuuauagaucugagggaaugaaaguguacaacagcacccugacauggcagcaguauggcgcccucugcgggccccgggcuuggaaggaaacgaauauggcccgcacccaaauccugugcucccaccuugagggacacagagucacauggaccggccgguucaaauacgugagagugacagacaucgauaacucugccgaaagcgcuauuaauaugcugcccuuuuucaucggggacuggaugcgcugucucuauggcgaggccuaccccgcgugcuccccuggaaacaccagcacggcugaggaggagcugugucggcugaaacuucuggccaagcaucccugccacauuaagaaguuugacagauauaaauucgaaaucaccgucggcaugccuuuuucuuccggggccgauggaagccgcucuagagaggaagacgauguuacaaaggacauugugcuccgggcuuccagcgaguucaaaucugugcugcucagccugcgccagggcucccuuaucgaguuuagcaccauucuggaagggagacucggaucuaaguggcccgucuucgagcugaaagccaucuccugucugaauugcauggcgcagcuuagcccgacacggcgccaugugaagaucgaacacgauuggagauccaccguucauggcgcugugaaguucgccuuugacuucuuuuucuuuccuuuccugucugccgcuuga

SEQ ID NO: 77888 - RNA, 1890 nt, Artificial Sequence
  derived and/or modified sequence opt5 from WHSC1__Homo_sapiens__NP_015627
auggaguucagcaucaagcagucuccccuguccgugcaaagcgucguuaaaugcauuaagaugaaacaggccccugaaauccucggcuccgcuaacgggaagaccccgucuugugaggugaauagagaaugcagcguguuucuguccaaagcccagcuuucuagcucccugcaggagggagucaugcaaaaguucaacggccacgacgcgcuccccuuuauuccugcugauaagcugaaagaccuuacaagccggguguucaauggggaacccggagcccaugaugccaagcugcgcuuugagucucaggagaugaaaggcaucgggacgccucccaacaccacaccuauuaagaauggauccccggaaaucaaacucaagaucaccaagacauacaugaacggcaaaccccuguucgagagcucuauuuguggcgacuccgcugccgauguuagccagucugaagagaaugggcagaagccugagaacaaagcuagacggaaucgcaagagauccaucaaauaugacagccugcucgaacaaggacugguggaggccgcgcuugucuccaagauuucuagccccuccgauaaaaagaucccugccaagaaagaaagcugccccaacaccggccgggacaaggaucaucugcucaaauacaaugugggggaccugguuuggucuaagguguccggauauccgugguggccuuguauggucagcgcugauccccuucugcacucuuacacaaaacucaagggccagaagaaaagcgcccgccaguaucacgugcaguuuuucggggacgcuccugagagagccuggauuuuugaaaagucccugguggcguucgagggagagggccaauuugaaaaacugugccaggagucugccaagcaggcucccaccaaagccgaaaagaucaagcuccugaaacccauuagcggcaaacuucgggcucaaugggagauggggaucguccaggccgaagaggccgcuuccaugagcguugaggaacgcaaagcgaaguucacguuucuguacgugggagaucagcuccaucugaacccucagguggccaaagaggcuggcaucgccgccgaaucucuuggggagauggcugaauccagcggagucucugaggaggccgcggaaaauccgaaguccgugagagaggaauguauucccaugaagcggcgcagacgggcuaaacugugcagcuccgccgagacccucgagucucacccugacaucggcaagagcacaccccaaaagaccgccgaagcugacccucgcagagggguuggaucucccccgggccggaagaaaacaaccguguccaugccuagaagccgcaagggcgaugccgcuucccaguuccuggucuucugucagaaacaccgggacgaggugguugccgaacaucccgaugcgagcggggaggaaauugaggagcugcucagaucucaguggucccugcuuagcgaaaagcaacgcgcccgguauaacacgaaguuugcucugguggccccuguccaggcugaggaagacucuggaaaugugaacggcaaaaagagaaaccacacaaaacgcauccaggaucccaccgaggacgccgaagcggaggauacaccucggaagagacuccgcaccgacaaacauucccugcggaagagagauaccauuacagacaagacggcccgcaccagcucuuacaaagcuauggaggccgcuagcucccuuaagagccaggccgccaccaaaaaucugucugaugcuugcaagccccucaaaaagcggaacagagcguccacagccgcuagcuccgcccugggguucucuaagagcuccucuccgagcgccucccugacagaaaaugaggucaaauga

SEQ ID NO: 77889 - RNA, 1938 nt, Artificial Sequence
  derived and/or modified sequence opt5 from WHSC1L1__Homo_sapiens__NP_060248
auggacuucagcuuuuccuucaugcagggcaucauggggaacaccauucaacagcccccucagcugaucgauucugccaauauuagacaggaggacgcuuuugauaacaauagcgacaucgccgaagauggaggccaaacaccguacgaggcgacgcuccagcagggguuccaguaucccgcuaccacagaagaccugccuccccuuaccaacggauacccuuccucuauuagcguguaugagacacaaaccaaguaccaguccuauaaucaguaccccaacggcucugccaauggguuuggagccguccggaacuucagcccuacagauuauuaccacuccgaaaucccgaauacccgcccccaugagauccuggagaaaccuucucccccucagcccccgccucccccuagcguuccccaaacggugauucccaagaaaaccggcuccccugaaaucaagcucaaaauuacaaagaccauccagaacggcagagagcuguuugaaagcucucuuugcggggaccugcucaaugaggugcaggcuuccgagcacacaaagagcaaacaugaaucucggaaggagaaacgcaagaaauccaacaagcacgauagcuccagaucugaagaacgcaagagccauaaaauuccgaagcuggaacccgaggagcaaaaucggccuaacgaaagagucgacaccguguccgagaaaccccgggaggagccuguucugaaggaagaggcccccgugcagccgauccucagcucugucccuacgacagagguguccaccggaguuaaauuccaggugggcgaucuggucuggagcaagguggggacauaccccugguggccuuguauggugucuagcgacccccagcuugaaguccacaccaaaauuaauacccgcggagcuagagaguaucacguucaauuuuucuccaaccagccugaacgggccugggugcaugagaagcgcgugagagaauacaagggccacaaacaguaugaggagcugcucgcggaagccacaaagcaggcuucuaaccauagcgagaaacaaaagauccggaaaccccgcccgcagagagaacgggcccagugggauaucgggauugcucacgccgagaaggcgcugaagaugacgagagaggaacgcaucgagcaguacaccuuuauuuauaucgacaaacaaccugaagaggcccuuucccaggcuaagaaaagcgucgccucuaagacagaagugaaaaagacccggagaccccgcuccguucugaauacacagcccgagcagaccaacgcuggagagguggccagcucucucuccagcacggaaauucggagacacucccaacgccggcauacaucugccgaggaagaggaaccuccgcccgucaagaucgcuuggaaaaccgcggccgcuagaaagagccugccugccuccaucaccaugcacaaaggcucucuggaccuccagaagugcaauaugagccccgugguuaaaauugaacagguguucgcccugcaaaacgcuacaggcgaugggaaguuuaucgaccaguucgucuacuccaccaagggaauuggcaauaaaacagagaucagcgugcgcgggcaggaucggcuuauuaucucuacgccuaaccagagaaaugaaaagcccacccaauccgucagcucuccugaggccacauccggaagcaccggcucuguggagaaaaagcagcagcgccggagcaucagaacacgguccgagagcgaaaaaucuaccgagguugugcccaagaaaaagauuaagaaagagcaggucgaaacggugccgcaagcgaccguuaagacagggcugcagaaaggauccgcugaccgcggcgugcagggcagcgucagauucuccgauucuagcguguccgccgccaucgaggaaaccguggacuga

SEQ ID NO: 77890 - RNA, 1140 nt, Artificial Sequence
  derived and/or modified sequence opt5 from WIF1__Homo_sapiens__NP_009122
auggccagacggagcgcuuuccccgccgcggcucuguggcucugguccauccugcuuugccugcucgcccugcgcgccgaggcuggcccuccgcaggaagagucucuuuaccuguggauugacgcccaccaagcuagagugcucaucggguuugaagaggauauucugaucgucagcgaaggaaagauggcccccuucacccaugacuuucggaaagcgcagcagcgcaugccugccauucccguuaacauccacuccaugaauuucacauggcaggcugccggccaagcugaguauuuuuacgaguuccugucucucagaagccuggauaaggggaucauggccgacccuacggugaacgugccccuucugggaaccgucccucauaaagcguccgugguucaggugggcuuuccgugucucgggaagcaggauggagucgccgcuuucgaaguggacguuauugugaugaacucugagggcaauacaauccugcagacaccccaaaaugccaucuuuuucaaaaccugccagcaggcugaauguccuggcgggugccggaacggaggcuuuuguaaugagcgcagaauuugcgagugucccgauggguuccacggaccucauugcgaaaaggcccuuuguacaccccggugcaugaacggcgggcugugugucaccccgggauuuugcauuugcccucccggcuucuauggcgugaauugugacaaggccaacugcagcaccacguguuucaaugggggaaccugcuuuuacccuggcaaauguaucugcccucccgggcucgagggagaacagugugagauuuccaagugcccccaaccgugucgcaacggcgggaaaugcaucggaaagagcaaauguaagugcucuaagggcuaucagggcgaucugugcuccaaacccgugugugaaccugggugcggagcucacggcacaugucacgagcccaauaagugccagugucaagagggguggcauggaagacacugcaacaaacgguacgaagcgagccugauccaugcccuccgcccugcuggcgcccagcugagacagcacacccccucucuuaagaaagccgaggaacggcgcgacccgccugaguccaauuauauuugguga

SEQ ID NO: 77891 - RNA, 1512 nt, Artificial Sequence
  derived and/or modified sequence opt5 from WIPF1__Homo_sapiens__NP_003378
augcccgugccuccgcccccugcucccccucccccuccgaccuucgcccucgccaacacagagaagcccacgcucaauaaaaccgaacaggcgggcagaaacgcucugcuuagcgacaucuccaaggggaaaaagcugaaaaagacagucaccaaugaucggucugccccuauucucgacaagcccaaaggagccggcgcugggggaggcgggggaggcuuuggcgggggaggcggguucggaggcgggggaggcggcgggggaggcgggagcuuuggaggcgggggaccucccggccugggcgggcuuuuccaagccggaaugccgaagcugcgcuccacagcuaacagagauaaugacucuggcgggagccggccuccccuccugccucccggaggccgcuccaccucugccaaacccuuuagcccuccguccgggcccggcagauucccuguucccagcccuggacaccggucugggcccccggagccucagcgcaacagaaugcccccuccccggccugaugugggcuccaagcccgacagcaucccgccucccgugcccucuacaccucgcccgauucaguccagcccccauaauagaggaucuccucccgucccuggcgggccccggcagccuucccccggaccgaccccucccccuuuucccggcaaccgcgggacggcgcugggcggaggcagcaucagacaauccccgcucucuagcuccagcccuuucucuaaucggcccccucugccucccacccccucccgcgcccuugaugacaaaccgcccccucccccucccccuguggggaacagaccgagcauucaccgggaagcuguucccccucccccuccccagaauaacaagccgccugugcccucuacacccagaccuagcgccuccucucaggcucccccuccgcccccucccccuagccgccccggaccgccuccccugccucccuccagcucuggcaaugaugagaccccucggcucccccagagaaaccugucccuuucuagcuccacaccgccucugcccagccccgggcgcuccggaccucucccgcccccucccucugaacggccucccccuccggucagagaucccccuggccgcagcgggccccugccucccccgccucccgugucccggaauggcucuaccagcagagcccugcccgcgacgccucaacuccccucccgcagcggaguugacucuccucgguccggcccgagacccccucugcccccugaccgccccagcgccggggcuccgccucccccucccccuucuacauccauccggaacggauuucaggauagccccugcgaggacgagugggaaucuagauucuacuuucauccgaucagcgaccuuccuccucccgagcccuaugugcagaccacaaaguccuacccgagcaaacuggcccggaacgaaucucgcuccggcagcaauagacgggagagaggggcucccccucugcccccuauuccccgcuga

SEQ ID NO: 77892 - RNA, 1323 nt, Artificial Sequence
  derived and/or modified sequence opt5 from WIPF2__Homo_sapiens__NP_573571
augcccauucccccgcccccucccccucccccuggcccgcccccucccccuaccuuccaccaggccaacacagagcaacccaagcugagcagagacgaacagcgggggcgcggagcucuccugcaggauaucugcaaaggcacgaaacuuaagaaggugaccaauaucaacgacagauccgccccgauucuggagaaaccuaaggggucuagcggaggcuacggguccggaggcgcggcucuccagcccaagggcgggcuguuucaaggaggcguccuuaaacugcggccuguuggggccaaggauggaucugaaaaucucgccggcaaacccgcucugcagauccccagcucccgcgccgcugccccuagaccgcccgugucugcggccagcgggcggccucaggacgauacagacuccagccgcgcuucucugcccgagcucccuagaaugcagcggcccucccugccggaucuuagccgcccuaacaccacaucuuccaccggaaugaagcauucuagcuccgcucccccucccccucccccgggcagacgggccaaugccccucccacaccccugccuaugcacagcuccaaagcgccggccuauaaccgcgaaaagccccucccucccaccccuggccaaagacugcaucccgggcgggagggaccucccgcuccgccucccgugaagccucccccgucuccugucaauauucgcacgggccccagcgggcagucccuugccccucccccucccccguacagacagcccccuggagugcccaacggcccuagcucucccaccaaugaguccgcuccugaacugccgcagcggcacaacagccuccauagaaaaacacccgggccuguucgcggacuggcucccccucccccgaccucugccagcccuucccugcucucuaaucggcccccuccgcccgccagagacccuccgagccgcggcgcggcucccccucccccucccccggugauccggaacggcgccagagaugccccucccccucccccucccuaucgcaugcacggguccgagccgccuagccggggaaagccucccccuccucccucuagaacccccgccgggcccccucccccgccuccuccgccccugcgcaauggccaccgggacuccaucacaacgguccgcagcuuccuugaugacuuugaaucuaaauacuccuuccaucccguggaggauuuucccgcucccgaggaauauaagcacuuccaaagaauuuacccuagcaaaacaaaccgggccgcgagaggagcuccuccccugccucccauccuccgguga

SEQ ID NO: 77893 - RNA, 1452 nt, Artificial Sequence
  derived and/or modified sequence opt5 from WIPF3__Homo_sapiens__NP_001073998
augcccgugccuccgcccccucccccuccccugccuccgcccccucccccucucggcgccccgcccccucccccucccagcgcucccccugucuccaccgacacaucuagccugagacgggccgauccgaaggggcgcuccgcgcuucuggcugacauccagcaaggaacgagacuccggaaaguuacccagauuaacgaucgcucugcuccccagaucgagagcuccaagggcacaaauaaagaagggggaggcucugccaacaccagaggggccagcacaccucccacccugggagaccuuuucgccggcggcuuuccugugcugcggcccgcugggcagcgcgauguggccggaggcaagacagggcaaggaccgggcuccagagcgccuagcccccggcucccuaauaaaaccauuucugggccccugaucccucccgccuccccgcgccugggaaacacgagcgaggcucacggcgccgcuagaaccgccccuccccggcccaaugucccugcgccgcccccucccacaccucccccucccccgccuccccucccucccccgcugccuucuuccagccccauuaagaccccucuugugucuccucccggcccccugacaaaggggaaccucccgguuguggcucccccuguccccugcgccccucccccuccgcccccucccccucccccgaccccuccuccccugccucccgccuccgugcuuagcgacaaagcuguuaagccccagcuggccccgcuccaucugcccccuauucccccuccccugccgcuccugccucccuguggauacccuggccuuaaagccgaacccgcuuccccugcgcaggaugcccaggagcccccggcuccucccccuccccugccgcccuaugccucuugcagcccucgcgccucccuccccgcuccuccccugccuggggucaauucuagcuccgaaacgccgcccccucuucccccuaagagccccucuuuccaagccccgccucagaaagcgggagcucaggcccugcccgccccucccgcucccccuggcagccagccguuucuccaaaagaagagacacgggcggcccggagccggcggcgggaaacugaacccucccccugcucccccggcccgcuccccuacaaccgagcugucuagcaagucccagcaggcgacagccuggacccccacccaacagccuggaggccagcucagaaaugggagccugcauaucaucgacgauuucgagucuaaauuuacauuccacuccguggaagacuuucccccucccgaugaguacaagccgugucagaaaaucuauccuagcaagauuccccggucuagaacgcccggaccuuggcuucaagcugaagccgugggccaguccagcgacgauaucaaagggcgcaacucccagcugucucucaagacccugcgguga

SEQ ID NO: 77894 - RNA, 1341 nt, Artificial Sequence
  derived and/or modified sequence opt5 from WIPI1__Homo_sapiens__NP_060453
auggaggccgaagcugccgacgcgcccccuggcgggguggagagcgcucuguccugcuucucuuucaaccaggauuguaccagccucgccacaggaacgaaggccggcuacaaacuguucucccuuucuagcgucgaacaacuggaccagguucacggguccaaugagaucccggauguguauauuguggaaagacucuuuucuagcucccuggucgugguugugagccauaccaagccccggcagaugaacgucuaccacuucaaaaagggaacagagaucugcaauuauucuuacuccagcaacauucuuucuauccgccugaauagacagcggcuccuggugugucuggaggaauccauuuauauccauaacaucaaagacaugaagcuccugaagacccuucuggauauuccugcuaaucccacaggccucugcgcccugagcaucaaccacucuaauuccuaccuugcuuauccugggagccugaccuccggagagauuguucucuacgacggcaacucucugaaaacaguguguaccaucgccgcgcaugaaggcacgcuggccgcuauuaccuuuaaugccagcggguccaagcucgcuagcgccucugagaaaggaacagucauccgcguguucuccgugcccgauggccaaaagcuguacgaguuuagacgggggaugaaacgcuaugucaccauuagcucucuuguuuucagcauggacucccaguuucugugcgcgucuagcaacacagaaaccgugcacaucuucaagcucgaacaggugacaaauuccagaccugaggagcccagcacguggucuggauacaugggcaagauguuuauggccgcuaccaacuaucugcccacacaggucuccgauaugaugcaccaagaccgggccuucgcuaccgcccgccuuaauuuuagcgggcagagaaacaucuguacccugucuacaauucagaaacucccucggcugcugguggccuccagcuccggacaucucuacauguauaaccuggauccccaggacggcggcgaaugcguucuuaucaagacgcacucucugcucgggagcggaaccacagaggagaauaaagaaaacgaucugcgcccuucccuuccccaaucuuacgcugcgaccguggccagaccgagcgcuuccagcgccucuacagucccuggcuauuccgaggacgggggagcccugcggggcgaagugauucccgagcaugaauuugcuaccgggccuguuugucucgacgaugagaaugaguucccgcccaucauucugugccgcggaaaccagaagggcaaaacgaagcagagcuga

SEQ ID NO: 77895 - RNA, 1332 nt, Artificial Sequence
  derived and/or modified sequence opt5 from WIPI2__Homo_sapiens__NP_001028690
augaaccuggccagccaguccggcgaggcuggggccggacaacuccuguucgcgaauuuuaaccaggacaauaccgaagugaagggcgcuucuagagccgccgggcuuggacggcgcgcugucguuuggagccuggccgugggcuccaaaucuggguacaaguucuuuagccucuccucuguggauaaacuggagcagaucuaugaaugcacagacacggaggaugucuguauuguggaaagacuuuucagcuccagccugguugcuaucgugucucucaaggcgccccggaaacugaaggucugccacuuuaagaaaggaaccgagauuuguaacuacuccuauagcaauacaauccuggccgugaagcucaaccgccagagacugauuguuugccuugaggaaucucuguacauccauaauauccgggacaugaaagugcuccacaccauucgcgagacaccuccgaaccccgccggccugugugcucuuuccaucaauaacgauaauugcuaucuggccuacccuggcagcgcuaccauuggggaaguccaaguguucgacacaaucaaccucagagccgcgaauaugauucccgcccaugauucuccucuggcugcccuggcuuuugacgccuccggaaccaagcucgccacggcuagcgagaaaggcaccgugauccgggucuucuccauucccgaggggcagaagcuguuugaguuccgcagaggaguuaagcggugugugucuaucugcagccuugcguuuuccauggauggcauguuccugagcgccucuuccaacacagagaccgugcacaucuuuaaacucgaaacagucaaggagaaaccuccggaagaacccaccacguggacaggguauuucggaaaggugcugauggcuagcaccucuuaccuuccuagccagguuacagagauguucaaucagggccgcgccuuugccaccgugagacugcccuucuguggccauaaaaacauuugcucccucgcuaccauccaaaagauuccucggcugcuggucggggccgcggacggauaccucuauauguacaaccuggauccccaggaaggcggggagugugcucuuaugaaacagcaccgccuggacggaucucucgaaacaacgaaugagauccuggauagcgccucccacgacugcccgcuugugacccagacauauggcgccgcugccgggaaggcuuacaccgacgaucugggagccguuggcggcgcgugccucgaagacgaggccagcgcucugagacuggaugaggacucugaacauccucccaugauucuccggacagauuga

SEQ ID NO: 77896 - RNA, 468 nt, Artificial Sequence
  derived and/or modified sequence opt5 from WISP1__Homo_sapiens__NP_001191798
augagaugguuccugcccuggacccucgccgcugugacagccgcggcugccagcacgguccuggccaccgcucuuuccccugccccgacaaccauggacuuuacacccgcuccucuggaggauaccucuagccggccccaguucugcaaguggccuugugaaugucccccuuccccgccccgcugcccucucggcguuucucugaucacagacgggugcgaguguugcaaaaugugugcccaacagcuuggagauaacugcaccgaagcggccauuugugacccccacagaggccuguacugcgauuauagcggggaccggccucgcuacgcuaucggagugugugccagacgggaggaaguguccggcugcguccccgcucgcgggauucaugagcuccacacgugcggacugcaucagcacacccugcucucuacacaggugcuguggagccuucauggccaauga

SEQ ID NO: 77897 - RNA, 753 nt, Artificial Sequence
  derived and/or modified sequence opt5 from WISP2__Homo_sapiens__XP_005260660
augagaggcacccccaagacacaucugcucgccuucagccugcuuugccugcucuccaaagugcggacgcagcugugcccuaccccgugcacaugucccuggccucccccucgcugcccccuuggggucccucugguucucgacggauguggcugcuguagagugugcgcucggcgccugggggagccgugugaucaacugcacgugugcgacgccucucagggacucgucugucagcccggcgcggggccuggaggcagaggcgcucugugccuucuggccgaagaugacagcuccugcgaggugaacgggcggcucuaccgcgaaggagagaccuuucagccccacuguucuaucagaugccggugugaagauggcggguucacaugcguuccucuguguagcgaggacgugcgccuucccuccugggauugcccgcauccuagacgggucgaggugcugggaaaguguugccccgaauggguuuguggccaagggggaggccucggcacccagccucugcccgcccaggggccccaguuuucuggacuggugagcucccucccuccgggcguccccugcccugaguggagcacagcuugggggcccuguucuaccacgugcggacugggcauggccacccgcguguccaaucaaaacagauucugccggcuugaaacacagcgcagacugugucucagccggccuugucccccgucuagagggcgcuccccucagaauagcgcuuuuuga

SEQ ID NO: 77898 - RNA, 1065 nt, Artificial Sequence
  derived and/or modified sequence opt5 from WISP3__Homo_sapiens__NP_003871
augcagggccuucucuucagcacccugcuucuggccgggcucgcucaauuuugcuguagagugcagggaacaggcccccuggacacgaccccugaggggcggccgggagaagucuccgaugcgccccagcgcaagcaguucugccacuggccuuguaaaugcccccaacagaagccuagaugucccccuggcguuucucuugugcgggacgggugcggauguugcaaaaucugugccaagcagccgggcgagauuugcaacgaagcugaucugugugacccccauaaaggccucuacugcgauuauagcguggaccgcccuagauacgagacaggggucugcgccuaucugguggccguuggaugugaauuuaaucaggugcacuaccauaacggccaagucuuccagcccaauccucuguuuuccugccucugugugucuggggcuaucggaugcacaccccuguucauuccgaagcuggccggcagccacuguuccggggcuaagggaggcaaaaagucugaucagagcaacugcucccuggagccucuccugcagcaacuuagcaccucuuauaaaaccaugcccgccuaccggaaucugccucucaucuggaagaaaaagugucugguucaggcgacaaaguggacccccugcucccgcacguguggcauggggauuagcaacagagugaccaaugagaacucuaauugcgaaaugcggaaagagaagcgccuguguuauauccagcccugcgacuccaacauccucaaaacaauuaagaucccuaaaggaaagaccugccaaccgacauuucagcugagcaaagccgaaaaguucgucuuuucuggcuguuccagcacccaguccuacaagcccacguucugcgggauuugucuugauaaaagaugcuguaucccuaauaagucuaaaaugauuacaauccaguuugacugccccaacgagggcagcuucaaguggaaaaugcuguggauuaccuccugugugugccaacggaauugucgcgagccuggagauaucuuuagcgaacucaagauccuguga

SEQ ID NO: 77899 - RNA, 1638 nt, Artificial Sequence
  derived and/or modified sequence opt5 from WLS__Homo_sapiens__XP_011540493
auggccggcgcuaucauugagaacaugagcaccaagaaacugugcaucgugggagggauucuccuggucuuccagaucauugccuuucuuguuggcgggcugaucgcgcccggaccuacaacggcuguguccuacaugucugugaagugugucgacgcccggaaaaaucaccauaagaccaaaugguucgugccguggggccccaaccacugcgauaagaucagagacauugaagaggccaucccucgcgaaauugaggcuaaugauaucguuuuuagcgugcauauuccccucccucacauggaaaugucccccugguuccaauuuaugcuguucauccuucagcuggacauugccuuuaagcucaacaaucagaucagagagaacgcugaggucucuauggaugugagccuggccuaucgggacgaugcguucgccgaauggacagagauggcucaugaacgcguuccuagaaaacugaaguguaccuuuacauccccgaaaacccccgagcacgaggggcgguacuaugaaugcgacgugcucccuuucauggagaucggaucugucgcccacaaguuuuaccugcuuaauauucgccugcccgugaacgagaaaaagaagaucaaugugggcauuggcgaaaucaaagauauuagacucgucgggauccaucagaacggaggcuucacaaagguuugguuugcuaugaaaaccuuccugacgccuagcaucuucauuaucauggugugguauuggcggcgcauuaccaugauguccagacccccggugcuucuggaaaaggucaucuuugcccucgggauuagcaugacauucaucaauaucccuguggagugguuuucuauuggauucgacuggaccuggaugcugcuguuuggcgauauccggcaagggauuuucuacgcgaugcuccuguccuuuuggaucauuuucuguggagagcacaugauggaccagcaugaacgcaaccacaucgccggcuauuggaaacagguuggccccauugcuguggggagcuuuugccuuuucaucuuugauaugugugagagaggaguccagcugacaaauccuuucuacucuaucuggaccacggacauuggcacagaacucgccauggcuuuuaucauuguggccgggaucugccugugucuuuacuuccuguuccucugcuuuaugguuuuccaaguguuucggaacauuuccggaaagcagagcucucugcccgccauguccaaaguccgcagacugcacuaugagggccucaucuuccgguuuaaguuccugaugcuuaucacccuggcuugugcggccaugacagugaucuuuuucauugucagccaggugaccgaagggcauuggaaguggggaggcguuaccgugcaggucaauuccgccuuuuucacaggcauuuacgggauguggaaccucuauguguuugcucugauguuccuuuacgcccccucucacaaaaacuauggagaggaccaaagcaauggcaugcagcugccuugcaaguccagagaggauugcgcucucuuuguuagcgaacuguaccaggagcuguucucugccuccaaauauagcuucaucaacgacaaugcggcuucugggauuuga

SEQ ID NO: 77900 - RNA, 7929 nt, Artificial Sequence
  derived and/or modified sequence opt5 from WNK1__Homo_sapiens__NP_001171914
augagcggcggggcugcugagaagcaguccucuacccccggaagccuguuccucuccccuccggcccccgcgccuaagaacggcucuagcuccgacucuagcgugggggaaaagcugggagcugccgccgcugaugccgugacaggcagaacggaggaauaccggcgcagacggcacaccauggacaaggauucccgcggggcugccgcgaccaccacaaccacagagcauagauuuuuccggcgcagcguuaucugcgacucuaaugccaccgcucuugaacugcccggacucccucugucccuuccccaaccuagcauuccggccgcugugccccagucugccccucccgagccucacagagaggaaacggugaccgcgacagccaccucccaggucgcucagcaacccccggccgcugccgccccuggcgagcaggcuguggcgggccccgccccuagcacaguucccucuuccaccagcaaggaucggcccgugucccagccuucucuggucgggagcaaggaagaacccccucccgcucgcuccggaagcggcgggggaucugccaaggagccccaggaagagagaucccaacagcaggacgauaucgaggaacucgaaacgaaggccgugggcaugagcaacgacgggcgguuucugaaauucgauauugagaucggacgcggcucuuuuaagacaguuuauaaaggccuggacaccgagacaaccguggaagucgcuuggugcgagcuccaggauagaaagcugaccaaaagcgaacggcaacgcuucaaggaggaagccgagaugcuuaaggggcugcagcauccuaauauugugagauuuuacgacuccugggagucuacagugaaaggaaagaaaugcaucguccucguuacggaacugaugaccagcggcacacuuaagaccuaucugaaacgguucaaggugaugaaaaucaaggugcucagauccuggugucgccagauucugaaggggcugcaauuucuccacacacggacaccucccaucauucauagagaucugaaaugcgacaacaucuucauuacgggacccacaggcagcgucaagaucggggaccuuggacuggcgacccucaaacgcgcuucuuuugccaaguccgugauuggcacccccgaguucauggccccugaaauguacgaggaaaaauaugaugagagcguugacguguacgcuuuuggcauguguaugcuggagauggccacaucugaauaucccuacuccgagugccagaaugcugcccagaucuaccggagagucaccagcggggugaagccugcguccuucgauaagguugccauccccgaagugaaagagauuaucgagggauguauucgccagaacaaggacgaacgguauucuaucaaagaucuucugaaucacgcuuucuuucaagaggaaacaggcgucagaguggagcucgccgaagaggacgauggggagaagauugcuaucaaacuguggcugcgcaucgaagacauuaagaagcucaaaggaaaguacaaagauaacgaggccaucgaguucagcuuugaccuggaacgggaugucccggaagacguggcgcaggagaugguugaguccggcuaugugugcgaaggggaccacaagacgauggccaaagcuauuaaggauagagucucucuuaucaagcgcaaacgggagcagagacagcuggugcgggaagaacaggaaaagaaaaagcaggaggagagcucccucaaacagcagguugaacaaagcucugccucccagaccggcauuaagcagcugccuagcgcuucuacaggaauccccaccgccuccacaaccagcgccucugugagcacgcaggucgagcccgaggagccugaggcugaccaacaucagcagcuucaauaccagcagccguccaucagcgugcugucugauggcaccguggacuccgggcagggaagcuccguuuucacagaaucucgcgucagcucccaacagaccgugucuuauggcagccagcacgagcaggcgcauuccacagggaccgugcccggacacauuccuucuacgguccaagcccagagccagccccacggcguguacccucccuccagcguuccucagucuauggcucaucccugugggggcacaccgaccuauccugaaucccaaaucuuuuuccccacaauucacgagagaccugugagcuuuucucccccgccuaccugucccccuaaagucgccaucucccagcggagaaagagcaccucuuuccucgaagcccagacacaucacuuucaaccccugcugcgcacggugggacagucccuccugcccccuggcgggagcccgaccaauuggacacccgaggcuguugugaugcuuggaaccacagccucccgggucaccggcgagagcugugaaauucaggugcauccuauguucgagcccucucagguuuacagcgauuacagaccugggcuggugcuccccgaagaggcgcacuauuuuaucccucaagaagcugucuacguggccggagugcacuaucaggcccgcgucgcugagcaguacgagggcauuccguauaacuccucuguucugagcucccccaugaagcagaucccugaacaaaaacccgugcaagggggcccuacgucuagcuccguguucgaguuucccucuggacaggccuuccuggucggccaucuucagaaucucagacuggacagcgggcugggaccgggcuccccucucagcucuaucuccgcgcccauuagcacagaugcuacccggcugaaguuccaccccguguuuguuccucauucugcccccgccgugcuuacccacaacaaugaaucccgcagcaacugcgucuucgaguuucacgugcauacaccuuccucuagcuccggggaaggaggcgggauccugccgcaaagaguuuaccggaaucgccagguggcugucgaccucaaccaggaggagcugcccccucagagcgugggccugcacggauaucuucaacccguuaccgaagagaaacauaacuaccacgccccugaacucacagugucugucguggagcccauuggccagaauuggccgaucggguccccugaguacagcucugauagcucccagauuacgucuagcgaccccuccgauuuccaaucuccucccccuaccggaggcgcugccgcgcccuuugggagcgacguguccaugccguucauccaucugccucagacaguccugcaggaaagcccccucuuuuucugcuuuccccagggaaccacaucucaacagguucugaccgccuccuucagcuccggcggcucugcccuucacccucaggcccaggggcaaagccagggacagccguccucuagcucccugacgggcguguccucuagccagcccauccaacacccucagcagcaacaggggauucagcagaccgcucccccucaacagacagugcaguauagccucucucagaccuccacaagcucugaggccaccacagcccaacccgucagccagccucaggcuccccaggugcugccccaaguuuccgcgggaaagcagggcuuuccucccagacugccuccccaguacccgggggauucuaacaucgccccuagcuccaauguggcuagcgucuguauucauuccaccgugcuuucuccgcccaugccuacggaaguucucgccacacccggauauuucccuaccgugguccagccguacguggagagcaaccugcugguccccaugggcggcgucgggggacaaguucaggugucccagccuggcgggucucucgcccaagcucccaccacaagcucccagcaggccguccuggaaucuacccagggagugagccaaguugcgccugcugagcccguggccgucgcccagacgcaggcuacacagccgaccacacuugccuccagcguggacucugcgcacuccgacguggcuagcggcaugucugaugggaaugagaacguuccuuccagcucuggacggcaugaaggccgcaccacaaaaagacacuaucggaaguccguccgcagcagaucccggcaugagaagaccagcagacccaaacugcgcauccucaaugugucuaacaagggcgaccggguggucgaaugccaacuggagacgcacaauagaaaaauggugaccuuuaaguucgaucuggacggggauaacccugaagagauugccacaaucaugguuaauaacgacuucauccuugccauugagcgcgagagcuuuguggaucagguccgggagaucauugaaaaagcugacgagaugcucuccgaagaugugucuguugagcccgagggagaccagggccuggaaagccugcaggggaaggaugacuacggauucuccggcucucaaaagcucgagggggaauuuaaacagccuauccccgccagcuccaugccgcagcaaauuggaaucccuaccucuagccugacacaggugguccacuccgcuggcagacgcuucaucgugagccccguucccgagucucggcuuagagaguccaagguguuuccuagcgaaauuaccgauacggucgccgcgucuacagcccaguccccgggcaugaaucugagccauuccgcuucuagccucucccugcagcaagccuucagcgagcugcgccgggcucagaugaccgaagggcccaacacagccccucccaauuuuucucacaccggaccuaccuuccccguggugccucccuuucuuuccagcaucgccggcgucccgacaacggcugcggccaccgcuccuguucccgccacaucuagcccucccaacgacauuuccaccucugugauccagagcgaggugacagucccgaccgaagaggggauugccggaguggcuacguccacaggcguugugaccucugggggacugccuauuccgcccgucagcgaguccccugugcucagcucuguuguguccagcauuaccauccccgccgucguguccaucucuacaaccagcccuucccugcaggucccgacaucuacgagcgaaauugugguuuccagcaccgcgcucuaucccucugugacaguguccgcuaccagcgccucugccggcggcuccacagcuaccccugggcccaaaccucccgccgucguuagccaacaggcggccggaucuacgaccgugggcgcuacacugaccuccgugagcacaaccacaucuuucccuagcacggccucccagcuuuguauccagcugagcuccucuaccagcacaccgacccucgcugagaccgucgugguuuccgcccauucucuggacaagacaagccacuccucuacgaccgggcuggcuuuuagccuuuccgcccccuccucuagcagcucuccuggagcgggcguguccagcuacauuucucaacccgggggacugcacccucucgucauccccuccgugauugccagcacaccgauccugccucaggcugccggccccaccucuacaccccuccugccucagguccccuccaucccuccgcuugugcaacccguugcuaacgugccugccguccagcagacccugauucauagccagccccaaccugcccuccugcccaaucagccgcacacgcauugcccugaaguggauagcgacacacagcccaaagcuccuggcaucgaugacauuaagacccuggaggaaaaacuuagaucccuguucucugagcacagcuccucuggggcgcagcaugccagcguuucccucgagaccucucuggugaucgaaagcacagucacccccggaaucccgacaaccgcuguggccccuuccaaacuccugacgagcacaaccucuacaugucuuccgcccaccaaccugccucugggcacgguggcccuccccguuaccccugucgugacaccggggcaaguguccacccccgucagcacaaccacaucuggaguuaagccuggcaccgcucccuccaaaccuccccugacgaaggccccugugcuuccgguggggacagagcugcccgcgggaacccucccuagcgaacagcugcccccuuuccccggcccgucccucacccagucucagcaaccucuggaggaucuugacgcccagcugcggcgcacacugagccccgaaaugaucaccgucacauccgcugugggccccguuucuauggccgcuccuacggccaucaccgaggcggggacacagccccagaaaggagugagccaagucaaggagggcccugugcucgccaccuccagcggggcuggaguuuuuaaaaugggcagauuccaggugucugucgccgcugauggggcccagaaggaaggcaagaauaaauccgaggacgcuaagagcgugcacuuugaaucuagcacauccgagucuagcgugcuguccuccucuuccccggagagcacccuugucaaacccgaaccuaacggaauuacgauccccggcauuuccucugauguuccugagagcgcccacaagaccacagcguccgaagccaaaucugacaccgggcaacccacaaaggugggacgguuccaggugaccacgacagcuaauaaggucggccgcuuuagcguguccaaaaccgaggauaagaucacagacaccaaaaaggaagggccgguugccucuccucccuucauggaccuggagcaggcugugcucccugccgucauucccaaaaaggagaagccugaacugagcgagcccucccaucucaacggaccgagcucugaucccgaagccgcguuucuguccagagacguggaugacggcagcgggucuccucacagcccccaucagcuuagcucuaaaagccugccuucccaaaaucugagccagucccucucuaacagcuucaauuccucuuacaugagcuccgauaacgagucugacaucgaagaugaggaccugaaacuugagcugcggagacuccgcgauaaacaccugaaggaaauucaggaccuccagagccggcaaaaacacgagaucgaaucccuguauaccaaacuuggcaagguuccgcccgcugugaucauuccucccgccgcuccucugagcggaagacgccggagacccacaaaaucuaagggcuccaaaagcucucgcuccagcucucuggggaauaaguccccucagcucagcggaaaccugucuggccaguccgccgccagcguccuucauccccagcaaacgcugcacccgccugggaauauccccgaguccggacagaaccagcuccugcaaccucugaaacccagcccgucuagcgauaaucucuacuccgcuuuuaccucugacggcgccauuagcgugccuucccuuucugcgcccgggcagggcacaagcuccaccaacacaguuggagccaccgugaacagccaggcugcccaggcucaacccccugccaugacgucuucccggaagggcacauucaccgaugaccugcauaagcuggucgacaauugggcgagagaugccaugaaccucagcgggcgcagaggaucuaaaggccacaugaauuaugaagggcccggaauggcucggaaguuuuccgccccuggccagcugugcaucagcaugaccucuaaccuuggcggguccgcuccgauuagcgccgcuuccgccacaucucugggacauuucaccaaaagcaugugucccccucagcaguacggcuuucccgcgacaccuuucggggcccaaugguccggaacgggcgggcccgcuccgcagccucucggacaguuccagcccgugggcaccgccagccugcaaaauuuuaacaucucuaaucugcagaaguccaucagcaacccucccggcucuaaucuccgcacaaccuga

SEQ ID NO: 77901 - RNA, 6894 nt, Artificial Sequence
  derived and/or modified sequence opt5 from WNK2__Homo_sapiens__NP_001269323
auggacggcgaugggggcagacgggacguccccggcacccugauggagccugggcgcggagccggcccggcugggauggccgaacccagagccaaggcugcccggccuggaccccagcgcuuccucagacgguccgucguugaguccgaucaagaggaaccucccggccuggaagccgcugaggccccuggcccccagcccccucagccccuucagcgcagagugcugcuccugugcaagacacggcgccuuaucgcugagagagcccgggggcgcccugccgcccccgcuccggccgcucugguggcccaaccuggagcgcccggcgccccugcugacgccgggcccgaacccgucggaacgcaggagccuggcccggaucccauugcugccgccguggaaaccgcuccugcgcccgacgggggaccuagagaggaggccgcugccacaguucggaaggaagaugagggcgccgcugaagccaagcccgagccgggccgcaccagacgggacgaaccugaggaggaagaggaugacgaagaugaccucaaggcgguggcuacaucucuggaugggagauuucugaaauucgacaucgagcucggacgcggcuccuuuaagaccgucuacaaggggcuggacacagaaaccuggguggagguugccuggugugagcuucaggaucggaaacugacgaagcucgaaagacagcgcuucaaagaggaagccgagaugcugaagggacuucaacaccccaacauugugcgguuuuaugacuucugggaauccucugcuaaaggcaagagaugcaucguccuggugaccgagcucaugacauccgggacccugaagacauaccugaaacgcuuuaaggugaugaaaccuaagguccuccgguccugguguagacagauucugaaaggacuucuguuccuccacacccgcacgcccccuaucauccaccgggaucugaagugcgacaauauuuuuaucacaggccccaccggcucuguuaaaauuggggaucuuggacuggccacacucaagagagcuagcuucgccaaguccgugaucggcaccccggaguuuauggcgccugaaauguaugaggaacacuacgacgagagcguggaugucuaugccuucgggauguguaugcuggagauggcuaccucugaauaccccuauuccgagugccagaacgccgcucagauuuaccgcaaagugacauguggaaucaagcccgccagcuuugaaaaaguucacgacccugagauuaaggaaaucaucggcgagugcauuuguaaaaauaaggaggaacgguacgagaucaaggaucugcucucucacgcguucuucgccgaagacacgggggugagagucgagcuggcugaagaggaucacggccggaaauccaccauugcccuucgccuguggguggaggacccgaagaaacucaagggaaaacccaaggacaacggcgcuaucgaauuuacauucgaucuggagaaggaaaccccugacgagguugcccaagaaaugauugagagcggguuuuuccacgagucugaugugaaaaucgucgccaaguccaucagagaccggguggcucuuauucaguggagacgcgaacggaucuggcccgcgcugcagccuaaagagcaacaggaugucggaagccccgacaaggccagaggcccucccgugccgcuccagguucaggugacauaucaugcucaagccgggcagccuggacccccugaacccgaggagccggaagccgaucagcaccuccugccucccacccucccuacguccgcuacaucucuggccagcgacuccaccuuugauagcggccaggggucuaccgucuacuccgacagccaaucuagccagcaguccgugaugcuuggcucucuggcggaugcugcccccagccccgcccagugcguuuguuccccuccggugagcgagggacccguccucccucaaucucugcccucccugggcgcuuaucagcagccuacagccgcgcccgggcuuccugugggaagcgugccggcucccgccugcccucccucucuccagcaacauuucccugaccccgccauguccuuugcuccgguucugccuccgcccagcaccccuaugcccacaggcccugggcagccggcgcccccuggacagcaacccccuccccuggcucagccgacgccucucccccagguccuggccccucagcccguggugccucuucaacccgucccgccucaucugccgcccuaccucgcgccugccucccaggugggcgcuccggcccagcugaaaccccugcagaugccucaagcuccccuucagccucucgcccagguucccccucagaugccgcccauuccuguggugcccccuaucacaccccuggccgggauugauggccugccgccugcucuccccgaccugcccacagcgaccgugccucccguuccuccgccccaauauuucucuccugccgugauccuucccagccuggcugccccucucccucccgccucccccgcucugccccugcaggccgucaaacuuccucaucccccuggagcgccccucgcuaugccgugccgcacaaucgugccuaaugcccccgccaccauuccccugcuggcuguugccccuccgggcguggcggcucucucuauccauagcgccgucgcccagcugcccgggcaaccuguguaccccgcugccuuuccucagauggcucccacggacgugccucccuccccgcaccauaccguccagaacaugagagccacaccuccccagccugcgcuucccccgcaaccuacccugccgccccaaccuguucugcccccucagccgacacugcccccucagcccgugcugccuccccaaccuacccggccgccccagccugugcuucccccucagcccaugcucccgccucagcccguccugcccccucaacccgcccugccugugcgcccggaaccccuccagccucaucugcccgagcaggcugccccugcugccacgcccggaagccagauucuucugggccauccggccccuuaugcuguugauguggcggcccaaguccccacagugccuguucccccggcugccgugcucucuccuccccugcccgaaguccugcuuccugccgcucccgagcugcucccucaguucccguccagccuggccaccgugucugcguccguucagagcgugcccacacaaaccgcuacccuccugccucccgccaauccuccccuuccugggggaccgggcaucgccucucccuguccuacaguccagcugacgguggagcccgugcaggaggaacaggcuagccaagacaagccucccgggcucccgcaguccugcgaaagcuacggcggaucugaugucaccuccggcaaagagcugagcgacuccugugaaggggccuuuggaggcgggagacuggagggacgggcggcccgcaagcaccacagacggucuacacgcgcuagaagccggcaggagcgcgccuccagaccucggcuuaccauucugaacguuugcaauacaggcgauaaaaugguggaaugucagcucgagacccauaaccacaagauggugacguucaaauuugaccuggauggcgacgcucccgaugaaaucgccacauacauggucgagcaugacuucauucuccaagcugaaagagagaccuucaucgagcagaugaaggaugugauggacaaagccgaagauaugcugucugaggacaccgacgcggaucgcgggagcgaccccggaacauccccuccccaccuuucuaccugcggccuggggacaggagaagagagccggcagucccaggccaaugcuccuguuuaucaacagaacgugcuccacacgggcaagagaugguuuaucauuuguccggucgccgagcaucccgcuccugaagcccccgagagcucuccuccccugccgcuguccagccuuccucccgaagccucucaggggccuugccgcggacugacccuccccugucugccuuggcggagagcugcgugcggcgccguguuccucucccuguuuagcgcugagucugcccaauccaagcagcccccggauagcgcccccuacaaagaccagcuuuccagcaaggaacagccuucuuuccuggcuagccaacagcugcucucccaggccggccccucuaauccuccgggggcgcccccugcgccccuggcuccuagcucucccccuguuacagcccuuccccaggauggagcugccccggcgaccagcacaaugccugagcccgccagcggcaccgcuucccaagccgggggaccuggcacgccccaggggcugaccucugagcucgaaacaagccagccgcuggcugagacccacgaagccccucucgcugugcagccccuggucgugggacuugcccccuguaccccugcccccgaggccgcuuccacccgcgacgccagcgcuccucgggaaccgcugcccccucccgccccugagcccucuccgcauuccggcacaccucaacccgcccugggccagccugcgccccuccugccugcugccgucggggcugugagccuugccaccucucagcugcccuccccgccccucggaccuacgguucccccucagcccccuagcgcccuggaguccgauggcgaagggccgcccccuagagugggauuugucgacucuacaaucaaaagccucgaugagaagcugcgcacccuucuguaucaagaacacgugcccaccuccagcgcuucugccggcacaccuguugaggugggggaccgggauuucacccuggaaccccucagaggagaccagccgcgguccgaggucugcggcggcgaccuggcgcuuccucccgugccuaaagaggccgugagcgggcgcguucagcugccccaaccgcucgucgaaaagucugagcuggcuccuacgagaggagccgugauggaacagggcacaagcuccucuaugaccgcugagagcagcccccggucuaugcucggguacgaucgcgacggaagacagguggccagcgauucccaugucgugcccagcguuccucaggacgugcccgcguuuguccggccugccagaguggagccgacagaucgcgacggcggggaagcuggagagucuuccgccgaacccccucccagcgauaugggcaccguuggcgggcaggcuucccacccucagacacugggagcccgggcucuuggcucucccagaaagcgcccugagcagcaggacgugagcuccccggccaaaaccgucgggcgguucucugugguuagcacgcaagaugaauggacccuggcgagcccccacagccugagauauucugccccucccgacguguaccucgaugaggcuccuuccagccccgacgucaagcuggccgugcgccgggcucagacagccucuuccauugaggugggagucggcgaaccgguuagcucugauagcggggacgagggacccagagcccgcccucccgugcagaaacaggcgucccuuccugugucuggcagcgucgcuggcgacuuugugaagaaagccaccgccuuccugcaaagacccucccgggcugggagccucggaccugaaacaccgucccgcguuggcaugaaggugcccaccaucucugucacgagcuuucauucccagucuagcuauauuuccucugauaacgacagcgagcuggaagaugccgacaucaagaaagagcugcagucccucagagagaagcaccuuaaagaaaucagcgagcugcaaucucagcagaagcaggaaauugaggcucuguaccggcgccucgggaaaccucugcccccuaaugugggauucuuucauacagcgccucccaccggcagacggagaaagacauccaagagcaaacuuaaggcggggaaacugcucaacccccugguucgccaacugaagguggucgccucuuccaccggacaccucgcugauagcucucggggacccccugccaaagaccccgcucaggccuccgugggccuuaccgcggauagcacagggcuguccggaaaggccguccagacgcagcaaccuugcagcgugagagcuucucugagcuccgacaucuguucuggccucgccagcgaugggggaggcgcucgcgggcagggcuggaccguuuaccaucccacauccgaacgggugaccuauaaaucuagcuccaagccgagagcccgguuccugucuggacccgugagcgucuccauuuggagcgcucuuaagcgccugugccucggcaaagagcacucuuccagaagcucuacauccagccuggccccugggcccgagccuggaccccagccggcgcugcacguucaggcccaagugaacaauuccaacaauaagaaaggcaccuucacggacgaucuccauaaacuuguggacgaauggacaucuaaaaccgucggggcugcccagcugaagccuacccugaaccagcucaagcaaacacagaaacugcaggauauggaggcccaggcuggaugggccgcgcccggcgaagcucgggccaugaccgccccucgcgcuggggugggcaugcccagacuuccucccgccccgggaccucugagcacaacgguuauccccggcgcugccccuacccucuccgugcccacaccggacggggcgcugggaaccgcccggcgcaaucaagucugguuuggccugagagugcccccuacagcuuguugcgggcacagcacccagccccggggaggccagcgcgucgggucuaagacggccuccuucgcugccagcgacccugugagaucuuga

SEQ ID NO: 77902 - RNA, 5403 nt, Artificial Sequence
  derived and/or modified sequence opt5 from WNK3__Homo_sapiens__NP_065973
auggccaccgacagcggcgaucccgcuuccacagaggacucugaaaagccugaugggaucagcuucgagaacagagugccgcaggucgccgcgacgcugaccguugaagcucggcucaaagagaagaauuccacauuuucugccagcggagaaaccguggagcgcaaaagauucuuucggaaguccguggagaugacagaagacgauaaagucgccgagucuagccccaaggacgaacgcauuaaggcugccaugaacaucccuagaguggauaaacugcccuccaauguucuucggggcgggcaagaggugaaguacgagcagugcagcaaaucuaccuccgaaauuagcaaggacuguuucaaagagaagaacgaaaaggagauggaagaggaggcugaaaugaaagccgucgcgacaucuccuuccggacgcuuucugaaguucgauaucgagcucggcagaggggccuuuaaaaccguguauaagggacuggacacggaaaccuggguugagguggcuuggugcgaacuucaggaucggaaacugacaaaggccgagcagcaacgcuucaaagaggaagcugagaugcucaagggccugcagcaccccaauauugucagauuuuacgacagcugggaaucuauccugaagggcaaaaaguguaucgugcucgugaccgagcugaugacauccgggacccuuaaaacguaucugaagcgguucaaagucaugaagccuaagguucuccgcagcuggugcagacagauucugaaaggacuucaguuucugcauacacggaccccgcccaucauucaccgcgaucucaagugugacaacaucuucauuacaggcccuaccggguccgugaaaaucggagaccugggccuggccacccucaugagaacaucuuuugcgaagagcgugauugggacgcccgaauucauggccccugagauguacgaggaacauuaugaugaguccgucgacguguacgcuuucggaaugugcaugcuggaaauggccaccagcgaguaucccuacucugagugucaaaaugcugcccagaucuaccggaaaguuacauccggcaucaagccggccagcuuuaacaaggugaccgauccugaagucaaagagauuaucgaaggcugcauuagacagaauaagucugagcgccuuagcauccgggaccugcucaaccacgcuuucuuugcggaagauacagggcugagaguggagcuugccgaggaagacgauuguuccaauucuagccuggcucuccgccuguggguugaggaccccaaaaagcugaaaggaaagcauaaggauaacgaagccauugaguucuccuuuaaucucgaaaccgacacgccugaggagguggccuaugaaauggucaaaagcggcuucuuucacgagucugauuccaaggcuguggccaaaagcauccgggacagagucacacccaucaagaaaacccgcgaaaagaaacccgcggggugccuggaggaacggagagacucucaguguaaguccaugggaaacguguucccucaaccgcagaauaccacacuuccccuggcuccugcccagcaaaccggcgccgagugcgaggaaacagagguugaucagcacgugcgccagcagcuccugcaacggaagccccagcagcauugcagcuccgucacgggggacaaccuuucugaagcuggagccgcuagcgugauucacuccgauaccucuagccagccuuccguugccuacagcucuaaccaaacaaugggcucccagauggugagcaauaucccccaggcggaggucaacgugccgggccagauuuauucuucccaacagcugguggggcauuaccagcagguuagcggacuccaaaaacacucuaagcugacccagccucagauccugccccucguccaaggccagagcacagugcugccugugcacguccuugggcccaccgugguuucccagccucaggugagcccccugacgguccaaaaagugccgcagauuaagccuguuucucagcccgugggagccgagcagcaagcugcccuccugaaacccgaccuggucagaucccuuaaucaggauguggcuaccacaaaggaaaacguuagcuccccugacaauccgucuggcaacgggaagcaggaucgcaucaaacagcggagagccagcuguccccggccugagaagggcaccaaauuucaacucacagugcugcaggucuccaccucuggagacaauaugguggaaugccagcuggagacgcauaacaauaagauggugacauucaaauuugaugucgacggcgaugcgcccgaagacaucgccgauuauaugguugaggacaacuucgugcucgagagcgaaaaggagaaguuuguggaagagcugcgcgcuauugucgggcaagcccaggaaauccuucacgugcauuucgcuaccgagagagccacaggaguugacuccauuaccguggauucuaauagcucccagaccggcagcucugagcagguccaaaucaacuccacaagcacgcagaccucuaaugaauccgccccucagagcucucccguggggcgguggagauucuguauuaaccagacaauccgcaaucgggagacccaauccccucccagccugcagcacuccaugagcgcuguuccgggaagacauccucuccccucuccuaaaaacacaagcaacaaggaaauuucccgcgacacccugcugacgaucgagaauaaccccugccacagagcgcuuuuuacaucuaaaagcgaacacaaggauguggucgacggcaaaaucuccgagugugccucuguggagaccaagcagccggcuauucucuaccagguugaagauaaucggcaaaucauggccccugugaccaacagcuccucuuauagcacaaccuccguccgcgccgugcccgcugagugcgaagggcugacaaagcaggccagcauuuucaucccuguguaccccugucaucagacggcgucucaggcugacgcccugaugucccaccccggcgagagcacccaaacaucuggaaauucccucaccacacuggccuuugaucagaaaccucagacccuuagcguccaacagccggcuauggacgccgaguucauuucccaggaaggcgagacgaccguuaacacagaagcgucuagccccaagaccgugaucccuacacagacccccgggcuggagccuacaacccuccaacccacgacagugcuggaauccgauggagagagaccuccgaaacuggaguuugcugacaaucggaucaagacccuugaugaaaaacuccgcaaccugcuguaccaggagcauagcauuucuuccaucuaucccgaaagccagaaggacacccagucuauugauagcccuuucuccucuagcgccgaggacacacucuccugccccgucaccgaagugaucgccauuucucacuguggcaucaaagacagcccuguucaaucccccaauuuucagcagacggggagcaagcugcuuucuaacguggcugccucccagccggcuaauaucagcgucuucaagagagaucugaacgugauuacauccguuccuucugagcucugccugcacgagaugagcuccgacgccucucugcccggagaucccgaagcguacccugccgcugugagcuccggcggggccauccaucuucaaaccggcggaggcuauuuugggcucagcuucacaugucccucucugaaaaauccuauuuccaagaaaagcuggacccggaagcugaaaucuugggcuuaccgccucagacaguccacaagcuuuuucaagcggucuaagguccgccagguggagaccgaagagaugagaagcgccaucgccccggaccccauuccucugacgcgggaauccaccgcugauacaagagcgcuuaaccgcugcaaagccaugucuggaagcuuucaacggggcagauuccaggucaucaccaucccccagcagcaauccgcuaagaugacaagcuucgggauugagcacaucuccguguuuucugagaccaaucauagcuccgaagaggccuucauuaaaacggccaagucucagcugguugaaaucgagccugcuacacagaaccccaaaaccagcuuuuccuaugagaagcuccaggcccugcaagaaacaugcaaggagaacaaaggagugccgaagcagggcgacaauuuccugucuuuuagcgcggcuugugaaaccgaugucuccagcgugaccccugagaaagaauucgaggagacaucugccacgggguccagcaugcagucuggcuccgaacuucugcucaaggagcgcgaaauucugaccgccggaaaacagcccagcucugacuccgaguuuagcgcuucccucgccggcagcgggaagucuguugcgaagacaggaccugaaagcaaccaaugccugccccaccaugaggagcaggcuuacgcccagacccaguccucucuuuucuauagcccuuccucucccaugagcuccgaugacgaaucugagaucgaagaugaggaccugaaaguggaacuccaacggcugagagagaagcacauucaggaggucgugaaucugcagacacaacagaacaaagaacuucaggagcuguacgaacgccuccggagcaucaaggacuccaaaacccagagcacggagaucccgcugccucccgccucucccagacgcccucgguccuuuaagagcaagcucagaucucggccgcaaucccugacacacguggauaauggcauuguugcuaccgggaaaagcugucuuaucaacgagcuggaaaauccccucugcgucgaguccaacgccgcuucuugucagcagagcccugccuccaagaaaggaauguucaccgacgaucugcauaagcugguggacgauuggacaaaagaagcggugggcaauagccuuauuaagcccucucugaaccagcucaaacaaucccagcacaagcuggagaccgaaaauuggaacaaggucagcgagaauacaccuucuacgaugggcuacaccagcacauggaucuccucucucagccagauucgcggggccgugcccaccucccugccucagggacuuucucugccgagcuuucccggcccucuguccagcuaugggaugccccauguuugccaauacaacgcuguggccggagcuggcuauccuguccaguggguggggaucucuggaacaacccagcaauccguugugauccccgcccagagcggcggcccguuccagccugggaugaauaugcaggccuuccccacguccucuguccaaaaccccgcuaccauuccucccggaccuaaauga

SEQ ID NO: 77903 - RNA, 3732 nt, Artificial Sequence
  derived and/or modified sequence opt5 from WNK4__Homo_sapiens__NP_115763
augcuggccagccccgcuaccgagacaacggugcucaugucccagaccgaagccgaccuggcgcuuagaccuccgcccccucugggcacagcugggcaaccccggcucggaccucccccucgcagagcccggcgcuucucuggcaaggccgagccgagaccccggagcucccgccugucuagacggagcuccgucgaucuugggcugcucucuagcuggucccugccugcuagccccgccccugaucccccggacccucccgacucugcuggaccuggccccgcccgcuccccgccuccgagcucuaaagaacccccugaggggaccuggacagaaggagcgcccguuaaggccgcugaggauuccgccagaccugagcugcccgacagcgcugugggcccgggcucucgggaaccucuccgcgugcccgaggccgucgcgcuggaaagacggcgcgagcaggaggaaaaagaggauauggaaacccaggccguggcuacauccccugacgggagauaccuuaaguuugauaucgagauuggacggggcagcuucaaaaccguuuauagagggcuggacacggauaccacaguggaagucgccuggugcgagcuccagacccgcaagcugucccgggcugagagacaacgcuuuucugaagagguggaaaugcuuaagggacugcagcaccccaacaucguucgguucuacgacagcuggaaauccgugcucagaggccaggucuguauugugcuggugacagagcugaugaccagcgggacgcucaagacauaucugcgccgguuuagagaaaugaaaccucgcguccuucagcgguggucuagacaaauccugcgcggacuccauuuccugcacucccggguucccccgauucuucauagagaucugaagugcgacaauguguuuaucaccggcccuacaggcagcgugaaaaucggggaccucggacuggccacccugaagcgggccucuuucgcuaagagcgucauuggcacccccgaguuuauggcgcccgagauguacgaagagaaauaugaugaagccguggacguuuacgcuuucgggauguguaugcucgagauggccacauccgaauauccuuacucugagugccagaacgccgcucagaucuaccgcaaggugacgagcggaagaaaacccaauuccuuucacaaggucaaaauucccgaggugaaggaaaucauugagggcuguauccggaccgauaaaaacgaaagauucacaauucaggaccugcuugcccaugcguuuuuccgcgaggagcggggaguucacguggaacuggcugaggaagaugacggagagaagccuggccucaagcuguggcuuagaauggaagaugcccgcagaggcgggcggccccgcgacaaucaagccaucgaguuccuguuucagcucggaagagaugcugccgaggaagucgcucaggagaugguggcccugggccuggucugcgaagcggacuaucaaccuguggcccgggcuguucgcgagagaguggccgcuauccagcggaaacgcgaaaagcucagaaaagcccgggagcuggaggcgcuucccccugaacccgggccgccucccgccaccgucccuauggcucccggaccgccuagcguguuucccccugagcccgaggaacccgaagccgaucagcaccagccuuuccuguuccgccaugcuucuuacuccagcacaaccucugacugugagacggacggcuaucucuccagcuccggguuucuggaugccucugacccggcccugcaacccccuggcggaguucccagcucccuugcugagucucaccucugccugccuagcgcguucgcccuguccauucccagaagcggcccugggucugauuuuuccccgggagacagcuacgcuucugaugccgccuccggccucagcgacgugggggaaggaaugggccagaugcggagacccccugggcgcaaccugcggagacgcccccggucuagacuucgcgucacaagcguguccgaucagaaugaccgggugguugagugucagcugcaaacccauaacagcaagauggucaccuucagauuugaucucgacggcgauucuccugaagagaucgcugccgcgaugguguauaaugaguucauucugcccuccgaacgcgacggauuucugcggagaauccgggagauuauccagcgcguggaaacacuucucaaaagagauaccggcccgauggaggcugccgaagacacacugagcccucaggaggagcccgcuccccugccugcccuccccgucccucugccggaccccuccaacgaggaacuucagucuagcacgucccuggaacaccggucuuggaccgccuucagcacauccucuagcuccccugggacaccccucagcccuggaaaucccuuuucuccgggcaccccuaucucccccgggccuauuuuccccaucaccagcccucccugccacccgucuccuucccccuucagccccauuucuucccaagugagcuccaacccuagcccgcaucccacgucuagcccucugcccuuuuccucuagcaccccugaguuccccguuccucugucccaguguccguggucuagccuucccacaaccuccccucccacauuuucuccuaccugcagccaggugacgcucuccagccccuucuuuccgccuugccccucuacauccagcuuccccucuaccacagcggcuccucugcugucccucgccagcgccuuuucccuggcugucaugaccguggcccagucucuucugagccccuccccuggacuccugagccaaucuccgcccgcuccucccuccccucugcccagccuuccgcucccucccccuguugcccccggcgggcaggaaucuccuagcccccacaccgcggagguggaguccgaagccucuccgccucccgcucgcccccugccuggcgaggccagacuggcuccgaucagcgaagagggaaagccccagcucgucggccgguuccaagugacauccucuaaggaaccugccgagccccugccucuucagcccacgagcccuacccuguccgggagccccaaaccgucuacaccucagcucaccuccgagagcuccgauacagaagacucugccggaggcgggcccgagaccagagaagcucuggcggagagcgaucgcgccgcugagggacugggcgccgggguugaagaggaaggcgacgauggaaaggagccucaggugggcgggucuccccaaccgcuuucccauccuagccccgucuggaugaauuacuccuauagcucucugugucucuccagcgaagagucugaguccagcggagaagacgaggaauuuugggccgagcugcagucucuccggcagaaacaccugagcgaaguggagacgcuucagacacugcaaaagaaagagauugaagaucucuacuccagacugggcaagcagcccccucccgggaucguggcuccugccgcgaugcugucuagccgccagcggagacuuuccaaggggagcuucccgaccucccgccggaacucucugcagagaagcgagcccccuggccccggcaucaugcgcagaaauucccucucugggagcuccaccggaucucaagaacagcgggcuagcaaaggcgucacauuugccggggacguuggacgcauguga

SEQ ID NO: 77904 - RNA, 1254 nt, Artificial Sequence
  derived and/or modified sequence opt5 from WNT10A__Homo_sapiens__NP_079492
augggcagcgcccaccccagaccuuggcugcggcuccgcccgcagccccaaccuagacccgcucugugggugcuucuguucuuucuccugcuucuggccgcggcuaugccucgguccgcccccaacgacauccucgaucugcgccugccuccggagcccguccucaaugccaacaccguuugccugacacuuccugggcugucuagacggcagauggaagugugugugcgccaucccgacgucgcugccagcgcuauucagggaauccagauugccauccacgagugccaacaucaguucagagaucagcgguggaauuguuccucucucgaaacgcgcaacaagauuccuuacgagagccccaucuuuuccagaggcuuccgggaaucugcguuugccuaugcuaucgccgcugccggggugguucacgcggugagcaaugccugcgcucugggaaaacuuaaggccuguggcugcgacgcuucccgcagaggggaugaggaggccuuccggcgcaaacugcauagacuccagcuggacgcccugcaacggggaaagggccucagccacggcgucccggaacacccugcucugcccaccgcgucuccugggcuucaggauuccugggaguggggaggcuguagccccgacaugggguuuggagaaagauucucuaaagauuuucuggacucccgcgagccccaucgggauauucacgccagaaugcgccuccauaacaaucgggugggcagacaggcuguuauggagaacaugcgccggaagugcaagugucacgggacaagcggaucuugccagcugaaaaccuguuggcaagugacaccugaguucagaaccgucggcgcccuucugcgcucccgguuucacagagccacacucauccgcccgcauaaucggaacggcgggcagcuggaacccggaccugcuggcgcccccagcccugcgcccggggcuccgggaccuagacggcgcgccucccccgccgaccugguguacuucgaaaagucuccugauuuuugcgagagagaaccccggcucgacagcgcuggcaccguggggagacugugcaauaaauccagcgccggaucugacggcuguggcuccaugugcugugggcgcggacacaacauucuucggcagacgagaagcgagcgcugccauuguagauuccacuggugcuguuucgucguuugcgaggaaugucggaucaccgagugggugucugugugcaaguga

SEQ ID NO: 77905 - RNA, 1170 nt, Artificial Sequence
  derived and/or modified sequence opt5 from WNT10B__Homo_sapiens__NP_003385
augcuggaggaacccagaccucggccgcccccuagcggccucgccgggcugcuuuuccuggcucucugcucccgcgcccugucuaacgagauccuuggacugaagcuccccggcgaaccuccccugaccgcgaauacagugugucugacgcucagcgggcuguccaaaagacagcuuggacugugccuccggaacccugacgucaccgcuucugcccugcaaggccuucacauugccguucaugagugucagcaccagcugcgcgaucagagauggaauugcagcgcucucgaagggggaggccggcugccgcaucacuccgccauccugaagcgcggcuuuagagagucugcuuucagcuuuuccaugcucgccgcgggggugaugcaugccguggcuacagccuguagccugggaaaacuugucucuugcggcuguggguggaagggauccggcgagcaagaccggcugcgcgcuaaacuccugcagcuucaggcccugagcagagggaagucuuucccccacucccucccuagccccggaccugggucuucccccagcccgggcccucaggauaccugggaauggggcggaugcaaccacgacauggauuuuggcgagaaguucucccgggacuuucuggauucucgcgaagcgcccagagacauucaagcccggaugcgcauccauaauaacagaguggggcggcagguugugacagagaaucugaaaagaaaguguaaaugccacggaaccagcggcuccugucaguucaagacaugcuggcgcgcugccccugaguuucgggcugucggggccgcccucagagaacgccugggacgggcuauuuucaucgauacccauaacagaaauagcggcgcguuucagccccgccuucggcccagacgccugucuggcgagcucguguacuucgaaaaauccccugacuuuugcgagcgggauccgacgauggggagccccggaaccagaggccgcgccuguaacaagacaucucggcugcuugacgggugcggaagccuguguugcggcagagggcacaauguucuccggcaaacccgcguggaaagaugucacugccgguuccauugguguugcuauguccugugugaugagugcaaggugacagagugggugaacgucuguaaauga

SEQ ID NO: 77906 - RNA, 1065 nt, Artificial Sequence
  derived and/or modified sequence opt5 from WNT11__Homo_sapiens__NP_004617
augagagcccggccccaggugugcgaggcucuccuguucgcccuggcgcuucaaaccggcgucuguuacgggaucaaguggcuggcucucagcaaaacaccuuccgcccuggcccuuaaccagacgcagcacugcaagcagcuggaaggacucguuucugcucaagugcagcugugucgcagcaaucuggagcucaugcauaccgugguccacgccgcuagagaagugaugaaagccugccggcgcgcguuugccgacaugagauggaacuguuccucuauugagcuggcuccgaauuaucuucuggaucucgaacggggcacacgcgagagcgccuucguuuacgcucuguccgccgcggccaucucucaugcuauugccagagcuugcaccagcggggaccuucccggauguuccugcggcccugugcccggggagccucccggaccuggcaaccgguggggcgggugugccgauaaucugagcuauggacuccugaugggcgccaaguuuucugacgcuccgaugaaagucaagaagacagggucccaggcgaacaaacugaugcgccuccacaauagcgaagugggaagacaggcccugcgggcuucucuugagaugaagugcaaaugucauggcguuuccgggagcugcucuaucagaaccugcuggaagggacugcaagaacuccaggauguggccgccgaccugaaaacacgcuaccuuuccgcuaccaaggucgugcaccggcccaugggcacgcgcaagcaccuggugccuaaagaucucgacauuagacccgucaaggauagcgagcugguuuaucugcaguccucuccugacuucuguaugaaaaacgagaaggugggcagccaugggacccaggaucggcaaugcaauaaaacauccaacggaagcgacucuugugaucucaugugcuguggcagaggguacaaucccuauaccgaccgcguggucgaacggugccacuguaaguaccauuggugcuguuacgugacaugcagacgcugugagcggaccguugaaagauaugugugcaaauga

SEQ ID NO: 77907 - RNA, 1068 nt, Artificial Sequence
  derived and/or modified sequence opt5 from WNT16__Homo_sapiens__NP_057171
augcagcugaccacaugccucagagagacgcuguucaccggcgccagccaaaagacaucccuuugguggcuggggaucgcuucuuuuggagugcccgaaaaacucggcugugccaaccugccucuuaauagccggcagaaggagcugugcaaacgcaagccguaccuccugcccuccauuagagaaggggcgcggcugggaauccaggaguguggcucucaguuccgccacgaaagauggaacugcaugauuaccgcugccgccacaaccgcuccuaugggggccagcccccucuuuggauaugagcuguccucuggcacaaaagagaccgcuuucaucuacgccgucauggcggccggccuuguucauagcgugacgcgguccuguagcgcugggaauaugaccgaaugcucuugugacacaacccugcaaaacggaggcuccgccagcgagggguggcacuggggaggcugcucugaugacgugcaguaugggaugugguuuucccgcaaguuccucgauuuuccuauuggaaauacaaccggcaaggaaaacaaaguccugcuugcuaugaaucugcauaacaaugaggccggcagacaggcgguggccaagcucaugagcguugacugucggugccacggggugucuggauccugugcugucaaaacgugcuggaagacaaugagcuccuucgagaaaaucggccaucugcugaaggauaaguacgaaaacucuauccagauuagcgacaaaaccaagcgcaaaaugagacggcgcgagaaggaucaaagaaaaauccccauucacaaggacgaucuccuguaugugaauaaauccccuaacuacugcguugaagacaagaaacuugggaucccgggaacacagggccgggaguguaaucgcaccagcgaaggggccgauggaugcaaccugcucuguugcggcagaggcuauaauacccacgugguccggcauguggagagaugugagugcaaguuuauuugguguugcuacgugcgcugucggagaugcgaaucuaugacagacguccacacguguaaguga

SEQ ID NO: 77908 - RNA, 1113 nt, Artificial Sequence
  derived and/or modified sequence opt5 from WNT1__Homo_sapiens__NP_005421
augggccugugggcccuccugcccgggugggugagcgcuacccuucugcucgcccuggcggcccuuccugcugcccuggcugccaacuccucuggaagaugguggggcaucgucaauguugcuagcuccacaaaccuccugacggacucuaagagccugcagcucgugcuggagccgucccuucaacugcucucucggaaacagcgcagacugauucggcagaaucccgggauccuucacagcguguccggaggccugcagagcgccguccgcgaaugcaaguggcaauucagaaaccggcgcuggaauuguccuaccgcgcccgggccucaucucuuuggaaaaauugugaacagaggcugccgggagacagccuucaucuuugcuauuaccucugccggcguuacacacuccguggcucgcagcuguucugaaggguccaucgagagcugcaccugugauuacagacggcgcggacccggcgggccugacuggcauuggggaggcugcucugauaauaucgacuucgggagacuguuuggacgggaguucgucgauuccggcgaaaagggccgcgaccugagauuucucaugaaccugcacaauaacgaggccgggcggacaaccguguucagcgaaaugagacaggaguguaaaugccauggaauguccggcucuuguacgguucggaccugcuggaugcgccuuccgacacugagagcggugggggauguccuccgcgaccgguuugauggagccagcagagugcuguauggcaaucgcggguccaaccgggcuagcagagccgaacuucugcgccucgagcccgaggacccugcucacaagcccccuucuccccacgaucugguguacuucgaaaaguccccgaauuuuuguaccuauagcggacggcugggcacagccggcaccgccgggagagcuugcaacucuagcuccccugcgcucgacggaugcgagcugcuuuguugcggccgcgggcaucggacgagaacacagcgggucaccgaacgcuguaauugcacauuccacugguguugccauguuucuuguagaaacugcacccacacccgggugcugcacgagugucucuga

SEQ ID NO: 77909 - RNA, 900 nt, Artificial Sequence
  derived and/or modified sequence opt5 from WNT2B__Homo_sapiens__NP_001278809
augagaagcgugggcgagggggcccgggaauggauccgcgagugccagcaccaauucagacaucaccgguggaacuguaccacacuggaccgcgaucauacggucuuuggaagaguuaugcuccgguccucucgcgaagcugccuucguguacgcgauuagcuccgcuggcgugguccacgccaucaccagagccugcucucagggggagcugagcguguguuccugcgaccccuauacacggggacgccaucacgaucagagaggcgacuuugauuggggaggguguucugacaauauucacuacggcguucgguucgcuaaggccuuuguggaugcuaaagaaaagcgccuuaaagacgccagagcgcugaugaaccuccauaauaaccggugcggccgcaccgccgucagacgguuccugaaacuugaguguaagugccacggggugagcggauccuguacacugagaaccugcuggcgcgcucucagcgauuuucggagaacaggcgacuaucugcgccggagauacgauggggccguucaggugauggcuacccaagacggagccaauuucacggcggcccgccagggcuaucggagagcuacccgcacagaucuggucuacuuugacaacucuccugacuauugugugcucgauaaggccgcugggucccugggaaccgccggccgggugugcagcaagacaucuaaaggcaccgacgggugcgagaucauguguugcggaagaggcuacgauacgacacgcgucacccggguuacacagugugaaugcaaguuccauugguguugcgccgugagauguaaagagugccggaauaccguggacguccacaccuguaaggcuccgaaaaaggcggaauggcuugaucagacauga

SEQ ID NO: 77910 - RNA, 1083 nt, Artificial Sequence
  derived and/or modified sequence opt5 from WNT2__Homo_sapiens__NP_003382
augaacgcuccccugggcgggaucuggcucuggcugccucuucugcucaccuggcugacaccggaggugaauagcuccuggugguacaugagagccacgggaggcucuagccgggucaugugcgacaacguucccgggcuuguguccucucagcgccaacugugucacagacauccugaugugaugcgggccauuagccagggagucgcggaauggaccgcugagugccagcaccaguuccgccaacauagauggaauuguaacacacucgaccgggaucacucccuguuuggccgcgugcugcucagaucuagccgggaauccgccuucguuuaugccaucagcucugcugggguggucuuugccauuacccgcgcuugcucccagggagagguuaagagcuguucuugcgaccccaaaaagaugggcuccgccaaagauagcaagggcaucuucgacuggggaggguguucugauaauauugacuacggcaucaaauuugcgagagccuucguggaugcuaaggaacggaaggggaaagacgcccgcgcucugaugaaccuucauaauaacagagccggacggaaggcggugaaacgcuuucugaagcaggagugcaaaugucacggcgucuccgggagcugcacacucagaaccuguuggcuggccauggcugauuuccggaagacaggagacuaucuuuggagaaaguacaauggcgccauccagguggugaugaaccaagauggcaccggguuuacggucgcuaaugagcgcuucaaaaagccuaccaaaaacgaccugguuuauuuugaaaauucccccgacuacugcauucgggauagagaggccggaucucucggcacagccgggcgcgugugcaaccugaccagccggggaauggacuccugugaagugaugugcuguggcagaggguaugauacaagccacgucacccgcaugacgaagugcggauguaaauuccauuggugcugugcugugcggugccaggacugucuggaggcgcucgauguucacacaugcaaggccccuaaaaaugcugacuggaccacagccaccuga

SEQ ID NO: 77911 - RNA, 1059 nt, Artificial Sequence
  derived and/or modified sequence opt5 from WNT3A__Homo_sapiens__NP_149122
auggcuccccugggcuacuuccuccugcuuugcagccugaagcaggcccucggguccuauccuaucugguggucucuggccgugggaccgcaauacagcucccuuggcucucagcccauucugugugcgagcaucccugggcucguccccaaacagcugagauuuugccggaacuauguugagauuaugccuuccguggcugaaggaaucaagauuggcauccaggagugucaacaccaguuccgcgggagacgguggaauugcaccacagugcaugacucucuggccaucuuuggacccguccucgauaaagccacgcgcgaaagcgcuuucgugcacgccauugcuuccgccggcguugcguuugccgugaccagaagcugugcugagggcacagccgcuaucugcggguguucuucccggcaucagggaagcccuggcaagggguggaaauggggaggcugcucugaagacauugaguucgggggaauggucucccgcgaguuugccgaugcgagagaaaaccggccggacgcccgcagcgcuaugaauagacacaacaaugaggccggccggcaggcuaucgccucucauaugcaccugaaguguaagugccacggccuuuccgggagcugugaagugaaaaccugcugguggucccaacccgauuuccgcgccauuggagacuuucugaaggauaaauacgacucugcuagcgagaugguuguggagaagcauagagaaucccggggcugggucgagacacuccgcccuagauauaccuacuucaaagugcccacagaacgggaucugguguauuacgaggcgagcccuaacuuuugcgaacccaauccggagaccgggucuuucggaacgagagaccgcaccuguaacgucuccagccacggcaucgaugggugcgaccuucuguguugcggacggggccauaaugccagagcugagcgccggagagaaaagugucgcugcguuuuucacugguguugcuacgugucuugucaggagugcacacggguguaugauguccacaccuguaaguga

SEQ ID NO: 77912 - RNA, 1068 nt, Artificial Sequence
  derived and/or modified sequence opt5 from WNT3__Homo_sapiens__NP_110380
auggagccccaucugcucggccugcuucuggggcuccugcuuggaggcaccagagugcuggccggguacccuaucugguggagccucgcucugggacagcaauauacaucccugggcucucagccgcuccugugcgggagcauucccggacuugucccuaagcagcugcgguucugucgcaacuacaucgaaauuaugcccuccguugccgagggcgugaaacucggcauccaggaaugccaacaccaguuuagagggcggcgcuggaauuguacgaccauugacgauucucuggcgaucuucggaccugugcuugacaaggcuacaagagagagcgccuuuguccacgccaucgcuuccgccggcguggcuuucgccguuacccggucuugcgcggaagggacaagcaccauuuguggaugcgauucccaucacaaagggcccccuggcgagggauggaaguggggcggcuguagcgaggacgccgauuuuggggugcuggucucucgcgaguucgcugacgccagagaaaaccggccggaugcucgcuccgccaugaauaaacauaacaaugaagcgggaagaacaaccauccucgaccacaugcaccugaagugcaagugucauggccugagcgggucuugcgaggugaaaacguguuggugggcccagcccgauuuucgggcuauuggagacuuccucaaggauaaauaugacuccgccagcgagaugguuguggaaaagcaccgcgagucuagaggcugggucgaaacccugcgggcuaaauacucccuuuuuaagccucccacagagcgcgaucugguguauuacgaaaacagcccuaauuucugcgagcccaacccggagaccggguccuuuggaacaagagaccggaccugcaaugugacgucucauggcaucgacggcugugaucuccugugcugugggagaggacacaacacacgcaccgaaaagcggaaagagaagugccacuguauuuuccauuggugcuguuaugucagcugccaggaauguaucagaauuuacgacguucacacaugcaaauga

SEQ ID NO: 77913 - RNA, 1122 nt, Artificial Sequence
  derived and/or modified sequence opt5 from WNT4__Homo_sapiens__XP_011539899
augacccagcugacacccgccccuccgcccgcuagcucccaaggcucucucugcagcacgcaggggaagagaaacaaacggcugccucgcacccuucccaaucagagaggauacgagggcgaagacacagggcacaucccucgguaucuggccaagcucuccucugugggaagcauuuccgaggaagagaccugugaaaaacugaagggccuuauccagcgccaaguccagaugugcaaaagaaaccuggagguuauggauucugugcggcgcggggcgcagcucgcuauugaggaaugucaguaccaauucagaaaucggcgcuggaacugcagcacacuggacucccugcccguguuuggaaaggucgugacccagggcacaagagaggccgccuucguuuaugcuaucagcucugccggcguggcuuuugccgucacccgggcguguuccagcggggaacucgagaagugcggaugugaucgcacggugcauggcguuucuccucagggguuccagugguccggaugcagcgacaauauugccuacggcguggcuuuuucucaauccuucgucgaugugagagagcggagcaaaggggccuccucuagccgcgcucugaugaaccuucacaauaacgaagccggaagaaaggcgauccugacccauaugcggguggaguguaaaugccacggcgucuccggcagcugugaaguuaagacaugcuggagagccgugccgcccuuucgccagguggggcaugcucucaaagagaaguucgacggagccaccgaagucgagccucggagaguggggucuucccgcgcucugguuccccggaaugcccaguuuaagccucacacagaugaggaccuuguguaucuggaacccagcccggauuucugcgagcaagacaugagaucuggcguccucggaacccgcggccggacguguaacaaaacaagcaaggccaucgaugggugcgaacugcuguguugcggaagaggcuuucacaccgcucagguggagcucgcggaacgcuguuccugcaaauuccauugguguugcuuuguuaagugucggcagugccagagacugguggagcuucacacaugucgcuga

SEQ ID NO: 77914 - RNA, 1098 nt, Artificial Sequence
  derived and/or modified sequence opt5 from WNT5A__Homo_sapiens__NP_001243034
auggccggcagcgcuauguccucuaaguucuuucugguggcccucgcgaucuucuuuagcuucgcucaggucguuauugaggccaacuccugguggucucuggggaugaauaaccccgugcaaaugagcgaaguguacaucauuggagcccagccucuuugcucccagcuggcuggccucucucaggggcagaaaaagcugugucaccuuuaucaagaccauaugcaguacaucggagagggcgccaaaaccgggauuaaggaaugccaguaucaauuuagacaccggcgcuggaauuguagcacagucgauaacacguccguguucggaagaguuaugcagaucggcagccgggagaccgcuuuuacauacgccgugucugcggccggcgucgugaaugcuaugucccgcgccugcagagaaggggagcugagcaccuguggaugcucucgggcugcccgcccgaaagaccuccccagagauuggcuguggggcggguguggagacaacaucgauuauggcuaccgguucgcgaaggaguuuguugacgcccgcgaaagagagcggauucaugcuaagggguccuaugaaagcgcccgcauccugaugaaucuccacaacaaugaggcuggaagacggacaguguacaaccuggccgaugucgccugcaaaugucauggcgugucuggcuccugcagccuuaagaccuguuggcugcagcucgcugacuuccgcaaagugggggaugcgcugaaggagaaauacgacuccgccgcugccaugagacuuaauucucggggaaagcugguccagguuaacagcagauuuaauuccccuacaacccaagaucucguguauauugaccccagcccugauuacugcgugcgcaacgaaucuacgggcucccuggggacccagggacggcugugcaauaagacaagcgagggcauggacgggugugaacucaugugcuguggaagaggcuaugaccaguucaaaaccguccaaacagagcgcugccacuguaaguuucacuggugcuguuacgugaaaugcaagaaauguaccgaaaucguugaucaguucgugugcaaguga

SEQ ID NO: 77915 - RNA, 1080 nt, Artificial Sequence
  derived and/or modified sequence opt5 from WNT5B__Homo_sapiens__NP_110402
augcccagccugcuccugcuuuucaccgccgcucugcucuccucuugggcccagcugcuuacagacgcgaacagcugguggucccuggcucucaauccugugcaaagaccggagauguuuaucauuggcgcccagcccgucugcucucagcugccugggcugagccccggacagcggaagcucugucaacuguaccaggaacacauggccuauaucggcgagggggcuaaaacgggaauuaaggaaugccagcaucaguuccgccaaagacgguggaacuguuccaccgccgauaaugcuucuguuuuuggccgcgugaugcagaucgggagcagagagacagccuucacccacgcgguguccgccgcuggagucgugaacgccauuagccgggcuugccgcgaaggcgagcuuucuacauguggcugcuccagaaccgcccggccuaaagaccugccccgcgauuggcucuggggaggguguggcgacaauguugaguacggguauagauuugcgaaggaguucguggaugcccgggaacgcgaaaagaacuuugcuaaaggaagcgaggagcagggcagaguccugaugaaucuucagaacaaugaagccgggcggcgcgcuguguacaagauggccgacguugccugcaaaugucauggagugucuggcuccugcagccugaagacauguuggcuccaacuggcugaguucagaaaagucggcgaucggcugaaggaaaaauaugacucugcggccgcuaugagagugacccgcaaggggcggcucgagcuggugaacuccagauuuacgcagccuaccccggaagaucuugucuacguugaccccagcccugauuauugccugcgcaaugaguccacaggaucucucggcacccaggggcggcugugcaacaagacaagcgagggaauggacggcugugaacuuaugugcugugggagaggauacaaucaauucaaauccguccagguggagcgcugccacuguaaguuucauuggugcuguuucgugcggugcaaaaaguguaccgaaaucguggaucaguacaucugcaaauga

SEQ ID NO: 77916 - RNA, 1098 nt, Artificial Sequence
  derived and/or modified sequence opt5 from WNT6__Homo_sapiens__NP_006513
augcugcccccucucccgagcagacugggccuucugcuccugcuucugcucugccccgcccacgucgggggacuguggugggcugugggcuccccucugguuauggaccccaccucuaucugucggaaggcccgcagacucgcggggcggcaggcugagcugugccaagccgaaccugaggugguggccgaacuugcucgcggagccagacugggcguccgggagugucaguuccaguuucgcuucagacgguggaacugcagcucccauucuaaggcuuuugggcgcauucuccagcaagauaucagagaaacagccuucguguuugcgauuacggccgcuggagccagccacgcuguuacccaggccuguuccaugggcgagcugcuucagugcggcugucaggcgccccgggggcgcgccccuccgagacccucuggacugccuggcacacccgggccucccggaccggcuggcagcccugagggguccgccgcuugggaauggggaggcugcggcgacgauguggacuucggggaugagaaaagccggcucuuuauggacgcccgccauaaaagaggacggggcgauaucagagcccugguccaacugcacaauaacgaagcugggcgccucgcggugcggucucauaccagaacagaguguaagugccacggacuguccggcagcugugcccuucggaccugcuggcagaaacugcccccuuuccgcgagguuggggcuagacuccuggaacgcuuucacggagccucucgggugaugggcacaaaugacggcaaggcccuucugcccgcugucagaacccucaagcccccugggcgcgccgaucugcuguacgcggcugacuccccggauuucugcgcccccaaccggagaacgggaagcccuggcacccgcgggcgggccuguaauucuuccgcucccgaccucagcggaugcgaucugcuuuguugcggcagagggcaucggcaggaguccgugcagcuggaagagaacugucucugccgcuuucacugguguugcgugguccaaugucauagaugccggguuagaaaagaacugucucuuugucuguga

SEQ ID NO: 77917 - RNA, 1050 nt, Artificial Sequence
  derived and/or modified sequence opt5 from WNT7A__Homo_sapiens__NP_004616
augaacagaaaggcccggcgcugccugggccaccucuuccugagccuugggaugguguaccugagaaucggaggcuuuuccucugucguugcucucggggccagcauuaucuguaauaaaauucccggacuggcgccucggcagcgcgcuaucugccaauccagaccggacgccauuaucgugaucggcgaggggucucagaugggacuugaugaaugucaguuccaguuucggaacggccgcuggaauugcagcgcccugggcgagagaaccguguucgggaaggaacucaaagucggaucccgggaggcugccuuuacauaugcuauuaucgccgcgggcguggcccaugcuauuacggccgcuuguacccaagggaaccugucugacugcggaugugauaaggaaaaacagggccaguaccaccgcgacgagggguggaaguggggaggcugcagcgccgauaucagauauggcauuggguucgcgaagguuuuuguggacgcccgggagaucaaacagaaugcucgcacacugaugaaccuccauaauaacgaagccggaagaaagauucuggaggaaaauaugaaacuugaguguaagugccacggcgucuccgggagcuguaccacaaaaaccugcuggacaacccugccccaauuccgggagcucggauacgugcugaaggauaaguauaacgaagcuguucauguggagccuguccgcgccucuagaaauaaacggcccacguuucuuaagaucaaaaagccucuguccuacagaaaacccauggacaccgaucucguguauaucgaaaagagcccuaacuacugcgaggaagacccggugacaggcucugucgggacccagggacgcgccuguaauaaaacagcuccccaggcguccggcugcgaucugauguguugcggccggggguacaacacccaccaguaugccagaguuuggcaauguaauugcaaguuccacugguguugcuacgugaaguguaacacgugcagcgagcgcacagagauguauaccuguaaauga

SEQ ID NO: 77918 - RNA, 1050 nt, Artificial Sequence
  derived and/or modified sequence opt5 from WNT7B__Homo_sapiens__NP_478679
augcacagaaacuuccggaaguggaucuuuuacguguuccugugcuuuggcguccucuauguuaaacugggggcccuuagcuccgugguggcucugggagccaauauuaucuguaacaagauucccggccucgcgccucgccagagagcuaucugccaaucucggccggacgccauuaucgucaucggggagggagcccagaugggcauuaaugaaugucaguaccaguuccgcuuugggagauggaacugcagcgcucugggagagaaaaccguguucggccaagaacuucggguuggcucccgcgaggccgcuuuuacauaugccaucacggcggccgggguggcucaugccgucaccgcugccuguucucagggaaaucugagcaacugcggcugugauagagaaaagcagggguacuauaaucaggcggagggauggaaauggggcgggugcuccgccgacgugcgguacggaauugauuucucucgcagauuuguugacgcucgggagaucaagaagaacgcccgcagacucaugaaucugcacaacaaugaagcuggccggaaagugcuggaggaucgcaugcaacucgaauguaagugccauggcgucagcggguccuguacaaccaaaacaugcuggaccacacugcccaaguucagagaggugggacaccuucugaaagagaaguauaacgccgccgugcaggucgaaguugugcgggcuagcagacuccgccagccuaccuuucugcggauuaagcagcuuagaucuuaccaaaaacccauggagacggaccugguguacaucgaaaaguccccuaauuauugcgaggaagaugcggccaccggcagcgucgggacacagggacgccucuguaaccggaccucucccggcgcugacgggugcgauacaauguguugcggaagaggcuacaauacccaucaguauacgaaaguguggcaauguaacugcaaguuccacugguguugcuuuguuaaauguaacacaugcuccgagcgcaccgagguguucacauguaaguga

SEQ ID NO: 77919 - RNA, 1056 nt, Artificial Sequence
  derived and/or modified sequence opt5 from WNT8A__Homo_sapiens__NP_490645
augggcaaccuguucaugcucugggccgcucuggggaucugcugugccgcguuuagcgcuuccgccuggucugugaauaacuuccuuauuaccggacccaaggccuaccugacauauacgaccagcgucgcucucggcgcccaguccgggaucgaggaaugcaaauuucaauucgcuugggagagauggaauuguccugaaaacgcccugcagcuuucuacacacaaucggcugcgcagcgcgaccagagagacauccuuuauucaugccaucucuagcgcuggaguuauguacauuaucaccaagaacugcuccaugggcgacuucgaaaauugugggugcgauggaagcaacaauggcaaaacaggcgggcacggauggaucuggggcggguguucugacaacguggaguuuggagagcggauuuccaaacucuucguggauagccuggaaaagggcaaggacgcccgcgcucugaugaaucuccauaacaauagagccgggcggcuggcgguccgcgccaccaugaagagaacgugcaaaugucacggaaucucuggcuccugcagcauucagaccuguuggcuucagcuggcugaguuucgggaaaugggcgauuaucucaaggccaaauacgaccaagcucugaagaucgagauggauaaacgccagcuuagagccgggaacucugccgagggacauugggugccggcugaagcguuccugcccuccgccgaggcugaacucauuuuucuggaggaaagcccugacuauugcacaugcaauuccucucugggcaucuacgggaccgagggacgggagugucuccagaacagccacaacacaucccgcugggaaagacggagcugcggccgccuguguaccgagugcgggcuucagguugaagagagaaagacggaagugauuucuuccuguaauugcaaguuccaaugguguugcacagucaaaugugaucagugccggcacgugguuagcaaguauuacugugccagaucucccggaagcgcccagucccugggcaaaggcucugcuuga

SEQ ID NO: 77920 - RNA, 1056 nt, Artificial Sequence
  derived and/or modified sequence opt5 from WNT8B__Homo_sapiens__NP_003384
auguuccugagcaagcccuccguguacaucugccucuuuaccuguguccugcagcuuucucacagcugguccguuaacaauuuccugaugacaggcccuaaagccuaucucauuuacucuagcuccguggcugccggggcgcaaucuggaaucgaggaaugcaaguaucaguuugcuugggacagauggaacuguccggagcgggcccugcagcuuagcucccauggcgggcugcgcagcgccaauagagaaacggcuuucgugcacgccauuucuuccgcuggagucauguacacccucacacggaacugcagccugggcgauuuugacaauugugggugcgaugacucucgcaacggacagcugggcggccaaggguggcucuggggaggcuguuccgauaaugugggguucggagaggccaucagcaaacaguuuguugacgcgcuggaaaccggccaggaugccagagcugccaugaaccuucauaauaacgaggcugggcggaaggccgugaaaggaacaaugaagagaaccugcaagugucacggcgucucuggcuccugcacaacccagacguguuggcugcaacuccccgaguuccgcgaagugggggcgcaucugaaagagaaguaucacgccgcucuuaaaguugaccugcuccagggagccggcaauagcgcugccgggcggggagccauugcugauaccuuucgcuccaucucuacaagagaacuggugcaccuggaggacagcccugauuacugccucgagaacaagacccugggccuucuggggacagaaggacgggagugccuccgcagaggccgggcgcugggccgcugggaaagacgguccuguagacgccuuugcggggacuguggacuggccgucgaggaacggagagcugagaccgugagcucuugcaauuguaaauuccauuggugcugugccgugcgcugcgagcagugucggagacgcgucacgaaguauuuuugcucccgggccgaaagaccccgcggcggggcugcccacaagccuggacggaaacccuga

SEQ ID NO: 77921 - RNA, 1098 nt, Artificial Sequence
  derived and/or modified sequence opt5 from WNT9A__Homo_sapiens__NP_003386
augcuggacggcagcccccucgccagauggcuggcugccgcguucgggcuuacccugcuccuggcugcccuucggccuuccgccgcuuacuuuggacugacaggcucugagccgcucacgauccugccccugacccucgaaccugaggccgcugcccaggcgcacuauaaggccugcgaucgccugaaacuugaaagaaagcaacggcgcauguguagacgggaccccgggguggcugagacacuggucgaagccguuagcauguccgcucucgagugccaguuccaguuucgcuucgagagauggaacuguacccuggaaggacgguaccgcgccucucuucugaaaagaggcuuuaaggagacagcguuccucuaugccauuagcuccgcugggcugacccaugcccuggcuaaagccugcucugccggacggauggaacgcuguacaugcgaugaggcuccugaccucgagaauagagaagcguggcaguggggcggcuguggggauaaccugaaguacagcuccaaguuugugaaagaguuccuuggacggcgcagcucuaaggaccugagagcccggguggauuuucacaauaaccucgucggcgugaaaguuaucaaggcugggguggaaaccacgugcaaaugucauggagucuccggcagcugcaccgugagaacauguuggcgccaacuggcccccuuccacgagguugggaagcaucuuaagcacaaauaugaaaccgcccugaaggugggaucuacaaccaaugaggcugccggcgaggcgggcgcuauuuccccuccgcgggggagagccagcggagccggcgggucugacccccucccucgcacgcccgaacugguccaccuggaugacuccccuagcuuuugccucgcuggacgguucucccccggcacagccgggagacgcugccaucgggagaaaaacugugaaucuaucugcuguggaagaggccacaauacccagagccgcguggugacacggccgugccagugucaggucagauggugcuguuacguugagugccgccaauguacccagcgggaagagguguauaccugcaagggcuga

SEQ ID NO: 77922 - RNA, 1074 nt, Artificial Sequence
  derived and/or modified sequence opt5 from WNT9B__Homo_sapiens__NP_003387
augagacccccuccggcccuggcucucgccggccugugccuucuggcgcuccccgcugccgccgcuagcuacuucgggcugaccggacgggaggugcuuacaccuuuucccggccuggggacggccgcugccccugcgcagggaggcgcccaccucaagcaaugugaccugcugaaacucucccgcagacagaagcagcugugccggcgcgaacccgggcuugcugagacccugagagaugccgcucaucucggacugcuugaaugucaguuccaauuucggcacgagcgcuggaacugcucucuggaaggcagaaugggccuccugaaacggggguucaaggagacagccuuucuguaugcggucagcuccgccgcucucacccauacacuggcccgcgcuuguucugccggaagaauggagcggugcaccugugacgauagcccuggccuugaaucccgccaggccuggcaguggggaguuugcggggacaaucugaaauacucuacaaaguuccucagcaacuuucugggcuccaagagagggaauaaagaucuucgggcucgcgcggacgcccacaacacccaugugggaaucaaggcugugaaaagcggccugagaacgaccuguaagugccacggcgucucuggguccugugccgugcggacaugcuggaaacagcucagcccguucagagagaccggacaaguucugaagcugcgcuaugauucugccgugaaggucuccagcgcuacaaaugaagcccucggccggcuggagcuuugggcgcccgcuagacaggggucucugaccaaaggacucgccccucgcuccggcgaccugguguacauggaggauagccccuccuuuugccggccuucuaaguauagccccgggacggccggaagaguuuguucccgcgaagcuagcuguucuucccuuugcugcggccggggcuacgacacacagagcagacugguggccuucucuugucacugccagguccaaugguguugcuauguggagugucagcagugcgugcaagaggaacucgucuacaccuguaaacauuga

SEQ ID NO: 77923 - RNA, 1647 nt, Artificial Sequence
  derived and/or modified sequence opt5 from WRAP53__Homo_sapiens__NP_001137462
augaagacccuggagacacagccccucgccccugacugcuguccgagcgaucaagaccccgcuccugcccaccccuccccucaugcgucucccaugaacaaaaaugcugauagcgaacugaugccuccgcccccugagagaggcgaucccccucggcuuucccccgacccgguggccgggucugccgucagccaggaacugcgcgagggagacccuguuucccucucuacgccccuggaaaccgaguucggcagcccuuccgagcuuagccccagaaucgaggagcaggaacugucugagaacacaucccuccccgcugaggaagccaaugggagccugucugaggaagaggcuaacggaccugaacugggcuccgggaaggccauggaggauaccagcggagagccggcggccgaagacgagggcgauacagcuuggaauuacucuuuuucccagcucccccgguuccugagcggcuccuggucugaauuuagcacccaaccugagaacuuccuuaaagggugcaagugggcccccgacggauccuguauucugacaaauagcgcugauaacauccuccgcauuuauaaucugccucccgaacuuuaccacgagggcgaacagguggaauaugccgagauggugccgguccugagaaugguggaaggggacaccaucuacgauuauugcugguacucucucauguccagcgcgcagccugacacgucuuauguugccagcuccucucgggagaaccccauucauaucugggacgcuuuuaccggagaacugcgcgccagcuucagagcuuacaaucaccuggaugagcucacagccgcccauucccuguguuuuagcccugacggcucucagcuuuucugcggguuuaaccggaccgugcgcgucuucuccacagcuagacccggacgggauugugaggugcgcgcgaccuuugccaaaaagcaaggccagagcggcaucauuucuugcaucgcuuucuccccugcccagccccuguacgccugugggagcuauggaagaucccucggccuguacgcuugggacgaugggucuccgcuugcccugcucggaggccaccaagggggaauuacgcaccugugcuuucauccugacggcaaucgguucuucagcggcgcgcgcaaggaugcugaacugcucuguugggaccugagacaguccggguauccccuuuggucucugggacgggagguuacaaccaaccagagaaucuacuuugaucucgaccccacaggccaguuccuggugagcggguccaccagcggagccgucucugugugggauaccgacggcccugggaaugacggcaaaccggaacccgugcuuuccuuucugccucaaaaggauugcacaaacggagucagccuccaccccucucugccucugcucgccacggcuuccggccagcgcguuuuccccgagccuaccgagagcggggacgaaggagaggaacugggccuuccccugcucucuacacggcaugugcaccuggagugcagacugcagcuuugguggugugggggagccccggauagcuccauuccugacgaucaccagggcgaaaaagggcaaggcggaaccgagggcggggugggagagcucaucuga

SEQ ID NO: 77924 - RNA, 423 nt, Artificial Sequence
  derived and/or modified sequence opt5 from WRB__Homo_sapiens__NP_001139690
augagcagagugcugcagaaggacgccgagcaagaaucccagaugcgggcugagauccaggauaugaaacaggaacucucuaccgucaacaugauggacgaguucgcccgcuacgcgagacuggaacggaagauuaauaaaaugacagauaaacuuaagacgcacguuaaggcucgcaccgcccaacuggccaagaucaaaugggugauuagcguggcuuuuuauguccuccaggccgcucugaugaucucccuuauuuggaaguacuauucugugcccguugccguggucccuagcaaauggaucacaccgcuggacagacucguggcguuccccacccggguugccggcggggugggaaucacaugcuggauucuggucuguaacaaggugguggcuaucguccugcauccuuuuuccuga

SEQ ID NO: 77925 - RNA, 4299 nt, Artificial Sequence
  derived and/or modified sequence opt5 from WRN__Homo_sapiens__NP_000544
augagcgagaagaaacuggaaaccacagcccagcaaagaaagugccccgaguggaugaacgugcagaauaaacggugugcugucgaagaacgcaaggccugcguuagaaaauccguguucgaagacgaucucccuuuucuggaguucacgggcucuaucguguacagcuaugacgcguccgauuguucuuuucuuagcgaggacauuuccaugucucugagcgauggggacgucgugggauucgauauggaauggccgccccucuacaaccggggcaagcuggggaagguugcucuuauccagcugugcguguccgagagcaaauguuaucucuuucacgucucuuccaugagcguguucccucagggacugaagaugcugcucgaaaauaaagccguuaagaaagccggcguggggauugagggagaccaauggaagcugcuucgcgauuuugacaucaagcugaaaaacuucgucgagcucaccgauguggcuaauaagaaacugaagugcacagaaaccuggucucuuaacucccuggugaaacaucuccugggcaagcagcugcucaaagacaagagcauuagauguucuaauugguccaaguuuccccugacagaggaucagaaacuuuacgccgcuaccgacgccuaugcgggcuucaucaucuaccggaaccuggaaauucucgacgauacaguccagcgcuuugccaucaauaaggaggaagagauucugcuuagcgacaugaacaaacaacugaccuccaucucugaggaaguuauggaucucgcuaagcaucugccucacgccuucagcaaacuggagaaucccagacggguguccauucuccugaaggacaucagcgaaaaccuuuauucucugcgcagaaugauuaucggguccacgaauaucgagaccgaacuccggccuagcaacaaucugaaccuucugucuuuugaggauagcacaaccggaggcgugcagcagaagcagauucgcgagcacgaaguccucauccauguggaggacgaaacaugggauccgacccuggaccaccuggcuaaacacgauggggaggacguucucggaaacaagguggaaagaaaagaggauggcuucgaggacggggucgaagacaauaagcugaaagagaacauggaacgggccugccuuaugucccuggauauuacggagcaugagcuccaaauccuggaacagcagucucaagaggaauaccugagcgacauugcguacaaguccacagagcaccuuagccccaaugauaacgaaaaugacaccucuuaugugaucgaguccgaugaggaccucgaaauggagaugcugaagcaucugagcccuaacgauaaugaaaacgacacaucuuacguuaucgaguccgaugaagaccucgagauggagaugcugaaaagccuugaaaaucugaacuccggaaccguggagcccacccacucuaagugucucaaaauggaacgcaaucugggccugccuacaaaggaggaagaggaggaugacgaaaacgaggccaaugaaggcgaggaggaugacgacaaagauuuccuuuggcccgcuccgaacgaggagcaggucacgugccucaagauguauuuugggcacagcuccuucaagccugugcaguggaaagucauucauucugugcuggaagagagacgggacaauguugccgugauggcuaccggauacggcaagagccuguguuuucaguaucccccugucuacguggggaaaaucggacucguuauuagcccccugaucucccuuauggaagaucaagugcugcagcucaagaugucuaacauucccgccugcuuccugggcuccgcccagagcgagaacguccugacagacaucaaacuugggaaguauagaaucguguacgugaccccugaguacugcucuggaaauaugggccuccugcagcaacuggaagcugauauuggcaucacacucauugcgguugacgaggcccacuguaucuccgaaugggggcaugauuuucgcgacagcuuccggaaacugggaucucuuaagaccgcucugccgaugguccccauuguggcccucacggccacagcuagcuccagcaucagagaggauauugugcgcugccugaaccugcggaauccucagaucaccuguaccggcuuugacagacccaaccuuuaucucgaaguccgccggaagacagggaauauccugcaggaucugcagccuuuccucgugaaaaccucuucccacugggaguuugagggacccacaauuaucuacugcccgagcagaaagaugacgcaacagguuaccggcgaacugcgcaaacuuaaccuguccugugggacauaucaugccggcaugucuuucagcacccggaaggacauucaccacagauuugugcgcgaugagauccagugcgucauugcgacaaucgcuuucggaaugggcaucaauaaagccgacauuagacaggugauccauuacggggccccuaaggacauggaauccuauuaccaagagauuggccgggcuggacgggaugggcuccagucuagcugucacguucugugggcccccgcugacaucaaccugaaucgccaucuucugaccgaaauuagaaacgagaaguuucggcucuauaaacugaagaugauggccaaaauggagaaguaccuccacuccucuagaugccgccggcagaucauccugagccacuucgaagauaaacaagugcagaaggcgucccuuggaauuaugggcacggagaaguguugcgacaauuguagaagccgccuggaucauugcuacucuauggacgauuccgaagacaccagcugggauuucgggccucaggccuuuaaacuccugucugcugucgacauccugggcgagaaguucggaauuggccuucccauccuguuucucagaggguccaacagccagcggcuggccgaucaauaucgcagacacucucucuucggaacaggcaaagaccagaccgaguccugguggaaggcuuuuagccggcagcugauuacagaaggguuccuuguggagguuucccgcuacaauaaauuuaugaagaucugcgcccugaccaagaaaggaagaaacuggcuccauaaggcgaauacggaaagccagucucugauccugcaagccaacgaggaacuuuguccuaaaaagcugcuccugcccagcuccaaaacagugucuagcggcaccaaggagcacugcuauaaccaggucccgguggagcucuccacagagaaaaagucuaaucuggaaaaacuuuacagcuauaaaccuugugacaagauuuccucugggagcaacaucuccaaaaagagcauuauggugcagucucccgaaaaggcuuacuccagcucucagcccgucaucuccgcccaagagcaggaaacccagauuguucuguauggcaagcugguggaggcucggcaaaagcaugccaauaaaauggaugugccuccggccauccucgcuaccaacaagauucuggucgacauggcgaaaaugcgccccacaacgguggagaauguuaagagaaucgauggagugagcgaaggcaaagccgcuaugcuugccccucugcucgaggucaucaagcacuucugccagaccaacuccgugcagacagaccuguuuucuagcaccaagccccaggaggaacagaaaacaucccucguugccaagaauaaaauuuguacccugagccaaucuauggcuaucacguacucccuuuuccaggaaaagaaaaugccucucaagagcauugccgagucucggauccugccccugaugacaauugggaugcaccugagccaggcggugaaggcuggaugcccucuugaucuggagcgcgccggccucacccccgaaguccagaaaaucaucgccgacgugauuagaaacccgccuguuaauuccgauaugucuaagaucagccugauucggaugcucgugcccgagaacaucgacaccuaccugauucauauggcuaucgaaauccuuaaacacgggccugauuccggacugcaacccucuugugacgucaauaagagacgcugcuuuccgggcagcgaggagauuuguuccagcucuaaacgguccaaggaagagguggggaucaacacagaaaccagcuccgccgagagaaagcgccggcugccugugugguucgcgaaaggcucugauacaagcaagaaacucauggacaagacgaaaagaggaggccuguuuuccuga

SEQ ID NO: 77926 - RNA, 1998 nt, Artificial Sequence
  derived and/or modified sequence opt5 from WRNIP1__Homo_sapiens__NP_064520
auggaggugagcggccccgaagacgauccuuuccugucccagcuccaccaaguccagugcccgguuugucagcagaugaugcccgccgcucauaucaacucucaccuggacagaugccuucugcuccauccugccgggcacgcggagcccgcugccggaagccaucgggccggcgaacgcgcuaaggggccuuccccucccggagccaaaagacggcgccugucugagagcuccgcucuuaagcaaccggccacccccacagcggccgaaucuagcgagggcgagggggaagagggagaugacggcggcgaaacggaguccagagagagcuacgaugcuccucccaccccuucuggggcccggcugauucccgacuuuccgguggcucgcuccagcucuccuggaagaaaaggcuccgggaagcggcccgccgcggccgcugccgcuggaagcgccucuccucgcuccugggaugaagccgaggcucaggaagaggaagaggcggugggcgacggggauggagacggcgaugccgacgcugauggcgaggacgaccccgggcacugggaugccgacgccgcugaagccgcgacagcuuucggagccagcggcgggggaagaccccacccucgggcccucgcugccgaggaaauccgccagaugcugcagggcaaaccgcuggcugauaccaugagacccgacacacuccaagauuauuuugggcaguccaaggccgucggacaggacacccugcuucggucucugcucgagacaaaugaaauuccuagccugauccuuugggggcccccuggcuguggcaagaccacgcuggcgcauauuaucgccuccaacagcaaaaagcacucuauccgcuucgugacccucuccgcuacaaaugccaaaaccaacgauguuagagacgugauuaagcaggcucaaaaugagaaauccuuuuucaagcggaagacaauccuguuuauugaugagauccauagauucaacaaaucucagcaggacaccuuucugccccacgucgaaugcggaacgauuacacucaucggcgccaccacagagaauccgagcuuccaagugaacgcggcccugcuuucccgcugucggguuauugugcuggaaaagcucccugucgaggcuauggugaccauccugaugagagccaucaauucucuugggauucacgugcuggauagcucccgccccaccgacccucucagccauucuuccaacagcucuagcgaacccgcuauguuuaucgaggacaaagccgucgauacacuggccuaccugagcgacggagaugcucgggcgggccucaaugggcugcagcuugccguucuggcuagacucuccucucgcaagauguucugcaaaaagagcggccaguccuauucuccuagccgggugcugauuacggagaacgacgugaaagaaggacuucagagaucccacauccuguacgaucgcgccggcgaggaacauuauaauuguauuagcgcccuccacaagucuaugcggggguccgaccaaaacgcuagccuguacuggcuggccagaaugcucgagggaggcgaggauccccuguaugucgcgcgccggcuugugagauuugcuucugaagacaucgggcuggccgauccguccgcccucacccaggcuguugccgcguaccagggaugccauuucaucggcaugccugagugugaagugcugcuggcucagugcgucguguacuucgcccgggcccccaagagcauugagguuuauucugcuuacaauaacgugaaagccugucuucgcaaccaccaagggccccucccuccggucccccugcaccugagaaaugcuccuacacggcucaugaaggaccugggcuauggaaaaggcuacaaguauaaccccauguacagcgaaccuguggaucaggaguaucuucccgaggaacugagaggggucgacuuuuucaaacagcgccggugcuga

SEQ ID NO: 77927 - RNA, 1266 nt, Artificial Sequence
  derived and/or modified sequence opt5 from WSB1__Homo_sapiens__NP_056441
auggccagcuuucccccuagagugaacgaaaaggaaaucguccggcugcgcaccauuggcgagcuccuggcuccggccgcgcccuucgacaaaaagugcgggagagaaaauuggacaguugcuuucgccccugauggauccuacuuugccuggucucagggccaccggacggugaaacuugugcccuggagccaaugucugcagaacuuccuccugcaugggaccaagaaugucacaaacuccucuagccuucgccugccuagacaaaauuccgacggaggccagaaaaacaagccccgggagcacaucauugauugcggggacaucguguggucucucgcuuuuggaagcuccguuccugaaaagcagagccgcugugugaauauugaguggcauagauuccgguuuggccaggaucagcugcugcucgccaccggccugaacaaugggcgcaucaaaaucugggacgucuauacaggaaaacuucugcucaaccugguggaucacaccgagguugugagagaccuuacauucgcuccggauggcucucugauucucgucuccgccagccgggacaagacccugcgcgugugggaucugaaggacgaugggaauaugaugaaagugcucagaggacaucagaacugggucuacucuugcgcguuuucccccgacagcucuaugcuguguuccguuggcgccagcaaggcuguguuccuuuggaauauggacaaguauacgaugauccggaaacuggaagggcaccaccaugauguggucgccugcgacuuuuccccugauggagcucuccuggccaccgcgucuuacgacacacgcguguauauuugggauccccacaacggcgacauccuuauggaguucggccaucuguuuccucccccgaccccuauuuucgccgggggagcuaaugauagauggguucggagcguguccuucagccacgacggccuccacgucgccucucuggcugaugacaagauggugagauuuuggcgcaucgaugaagacuaccccguucaaguggccccucuguccaacgggcucuguugcgccuucagcacagacggaucuguccuggcugcgggcacccaugaugggagcguguauuuuugggccacgccccggcagguccccucccuucagcaccuguguagaaugucuauucgccgggugaugccuacacaggagguucaagagcucccgauccccagcaaacugcuugaguuccuguccuacagaaucuga

SEQ ID NO: 77928 - RNA, 1728 nt, Artificial Sequence
  derived and/or modified sequence opt5 from WSCD1__Homo_sapiens__NP_056068
auggccaagcccuucuuuagacugcagaaauuccuccggcgcacccaauuucugcuuuucuuucugacagcugccuaccucaugacgggcagccugcuucugcuccagagagugcgggucgcgcugccucaggggccgcgcgcucccggaccucugcagacccuccccguugccgccguggcucugggcguggggcuucuggacuccagagcccuccacgauccucgggucucucccgagcugcuucugggaguggacaugcuccaaagcccucugacacgcccgagacccggcccucgguggcugcgcuccagaaacucugaacuccggcagcugcgcagacggugguuccaucacuuuaugagcgauucccaggggcccccugcucuuggacccgaggccgcgcgcccggccauccauucuagaggcaccuauauuggcugcuucagcgacgaugggcacgaacggacacugaagggagcuguguuuuacgaccucagaaaaaugaccguuucccauugucaggaugccugcgcugagcgcagcuaugucuacgccggccuggaagcgggggccgaguguuauugcggaaaucggcuuccugcugugucuguuggccuggaggaauguaaccacgagugcaagggggaaaaaggauccguguguggcgccgucgacagacucagcguguaccgcguggaugagcugcaacccggcucucggaagagacgcacagcuaccuaucgggggugcuucagacugccugagaauaucacgcacgccuuucccuccagccucauucaggccaacgucaccguuggaacauguucuggcuucugcucccagaaggaauuuccccuggcuauccuucgcgggugggaguguuacugcgcguacccuaccccgcgguucaaucugagagacgccauggauagcuccgugugcggacaggaccccgaagcucaacgccucgccgaguauugugaaguguaccagacaccuguccaggauacccggugcacggacagacgguuccugcccaacaaaucuaagguguuuguugcccuuagcuccuucccuggcgcugggaauacaugggcccgccaucugauugagcacgcgaccggauuuuauacaggcagcuacuauuucgacggcacccucuacaacaaaggguuuaagggagagaaagaucauuggagaucucggagaaccaucugugugaagacacacgaauccggccgccgggagaucgaaauguucgacagcgcuauucugcugaucagaaaucccuaucgcucucucgucgccgaguuuaacagaaagugcgccgggcaccugggauacgcugccgaucggaauuggaaaagcaaggaauggccggacuucgugaacuccuacgcuucuugguggagcucccauguucuugauuggcugaaauauggcaagcgccuccuggugguccacuacgaggagcugagacggagccuugugccuacgcuccgcgaaauggucgccuuucugaaugugucuguuuccgaggaaagacugcucuguguggagaacaauaaagaagggagcuuccggcgcagaggccggcgcucucaugaccccgagccuuuuacccccgagaugaaggaucugauuaacggauauaucagaacagucgaccaagcgcuucgggaucacaacuggaccggccugccuagagaauacgugccccgcuga

SEQ ID NO: 77929 - RNA, 1698 nt, Artificial Sequence
  derived and/or modified sequence opt5 from WSCD2__Homo_sapiens__NP_001291376
auggccaagcugugguucaaauuucagagauacuuccggcgcaagcccgugagauuuuucaccuuucucgcucuguaucuuacagccggcagccuggucuuccuccacuccggguuuguuggacaaccugcggugucuggcaaccaggcuaauccggccgccgcugggggacccgccgagggcgcugaacugagcuuccuuggggacaugcaucugggacggggcuuucgcgauacgggcgaggccuccucuaucgcgagacgguacgggccuugguucaaaggaaaggacggcaacgaacgcgccaaacucggggauuauggaggcgcuuggagcagagcccugaaggggcgggugguccgcgagaaggaagaggagagagcuaaauacauuggaugcuaucuggacgauacccagucccgggcccuccgcggcgugagcuuuuucgacuacaagaaaaugacaaucuuuagaugucaggauaauugcgcggaacggggcuaucuguacgggggacuugaguucggcgccgaauguuacugcgggcacaagauucaagcuaccaacguuucugaggccgagugugacauggaaugcaaaggagagcgcggcuccgugugugggggagcuaauagacugagcgucuaucggcuccagcuggcccaggaaucugccagacgcuacggcuccgcuguguuccggggcugcuuuagacgccccgauaaccuuagccuggcgcucccuguuacagccgcuaugcugaauaugucuguggacaagugugucgauuucugcaccgagaaggaauauccccuggccgcccucgcugggacagccugucauugcggauuuccuaccacgcgguucccgcugcacgacagagaggaugagcagcuuugcgcgcaaaaauguuccgcugaagaguuugaaagcugcggcacccccucuuacuucaucguguaucagacacaggugcaggacaaccgcuguauggaccggagauuucugccugggaaguccaaacaacucauugcccuggccagcuuccccggagcuggcaauaccugggcccgccaucuuaucgagcuggcuacaggguuuuacaccggcuccuauuacuucgauggaucucucuacaacaagggcuuuaaaggggaacgggaccacuggagaagcggacgcacgaucugcauuaagacacacgaguccggccagaaagagaucgaagccuucgaugcggccauucugcugauccggaauccuuauaaggcucucauggccgaguuuaacagaaaguacgggggacauauuggcuucgcugcccacgcgcauuggaaagggaaggaauggcccgaguucguccggaauuaugccccguggugggcuacccacacacuggacuggcuuaaauuuggcaagaaaguucugguggugcacuucgaagaucucaagcaggaccuguuuguccaacuuggacgcauggugagccugcucggcguugccgugagagaggaucggcugcugugugucgagucucagaaggacgggaacuucaaaagauccggacuccgcaagcuggaauacgauccuuauaccgcugacaugcagaaaaccaucagcgccuacauuaagaugguggaugccgcucuuaaaggccggaaucugacagggguucccgacgacuauuacccuagauga

SEQ ID NO: 77930 - RNA, 1494 nt, Artificial Sequence
  derived and/or modified sequence opt5 from WT1__Homo_sapiens__NP_000369
augcaggaccccgccagcacaugcgugccugagccggcuucccaacacacccugagaucuggccccgggugucuccagcagccugaacagcaaggaguccgggaucccggcgggaucugggccaagcugggagcggcugaggccagcgccgaacgccuucagggcagacggucccgcggggcuucuggaagcgagccucagcagaugggcuccgacguuagagaucugaacgcccuccugcccgcugugccuucucuuggcgggggaggcgggugcgcccugccggugagcggagcggcccaaugggcucccguccucgacuucgccccucccggcgcuuccgccuacgggagccugggaggcccugcgcccccgccugcucccccucccccucccccgcccccuccccauucuuuuauuaagcaggaaccuuccuggggcggggccgagccccacgaggaacagugucugagcgccuucacggugcauuuuucuggacaguucaccggcacagcuggggccugccgguauggaccguuuggcccucccccucccucccaagccagcucugggcaggcucgcauguucccuaaugcgcccuaccucccguccugucuggagagccagccugccaucagaaaccaaggauauuccaccguuacauuugauggcacccccucuuacggccacacacccagccaucacgcugcccaguucccuaaucacuccuuuaagcaugaagacccgauggggcagcagggaagccuuggcgagcaacaguauucugugcccccucccgucuacgggugccacaccccuacggauuccuguaccggaagccaggcccugcuccugcggacacccuauucuagcgacaaccuuuaccagaugaccucccaacuggagugcaugacauggaaucagaugaaccucggcgcuacccugaaagggcauucuacgggcuacgaaagcgauaaucacacaaccccuauucuguguggagcccaguaucgcauccacacacauggcguguucagagggauucaggacguucggcgcgugcccggagucgcgccgacccucgugagauccgcuagcgagaccucugaaaagcggccuuuuaugugcgccuaccccggcuguaacaaacgcuauuucaagcugucccaccuucaaaugcauagcagaaagcacacaggggagaaaccuuaccagugcgauuuuaaggacugcgaacggagauucucucgcuccgaucagcugaaacggcaucagagacgccacacgggagugaagcccuuccaauguaaaaccugccagcggaaguuuagcagauccgaccaccucaagacacauacccgcacacacaccggcgagaaaccguucucuugucgguggccuagcugccagaagaaauuugccagauccgacgagcugguccgccaucacaauaugcaccaacggaacaugacgaaacuucagcuggcucucuga

SEQ ID NO: 77931 - RNA, 1191 nt, Artificial Sequence
  derived and/or modified sequence opt5 from WTAP__Homo_sapiens__NP_001257460
augaccaacgaggaaccccugccuaagaaagugagacucagcgagacagacuucaaggucauggcccgggaugaacugauccuucgcuggaaacaguacgaggcuuauguucaagcccuggaaggcaaguacacggaccucaauuccaacgaugugaccgggcugagagagucugaggaaaaacuuaagcagcagcagcaagagagcgcgcggcgcgaaaauauucuggugaugagacucgcuacaaaggagcaggagaugcaggaaugcaccacacagauccaauaucugaaacagguccagcagccguccguggcccaacugcggucuaccaugguugaccccgccauuaaccucuuuuuccugaagaugaaaggagagcuugaacagacaaaggauaaacuggagcaggcucaaaaugaacucagcgccuggaaguuuaccccugacucccagacgggcaagaaacugauggcuaagugucgcaugcuuauccaggagaaccaggagcuggggagacaacucucucagggacggauugcccagcuggaagcggagcuggcccuccagaaaaaguacagcgaagaacugaaauccagccaagaugaacuuaaugacuucaucauccagcuggaugaggagguggaaggcaugcagucuaccauucucguccugcagcaacagcuuaaggagacacgccagcagcuggcucaauaucagcagcaacagucccaggccagcgcucccucuaccuccagaacaaccgccagcgaaccuguggagcagucugaagcgacguccaaagacugcagccggcucacaaacgggcccuccaauggaucuagcucccgccaaagaaccagcggcucuggcuuucaccgggaggggaacacaaccgaggaugacuucccuuccagcccgggaaauggcaacaagucuagcaauuccucugaggagcgcaccgggagaggaggcagcggguacguuaaccagcuguccgccggauaugaaagcguggauucucccacaggcuccgagaauagccugacgcaucagucuaacgacaccgacuccagccacgauccucaggaggaaaaggcugucuccggcaaagggaaccggacagugggaucuagacaugugcaaaauggccucgacagcuccgucaacguucaggggucugugcuguga

SEQ ID NO: 77932 - RNA, 1293 nt, Artificial Sequence
  derived and/or modified sequence opt5 from WTIP__Homo_sapiens__NP_001073905
augcagagaagccgggccggcgcugacgaggccgcgcugcuccuggcugggcuugcccugcgcgaacucgagcccggaugcggcuccccugggagaggacggcgcggcccgagacccgggccuggagaugaagccgcucccgcccugggccggcgcggcaaggggucuggaggcccugaggcuggggccgacggacuuagcagaggcgaacgggggccccgcagagcggccgugccugagcuguccgcucaaccggccggaucuccccgggcuagccucgccggcuccgauggcgggggaggcgggggaucugcgcgcagcuccggcaucagccugggguacgaccagagacacggaucuccucgguccggccgcagcgaucccagaccuggccccgggccgccuucugucggauccgcccggagcucuguuuccagccugggcuccagagggucugcuggagccuaugcugacuuccuucccccuggcgccugucccgcccccgcucgcagcccugagccggcggggcccgccccuuuuccccugccugcucucccccugccgccuggccgggaaggaggccccuccgccgccgagagacgccucgaagcucugacccgggagcuugagagagcccuggaagcgcgcacagcucgggauuacuucgggauuugcaucaaauguggacucggcauuuauggggcccagcaggccugccaagcuaugggaagccuguaccauacggacuguuuuaccugcgauucuuguggcagacgccugcgggggaaggccuucuauaacgugggcgagaaaguguacugccaggaagacuuucucuauuccggauuccagcagacagcugauaaguguagcgucugcggccaccugaucauggagaugauucuucaagcccuggggaaaucuuaccauccuggauguuuuagaugcagcgugugcaaugaaugucucgacggcguucccuucaccguggaugucgagaacaauaucuacugcgugcgcgacuaucacacaguuuuugcgccuaagugugccuccugcgcucggcccauccugccggcccaggggugugagaccacaauuagaguggucucuauggaccgggauuaccauguggcuugcuaucacugugaagacugcggacuucagcugagcggcgaggaagggcgcagauguuacccucucgccggccaucugcugugccggagaugucaccuccgccggcugcagcccggaccccuuccuuccccgaccgugcacgucacggagcuguga

SEQ ID NO: 77933 - RNA, 3360 nt, Artificial Sequence
  derived and/or modified sequence opt5 from WWC1__Homo_sapiens__NP_001155133
augcccagaccugagcugccgcuccccgaaggcugggaggaagcccgggacuucgaugggaagguguacuauaucgaccacaccaaccgcacaacgagcuggauugauccuagagaccgguacaccaaaccccugacauuugcugauugcaucuccgacgagcuuccucugggaugggaagaggccuaugauccccaggucggcgacuacuucauugaucauaauaccaagacaacccaaaucgaggacccucgcguucaguggagacgggaacaggagcacaugcucaaagauuaucuggugguggcgcaggaagcucuuucugcccaaaaggagauuuaccaggucaaacagcagcgccuggagcucgcccaacaggaauaucagcagcugcaugcugugugggagcacaagcuggggagccaaguuucccucgugucuggaagcuccucuagcuccaaguacgacccggaaauccugaaagccgagaucgcuacagccaagagcagagucaacaaacuuaagcgggaaauggugcaucugcagcacgagcuccaguuuaaagagcgcggcuuccaaacccugaagaagauugauaaaaagaugucugacgcgcagggguccuacaaacuugacgaagcccaggcuguucugagagagacgaaggccaucaaaaaggcuauuaccuguggagaaaaagagaagcaggaucucaucaagagccuggccaugcugaaagacggcuuucggacagaucgcggcucucacuccgaccucuggucuagcuccagcucccuggaaucuagcuccuucccccuuccuaagcaauaucuggaugugagcucucagaccgacauuuccgggagcuuuggaaucaauucuaacaaucagcucgcggagaaagucagacugcggcuucgcuacgaggaagccaagagacggauugcuaaccugaaaauccagcucgccaagcuggauagcgaggcuuggcccggcgugcuggacuccgaaagagaucgccucauccugauuaaugagaaggaggaacuucugaaagagaugcgguucaucucuccuagaaaguggacacaaggggaaguggagcagcucgaaauggcccgcaaacggcuggagaaggaccuucaggccgcuagagauacccagagcaaagcgcugacggagcgccucaagcugaacuccaagcggaaucaacuggucagagaacucgaggaagccacacgccagguugcuacccugcauagccagcuuaaaucucuguccagcucuaugcagucccucagcuccggaucuagccccggcucccugacaucuagccgggggucccugguggccagcucucuugacuccagcaccucugccuccuuuaccgaccucuauuacgauccguucgagcaacuggacagcgaacugcagucuaagguggaguuucuccugcuugagggagcuacaggcuucagaccuagcggcugcauuacgaccauccacgaagaugaggucgccaaaacacagaaggcggaagggggaggccgccugcaagcucuccggucccugagcgggacccccaaaucuaugacaucccugagcccuagauccucucuuagcucccccucucccccuuguagcccgcucauggccgacccccugcuggccggagaugcuuuucucaacucccuggaguucgaagacccugagcuuucugccacccugugcgagcucagccugggcaauuccgcucaggaacgguaucgccuggaggaacccgggacggagggaaagcagcuuggccaggccgugaacacagcgcaaggcugugggcucaagguugccugcgugagcgcugccgucucugaugaauccguggcuggagacagcggcguuuacgaggccucugugcagagacugggggcguccgaggccgcugccuucgauagcgacgaaucugaggcugucggagccacccggauucagaucgcccugaaauaugaugaaaagaauaaacaguuugcuauccucauuauccaacuguccaaccuuagcgcgcugcuccagcagcaggaccaaaaggugaauauuagagucgccgugcugccuuguuccgagagcaccacaugccuguuccgcacccggccccuugaugcuucugacacacucguuuuuaacgagguguucugggucagcauguccuacccggcccugcaucagaaaacgcugagaguggacguuuguaccacagaucgcucucaccucgaagagugccugggcggggcccagaucagccuugcugaaguguguagauccggcgagcggucuacccgcugguacaaccugcucagcuauaaguaccugaaaaagcaauccagagaacugaagccugucggagugauggcccccgcgucuggcccugcuagcacagacgccguguccgcccuucuggagcagaccgcuguugagcucgaaaaacggcaggaggggcgcagcucuacgcagacccuggaagauuccuggagauaugaggaaacaagcgagaaugaggccgucgcggaagaggaagaggaagagguggaggaagaggaaggagaggaggacguguuuaccgaaaaggcuucucccgauauggacggcuacccugcccucaaagucgauaaggagacaaacaccgaaacgcccgccccguccccuacagugguucggcccaaagaccgcagaguggggacccccagccaaggaccuuuccugcggggcuccacaauuauccgcucuaagaccuuuagcccggggccccagucccaguaugucugcagacuuaaucggagcgauucugacuccagcacccugucuaagaaaccucccuucgugagaaacagccucgagcgccgguccguuagaaugaagcgcccuucucccccuccccagccgagcuccgugaaaucucugcggagcgaaagacugauccgcacaucccuugaucuggagcucgaccugcaagcuacgcggaccuggcacagccagcucacacaggagauuucuguccugaaggaacuuaaagagcagcuggaacaagccaagucccauggcgagaaggaacucccucaguggcugagagaggaugagcgcuuucggcugcuucugagaaugcucgaaaaacggcagauggaccgcgcugagcacaagggagaacugcagaccgacaaaaugaugagagccgcggccaaggaugugcaucggcuccgcggccaaagcugcaaagagcccccugaaguucaguccuucagagagaagauggccuuuuucacacggcccagaaugaauaucccggcucugucugcugacgauguguga

SEQ ID NO: 77934 - RNA, 3579 nt, Artificial Sequence
  derived and/or modified sequence opt5 from WWC2__Homo_sapiens__NP_079225
augcccagacgggccggcagcgggcagcugccucucccgcgcggaugggaggaagcuagagacuacgauggcaagguguucuauaucgaccacaacacccggcgcacauccuggauugaucccagagaccggcugacgaaaccucuuucuuuugccgauugcgucggggacgagcugcccuggggaugggaagcgggcuucgauccucaaaucgggguuuacuauauugaccauaucaauaagaccacacagauugaggauccccgcaaacaguggagaggagaacaggagaagaugcucaaagacuaccugagcguggcucaagaugcccuucggacccagaaggagcuguaucacgugaaggaacagcgccucgcccuggcucuggacgaguacgucagacucaacgaugccuauaaagaaaaguccucuagccauacaucccuguuuucuggcagcuccagcucuaccaaauacgacccugacauccuuaaggcugagaucuccacaacccggcugcgcgugaaaaagcucaagagagagcugagccagaugaaacaagaacuucuguacaaggagcagggcuucgaaacgcuccagcagauugauaaaaagaugucugggggacaauccggcuaugagcugagcgaagccaaagcgauccugaccgagcucaagucuauucggaaagccaucuccagcggggagaaggaaaagcaggaccugaugcagucccuugcuaaacugcaagagcgcuuucaccucgaucagaauauuggaagaucugaaccggaccugcgguguagccccguuaacucccaucuuugccugagcagacagacacucgaugccggcucucagaccuccaucagcggggacauuggagugcgcucucggagcaaucuggcugagaaggucagacugucccuccaauacgaagaggccaaacgcucuauggcgaaccugaagaucgagcuuagcaaacuggauuccgaagccuggccuggcgcucucgacaucgagaaggaaaagcugaugcuuauuaaugagaaagaagaacugcucaaggagcugcaguucgugacaccccagaaacggacccaggaugaacuggagagacucgaagccgagcgccaacggcuggaggaggagcuucugagcguuagaggcacgccuucucgcgcucucgccgaacggcugagacuggaggaacgccggaaggagcuucuccagaaacuggaggaaacaaccaagcugacaaccuaucuccacucccagcuuaagagccugucugccuccacccugagcauguccucugggagcucccucggaucucuggcuagcuccagaggcagccugaacacaucuucccgggggagccuuaauucucucuccagcacggagcuguacuauucuagccaguccgaccaaaucgauguggacuaccaguauaaacuggacuuucuccugcaggaaaagagcggauacauucccucuggcccgaucaccacaauucacgagaacgaagucgugaaauccccuagccagcccgggcaauccggacuuuguggcguggcggccgcugccaccggccauacaccuccccuggccgaggcucccaagucugucgccagccucuccucucgcagcucccugucuagccuguccccuccggggagcccccuuguucucgagggaaccuucccuaugucuuccagccacgaugcgucucugcaucaguuuacggcugacuucgaagauugcgagcuguccagccacuuugccgacaucucucucaucgaaaaucagauucugcuugauuccgacagcggcggggccucccaaagccugucugaggauaaagaccucaacgaaugugcuagagagccccuguacgagggaacagccgauguggaaaagagccugccuaagcggagagugauccaccuucucggcgagaaaacaaccugcgucuccgcugccgugucugacgaaagcguugcgggggauuccggcguguaugaggccuucgucaagcagcccucugagauggaagacgugaccuacagcgaggaagauguugcuauuguggagaccgcccagguccagaucggacugcgcuauaaugcuaaauccucuagcuuuauggugauuaucgcccaacugcggaaccuccaugcguuccugaucccgcacacauccaaggucuacuucagaguggccguucuuccuagcucuacggacguguccugucuguuucgcaccaaaguccaucccccuacagaaagcauucucuucaaugacguguuuagaguugcuaucucucagaccgcccugcagcagaagacacugcggguggaucuuugcuccgucagcaaacaccgcagagaggagugucuggcuggcacccaaauuucccucgccgaccugcccuucucuagcgaaguguuuacgcucugguauaaccugcuuccuuccaagcagaugcccugcaagaaaaacgaggaaaaugaggauagcguguuccagccgaaccagccucugguugacucuaucgaucucgacgccgucuccgcucugcuggcgcggaccagcgccgaacuucuggcuguggagcaagagcucgcccaggaagaggaagaggaaucugggcaggaggagccccgcggacccgauggcgacuggcugacaaugcucagagaagccagcgaugagauuguggcugaaaaggaggccgaggucaaacugccugaagacuccucuuguaccgaggaucuuagcuccugcacaucugugccggaaaugaaugaggacgggaaccggaaggaaagcaauugcgcgaaagaucugcgcucccaacccccuaccagaauccccacgcucguugacaaggagacaaacaccgacgaggcugccaaugauaacauggccgugcggccuaaggaacgcagcucucuguccagcagacagcaucccuuuguccgguccucugugauuguuagaagccagacauucuccccuggagagcgcaaucaguacaucugucggcugaacagaucugacagcgauuccagcacccuugcuaaaaagucucuguuugugcgcaauuccaccgaacggagaagccuccgcgucaaacggacagugugccaaucuguucugagacgcacgacccaggagugucccgugcggacaucccucgaccuggaacuugaucugcaggccagccugaccagacagucucggcucaacgacgagcugcaagcgcuucgcgaucugagacagaagcucgaggaacugaaagcucagggcgagacagaccucccgccugggguccuggaagaugagcgguuccagcgccuucugaagcaagccgaaaagcaggccgagcagagcaaagaggaacagaagcaaggccugaaugcugagaaacucaugagacagguguccaaggacgugugccggcugagagaacagucucaaaaagucccccgccagguucagagcuuucgggagaagaucgccuauuucaccagagcuaagauuuccaucccuagccuucccgccgaugacguguga

SEQ ID NO: 77935 - RNA, 906 nt, Artificial Sequence
  derived and/or modified sequence opt5 from WWOX__Homo_sapiens__NP_001278926
auggagauccugcagggcagagacuucaccgggaagguggucguugugacaggagccaacagcggcauuggguuugaaacggcuaaauccuucgcccuccacggagcgcaugugauccuggcuugccggaauauggcccgcgccucugaggcugucagccggauucuugaagaguggcacaaggccaaaguggaagcuaugacccuggaucucgcccugcuuagauccguucaacauuuugcggaggccuucaaggcuaaaaacgugccccugcacguccucguguguaaugccgcuacauuugcccugccuuggucucugaccaaggacggccucgagacaaccuuccagguuaaccaucuggggcacuuuuaccuugugcagcugcuccaggauguccugugccgcagcgcgccggccagagugaucguggucuccucugaaagccaccgguucacagacauuaaugauucccuuggaaagcuggacuuuagccgccucucucccaccaaaaacgauuauugggcuaugcuggccuacaauagauccaagcuguguaacauccucuucagcaaugagcugcaucggcgccuuucuccuagaggcguuacguccaacgcugugcaccccggcaauaugauguauagcaacauccaucggucuugguggguguacacccugcucuuuacacuggcccgcccuuucaccaaauccaugcaacagggggccgcuacaaccgucuauugcgcggccgugcccgaacuugagggacugggcgggauguacuuuaauaacuguugcagauguaugccuagcccggaggcucaguccgaagagacggcccggacacucugggcccugucugaacgccugauucaggagagacucggaagccaauccggcuga

SEQ ID NO: 77936 - RNA, 2769 nt, Artificial Sequence
  derived and/or modified sequence opt5 from WWP1__Homo_sapiens__XP_005250817
auggccaccgcuagccccagauccgacacaucuaacaaucacagcggccggcugcagcuccaagugacggucuccucugccaagcugaaacgcaagaaaaacugguucgggaccgcgaucuacacagagguugugguggauggagaaauuaccaagacagcuaaaagcuccucuagcuccaauccuaagugggacgagcagcuuaccgucaacgugacaccgcagaccacgcuggaauuucagguuuggagccauagaacccucaaggccgaugcccugcuuggcaaagcuacaaucgaccugaagcaagcccuccugauucacaaucggaaacuggagcgcgugaaggaacagcucaaacugucucuugagaacaagaaugggaucgcucagaccggagagcugacagucgugcucgauggccugguuauugaacaggagaacaucaccaauugcuccagcucucccacgaucgaaauucaagagaacggggacgcccuucaugagaauggagaaccuuccgcgagaacaaccgcccggcuggcuguggagggcacaaacggcaucgauaaucacguccccaccagcacccucgugcagaacucuuguugcuccuauguggucaauggggacaacacaccuagcucccccucucagguugccgcucgcccuaagaacacgccggcccccaaaccucuggcgagcgaacccgccgaugacaccgugaauggagaguccagcucuuucgcuccuacagauaacgccuccgugaccggcacacccgucgugagcgaagagaaugcucugucuccgaacuguaccagcacgacaguugaggacccucccgugcaggaaauucucaccuccucugagaauaacgaaugcaucccuagcaccuccgccgagcuggaaagcgaggccagaucuauucuugagcccgauacauccaauagccggucuuccagcgcuuuugaagcggccaagucccgccaacccgacggguguauggacccugucagacagcagucuggaaacgcuaauaccgagacacugccgagcggcugggaacaacggaaagauccccaugggcgcacguacuauguggaccacaacaccagaacaaccacaugggagcggccucagccccucccucccggaugggaacgcagaguugaugaccggagacgcguguacuaugucgaucacaauacccggacgaccacauggcagagaccgaccauggaguccgugcgcaacuucgagcaguggcaaucucagcggaaucagcugcagggcgccaugcaacaguuuaaccagagauaccuuuauagcgccuccaugcuggcugccgaaaaugacccuuacggcccccucccucccgggugggagaagcgcgucgauagcacagaccggguguacuucguuaaccauaacaccaaaacgacacagugggaagauccuagaacccaaggacugcagaaugaggagccccugccggaaggcugggagauccgcuauacacgggaaggggugagauacuuugucgaccacaacacccgcaccacaacguucaaggauccucggaauggaaaaucuuccgugaccaagggcgggccccagauugcguaugagagaggauuucgguggaagcucgcucauuuccgcuaccugugccagagcaacgcccuucccucucacguuaaaaucaauguguccagacaaacacuguuugaagacagcuuccagcagaucauggcccucaagccuuaugaccugcggagacgccuuuacgucauuuuucggggcgaggagggccuggauuaugggggacucgcuagagaaugguucuuccugcugucucacgaggugcucaacccgauguacugucuguuugaauacgccggcaaaaauaacuauugccuucaaaucaaucccgcuagcaccauuaacccugaccaucuguccuacuucuguuuuaucgggcgcuucauugccauggcgcucuuucacggaaaguucaucgauacaggcuuuagccugcccuucuauaaaagaaugcugucuaagaaacuuaccaucaaggaccucgaguccauugauacggaauuuuacaauagccugaucuggauucgggacaacaauaucgaggagugcgggcuggaaauguauuucuccguggauauggagauucucggcaagguuacaucucaugaccugaaacuuggaggcagcaacauccuggucaccgaagagaauaaggaugaauacaucgggcucaugaccgaguggcgcuuuuccagaggagugcaggagcagacaaaagccuuccuggacggcuuuaacgaaguggucccucugcaguggcuucaauauuucgaugagaaggaacucgaggugaugcugugugggaugcaggagguugaccuggcugauuggcagcggaacaccguguaccgccacuacacaagaaauucuaagcagauuaucugguucuggcaauuugucaaagaaacggacaacgaggugcggaugcgccuccugcaguucguuaccggaacaugcagacuuccccugggcggguuugccgaacucaugggcagcaauggaccucagaaguucugcauugagaaagugggcaaggacaccuggcugccccggucccauacauguuuuaaccgccuggaucuuccgccuuauaaaucuuacgaacagcucaaggagaagcugcuguucgcuaucgaggaaaccgagggguuuggacaagaauga

SEQ ID NO: 77937 - RNA, 1008 nt, Artificial Sequence
  derived and/or modified sequence opt5 from WWP2__Homo_sapiens__NP_001257384
auggccagcgcuuccucuagcagagccggcguggcgcugcccuucgagaagucccagcucacccugaaagucguuucugcuaagccuaaagugcacaaccggcaaccgcgcaucaauagcuacguggaagucgccguggacgggcuucccuccgagacaaagaaaacgggaaagagaauuggcucuagcgaacugcucuggaacgagaucauuauccugaauguuaccgcccagucccaucuugaucugaagguguggagcugccacacacuccggaacgaacugcuggggaccgcuucugucaaucucuccaacgugcugaaaaauaacggaggcaagauggagaauaugcagcuuacacugaaccuccagaccgagaauaaagggagcguugugucuggaggcgaacugacaauuuuucuugacggcccuaccgucgaucuggggaacgugcccaauggauccgcccucacggacggcagccaacugccuucucgcgauuccagcgggaccgcuguggcccccgagaacagacaucagccuccguccacaaauuguuucggaggccggucucgcacccacagacauagcggggcguccgcccggacaacccccgcuacgggagaacagagcccuggcgcccgcucuagacaccggcagcccgucaagaacuccggccacagcgggcuggcuaacggaacaguuaaugacgagccuaccacagccaccgaucccgaggaaccgucuguggugggcgucaccagcccucccgcggccccucucuccgugacacccaaccccaauacgaccucucugccugcuccggccacacccgcugagggggaggaaccuagcaccuccggaacacaacagcuucccgccgccgcucaggcgccugacgcccugcccgcuggcugggaacagcgcgagcucccgaacgggagaguuuauuacguggaucauaauaccaaaacgacaaccugggagcggccucugcccccuggauga

SEQ ID NO: 77938 - RNA, 1203 nt, Artificial Sequence
  derived and/or modified sequence opt5 from WWTR1__Homo_sapiens__NP_001161750
augaaccccgccagcgcuccuccgccccugccucccccuggccagcaagugauccacgucacccaggaccucgauacagaccuggaggcccuuuucaauuccguuaugaaccccaagccuucuagcuggagaaagaagauucugccggaauccuuuuucaaagagcccgauucugggagccauucccggcagucuagcacggacuccagcggaggccacccugggccccgccucgcgggaggcgcucagcaugugagaucucacuccagcccugccucucugcaacuugggaccggagccggcgcugccggcucccccgcucagcagcaugcccaucugcggcagcaaagcuacgaugugacagacgaacucccgcugccucccgggugggagaugaccuuuacagcgaccggacagcgcuauuuccugaaucacaucgaaaagauuacaaccuggcaggauccuagaaaagccaugaaccagccccucaaucacaugaaccugcaccccgcugucucuuccacgccugugccgcaacggagcauggccguuucccagcccaaucuugugaugaaccaucagcaccaacagcagauggcuccuucuacccugagccagcaaaaucaccccacacagaacccucccgccggccucauguccaugccgaaugcgcugaccacacagcagcaacagcagcagaaacuucgccugcaaagaauccagauggagcgggagcgcauuagaaugcggcaggaggaacucaugcgccaggaagccgcucugugcagacaacugccuauggaggccgagacccucgcucccguccaggccgccgugaacccucccacgaugacaccugacaugcggagcaucaccaauaacucuuccgaucccuuucugaaugggggaccguaccauagccgcgaacagucuacagacagcggccuugggcugggauguuauuccguuccuaccacccccgaggauuuccucucuaacguggacgaaauggauacaggcgagaacgcuggccaaacgcccaugaauaucaacccucagcagaccagauuuccggacuuccuggacugccuucccgggacaaaugucgaucugggaacccucgaaagcgaggaccugauuccucuguuuaacgauguggaguccgcgcucaauaagagcgaacccuuccugacauggcuuuga

SEQ ID NO: 77939 - RNA, 2568 nt, Artificial Sequence
  derived and/or modified sequence opt5 from XAB2__Homo_sapiens__NP_064581
augguggucauggccagacugagccggcccgagcgcccugaccucguuuucgaagaggaagaucugccguacgaggaagagaucaugagaaaccaguuuuccgugaagugcuggcuucgguauauugaguucaaacaaggcgcucccaagccucgccugaaucagcucuacgaaagagcccugaaacuucugcccuguucuuauaagcucugguaccgguaucugaaagcgcgcagagcucaggugaagcaccggugcgucaccgacccugccuacgaggaugugaacaauugucaugaacgcgccuuuguuuucaugcacaagaugcccagacuguggcucgacuauugccaguuucugauggaucaagggcgggugacacauacgcgcagaaccuucgaccgggcccuucgcgcucugccuaucacacagcacagcagaauuuggccgcucuaccugcgguuucuuagaucccauccccugccugagaccgcuguccgcggauaccggagauuccucaaacugucucccgagagcgccgaagaguauaucgaauaccugaaguccucugaucgccucgacgaggcggcccagcggcuggcuacagugguuaacgaugaaagauuugugagcaaagccggcaaguccaauuaucagcuuuggcacgagcugugugaccucauuagccaaaacccugauaaaguccagucucugaauguggacgcuaucauccgcgggggacuuacccgguucacagaucagcugggcaagcucuggugcucccuggccgacuacuauauuagaagcgggcacuuugagaaggcgcgcgacguguacgaagaggccauccggaccgucaugacgguuagagauuucacccagguguuugacucuuaugcucaauucgaagaguccaugauugccgcuaaaauggaaacagccagcgagcugggacgcgaggaagaggaugacguggaucucgaacugcggcuugccagauucgagcagcugaucucucggcgcccccuccugcuuaacuccguccugcucagacagaauccgcaucacgugcaugaauggcacaagcggguugcucugcaccaaggcagaccucgcgagauuaucaacaccuacacagaggcggugcagaccgucgaccccuuuaaagccacgggcaagccucauacacuguggguggcuuucgccaaauuuuacgaagauaaugggcagcucgacgaugcccggguuauucuggagaaggcuaccaaagugaacuucaagcaggucgacgaucuugccagcguguggugucaaugcggagaacuggagcucagacacgagaauuaugacgaagcgcugcgccugcuuagaaaggcuacagcccuccccgcccggcgcgcugaguacuuugacggcuccgaacccguccagaacagaguguauaaaucucugaagguuuggagcaugcuggccgaucucgaggaaucccuggggaccuuccagagcaccaaagcuguguacgaccggauccuugaucugcgcaucgccacaccucagauugucaucaauuaugcgauguuucucgaggagcauaaguacuucgaagagucuuuuaaagccuaugaaagaggaauuucccuguucaaguggccgaacgugagcgacaucuggucuacguaccugaccaaguuuauugcucgguacggcgggcgcaaacuugagagagcccgggaucucuucgaacaagcucuggacggaugucccccuaaguaugccaaaacacuguaccuccuguaugcgcagcuugaggaggaauggggccuggcccgccacgcuauggccguuuacgagagagcuacccgggccguggaacccgcccagcaguaugauauguuuaacaucuacaucaagagagcugcggagauuuauggcgucacacauacccgcgggaucuaccaaaaagccauugaagugcucagcgacgagcacgcucgggagaugugccugagauucgccgauauggaauguaagcugggagagaucgaccgcgcccgggcuauuuacuccuucugcucucagaucugcgauccuagaacgacaggcgccuuuuggcagaccuggaaggacuucgaagugcgccacgggaaugaggauaccaucaaagagaugcuucggauuagacgcagcguucaggcgacauauaacacccaagucaauuuuauggcuucccagaugcucaaggugagcggaucugccacaggcacgguguccgaccuggcccccgggcagagcggaauggacgauaugaaacugcucgaacaacgggcugagcagcuggccgcggaagcugagagagaccagccgcuucgggcccagucuaagauccuguucguccgcuccgaugccagcagagaggaacucgcugagcuggcccaacaggugaacccugaagagauucagcugggcgaagacgaggaugaagacgagauggaucuugagcccaaugaaguucggcucgagcagcaauccgugccugcugccgucuuuggcucucugaaagaagacuga

SEQ ID NO: 77940 - RNA, 906 nt, Artificial Sequence
  derived and/or modified sequence opt5 from XAF1__Homo_sapiens__NP_059993
auggagggcgacuucagcgugugcagaaacuguaagcggcacgucguuuccgccaauuuuacccugcaugaggcuuacugccuccgcuuccuggugcuuugucccgagugcgaagaaccugugccgaaggaaacaauggaggagcacuguaagcuggaacaucagcaagucgggugcacgaugugucagcagucuaugcagaaaagcucccucgaguuucacaaggccaacgaaugccaagagagacccguggaguguaaauucugcaagcuggauaugcagcuuucuaagcuggaacuccaugagagcuauuguggaucccggaccgaacugugccagggcugcgggcaguuuaucaugcaccgcaugcuggcgcaacacagagacguuugucggucugagcaggcucagcucggaaaaggcgaacgcauuagcgccccugagagagagaucuacugccauuauuguaaucagaugauucccgaaaacaaguacuuccaccauauggggaaaugcuguccugauuccgaguuuaagaaacacuuccccgugggaaauccugaaauccugccgagcucucuucccucccaagccgcugagaaccagacaagcaccauggaaaaggacguccggccuaagacacgcucuauuaauagauuuccccugcacuccgagucuagcuccaaaaaggccccucggagcaaaaacaagacccucgauccccugcuuauguccgagccgaaaccucgcacaucuagccccagaggcgacaaggcugccuaugauauccugcggcgcugcucccaguguggcauccuccugccucugcccauucucaaucaacaucaggaaaaaugcagauggcuggcgagcucuaaggggaaacaggugcggaacuucuccuga

SEQ ID NO: 77941 - RNA, 210 nt, Artificial Sequence
  derived and/or modified sequence opt5 from XAGE1B__Homo_sapiens__NP_001091065
auggagagccccaagaaaaagaaccagcaacugaaagugggcauccuccaccugggguccagacagaagaaaauucggauccagcuucgcucucagguccugggaagagaaaugcgggacauggagggcgaucuccaagaacugcaucagagcaauaccggggacaaguccggauucggcuuucgcagacagggggaggauaacacauga

SEQ ID NO: 77942 - RNA, 246 nt, Artificial Sequence
  derived and/or modified sequence opt5 from XAGE1E__Homo_sapiens__NP_001091073
auggagagccccaagaaaaagaaccagcaacugaaagugggcauccuccaccugggguccagacagaagaaaauucggauccagcuucgcucucagugcgccaccuggaaggucauuuguaagagcugcaucucccaaacaccuggaauuaaucuggaccucggcucugggguuaaagugaagaucaucccgaaagaggaacauuguaagaugcccgaagcuggagaggaacagccucagguguga

SEQ ID NO: 77943 - RNA, 1131 nt, Artificial Sequence
  derived and/or modified sequence opt5 from XBP1__Homo_sapiens__NP_001073007
augguggucguugccgcugcccccaacccugcggacggcaccccgaaggugcugcuccugagcgggcagcccgcuuccgccgccggagcuccugccggccaagcccuuccccugauggugccugcccagagaggggcgucucccgaggccgcuagcggaggccucccucaggcccggaaacgccagagacugacacaccuuuccccggaagagaaggcucugcggcgcaaacucaagaauagagucgccgcgcaaacggcccgggaucgcaaaaaggcuagaaugucugaacuggagcaacaggugguugaccuggaagaggagaaccagaagcuccugcuugaaaaucagcugcuccgggagaaaacccaugggcugguggucgaaaaccaggagcuucgccagagacugggaauggaugcccucguggcugaggaagaggccgaagccaagggcaaugagguucggcccguggcuggcagcgcggaauccgccgcuggggccggaccugucgugacacccccugagcaucugcccauggacucuggcgggaucgauagcuccgacagcgagucugauauucugcucggaauccuggacaaccuugauccggugauguucuuuaaaugcccuucccccgaaccugccagccuggaggaacuccccgaggucuaccccgaaggcccuucuucccugccggcuagccuuucucuguccguugggaccagcuccgccaagcucgaggcgauuaaugagcugauccgcuucgaccacauuuauacaaaaccccuggugcucgaaaucccuucugagaccgaaagccaggcuaacguggucgugaagaucgaggaagcuccccuguccccuagcgagaaugaucaccccgaguuuauuguuucugugaaggaggaaccggucgaagacgaucuugugccugagcugggaaucuccaaccuccugagcucuagccauugucccaaaccuuccucuugccuucuggacgccuacagcgacuguggcuauggcgggucccucagccccuucucugauauguccagccugcugggaguuaaucacucuugggaggacacauuugcuaacgaacucuucccucaacugauuuccguguga

SEQ ID NO: 77944 - RNA, 345 nt, Artificial Sequence
  derived and/or modified sequence opt5 from XCL1__Homo_sapiens__XP_011508167
augagacugcucauccuggcccuucugggcauuugcagccucaccgcuuacaucguggagggggucggauccgaaguuucugacaagcggacaugugugagccugacgacccagcgccuucccguguccagaauuaaaacauauaccaucacagagggcucucugcgggccgucauuuucaucaccaagcgcgggcucaaagugugcgcggauccucaagcuacauggguuagagacgugguccggagcauggaucgcaaguccaacaccagaaauaacaugauccagacgaaaccgaccggaacacagcagucuaccaauacagccgugacccugacgggcuga

SEQ ID NO: 77945 - RNA, 345 nt, Artificial Sequence
  derived and/or modified sequence opt5 from XCL2__Homo_sapiens__NP_003166
augagacugcucauccuggcccuucugggcauuugcagccucaccgcuuacaucguggagggggucggauccgaaguuucucaccggcgcacaugugugagccugacgacccagagacuucccgugucccggauuaagacauauaccaucacagagggcucucugcgcgccgucauuuucaucaccaaaagagggcucaaggugugcgcggacccucaagcuacauggguucgggaugugguccgcagcauggacagaaaauccaacacccggaauaacaugauccagacgaagccgaccggaacacagcagucuaccaauacagccgugacccugacgggcuga

SEQ ID NO: 77946 - RNA, 1002 nt, Artificial Sequence
  derived and/or modified sequence opt5 from XCR1__Homo_sapiens__NP_001019815
auggagagcuccggcaaccccgaaucuaccacauucuuuuacuaugaccugcagagccaaccuugcgagaaucaggccuggguguucgcuacgcucgccaccacaguccuguacugucuuguuuuucugcucucccugguggggaacucucuugugcuguggguccucgugaaguaugaaagccuggagucccugaccaauaucuucauucucaaccugugccuuucugaucugguuuuugcgugucuccugccgguguggaucagccccuaccacuggggauggguccuuggcgacuuccugugcaaacuccugaauaugaucuuuuccauuagccuguauucuuccauuuucuuucucacaaucaugaccauccauagauaccugagcgugguuucuccucuuuccacacugcgggugcccacccuccgcuguagaguccuggugacgauggcugugugggucgccagcauucuuucuuccauccuggauaccauuuuccacaagguucucagcuccgggugcgacuauucugaacugacaugguaccugaccagcguguaccagcauaaccucuuuuuccugcuuucccugggaaucauucucuuuuguuauguggagauccugcggacacuuuuccgcagcagaucuaaacggcgccacagaaccgucaagcugauuuucgccaucgugguugcuuacuuucucuccuggggcccuuauaauuucacgcuguuucugcagacacucuuccggacccaaaucauucgcagcugcgaggccaaacagcagcuggaauacgcccuucugaucuguagaaaccucgcuuuuucucauugcuguuucaaucccgugcuguaugucuuuguggggguuaaguuccggacacaccugaagcacgugcuucgccaguuuugguucugcagacuccaagcgccuagcccggccuccauuccccauucuccuggagcuuuugccuacgagggcgcuagcuucuauuga

SEQ ID NO: 77947 - RNA, 4002 nt, Artificial Sequence
  derived and/or modified sequence opt5 from XDH__Homo_sapiens__NP_000370
augaccgccgacaagcugguguucuuugucaacggcagaaaaguuguggagaagaaugcugaucccgaaacaacgcuccuggccuaccuucggcgcaaacuggggcucagcggaaccaagcugggcugcggggagggaggcuguggggcgugcacagugaugcuuuccaaauaugacagacugcagaacaagaucguccacuucucugcuaaugccugucucgccccuauuugcagccugcaucacguggcuguuaccacaguggaaggaaucggcuccaccaagacacggcugcauccgguccaagagcgcauugccaaaucucacggcagccaguguggguuuugcacccccggaaucgugauguccauguacacgcuccugagaaaccagccugaacccaccauggaggagauugaaaaugcuuuccagggcaaccuuugucggugcacaggguaucgcccuauccugcaaggauuuagaaccuucgcccgggauggcggguguugcggaggcgacggcaauaaccccaauuguugcaugaaccagaagaaagaucauucuguuagccucuccccuagccuguuuaagccggaggaguucacaccccuugacccuacccaggagcccaucuuuccucccgagcugcuccgccugaaagauacgccgagaaagcagcugcgguucgaaggggagcgcgugacauggauucaagcgucuacccucaaggaacugcuugaccugaaagcccagcacccugaugcuaagcucgucgugggaaauacagagaucggcauugaaaugaaauuuaagaacaugcuguuccccaugaucgugugcccugccuggauucccgagcuuaauuccgucgagcacgggcccgacggaaucagcuuuggcgcugccuguccucugucuauuguugaaaagacccucguggaugcgguggccaagcugccggcucagaaaaccgaggucuucagaggggugcuggaacagcuccggugguucgccggaaagcaaguuaaguccguggcuagcgucggcggcaacaucaucacagccucucccauuuccgaccugaauccuguguuuauggccagcggggcuaaacuuacgcugguuucccgcggaaccagacggacagugcagauggaucauaccuucuuucccggcuacagaaagacacuccugucuccugaggaaauccuucugagcauugagauccccuauucccgcgagggggaauacuucagcgcguuuaaacaggccucucggagagaggacgacauugcuaaggucaccuccggaaugcgcgugcuuuucaaaccgggcacgacagaaguccaagagcuggcccugugcuaugggggcauggccaaccggaccaucagcgcucucaagaccacacagagacagcugucuaaacuuuggaaagaagaacugcuccaggaugugugugccggacuggcggaggaacugcaccuuccucccgacgcuccuggcgggaugguugauuuucgcugcacccucacacugagcuucuuuuucaaguuuuaccugacggugcuccaaaaacugggacaggagaaccuugaagacaaguguggcaaacuggaucccaccuucgccuccgccacacuccuguuucagaaggacccucccgcugauguccagcuguuccaagaggugccgaaggggcagucugaggaagacaugguuggacggccucuuccccaucucgccgcugauaugcaggccagcggcgaggcgguguacugcgacgauauccccagauaugaaaaugagcugucccugcgccucgucaccagcacacgggcccacgcuaaaauuaagucuaucgacaccuccgaagccaaaaaggugccuggguucguguguuuuauuagcgcugacgauguuccgggcucuaacaucacgggaauuugcaaugacgagaccgucuucgccaaagauaaggugacaugugugggccacaucaucggggcggucguggccgacacccccgagcauacacagagagcugcccaaggaguuaagauuaccuacgaggaacugccugcuaucauuacgaucgaagaugccauuaaaaacaauuccuuuuauggccccgagcuuaagaucgaaaaaggggaccugaagaaaggauucagcgaggccgauaacguggucuccggcgagauuuacaucgggggccaggaacacuuuuaucucgagacacauugcaccaucgcugugccuaagggagaagcgggcgagauggaacuguucguuucuacacagaauaccaugaaaacccagagcuuuguggccaagaugcuggggguccccgcuaaccgcauugugguucgggugaagagaaugggaggcggguucggaggcaaagagacacgguccacggucgugucuaccgccguggcccuugcugccuacaagacagggcgcccugucagauguaugcucgaccgggaugaggacaugcugaucaccggcggaagacaccccuuucuggcgcgcuauaaaguuggcuucaugaagacagggaccgugguggcucucgaagucgaucauuuuagcaaugugggaaacacgcaagaccugucccagagcauuauggagcgggcccuuuuccacauggauaauugcuacaaaaucccgaacauuagaggcacagggcgccugugcaagaccaaucucccuucuaacaccgccuuuagaggauucggcggcccccaggggaugcugaucgcugaauguuggauguccgagguugccgugacaugcggaaugccugcggaggaaguccggcgcaagaaucuguacaaagagggcgaccuuacccacuucaaccaaaagcucgaaggguuuacacugcccagauguugggaggaaugccuggcuagcucucaguaucaugcccggaaauccgagguggacaaguucaacaaagagaauuguuggaagaagcgcggacucugcaucauuccgacgaaauuuggcaucagcuucaccguuccuuuucugaaccaggccggggcucuccugcacguguacacagauggaucuguccuccugacccauggcggcacagaaauggggcagggacugcacaccaagauggugcaaguugccagcagagcucuuaaaauucccacguccaagaucuauauuagcgagaccucuacaaauaccgugccuaacacaucccccaccgccgcgagcgucuccgccgaccugaauggccaggcuguguacgccgcuugucagacaauccucaaacggcuggaacccuauaagaagaaaaacccuucugggagcugggaggauugggugaccgccgccuacauggacacggucucccucucugcuacaggauucuaucgcaccccgaaucugggcuacagcuuugaaaccaacuccgggaaucccuuccacuacuuuucuuauggaguugcgugcagcgagguggagaucgauugucuuacaggcgaccauaagaaccugagaaccgauauugugauggacgucggcuccagccucaauccugccaucgauauuggacagguggaaggggcuuucguucaaggccuggggcuguuuacgcuugaggaacugcacuacucucccgagggaucccuccauacacggggcccuagcaccuauaaaauccccgccuucgggucuauuccuaucgaguuccgcgugucccugcucagagacugcccgaacaagaaagccaucuacgcuagcaaggccgucggagaacccccucuguuucuugcggcuucuauuuucuuugccaucaaagaugccauucgggcugccagagcgcagcacacaggcaauaacgugaaggagcuguuccgccucgacucccccgcuaccccugaaaagauccggaaugccuguguugauaaauuuacaacccugugcgugacgggcguccccgagaacugcaagccguggagcgugagagucuga

SEQ ID NO: 77948 - RNA, 588 nt, Artificial Sequence
  derived and/or modified sequence opt5 from XG__Homo_sapiens__NP_001135391
auggagagcugguggggccugcccugccucgccuuccuguguuuucuuaugcacgcuagagggcagcgggacuucgaucuggccgacgcgcucgaugacccugaaccgaccaagaaacccaacuccgauaucuacccuaagcccaaaccucccuauuacccucaaccggagaaucccgacucuggaggcaacauuuauccucgccccaagccuagaccccagccgcagccugggaauagcggaaacuccggcggguacuuuaaugauguggaccgggaugacggacgcuaucccccuagaccccggccccgcccuccggcuggcggcgggggaggcggguacucuagcuauggaaacuccgauaauacacauggcagagggggauaccggcugaacucucgcuacggcaauacguauggcggggaccaccauagcaccuacggaaaccccgaaggcaauauggucgccaaaaucguuuccccuauugugagcguggucgugguuacacuucugggggccgcugccucuuauuucaagcucaacaauagacggaacugcuuucgcacccacgagcccgaaaauguguga

SEQ ID NO: 77949 - RNA, 1494 nt, Artificial Sequence
  derived and/or modified sequence opt5 from XIAP__Homo_sapiens__XP_011529631
augaccuucaacagcuuugagggcuccaagacaugcgugcccgccgacaucaauaaagaagaggaguucgucgaagaauuuaacagacugaagacguucgcuaauuuuccuucugggagcccgguuuccgccucuacccucgcgcgggcuggauuccuguacacaggcgagggggauaccgugcgcuguuuuagcugccacgccgccguggacagauggcaguauggagauuccgcugucggccggcaucgcaaagugucucccaacuguagauucauuaauggguuuuaccuugagaacagcgccacacaauccaccaauagcggaauccagaacggccaguauaagguugaaaauuaccugggcucucgggaccacuucgcucucgaucgcccuuccgagacacaugccgacuaucugcuuagaaccggacagguggucgauauuagcgacacgaucuacccccggaacccugcgauguauucugaagaggcccgccugaaauccuuucaaaauuggcccgauuacgcucaccucaccccuagagagcuggccagcgcugggcuguacuauacaggcauuggggaccaggugcagugcuucuguugcggaggcaagcucaagaacugggaaccgugugaucgggccuggucugagcaucgcagacacuuucccaauugcuucuucguucuggggcggaaccuuaauauccgcuccgaaagcgacgcgguguccucugauagaaacuuuccuaacagcaccaaucugccccggaacccuuccauggccgacuacgaggcuagaaucuucacauuuggaaccuggauuuauagcgucaauaaagaacagcucgcccgcgcuggcuucuacgcccugggcgagggggacaaggugaaauguuuucacugcggaggcgggcuuacggauuggaagcccucugaggacccgugggaacaacaugccaaaugguauccuggauguaaguaccugcucgagcagaagggccaggaauauaucaacaauauucaccugacacauucccuggaggaaugccucgugcggaccacagagaaaacccccagccugaccagacgcaucgaugacacaauuuuccagaacccuaugguccaagaggcuauccggaugggguuuucuuucaaggauauuaaaaagaucauggaagagaaaauccagauuagcggauccaauuacaagucucuugaaguucugguggcggaccucgugaacgcccagaaagauagcaugcaagacgaguccagccagacgucucugcagaaggaaaucuccaccgaggagcagcuuagacgccugcaagaagagaagcucugcaaaauuuguauggaucggaauaucgcuauugucuuugugcccugcggccaccugguuacauguaagcagugcgccgaagccguggacaaaugucccaugugcuacaccgucaucacauucaagcagaaaaucuuuaugagcuga

SEQ ID NO: 77950 - RNA, 3366 nt, Artificial Sequence
  derived and/or modified sequence opt5 from XIRP1__Homo_sapiens__NP_001185550
auggccgacacccagacacaaguggcucccacgccuaccaugagaauggccacagcggaggaucugccgcugcccccucccccugcucuggaagaccuuccccugccuccgcccaaggagagcuucuccaaauuucaccagcagcggcaggccucugaacuccgcagacuguaccggcauauccacccugagcuucgcaagaaccuggccgaagcugucgccgaggaucucgcugagguucugggcagcgaagaacccaccgaaggggacgugcaaugcaugagauggauuuucgagaauuggcggcuggaugccaucggagagcaugaacgcccugcggccaaagagcccgugcucuguggcgacguccaggcuacauccagaaaguuugaagaggggucuuucgccaacagcaccgaucaggaaccgacacggccucagcccggaggcggggacgugcgcgcugccagauggcuguuugagaccaaaccucuugaugagcugacgggacaagcgaaggaacucgaggccaccguucgggaacccgcugccuccggcgacgugcagggcacacgcaugcuguucgagaccagaccccuugaucggcuggggucucgcccuagccuccaggaacaguccccgcuggagcugagaagcgagauucaagaacucaagggagacgucaaaaagacagugaaacuguuucagaccgagccccuuugcgcuauccaggaugccgaaggcgccauucacgagguuaaggcugcgugucgggaagagauccaaucuaaugccgugagauccgcucgcuggcuguucgagacgcggccucucgacgccaucaaccaggaccccagccaggucagagugauucgcgggaucucucuggaagagggagcccggccugauguguccgcuacaagauggauuuuugaaacccagccccuugacgccauccgcgagauucuggucgaugagaaagacuuccaaccgagcccugaucucauucccccuggccccgacguucagcagcagcaacaucuguuugaaacacgggcgcuggauacccucaagggggacgaggaagcuggagccgaggccccucccaaggaagagguggugccgggcgaugucagaucuacccuguggcuuuucgagacaaaaccucuggacgcuuuucgcgauaaggugcagguuggccaccuccagcggguggacccccaggacggggaaggacaccuguccagcgauuccucuagcgcccuucccuucucccaaagcgcuccucagagagacgagcugaaaggcgaugucaagacguucaaaaaucucuuugaaacccugccgcuggacucuauugggcagggagaggugcucgcccauggcucccccagccgcgaagaggggacagauucugcgggacaggcccaaggcaucggcagcccuguuuaugcuaugcaggacuccaaggggcggcugcacgcccuuaccucugugagcagagagcagaucgucggaggcgaugugcaaggguaccgguggauguucgaaacacagccccuggaccagcucggacgcuccccuagcaccauugaugucgugagaggcaucacgcggcaggagguuguggcuggggacgucggcacagccagauggcuguuugaaacccaaccccuggagaugauucaucagcgcgaacagcaggagcggcaaaaagaggaaggaaagucucagggcgauccucagcccgaggcgccgccuaagggggacgugcagaccaucagauggcuuuucgaaacaugccccauguccgagcucgccgagaaacaaggaagcgaaguuaccgauccuacagcuaaggccgaggcucagucuuguacguggauguuuaaaccccagccgguggaccgcccugucggcuccagagaacaacaccuccaggugagccaggugcccgccggggagcggcagaccgaccgccacguuuucgaaacagagccucugcaagccuccggaagacccugcggccggcgccccgucagauauuguucucggguggagauuccuagcggccaggugucccgccagaaggaagucuuucaggcucucgaggcggggaaaaaggaagaacaagaaccgagagugaucgccggaucuauccccgcuggcagcguucauaaguucaccuggcuguuugagaacugcccuauggggucccuugccgccgagagcauucagggaggcaaucugcucgaggagcagcccaugucuccuuccgggaaccggaugcaggaaagccaagagacagcugccgaaggaacccugcgcacgcugcacgcgacccccggcauccuucaucacgggggcauucucauggaggcuagaggaccuggcgagcugugucuggccaaauacgugcucucugggacaggacagggccauccguauauccggaaggaggagcuggucuccggggaacuucccagaauuaucugccaggugcugcgccggccugauguugaccagcaaggacuccuggugcaggaggaucccaccggccagcugcaacuuaaaccucucagacugcccacaccggggagcucuggcaauaucgaggacauggauccugaacugcagcagcuccuggccuguggacuuggcaccagcgucgcucgcacggggcuggugaugcaggagacagaacaaggacucguugcccugaccgcguacucccugcagccccggcuuacaagcaaggcuucugagagauccagcgugcagcuccuggccuccugcauugacaaaggcgaucugucugggcuccacagccugcgcugggaacccccugccgaccccuccccugucccggcuucugagggagcccagagccuucaccccaccgaguccaucauucaugugccuccccuggauccuucuaugggcaugggccaccuccgggcuagcggggccacccccugcccgccucaagcgaucggaaaggccgugccccuggcuggcgaagccgcugccccugcccagcugcagaacacagagaagcaggaagacucccauagcgggcaaaaaggaauggcuguccuuggcaagucugagggggcgacgaccacacccccuggacccggcgccccggaucugcucgcugccaugcagucccugagaauggccaccgcugaagcccagagccuccaccaacagguucugaauaaacacaagcagggcccuacacccaccgcgacgucuaaccccauucaggacgggcuucgcaaagcuggagccacacaauccaauauccggccuggcgggggaagcgauccgagaauccccgccgcuccucggaagcugcucuga

SEQ ID NO: 77951 - RNA, 2817 nt, Artificial Sequence
  derived and/or modified sequence opt5 from XIRP2__Homo_sapiens__NP_001073278
auguuccccaugcagaagggcagccugaaccuccugagacaaaaaugggaguccugcgacuaccagcggucugaaugucacccucgcgauagccauugcaccaucuuucagccgcaggaguccaagcugcuggcccccgaaggggagguggucucugcuccucaaagccucgaccccacaucccugccuuauucuacgggagaagagauguggagcuccaaacccgaggaaaaggauagcguugacaaaucuaauaacaccagagaguacggccggccugaagugcuuaaggaggauucccugagcucucgcagacggauugagcgcuucuccaucgcccucgacgaacugagaagcguguuugaggcgccgaagucugggaauaaacccgcugaauauggaggcaaggaggucgaaauugagcggucccuguguagcccugccuucaaaucccaccccgggucucagcucgaggauagcgugaaggacuccgauaaaaagggaaaggaaaccagcuuugacaaaaugucuccugaguccggccauagccgcaucuucgaagccacagcuggccccaacaagccggagucuggguuugccgaagauagcgcugccagaggagagggcguuuccgaccugcacgagguggucucucuuaaagaacggauggcgcgcuaccaggccgcugugagcagaggggauugccgguccuucagcgccaauaugauggaggaaucugagaugugugcuguuccuggaggccuggccaaggugaaaaagcaguuugaagacgagauuacauccagccgcaacaccuucgcgcaauaucaguaccagcaucagaauagaucugagcaagaagccauccacuccagccaggucgggacaucccggucuagccaggagauggcuagaaacgaacaagagggauccaaagugcagaagaucgacgugcacggcaccgagauggucucucaucucgaaaagcacacggaggaaguuaaucaggccagccaguuucaucaauaugugcaggagaccgugauugauacacccgaagacgaggagaucccuaaagucuccaccaagcugcuuaaagaacaguucgaaaagagcgcucaggaaaagauucuguacucugauaaggagaugacaacccccgccaagcaaaucaaaaagcuccugcugcaggacaaagaaauuugcauccucugucagaagacgguguaccccauggagugccugguugccgauaaacagaacuuucacaaguccuguuuccgcugccaccauuguaauagcaaacuuucucugggcaacuaugcuucccuccacgggcaaauuuacugcaaaccucauuucaagcagcuguuuaaaagcaagggaaauuaugacgagggcuucgggcacaaacagcauaaggaucgguggaacugcaagaaucagucuagaagcguggacuuuaucccgaacgaggagcccaacauguguaaaaauaucgcggaaaacacacuugucccuggagaucgcaaugagcaccuggacgccggcaacuccgaagggcaacggaaugaucucagaaagcugggagagcgcggcaaacugaaggugauuuggcccccuagcaaagagauccccaagaaaacccucccguucgaagaggaacugaagaugucuaagccuaaauggcccccugagaugacaacccuucugucccccgaguuuaagagcgaaucccuccuggaggacguucggaccccugaaaacaaaggccagagacaggaccacuuccccuuucuucaaccguaccugcagucuacacaugugugccagaaggaggaugucauugggaucaaagaaaugaagaugccugagggacgcaaggacgagaaaaaggaaggccggaaaaaugugcaggauagacccagcgaggcugaagacacgaaguccaaccgcaaaucugccauggaucucaaugacaacaauaacgucauugugcaaagcgccgagaaggaaaagaaugagaaaaccaaccagacaaauggggcugagguucuucaggugaccaacacagaugacgaaaugaugcccgagaaccacaaggaaaaucugaacaaaaauaacaauaacaauuaugucgccguguccuaccucaacaauugucggcagaagaccucuauccuggaguuccuugaucugcucccucugagcuccgaagcgaacgacacggcuaaugaguaugagaucgaaaaacuggagaacacaagcagaauuucugaacuucucggaaucuuugaguccgagaagaccuacagccggaauguucuggccauggcccugaagaaacaaaccgaucgcgcugccgcuggcucuccggugcagcccgccccuaagcccucccucagcagagggcugauggucaaaggcggaucuuccauuaucagcccugacacaaaccuucugaauauuaagggcucccauagcaaaucuaagaaccuccacuucuuuuucagcaacaccgugaaaaucacagcguuuuccaagaagaaugaaaacaucuucaauugcgaucugauugacucuguggaccagaucaaaaacaugcccugucuggaucuucgggaguucgggaaggacguuaaaccuuggcacgucgaaacgaccgaggccgcuagaaauaacgaaaauacaggauuugaugcccucagccaugagugcaccgcuaagccccuguucccgcgcguggaggugcaguccgaacaacugacagucgaggaacagauuaaacggaacagauguuacucugacaccgaguga

SEQ ID NO: 77952 - RNA, 1335 nt, Artificial Sequence
  derived and/or modified sequence opt5 from XK__Homo_sapiens__NP_066569
augaaguuccccgccagcgugcuggcuuccgucuuucucuucguugccgagaccacagcggcucugucucuuagcuccacguacagaucuggcggggaccggauguggcaggcccugacccuccuguuuagccuucugccuugcgcccucgugcaacugacacuucucuucgugcaccgcgaucuguccagagaccggccgcuuguccugcuccugcaucuucugcagcucggaccccuguuucgcuguuucgaaguguuuugcaucuauuuccagucuggcaacaaugaggaaccuuacguuagcauuaccaaaaagagacagaugcccaaaaacgggcuguccgaggaaaucgagaaggaggugggacaagcugaaggcaaacucauuacacaccggagcgccuuuucucgcgcuuccgucauccaggccuuccuggggagcgcgccucagcuuacccugcagcucuauauuucugugaugcaacaggauguuacagugggaagaucccugcuuaugaccaucagccugcucucuaucgucuacggcgcccugcgguguaauauucuggcuaucaagauuaaguaugacgaguacgaagugaaagugaagccccucgccuaugucugcaucuuucuguggcgcuccuucgagauugcuacgagaguuguggugcuuguccuguuuaccagcgugcucaaaacauggguuguggucaucauucugaucaacuucuucuccuuuuuccuuuacccuuggauccuguuuugguguucuggcagcccguuccccgagaauauugaaaaggcccucucccggguggggaccacaaucguucugugcuuucugacccuccuguacacgggaauuaacauguucuguuggagcgcggugcagcuuaaaaucgauucuccugaccugauuuccaagagccauaauugguaucagcuccuggucuacuauaugauccgcuuuaucgagaacgccauucugcuucuccugugguaccuguucaagacagauaucuauauguacgugugcgcuccccuccugguccuucaacugcucauuggcuauuguaccgccauccuguuuaugcugguguucuaccaguuuuuccacccuugcaaaaagcuguuuucuagcuccguuucugaaggguuccagagauggcuccgguguuucugcugggcuugccgccaacagaaacccugugagccgauuggaaaggaagaccugcagagcuccagagaucgggacgagacaccuucuagcuccaaaaccagccccgagccuggccaguuucugaaugccgaagaucucugcucugccuga

SEQ ID NO: 77953 - RNA, 1953 nt, Artificial Sequence
  derived and/or modified sequence opt5 from XKR4__Homo_sapiens__NP_443130
auggccgcuaagagcgacggcagacugaaaaugaagaaauccucugauguggccuucacaccccuccagaacagcgaccacuccgggucuguccaaggacuggcgccuggccuuccgagcggguccggagcugaggaugaagaggccgccggcgggggaugcugucccgacggcggcgggugcucucgguguugcuguugcugugcuggaagcggcggguccgccggaagcggcgggucuggaggcguugcuggcccugggggaggcggggccggauccgcggcccugugccuccgccugggcagagaacagcggcgcuacagccuuugggauugucuguggauccucgcugccguggcuguguauuuugccgacgucgggaccgauguguggcuggcgguugacuacuaucugagaggacagcgguggugguucggccucacgcuguuuuucgugguccuuggcucucuguccgugcagguuuuuagcuuccgcugguuugugcaugauuucucuaccgaggacuccgccacagcugccgcugccagcuccugcccccaaccuggggccgauuguaagaccgucgugggaggcgggucugcugcgggagaaggcgaggccagacccagcacaccucagcggcaggcuuccaaugccagcaaaucuaacauugccgcugccaauuccgggagcaacucuagcggcgcgacccgcgcuuccggaaagcacagaucugccagcugcuccuuuugcaucuggcuccugcagagccuuauucauauccugcaacucggccagauuuggcgguacuuccacacaaucuaucuggggauccgcucuagacaguccggagagaaugaccgguggcgcuuuuacuggaagaugguguaugaauacgccgaugucagcaugcugcaucuccuggcuaccuuccuugagucugccccgcagcugguucuccaacuguguauuaucgugcagacgcacucccuucaggcucugcaaggcuuuaccgccgcggccagccucgugucccuggcuugggcccuggcuucuuaccagaaagcccucagagacagccgggacgauaagaaacccauuuccuauauggcggucaucauucaguucugcuggcacuucuuuacaaucgccgcuagagugauuaccuucgcccuguuugcuucuguuuuccagcuuuacuuugggaucuucaucgugcugcauugguguauuaugacauuuuggaucguccacugcgaaaccgaguucuguauuacgaagugggaggaaaucguguuugacaugguugugggaauuaucuauaucuucagcugguuuaacgucaaagagggccgcacacggugcagacucuucauuuacuauuuugugauccugcuugaaaauaccgcccuguccgcccucugguaccuguauaaggcuccucaaauugcggaugccuucgcuauccccgcccugugugucguguucagcucuuuucucacagggguuguguucaugcugauguacuacgccuuuuuccauccuaacggcccccgcuuuggacaguccccgagcugcgcuugugaggacccugccgcggcuuucacccuucccccugaugucgccaccucuacacugcgguccauuagcaauaacagaucugugguuagcgaccgcgaucagaaguuugccgaacgggacggcugcgugcccgucuuccaggugagacccacggcuccuuccaccccgagcucucggcccccucgcaucgaggaguccgugaucaaaauugaucucuuuagaaaucgcuaucccgccugggaacggcacguucuggacagaagccugcggaaggcgauccuugcuuucgaguguuccccuucucccccgcgccuccaauacaaagaugacgcccugauucaggaaagacuggaguaugaaacaacccucuga

SEQ ID NO: 77954 - RNA, 1926 nt, Artificial Sequence
  derived and/or modified sequence opt5 from XKR6__Homo_sapiens__NP_775954
auggccgcuaagagcgacggcgggggagugggcgucggguucgcccagcugcacaaccucgaugaggcgguuggauccggcggggaagaggacggagaacccggcggcgggggaugcggcgggggaggcgaugggucugagccuggagaaagcuccucuaugcauaucugucacugcuguaauaccagcuccugcuacuggggcuguagaucugcuugccugcggagccuucugggccgcaaaccgagacgguccgccgccgcugacgggggagaucaaccccuccagccucccgccgcuccuggcgccgggcgccagcccccuacaccgagcgcggccagacccgagccucccccuccccagguggagcggccguggcuggacugucuuuggauugugcuggcucuccuggucuuuuucggagaugugggcacggaccuguggcucgcccuggauuauuaccgcaagggggacuauguuuacuuuggacuuacccuguucuuugugcucgucccuucucugcuugugcaaucccugagcuucagaugguuuguucaggauuauacaggcggcgggcucggagcuguggaaggccugaccucucgggggcccccuaugaugggagccggcuacguccauggggcggcccgcggcggacccggcgugagagugucccccacaccuggggcucagcggcugugccgccucagcgucuggaucuggcagucuguuauucaucugcuucaaaugggacagguguggagauauauccggaccauguaccugggcauucagucccagcgcagaaaagagcaccaacggagauucuacugggccaugauguaugaauacgcugacgugaacaugcuccgccugcuugagacauuucuggagagcgccccgcagcucguccugcagcuguauaucaugcuccaaaagaacuccgccgaaacccugcccugugugucuagcguuacgucccuuaugagccuggcuugggugcucgcgucuuaccacaaacugcuucgggauuccagagacgacaaaaagagcaugucuuaucgcggggccaucauucaggucuucuggcggcuguuuaccaucagcuccagagugauuucuuucgcucucuuugccagcaucuuccagcuguacuucggaauuuuuguugugguccacuggugcgccauggcuuucuggaucauucauggcgggacagauuuuuguauguccaagugggaggaaauccuguucaauaugguggucggcaucguguauaucuuuugcugguucaauguuaaggagggacgcacccgguacagaauguuugccuacuauacaauugugcucaccgaaaacgcggcucugacguuccuuugguacuuuuaucgcgacccugagacaaccgauagcuacgccguccccgcccugugcuguguguucauuucuuuuguugcuggcaucgccaugaugcuccuguauuacggggugcugcacccuacaggaccccgggcuaaaauucuugccuccagcugcugugcggagcuccuguggggcaucccgcugccucccgacgucgaaccuauggcccccgagaucccuggguauagaggaacccaggugacccccacacgcgcugugacggaacaacaggaggaucucaccgccgacacaugccugccgguuuuccagguccggccuaugggcccucccacaccccuugggagaccguaccugcccgaaggcccucucauuaagaucgauaugccccggaaacgcuacccugcuugggacgcccauuuuguggauagacggcugagacgcaccauuaauauccugcaguaugugacccccacggcggucggcauucgguacagagacggaccucuucucuaugagcugcugcaauacgagucuucccucuga

SEQ ID NO: 77955 - RNA, 1122 nt, Artificial Sequence
  derived and/or modified sequence opt5 from XKR9__Homo_sapiens__NP_001274188
augaaguacaccaaacagaacuucaugaugagcgugcugggcaucauuaucuaugucacagaccucauuguugauaucuggguguccgugagauuuuuccacgaggggcaauacgucuuuucugcccuggcucuuagcuucaugcuguuuggaacgcucguggcccagugcuucuccuauucuugguuuaaggcggaccugaaaaaggcuggccaggaaagccagcauuguuuccuucugcuccacugccugcaagggggaguuuuuacccgguacugguucgcccugaaacgcggcuaucaugccgcuuuuaaguacgauuccaauacaucuaacuucguggaggaacagauugaccuccacaaggaggucaucgauagagugaccgaccugagcaugcuucggcuguuugaaacauaucucgagggguguccccagcugauccuucagcuguacauucuccuggagcauggacaagccaauuucucccaguacgcugccaucaugguuagcugcugugcgauuucuugguccaccguggauuaucaggucgcccugcgcaaaagccucccugacaagaaacugcuuaacggccugugcccgaagaucacauaccucuucuauaaacuguuuacccuucugucuuggaugcucuccguggugcugcuccuguuccugaaugucaagauugcucuuuuucugcuccuguuccuuuggcugcucggcaucauuugggccuuuaagaacaauacgcaguucuguaccugcaucagcauggaauuucuguacagaaucguugugggguucauucugaucuuuacauucuuuaacauuaaaggacaaaauaccaagugucccaugucuugcuauuacaucgugcggguccucggcacacuggggauucuuaccguguucuggguuuguccucugacgaucuuuaaccccgauuauuucaucccuauuuccaucacaauugugcucacccugcugcuuggaauccucuuccugauugucuacuacggcagcuuucaccccaaucgcuccgcugagacaaaaugcgacgaaaucgaugggaagccugugcugagagagugccggaugcgcuauuuccucauggaguga

SEQ ID NO: 77956 - RNA, 822 nt, Artificial Sequence
  derived and/or modified sequence opt5 from XPA__Homo_sapiens__NP_000371
auggccgcugccgacggcgcgcugcccgaggcugccgcccucgaacagccugcugagcugccggccagcgugagagcuuccaucgaacggaagcgccaaagagcccuuaugcugcggcaggcgcgccucgccgcuagacccuacucugccaccgcugccgcggccacagggggaauggcuaacgucaaagccgcuccuaagauuaucgauacgggcgggggauucauucuggaggaagaggaggaagaggaacagaaaaucggcaagguugugcaccagcccgggccugugauggaguuugacuaugucauuugcgaggaauguggaaaagaguucauggauagcuaccuuaugaaucauuuugaccugccuaccugcgauaacugucgggacgccgaugacaagcacaagcucaucacaaaaaccgaagccaagcaagaguaucugcugaaagauugcgaccucgaaaagcgcgagcccccgcugaaauucaucgugaagaagaauccccaucacucccaguggggcgauaugaaacuuuaccugaagcuccagauuguuaaaagaucucuggagguguggggcagccaggaagcucuugaggaagcgaaggagguccggcaagaaaaccgcgagaaaaugaagcagaaaaaguuugacaagaaagugaaggagcugagacgggccguucgcuccucuguguggaaaagagaaacaaucguccaucagcacgaguaugggccugaagagaaucucgaagaugacauguaccggaagaccuguacaaugugcggacacgagcugaccuaugagaaaauguga

SEQ ID NO: 77957 - RNA, 2823 nt, Artificial Sequence
  derived and/or modified sequence opt5 from XPC__Homo_sapiens__NP_004619
auggccagaaagcgggcugccggcggggagccccgcggaagagaacugcggagccagaaauccaaggcgaaaucuaaggcucgcagagaggaagaggaagaggacgccuucgaggaugaaaaaccuccgaaaaagagccuccuguccaaagugucucaaggcaagcggaaacgcgggugcagccaccccggaggcuccgccgacgggccugcuaagaaaaaggucgccaagguuaccgugaaaucugagaaccuuaaggugaucaaagaugaagcucugagcgacggagaugaccucagagauuuucccuccgaccugaagaaagcccaucaccuuaagcggggcgcgacaaugaaugaggauagcaacgaggaagaggaagagucugaaaaugacugggaggaggucgaagaacuguccgaaccugugcucggcgauguucgcgagagcacggccuucucuagaucccugcugcccgugaaaccugucgaaauugagaucgagaccccggaacaggcuaagacacgggagcgcagcgaaaagauuaaacucgaguuugaaaccuaccugagacgggccaugaagcgcuucaacaaaggggugcaugaggacacacacaagguucaucuucugugucuccuggcuaauggauuuuauagaaacaauaucugcucucagcccgaucuucacgccauuggccuguccaucaucccugcgcgguucaccagagugcucccccgcgacgucgacacauacuaucugagcaaccuggugaaaugguuuauugggaccuucacggugaaugccgagcucuccgcuucugaacaggauaaccugcaaaccacacuugagcggagauuugccaucuacagcgcucgcgacgaugaggagcugguccacauuuuccuccugauccuucgggcccugcagcuccugaccagacugguucucucccugcagccuauuccccuuaagagcgccacagcuaagggaaagaagccgucuaaagagcgccugaccgcggacccuggcggguccagcgaaacgucuagccaggugcucgagaaucauacaaagcccaaaaccuccaagggaacaaagcaagaagagaccuuugccaaaggcaccugucggccuucugcuaagggcaaaagaaacaaagggggacgcaaaaagcggagcaagcccuccagcucugaagaggaugagggccccggggacaaacaggaaaaggccacacagagacgcccucacggacgggagagacggguggccucccgcgucagcuauaaagaagagucuggcuccgaugaagcugggagcggauccgacuucgagcugucuagcggcgaggccuccgauccgucugacgaagauagcgagcccggcccucccaagcagagaaaagcgccugcuccccaacggacgaaggccggguccaaaagcgccucuagaacccaucgcggaucccaccggaaggacccgagccuuccugcugccucuuccagcucuagcuccagcaagagaggcaaaaagaugugcucugacggggaaaaagcugagaagcgcuccaucgccggaauugaucaguggcuggaaguguuuugugagcaggaggaaaaauggguuugcguggacuguguccacggcgugguugggcaaccccucacaugcuacaaguaugcgaccaagccuaugacauacguggucggcaucgauagcgacggaugggugagagaugucacccagcgguacgaccccguguggaugacgguuacacgcaaauguagaguggaugccgaguggugggcugaaacccugcggccuuaucagucccccuucauggaccgcgagaagaaagaggaucuggaguuccaggccaagcauauggaccaaccgcucccuaccgcuaucggccuguacaaaaaucacccccuuuaugcccugaagagacaucuccugaaguacgaagcgauuuaucccgaaacagccgcuauccugggguacugccggggagaggccgucuauucucgcgauugugugcacacccuucauagcagagacacauggcucaaaaaggcucggguugugcgccugggcgaagucccuuacaaaauggugaagggguuuuccaacagagcccggaaagccagacuggcugagccgcagcuccgcgaggaaaaugaucugggacuuuucggcuacuggcagacggaggaauaucagcccccuguggcgguugacgggaaggucccccggaacgaguuuggcaacguguaccuguuccucccuucuaugaugcccauuggaugcgugcaacugaaucugccuaaccuucacagagucgcccgcaagcucgacaucgauugcgugcaggcuauuaccggcuuugacuuccacgggggauauagccaucccguuacagauggcuacaucgugugugaagaguuuaaagacguccugcugaccgccugggagaaugaacaggccgugaucgagcggaaggaaaaagagaagaaagaaaagagagcucucgggaacuggaaacugcuugccaagggacugcucauucgcgagcggcugaagagacgcuauggcccgaaauccgaggcggcugccccucacacagaugccgggggcggacugucuagcgacgaagaggaaggcaccuccagccaggcugaggccgcgcggauccuugcugccucuuggccccaaaauagagaggaugaagagaagcagaaacucaaagggggaccuaagaagacgaagcgggaaaagaaggccgcugccucccaucuguuccccuuugagcagcuguga

SEQ ID NO: 77958 - RNA, 1929 nt, Artificial Sequence
  derived and/or modified sequence opt5 from XPNPEP1__Homo_sapiens__NP_001161076
auggccgcuagcagaaagcccccucgggugcgcgucaaccaccaggacuuccaacugagaaaucuccggaucauugagccgaacgaaguuacccauuccggcgauacagggguggagacggacggacgcaugcccccuaaagugaccucugaacugcuuagacagcugcggcaggccaugcgcaauagcgaguacgucacagaacccauccaggcguauauuaucccuuccggcgaugcucaccaaucugaguacauugcccccugcgacuguagacgggccuuugugagcggguucgauggauccgcuggcaccgccaucaucacagaggaacaugcugccauguggaccgacgggcgcuauuuucuccaggcggccaagcagauggauucuaacuggacacugaugaaaaugggacuuaaggacaccccuacgcaggaggauuggcugguuagcgugcucccggaaggcuccagagucggcguggacccccugauuaucccuaccgauuacuggaaaaagauggcuaagguucugcggagcgccgggcaccaucucauucccgugaaagagaaucuggucgacaagaucuggacagaucgcccugagagacccugcaaaccgcuucugacccucggacuggacuauacaggcauuucuuggaaggacaaaguggcugaucuucggcugaagauggccgaacgcaacgugaugugguucgucguuaccgcgcucgacgagaucgccuggcuguuuaaucugagaggguccgauguggaacacaacccuguguucuuuagcuacgcuauuaucggacucgagacgaucaugcuguucauugacggcgaucggaucgacgcccccucugucaaggaacaccuucugcucgaucuggggcuugaggcugaguaucgcauucaagugcauccuuacaaauccauccugagcgaacucaaggcccugugugccgaccugucucccagagagaaaguuuggguguccgauaaggcuagcuacgcggucuccgaaacaauucccaaagaccaccggugcuguaugccuuauaccccgaucugcaucgccaaggcugugaaaaauucugccgagagcgaaggaaugagacgcgcccauauuaaggaugcuguugcccucugugagcuguuuaacuggcuugagaaggaagugcccaaaggcggcgucacagagaucuccgcggcugacaaggccgaagaguuccggagacagcaggccgacuuuguggaucugagcuucccuaccauuucuuccaccgggcccaauggagcuaucauucacuacgccgacggcacaacggaugucacccgcacaaugcacuuugggaccccuacagcuuaugaaaaagagugcuucaccuacgugcucaagggacauaucgccguuagcgcggccguguuccccacgggcacaaaagggcaucugcuugacucuuuugcucggagcgcccugugggauuccggacucgacuaucugcacggcaccggccacggggucggaucuuuccugaacgugcaugagggcccgugugggaucagcuacaagaccuuuuccgaugaaccucucgaggcuggaaugauuguuacagacgaacccggcuauuacgaggauggggccuucggcaucagaauugagaaugugguccugguggugccuguuaagaccaaauacaacuuuaauaaccgcggaagccuuacauucgaaccccugacgcucgucccuauccagaccaagaugauugacguggauucucugacagacaaagagugcgauuggcugaacaauuaucaccuuaccugucgggacgugaucggcaaggaacuccaaaaacaggggagacaggaggcgcuggaauggcugauucgcgagacacaacccaucuccaagcagcacuga

SEQ ID NO: 77959 - RNA, 2025 nt, Artificial Sequence
  derived and/or modified sequence opt5 from XPNPEP2__Homo_sapiens__NP_003390
auggccagagcucacuggggcugcugucccuggcuggugcuccugugcgccugugcgugggggcauaccaagccugucgaccuuggaggccaggauguucggaacugcagcacaaauccgcccuaccugccugugacgguggucaacaccacaaugucccucaccgcucugcgccaacagaugcagacacagaaucuuucugccuauaucauucccgggaccgacgcccacaugaacgaguacaucggacaacaugaugaaagacgggcuuggauuacaggcuucaccgggagcgccggaacggcugugguuaccaugaaaaaggccgcgguguggacagacucccgcuauuggacccaggccgagagacagauggauuguaauugggaacugcacaaagaggucggcacaaccccuaucgugacguggcuccugacagaaauucccgcuggcgggcggguuggauuugacccuuuccugcucucuaucgauaccugggagagcuacgaccuggcccuucagggcuccaaccgccaacuggugucuaucacaaccaaucucgucgaucuggugugggggagcgagagaccgcccgugccuaaccagcccauuuaugcucugcaggaagccuuuaccggauccacauggcaggagaaggucagcggcguucggucucaaaugcagaaacaucagaaggugccuacggcggugcuucucuccgcccuggaagagaccgcuuggcuguucaaucuccgcgccagcgacauccccuacaacccguuuuucuauucuuacacacugcuuaccgauuccagcauuagacuguuugcuaauaagucucgguucuccagcgagacacucuccuaccugaacucuagcugcaccgggccuauguguguccaaaucgaagacuauucccaggugcgcgauagcauucaggccuacucucuuggagacguuagaaucuggauuggcacguccuauacaauguacggcaucuaugagaugauccccaaagaaaagcuggugaccgacaccuacagcccugucaugaugacaaaagccgugaaaaauucuaaggagcaggcucuccugaaggcgagccacguucgggaugccguggcugucauucgcuaucugguguggcucgaaaagaacguccccaaagggaccguggacgaguuuuccggagccgagaucguugauaaguucagaggcgaagaacaauuuucuagcgggcccuccuucgaaacaauuagcgccucuggacugaaugcugcccuugcgcacuacuccccuacgaaagagcugaaccggaagcucagcucugacgaaauguaccugcuugauuccggcgggcaguauugggacggaaccacagauaucaccagaacagugcauuggggcaccccgagcgcuuuucagaaagaggccuacacgcgcguccugauuggcaacaucgaccucucccggcugaucuuccccgccgcuaccucugggagaaugguggaggccuucgcucgccgggcccugugggaugcgggacucaauuauggccacgggacaggacauggcauugggaacuuucugugcguucacgaauggccugugggcuuccagagcaauaacaucgccauggcuaagggaauguuuaccuccauugagcccggcuacuauaaagacggggaguucggaaucagacuugaggaugucgcccuggugguggaagcuaagacaaaguacccuggcucuuaucucaccuuugagguugucagcuucgugcccuacgaccgcaaucugauugacgugucccugcuuagcccggagcaccuccaauaccugaaccgguauuaccagacgaucagagaaaaagucgggccugagcugcagcgccggcagcuccuggaagaguuugaguggcuucaacagcauacagaaccccuggccgcgagagccccugauaccgcuucuugggccuccgugcucguugugagcacacuggcuauccugggauggucugucuga

SEQ ID NO: 77960 - RNA, 1524 nt, Artificial Sequence
  derived and/or modified sequence opt5 from XPNPEP3__Homo_sapiens__NP_071381
augcccuggcugcucagcgccccuaagcuggugccggcugucgccaacguuagaggccuuuccgggugcaugcuguguucucagcggcgcuacagccuccaacccgugccugagagacggauccccaaucgcuaucugggacagccuucccccuucacccacccucaucuucugagaccgggcgaagugacacccgggcucucucaggucgaguacgcgcugcggcgccacaaacugaugagccucauucagaaggaagcucaaggacaguccggcacggaccagaccgugguugugcugucuaacccuacauauuacaugagcaaugauauccccuauaccuuucaucaggacaacaauuuccuuuaccugugcggguuucaagagccugauuccauucucguccugcagagccuucccggaaaacagcugccgucucacaaggccauccucuucgugccuagacgggaccccucccgcgaacugugggauggcccuagaagcggcacagacggggccauugcucugaccggaguugaugaggccuauacacucgaggaauuucagcaucugcuucccaaaaugaaggcugagaccaacauggugugguacgacuggaugcggcccucucacgcccaacugcacuccgauuacaugcagccucucacggaagcgaaggccaaaagcaagaauaaaguccgcggcgugcagcaacugauccagagacuucggcugaucaagucuccggcugagauugagcgcaugcagaucgccgggaaacucaccucccaggcuuucauugaaacaauguuuaccagcaaggcccccguggaggaagcguuccuguaugccaaguuugaguucgaauguagagcucggggagccgacauccuggcuuacccucccgucguugccggcgggaacagauccaauacacuccauuaugugaaaaacaaucaacugauuaaggauggagagauggugcuucuggacggcggcugcgagucuagcuguuacgucuccgauaucacccgcacguggccugugaacgggcgguuuacagcuccccaggccgaacucuaugaggcgguucuggaaauucagagagacugccuugcccuguguuucccgggaaccagccucgagaauaucuacucuaugaugcugacacugaucggccagaaacucaaggaccuggggauuaugaaaaacaucaaggaaaauaacgcuuuuaaagccgcccgcaaguauugcccucaccaugugggacacuaccuuggcauggauguccacgacacccccgauaugccucggucccugccccuccaaccugggauggugauuaccaucgagcccggaauuuacaucccggaggacgauaaggacgcuccugaaaaauucagaggccugggcguucgcaucgaggaugacguggucgugacacaggauagcccccugauucuuucugccgacugucccaaggaaaugaacgauaucgagcagauuugcagccaggcguccuga

SEQ ID NO: 77961 - RNA, 3216 nt, Artificial Sequence
  derived and/or modified sequence opt5 from XPO1__Homo_sapiens__XP_011531399
augcccgccaucaugaccaugcuggcugaccacgccgcgagacagcuccuggauuucagccaaaaacuugacauuaaccugcucgauaauguggucaacugccuguaccauggcgagggggcucagcagcggauggcccaggaaguucuuacacaccugaaagagcauccugacgccuggacgcgcguggauaccauccucgaauuuucccaaaauaugaacacaaaguauuacggacugcagauucuggagaaugugaucaaaaccagauggaagauucucccgcggaaccagugugaaggcaucaaaaaguaugucguggggcugaucauuaagacaucuagcgacccuaccugcguugagaaagagaagguguacaucggaaaacuuaauaugauucugguccagauccucaagcaagaauggcccaaacacuggcccacauucauuuccgauaucgugggcgcuucucgcaccagcgagucccugugucagaacaauaugguuauucuuaagcugcucucugaagagguguuugacuucagcuccgggcagaucacgcaggucaagagcaaacaucugaaggauucuaugugcaacgaguuuucccaaaucuuccagcugugucaguuugugauggaaaauagccaaaacgccccucucgugcacgcuacccuggagacacuucugagauuccucaauuggauuccccugggauauaucuuugaaaccaaacuuauuucuacacugaucuacaaguuccucaacgucccuauguuucggaauguuucccugaaaugccugaccgagauugccggcgugagcgugucucaguaugaagaacaguucgucacgcucuuuacacugaccaugaugcagcuuaagcaaaugcugccgcucaacacaaacauccgccuggcguacuccaauggcaaagacgaugagcagaacuucauccagaaucuuagccuguuccucuguaccuuucugaaggaacacgaccagcugauugagaagagacucaaccugcgggaaacccuuauggaggcccugcauuacaugcuccugguguccgaaguugaggagacagaaaucuucaaaauuugccuggaguauuggaaucaccuugcugccgaacucuaccgcgagucucccuuuagcacguccgcuagcccucugcugucugggucccaacauuucgaugugcccccuagacggcagcucuaucugcccaugcuuuuuaagguccgccugcucauggugagcagaauggccaaaccggaagagguucugguggucgagaacgaccagggagaagugguccgggaguucaugaaggacaccgauucuaucaaucuguacaaaaacaugcgcgaaacacuuguguaucucacccaccuggacuacguugauacagagagaauuaugaccgagaagcugcacaaucaggugaacggcacggaauggagcuggaagaaucucaacacacuguguugggcgaucggguccaucucuggagccaugcaugaggaagacgagaaacgguuucuugucaccgugauuaaggaucugcucggccugugcgaacaaaagagagggaaggacaauaaagcuaucauugccagcaacaucauguauauuguuggacaguacccucgcuuccugcgggcucacuggaaguuucuuaagaccguggucaauaaacucuucgaguuuaugcaugagacacacgauggcgugcaggacauggccugugauaccuucaucaagauugcccagaaaugcagacgccauuuugugcaaguucaggucggcgaagugaugcccuucaucgacgagauccugaacaacauuaauacaaucauuugcgaucugcagccucaacaggugcacacguucuacgaagcugucggguauaugaucggagcgcagaccgaccagacagugcaagagcaccucauugaaaaguacaugcugcuucccaaccagguuugggacuccaucauccagcaggccaccaaaaauguggauauucugaaggaccccgagacagucaagcaacucggcagcauccugaaaaccaacgugcgggcuuguaaggccguugggcauccuuuugugauucagcugggaagaaucuaucuugauaugcucaaugucuacaaaugccugucugagaacauuuccgccgcuauccaggccaauggcgaaauggugacgaagcagccgcugauccgcagcaugcggaccguuaaaagagagacacucaagcugauuucugggugggugucccgcagcaacgacccccaaauggucgcggaaaauuucgugccuccccuucuggaugcugugcucaucgacuaucagcggaacgucccugccgccagagagcccgaaguucuguccaccauggcuauuaucgugaauaaacugggaggccacauuacagccgagaucccgcagaucuuugaugcuguguucgaguguacccuuaacaugauuaauaaggacuuugaagaguacccugaacaucgcacgaacuucuuucugcuccugcaagccgucaauucucacugcuuccccgcguuucucgccaucccucccacacaguucaagcuggugcuugauagcauuaucugggcuuuuaaacacaccaugcggaacguugccgacacaggccugcagauucucuucacccugcugcagaacguggcucaagaggaggccgcggcccaguccuuuuaucagaccuacuucugugauauccuucagcauauuuucucugucgugacagacacgagccacaccgcugggcugacaaugcaugccuccauccucgcuuacauguuuaaucugguugaagagggaaagaucagcaccucucucaacccuggcaaucccgugaacaaucaaauuuuccugcaggaauaugucgccaaccuucugaaauccgccuuuccgcaccuccaggaugcucaggugaagcuguucguuacagggcuguuuagccuuaaucaagacaucccugcguucaaagagcaucugagagacuuucucgugcagauuaaggaguucgccggagaggauaccucugaccuguuucucgaggaacgggagaucgcucugcgccaggccgaugaagagaagcacaaaagacagauguccguccccggcauuuucaacccccacgaaaucccugaggagaugugcgacuga

SEQ ID NO: 77962 - RNA, 3456 nt, Artificial Sequence
  derived and/or modified sequence opt5 from XPO4__Homo_sapiens__NP_071904
augauggccgcugcccuggggcccccugaggugaucgcgcagcucgaaaacgcugccaagguccugauggccccgcccagcaugguuaauaacgagcaaagacagcacgcugaacauauuuuccuuuccuuucggaaaucuaagagcccuuucgccgugugcaaacacauccuggagaccuccaagguggacuacguccucuuucaggcugccacagcgauuauggaagccgugguucgcgaguggauccugcuugagaaaggcucuauugaaagccugagaacguuccuccugaccuaugugcugcagcggcccaaucuccaaaaguacguccgcgagcagauccugcuugcuguggccguuaucgugaagagaggaucccuggauaaaucuauugacuguaagagcaucuuucaugaagucucccagcucauuagcucuggcaacccuacagugcagacccuggcuugcuccauccuuacagcccugcucagcgaguucucuuccagcucuaaaaccuccaauauugggcugagcauggaguuucacggaaacuguaagcggguguuccaagaagaggaucugcgccagaucuuuaugcucacagucgaaguucugcaggaguucuccagacgggaaaaucuuaacgcgcagaugucuagcguguuucaacgcuaucuggcccucgcuaaucaggugcuguccuggaacuuccuucccccuaaucugggcagacauuacauugccauguuugagagcucucagaacguccuccugaaaccgaccgaguccuggcgggaaacgcugcucgacagccgcgugauggagcuguucuucaccguucacagaaagauccgggaagauucugacauggcucaagauagccuucagugccuggcccagcucgccucccugcacgggcccaucuuuccugacgagggaucucagguggauuaucuugcucauuucauugaaggccugcucaauacaaucaacggcauugagaucgaggacagcgaagcggucgggauuuccagcaucaucucuaaucugauuaccguguuuccccgcaacguucugacagccaucccuuccgaacucuucagcucuuuugugaacugucugacccaccuuacgugcuccuucggaagaagcgcugcccuggaagagguccucgauaaggacgauaugguguacauggaagccuaugacaaacugcuggaguccuggcuuacacucguccaagacgauaagcauuuucacaaaggcuucuuuacccagcacgcugugcagguuuucaauucuuacauucagugucaucuggccgcgcccgacgggacacggaaccugaccgcuaauggaguggccagcagagaggaagaggaaaucuccgagcuccaagaggaugaccgcgaucaguuuucugaccagcuggccagcgucggcaugcuugggcggauugcugccgaacacugcaucccgcugcucaccucccugcuggaggaaagagugacacgccuucauggacagcuccaacggcaccagcagcagcugcuggcuagcccugggucuuccacgguugauaacaagaugcucgacgaucuguacgaggacauccauuggcuuauucuggugaccggcuaucuccuggccgaugacacacaaggcgaaacaccccugaucccucccgagauuauggaguacagcaucaaacacucuuccgaagucgacauuaauaccacccuucagauccucggaagccccggcgagaaggcgucuagcauuccuggguauaacagaacggauuccgugauccgccugcugagcgccauccuccgggugucugaaguugaguccagagcuauucgcgccgaccugacacaccuucugagcccgcagaugggaaaagauaucgucugguuccucaagcggugggcuaagaccuaccugcugguggacgaaaaacuuuaugaucaaauuucccuccccuuuucuaccgccuucggcgcggacacagaggggagccaguggaucauuggauaccugcugcagaaggugaucuccaaucucucugucuggagcuccgagcaggaucuggccaacgacaccgugcaacuucugguuacacucguggaaagacgcgagcgggcuaaucuggucauccagugugaaaacugguggaaucuggccaaacaguucgcuucuagaagcccuccccuuaacuuucuguccagcccugugcagcggacgcucaugaaggcccugguucucggcggcuucgcccauauggauaccgagacaaaacaacaguauuggaccgaagugcugcagccccuucagcaacgcuuucugagagucauuaaucaggagaacuuccagcaaaugugccagcaggaggaagugaagcaggagaucacagcuacccucgaagcgcugugugggauugccgaggcuacgcaaaucgacaauguugccauucuguuuaacuuccuuauggauuuucugaccaacugcaucggacucauggagguguacaagaauacaccggaaaccgucaaccugaucauugagguguucguggaagucgcccacaaacagaucugcuaccucggcgagucuaaggcuaugaaucuguaugaagccugucuuacacugcuccagguuuacuccaaaaacaaucuggggcggcagagaauugacgugaccgcggaggaggaacaauaucaggaucugcuucugaucauggagcuccugacgaaccuccugagcaaggaauuuauugacuucucugacacagaugagguguuucgcggacaugaaccuggccaggcugccaaucgguccgucagcgccgcugacgugguucuuuacggggugaaccugauccugccccucaugucucaggaucugcuuaaauucccuacccugugcaaucaauauuacaagcucaucacauuuauuugugagaucuuccccgagaagauuccucagcugcccgaagaccucuucaaaucccugauguauagccuugagcugggcaugaccuccaugagcucugaagucugccagcugugucucgaggcccugaccccgcuugcggaacagugcgcuaaggcccaagagacagauagcccucuguuucucgccacgagacacuuccugaaacucguguuugacaugcugguucuucagaagcacaacaccgagaugacaaccgcugccggagaggcuuucuacacacuggugugucugcaucaggccgaguacuccgaacucgucgagacccugcuuucuagccaacaggaucccgugaucuaucagcgccuggcggacgccuuuaauaaacucacggcuuccucuacacccccuacccuggauagaaagcagaagauggccuuccucaaaagccuggaggaauuuauggcuaacguuggcgggcuucugugcgugaaguga

SEQ ID NO: 77963 - RNA, 3615 nt, Artificial Sequence
  derived and/or modified sequence opt5 from XPO5__Homo_sapiens__NP_065801
auggccauggaccaggugaacgcucugugcgagcaacucgucaaggccguuaccgugaugauggaucccaauagcacacagagauaccggcuggaagcgcuuaaauucugugaggaauuuaaggagaaaugcccuaucugugugccgugcggccugcgccucgcugaaaagacgcaggucgccauugugagacacuucgggcugcagauccuugagcauguugugaaauuucgguggaacggaaugucccgccuggagaaggucuaucucaagaauagcgugauggaacugauugccaacggcacccugaauauccucgaggaagagaaccacauuaaagacgcucugagcagaaucguuguggagaugaucaagcgggaauggccccaacauuggccugauaugcuuauugagcuggacacacucuccaaacagggggaaacccagacagagcuggucauguucauccuucugcgccucgccgaagauguggugaccuuucagacacugcccccucaaagacggcgcgacauucagcagacccugacgcagaauauggagagaaucuucucuuuucuccugaacacccuucaagagaaugucaacaaguaccagcagguuaaaacagauaccagccaagaauccaaggcucaggccaauugucgggugggaguggcggcccugaacacacucgcuggcuauauugacugggucucuaugagccacaucaccgccgagaauugcaagcugcuugaaauucugugucuccugcugaacgagcaggaacuccagcugggggcugccgagugccuucugaucgcggugucccgcaaaggaaagcucgaggauagaaaaccccugaugguucuuuucggcgacguggccaugcauuacauccugagcgcugcccaaacggcugauggcgggggacucgucgaaaagcacuauguguuucugaaacggcugugucagguucucugcgcccugggcaaucagcuuugugcccugcucggggcugacucugauguggagacaccuuccaacuucggaaaguaccuggaaucuuuucuggcguucaccacacacccgucucaguuucuucgcuccagcacccaaaugaccuggggcgcccucuucagacaugagauucugucucgggacccccugcuccuggcuaucauuccuaaauaucuuagagccuccaugacaaaccuggucaagaugggguuccccagcaagacggacuccccuucuugcgaauacagccgcuuugauuucgacuccgaugaggacuuuaaugccuucuuuaacagcucucgggcucagcagggagaggugaugagacucgccugccgccuggaucccaaaaccuccuuccagauggcgggcgaauggcugaaguaccaacuuagcacauuucucgacgcuggcucugucaauagcuguuccgccguggggaccggagagggcucucugugcagcguuuucuccccgagcuuugugcagugggaagccaugacacuguuccucgagucugucaucacccagauguuucggacgcugaacagagaggaaauuccugugaaugaugggaucgagcuucugcagaugguucucaacuucgacacaaaagauccccugauccuguccugugugcuuaccaaugucagcgcucucuuuccuuucgugaccuaucgccccgaguuccugccccaaguguuuucuaagcuguucuccagcguuacauuugagaccgucgaagaguccaaagccccucggacaagagcugugcgcaacgugcggagacacgccugcucuagcauuaucaagaugugucgcgacuacccgcagcucguccugcccaauuucgauaugcuuuauaaccaugugaagcagcugcucuccaaugagcugcugcuuacgcaaauggaaaaaugcgcgcucauggaggcccugguucugauuucuaaccaguuuaagaauuacgaacggcagaaaguguuccucgaggaacugauggcuccugucgccagcaucuggcuuucccaggacaugcacagagugcugagcgacguugaugcuuuuauugccuaugugggaaccgaccaaaagucuugugaucccggccucgaggacccuugcgggcugaaccgggcgcgcauguccuucugugucuacagcauccugggagugguuaaaagaacaugcuggcccaccgaucuugaggaagccaaggcuggcggcuuuguggucggguauacaucuuccggaaauccgaucuuccggaacccuuguaccgagcagauucugaagcuccuggacaaccuccuggcccuuaucagaacgcacaauacccuguacgcucccgaaaugcucgccaaaauggccgagccuuuuacaaaggcucuggauaugcuggacgcggaaaagagcgccauucuuggccugccccagccucuccuggagcucaacgauucucccguguucaagaccgugcuggagcgcaugcagcgguuuuucagcacacuuuacgaaaauugcuuccauauccuggggaaagcuggaccguccaugcaacaggacuuuuauaccgucgaggaucucgccacgcagcugcugagcucugccuucguuaaccuuaauaacauuccugacuacagacugcgccccaugcucagaguguuugugaagccccugguccucuucugcccuccggaacacuaugaggcucuggugucccccauccuuggcccucuguuuacauaccugcauaugcggcucagccagaaguggcaaguuauuaaucagcgcucccugcuuuguggggaggaugaagccgcggacgagaaccccgaaucucaggagaugcuggaagaacaacucgugagaaugcugacccgggaggucauggaccucaucacagugugcuguguuagcaaaaagggcgcugaucacuccucugccccucccgccgacggagaugacgaagagaugauggcuaccgaagugaccccuagcgccauggcggagcugacagaucuuggcaaaugccugaugaagcaugaagacgucuguacggcucugcucaucaccgccuucaauucccuggccuggaaagauacacuuucuugccagcgcaccacaagccagcuguguuggccccuccugaaacaggugcucuccgggacccugcuugcugacgccguuacguggcuguuuacaagcgugcugaaaggacuccaaaugcacggccagcacgaugggugcauggcuucucugguccaucuugccuuccagauuuaugaggcgcugagaccgcgguaccucgagauccgcgccgugauggaacagauuccugagauccaaaaggacucccuggaucaguuugacuguaagcuccugaaccccagccuucagaaaguggcugauaagagacggaaagaccaguucaagcgccugauugccggaugcaucggcaaaccucugggggaacaauuuagaaaggagguccacaucaagaaucuccccucucuguucaaaaagaccaaaccgaugcuugaaaccgagguucuggacaacgauggcggaggccucgcuacaauuuucgagccuuga

SEQ ID NO: 77964 - RNA, 3336 nt, Artificial Sequence
  derived and/or modified sequence opt5 from XPO6__Homo_sapiens__NP_001257869
augaccgaguucuuucacgacugcacaacgaacgaaagaaagcgggagaucgaagaacugcucaauaacuucgcccagcaaauuggcgcuuggcgcuuuugucuguacuuccuuagcuccaccagaaaugauuaugugaugauguacucucugacagucuuugaaaaccucaucaauaaaauguggcuggggguucccagccaggacaagauggagauucgguccugccuuccuaaacugcuccuggcccaucacaagacccugccguauuucauccgcaacaaacucuguaaggugauuguggauaucggaagacaggacuggcccauguuuuaccaugauuucuuuacaaauauccugcagcuuauucaaucuccugucaccacaccccugggccucaucaugcugaagaccacgagcgaggaacuugcgugcccucgggaggaccuguccguggcucgcaaagaagaacucagaaagcugcugcucgaucagguucagaccgugcuggggcuucugacaggcauucucgagaccgucugggacaaacacucugugacagccgccacgcccccuccgagccccaccuccggagaaagcggggaucugcuuucuaaccugcuccaguccccuagcucugcuaagcugcugaaucaacccaucccuauucucgacguugaguccgaauauaucuguagccuggcccuugagugccuggcucaucucuucucuuggauuccccuguccgccagcaucacaccgucccuucugaccacaaucuuucacuucgcgcgguuuggaugugauauucgcgccagaaaaauggcuucugugaacggcagcucccagaauugcgucagcggccaggaacgggggcgccucggagugcuggccaugucuuguaucaacgagcugauguccaagaauugcgugccuauggaguucgaagaguaccuccugagaauguuccagcaaaccuuuuaucuucugcagaagauuaccaaagacaacaaugcucacacagucaagagccggcucgaggagcuggaugaaucuuacaucgagaaauucacggacuuucugcgccuuuucguuagcgugcaucucagacggauugaguccuacucucaguuucccguggucgaguuccugacccugcucuuuaaguauacauuccaccaaccuacccaugagggcuacuuuagcugucuggacaucuggacacuuuuccuggauuaucucaccuccaaaaucaagagcagacugggggacaaagaagccgugcugaaccgcuacgaggaugcgcuuguucuccugcugacggaagugcucaaccggauucaguuuagauauaaucaggcccagcuggaggagcuugacgaugaaacacuggacgaugaccaacagaccgaguggcagcgcuaccuccggcagucucuggaagucguggcuaagguuauggagcugcuucccacccacgccuucuccacacucuuucccgugcugcaagauaaccuggaggucuaucucggacugcagcaguucaucgugaccagcggcucugggcacagacuuaauauuacagcugaaaacgacugccgccggcugcauugcucccucagagaucugagcucccugcuucaggccgucggacgccucgccgaguacuucaucggcgacguguuugcugcgcgguucaaugacgcccugacgguuguggaaagacuggucaaggugacccucuacggcucucaaauuaaacuguauaacaucgagacagcuguuccuagcgugcuuaagccggaucugaucgacguccacgcccagucccucgccgcucugcaggccuacucucauuggcuggcgcaguauuguagcgaagugcaccgccaaaauacccagcaguuugugacacuuauuuccaccacgauggaugcuaucacaccccugauuagcaccaaaguucaagacaagcuccugcucucugccugccaucugcuugucucccuggccaccacagugcggccuguguuccucaucagcauucccgcuguccagaaaguguuuaacagaaucaccgaugccucugcucugcggcugguugacaaggcccaggugcuugucugucgcgcgcuguccaauauucuccugcucccuuggcccaaccugccggagaaugagcagcaauggccugugagaagcaucaaccacgccucucuuaucagcgcucugucccgggauuacagaaaucucaagcccagcgccguugcuccucagcgcaaaaugccccuggacgauacgaagcugauuauccaccagacacuuucugugcuggaagacauugucgagaacaucuccggggaaagcaccaaaucccggcagauuugcuaucaaucucuccaggagagcgugcagguuucccuggcccucuucccugcguuuauccaucagucugaugugacagacgaaaugcugagcuucuuucuuacccuguucagaggacugcgcguccaaaugggcgugcccuuuaccgagcagaucauucagacauuccucaauauguuuacgagagagcaacuggccgaauccauccuucacgaggggucuaccggaugucggguggucgaaaaguuccugaaaauucuccagguuguggugcaggagccgggccaggucuucaagccuuuucugcccagcaucauugcucucugcauggaacaaguguaccccaucaucgccgagcgcccuuccccggauguuaaggcugagcuguucgaacuucuguuuagaacacugcaucacaacuggcgguauuucuuuaaaagcaccgugcucgccucuguccagcgcgggauugccgaggaacagauggagaacgagccccaguucuccgcuaucaugcaagcguuuggacagagcuuccugcagccugacauucaccuuuuuaagcagaaucuguucuaccucgaaacacugaacaccaaacaaaagcucuaccauaaaaagaucuuuagaacggccaugcuguuccaguucgugaauguucuucuccaggugcugguccacaagucucaugaccugcugcaggaggaaauuggcaucgcuaucuauaacauggccuccguggauuuugacggcuucuuugccgcuuuccuucccgaguuucugacaagcugugaugggguugacgccaaucaaaaaucugugcucggacggaacuucaagauggaucgcgaccugccuuccuuuacccagaauguccacagacucgugaacgaucugcgguacuaucgccuuugcaaugacagccugcccccuggcaccgugaaacuguga

SEQ ID NO: 77965 - RNA, 3264 nt, Artificial Sequence
  derived and/or modified sequence opt5 from XPO7__Homo_sapiens__NP_055839
auggccgaccacgugcagagccuggcucaacucgagaaccugugcaagcagcuuuacgaaaccacagauacgaccacaagacugcaggccgagaaagcgcucgucgaguucaccaauucccccgacugucugucuaagugccagcuucugcucgaacggggcagcuccucuuauagccaacugcuggcugccacaugucucaccaaacugguuucccgcacaaacaauccucuuccgcuggaacagagaaucgauauucggaacuacgugcucaauuaucuggccacccgccccaagcucgcuacguuugugacccaggcccugauccagcucuacgcuagaauuacaaaacuggggugguucgacugccaaaaggaugacuaugucuuucggaacgccaucaccgaugugacacgcuuccugcaggacucuguugaguacuguauuaucggagugaccauccucagccagcugacgaaugagauuaaccaggcggauacaacccauccucuuacaaagcacagaaaaaucgccuccagcuuucgggacucuucccuguucgauauuuuuacccucagcugcaaucugcuuaagcaggcuucuggcaaaaaccugaaucucaacgacgaaucccaacaugggcugcugaugcagcuccugaaacuuacccacaauugucugaacuucgauuuuaucggaacaagcacggacgagucuuccgacgaucucugcaccguccaaauucccacaagcuggcgcuccgccuuccuggacucuagcacccuucagcuguuuuucgaucucuaucauuccaucccucccagcuuuucuccucuggugcuguccugucucguucagauugcuagcgugagacggucucuguucaauaacgccgaacgcgcgaaauuccuuagccaccuggucgacggcgugaagagaauccucgagaacccgcagucccugucugaucccaauaacuaccacgaguuuugccggcugcuugcccgccucaagagcaauuaccaacugggggaacuggugaaagucgagaacuauccugaaguuaucagacucauugcuaauuucacagugaccucccugcagcauugggaguuugcccccaacagcgugcacuaccuucugucucucuggcagcggcuggcugccuccgucccuuaugugaaggccacggaaccccauaugcuggagacauacaccccggagguuaccaaggcuuauaucacaagcagacuugaaucugugcacauuauccuccgcgacggacuggaggauccucuggaagacaccggccucguccagcaacagcuggaucagcuuuccacaauuggccggugugaguacgaaaagacgugcgcgcugcucgugcagcuguucgaccaaagcgcccaguccuaucaggagcugcuucagucugcuagcgccucccccauggauaucgccguucaagaggggagacucaccuggcugguguacaucauuggagcugucaucggcgggcgcgugucuuuugccagcacagacgaacaggacgcgauggauggagagcuggucugccgggugcuccagcugaugaaucuuaccgacuccagacuggcucaagccggcaacgaaaaacucgagcuggccaugcugagcuucuuugaacaguuccgcaagauuuacaucggggaucagguucagaaaucuuccaaacuuuaucggagacucagcgaggugcugggacugaaugacgagacaaugguccucucuguguuuauuggcaagaucaucaccaaccugaaguacuggggccgcugugaaccuauuacguccaagacccuucaacugcucaaugaucugagcaucggguauucuagcguucggaaacuggugaaacuuuccgcuguccaguucaugcugaacaaucacacaagcgagcauuuuucuuuccucggaauuaacaaucaguccaaccugaccgacaugagaugccgcacaaccuuuuacacggcccucggccggcugcuuaugguggaucugggggaagacgaggaucaguaugagcaauucaugcucccccugacagcugccuucgaagcgguggcccagauguuuagcaccaacuccuucaaugagcaggaagcuaagagaacacugguuggacuuguccgggaccugcgcggcaucgccuuugcuuucaacgccaagaccucuuuuaugaugcuuuucgaguggauuuaccccagcuauaugccuauccugcagagagcgauugaacucugguaccacgauccggccuguaccacacccgugcugaaacuuauggcugagcuggugcauaaucggucccaaagacuccaguuugacgucucuagcccuaacgggauccugcuguuccgcgagacguccaagaugaucaccauguacggaaaucggauucuuacacugggcgaagugcccaaggaucagguuuaugcccucaaacugaagggcaucucuauuugcuuuagcaugcucaaagcugcccuguccgggagcuacgugaacuucggagucuuuagacuuuauggcgacgacgcccuggauaaugcucugcaaaccuucaucaagcuccugcuuucuauuccucacuccgaccugcucgauuaccccaagcugagccagucuuauuacucccuccuggaggugcuuacacaggaccauaugaacuuuaucgcgagccuggaaccgcacguuaucauguauauucugucuuccaucagcgaggggcucaccgcccuggauacgaugguguguacaggaugcuguuccugccuugaccacauugucaccuaccuguucaaacagcucagccgcucuaccaagaaaagaacaaccccucugaaucaagaaagcgaucgguuccuccauaucaugcagcagcaccccgagaugauucagcaaaugcuguccacagugcuuaacaucaucauuuuugaggacugucgcaaucaguggucuaugagcagaccucugcugggccucauccugcuuaacgaaaaguacuucuccgaucugcgcaauucuauuguuaacagccagcccccugagaaacagcaagcuaugcaucucugcuuugaaaaucugauggaggggaucgaacggaaccuccugacgaagaacagagaccgguucacccagaaucuuuccgccuuucgcagagaggugaacgauucuaugaagaauagcacauauggcgucaacuccaaugacaugaugagcuga

SEQ ID NO: 77966 - RNA, 1896 nt, Artificial Sequence
  derived and/or modified sequence opt5 from XPR1__Homo_sapiens__NP_001129141
augaaguucgccgagcaccugagcgcucauaucacccccgaauggagaaaacaguacauucaauaugaggccuuuaaggacaugcucuacuccgcgcaggaucaggcuccuucuguggaagucacagacgaggauacgguuaaacgguauuucgccaaguuugaagagaaauucuuucagaccugcgagaaggaacuggccaagaucaacacauucuacagcgagaaacuugcugaagcccaacgcagauuugcuacccugcagaaugagcuccaguccucucuggacgcccagaaggagagcacaggcgugaccacacuucggcaacgcagaaaaccgguguuccaccugucccaugaagaacggguccagcaccgcaacauuaaggaucucaaacuggcguuuucugaguucuaucugagccucauccugcuucagaauuaccagaaccugaauuuuaccggguucagaaagauucucaagaaacaugacaagauccuggagacgucccggggagccgauuggcgcguggcucacguugaaguggcccccuuuuauaccuguaaaaagaucaaccaacuuauuagcgagacagaggcugucgugaccaaugaacuggaggacggcgauagacagaaagccaugaagcggcuccgcguuccuccccugggggcggcccagccugcucccgccuggacaaccuucagagugggacuguucugcggcaucuuuauuguccucaacaucacgcuggugcuugcugccguguucaaacuggaaacagaccggucuauuuggccucucauccgcauuuacagagggggauuucugcuuaucgaguuccuguuucuccugggcaucaauaccuacggcuggcggcaagccggggucaaccacguucugauuuucgaacucaauccgagauccaaccugagccaucagcaccuuuuugagaucgcuggauuccugggcauucucuggugucugucucuucuggcgugcuuuuucgcccccaucuccgugauuccuacauauguguacccccucgcucuguauggguuuauggucuucuuucugaucaauccuaccaagaccuucuacuauaagagccgcuucuggcuccugaaacuucuguuucggguguucacagcccccuuucauaagguuggauucgccgauuuuuggcucgcugaccagcugaacucucuguccgugauccuuauggaucucgaguacaugauuuguuucuauagccuggaacugaaaugggacgaguccaagggccuccugccgaauaacucugaagagagagggcacagcgacacgauggucuuuuucuaccuuuggaucguguuuuacauuaucuccagcugcuauacccugauuugggaucucaaaauggacuggggacuguucgauaagaacgccggcgaaaauacauuucugcgcgaggagaucguuuacccucagaaggcguauuacuauugugcuaucauugaagacgugauccuucgguucgccuggaccauucaaaucucuauuacauccaccacgcuccugccccacagcggcgauaucauugccacagucuuugcuccucuggagguguucagacgcuucgucuggaacuuuuuccggcucgaaaaugagcaucugaacaauugcggggaguuuagagccgugcgcgacaucucuguugcuccccuuaacgccgaugaccagacccugcucgaacagaugauggaucaggacgauggagugcggaauagacagaaaaaccgcagcuggaaguacaaucaauccaucucucugcggagaccccggcuggcgagccaguccaaagcccgcgacaccaagguccuuauugaggacacagaugacgaagcuaacaccuga

SEQ ID NO: 77967 - RNA, 1902 nt, Artificial Sequence
  derived and/or modified sequence opt5 from XRCC1__Homo_sapiens__NP_006288
augcccgagaucagacugcggcacguggucagcugcuccucucaggacagcacccauugugccgaaaaccuccugaaggcugauacauaccgcaaauggagagccgcgaaggcuggcgagaaaacgauuuccguugugcuucaacuggaaaaggaggaacagauccacucuguggacauugggaaugauggaagcgccuucgucgaggugcucguuggcuccucugccgggggagcuggcgagcaggacuaugaagugcugcuugucaccagcuccuuuaugagcccuucugagucccggagcgggucuaacccgaaucgcgugagaauguucggacccgauaaacugguucgggccgcugccgaaaagcgcugggacagagugaagaucgucugcucccagccuuacagcaaagauucucccuuuggccucuccuucgugcgguuucauagcccucccgacaaggaugaggcggaggccccuucccaaaaagugacagucaccaagcugggccaguuccgcguuaaagaagaggacgaaucugcuaacagccugagaccgggggcccucuuuuucucccggauuaauaagacaagccccgugaccgcuucugauccugccggacccuccuaugcggccgcuacacugcaggccagcucugcugccagcuccgccucuccugugagccgcgcuaucggcuccaccagcaagccccaggagucuccgaaagggaagagaaaacuugaccugaaccaagaagagaagaaaacgccuuccaagcccccugcgcagcucagccccucuguccccaaacggccuaagcugccggcccccacccgcaccccugcuacagcccccgugccugccagagcucagggagccguuacaggcaagcccagaggggagggaaccgaaccgcggcgcccucgggcgggccccgaggaacuuggcaaaauccugcaggggguggucgugguucucuccggauuucaaaauccuuucagaagcgagcugcgcgauaaggcucuggaacucggcgccaaauaccggcccgacuggacgagagacuccacacaccugauuugugccuuugcuaacaccccuaaguauucucaggugcuugggcugggaggccgcaucguccggaaagagugggugcucgauugccauagaaugcgccggagacugcccagccagcgcuaccuuauggccgggccgggauccucuagcgaggaagacgaggcuucccacagcggcggcucuggggaugaagccccuaagcugccccaaaagcagccccagacaaaaaccaagccuacccaggcggccggaccguccagcccccaaaaaccucccacaccugaggaaacgaaggcugccucucccguccuccaggaggacauugauaucgagggcgugcaguccgaagggcaggacaauggagcugaggauagcggcgacaccgaagaugagcugcggagaguugccgagcaaaaagaacaccggcugccucccgggcaggaggaaaacggcgaggacccguaugcgggaucuacagaugaaaauaccgacagcgaggagcaucaggaaccucccgaccucccugugcccgagcugccggauuucuuucagggcaagcacuucuuccuuuacggggaauuuccuggagacgagcgcagaaagcugauucgguacgucacagccuucaacggcgaacucgaggauuauauguccgacagagugcaauuuguuaucaccgcucaggagugggaucccagcuucgaagaggcccugauggacaauccuucucuugcuuuugugcgcccccgguggauuuacuccuguaacgaaaaacagaagcugcucccccaucagcuguauggggucgugccucaagccuga

SEQ ID NO: 77968 - RNA, 843 nt, Artificial Sequence
  derived and/or modified sequence opt5 from XRCC2__Homo_sapiens__NP_005422
augugcagcgccuuccacagagcugaauccggcaccgaacugcucgcccggcuggaggggcgcucuagccuuaaggaaaucgagcccaaccuguuugcggacgaagauuccccugugcauggagacauucucgaguuccacggcccggaggggacaggaaaaacggaaaugcuguaccaucuuaccgcuagauguauccugcccaagucugagggcgggcucgaagucgagguucuguuuauugauacagacuaucacuucgauaugcugcggcucgugaccauccuggagcaucgccuuagccaguccucugaagagauuaucaaauacugccugggaagauuuuuccucguguauuguagcuccagcacacaucugcuucugacccucuacucucuggaauccauguuuugcagccacccuucucugugucuccugauccuugacucccugagcgccuucuauuggauugaucgggucaauggcggcgagucugugaaccuccaagaauccacacugcgcaagugcagccagugucuugagaaacugguuaaugacuacagacucgugcuguuugccaccacgcagaccaucaugcagaaggcuuccucuagcuccgaggaacccagccaugccucucggcgccugugcgaugucgacauugauuauagaccuuaccucuguaaggcuuggcaacagcuggugaaacaccggauguucuuuuccaagcaggacgauagccagucuagcaaccaauucucccuuguuucucgcugccugaaaagcaauucccucaagaaacacuuuuucaucauuggggagagcggaguggaguucuguuga

SEQ ID NO: 77969 - RNA, 1041 nt, Artificial Sequence
  derived and/or modified sequence opt5 from XRCC3__Homo_sapiens__XP_005268103
auggaccuggaucuccuggaccuuaaccccagaaucauugccgcuaucaagaaagccaagcugaaaagcgugaaggagguccuccacuucuccggcccugaucugaaacggcuuaccaaucugucuagcccggaaguuuggcaucuccugcgcacagcgucccugcaccucagagggucuagcauucugacggcccuucagcugcaucaacagaaggagcgguuucccacccagcaccagcgccucucccugggaugcccugugcuugacgcucugcucagaggcgggcugccccuggauggaaucacagaacucgccggccggucuagcgcugggaagacccaacuggcccuucagcugugucucgcugugcaguucccucgccagcauggaggccuggaggccggcgcggucuacauuugcacagaagacgccuuuccccacaaaagacuucaacagcugauggcucagcagccucggcuccgcaccgaugugccgggggagcugcugcaaaagcucagauucggaucccagaucuuuaucgagcacguugccgacguggauacacugcuugaaugugucaacaaaaaggugcccguucugcucagccggggcauggcucgccugguggucauugacucuguggccgcgccuuucagaugcgaguuugauucccaggccagcgcuccccgggcccgccaucuucaaucucugggggcuacccucagagaacuguccagcgccuuccagucuccugugcuguguaucaaucaggucacggaggccauggaggaacagggagcugcgcacggcccccucggguuuugggacgagcggguuuccccggcccugggaauuaccugggcuaaccaacuucuggugagacuccuggccgaucgccugcgggaagaggaagccgcucuuggcugcccugccagaacacuccgcgugcugagcgcgccccaucugccucccuccucuuguagcuauaccaucuccgcugagggcguccgggggacacccggaacccagagccacuga

SEQ ID NO: 77970 - RNA, 1005 nt, Artificial Sequence
  derived and/or modified sequence opt5 from XRCC4__Homo_sapiens__NP_072044
auggagagaaagaucagccggauucaccugguguccgaacccucuaucacccauuuccuccaggucagcugggagaaaacacuggaauccggcuuuguuauuacgcuuaccgacgggcacucugccuggacaggaaccgugagcgaguccgaaaucucucaagaggcugaugacauggccauggagaagggcaaauacgugggggaacugcgcaaggcgcuccugagcggagcuggcccugccgaugucuauacauucaacuuuuccaaagagagcugcuacuucuuuuucgaaaagaaucuuaaggacgugucuuuuagacugggguccuucaaccucgagaaaguugagaauccggccgaagugauucgggagcugaucuguuauugccuggauaccaucgcugaaaaccaggccaagaaugagcaucuccagaaagaaaacgagcgccugcuuagagacuggaaugauguccagggacgguuugagaagugugugagcgcuaaagaagcccuggagacagaccucuacaagcgcuucauucugguucuuaacgaaaagaaaaccaagaucagaucucugcacaauaaacuccugaacgcggcccaagagcgggaaaaggauauuaaacaggagggcgagacggcuaucugcuccgaaaugaccgccgaccgcgaucccguguaugacgagagcacagaugaagagucugaaaaucagaccgaccuguccggccucgcuagcgccgcggucuccaaggacgauucuauuaucagcucccuggacgugacagauauugccccuagcagaaaacggcgccagagaaugcaacggaaccuugggaccgagcccaagauggcuccucaggagaaucagcugcaggaaaaggagaaacccgacucuucccucccugaaacgagcaagaaagagcauaucucugccgagaacaugagccuggaaacacuucgcaauuccucuccggaggaucuguuugacgaaaucuga

SEQ ID NO: 77971 - RNA, 2199 nt, Artificial Sequence
  derived and/or modified sequence opt5 from XRCC5__Homo_sapiens__NP_066964
auggugagaagcggcaacaaggccgcugucguucugugcauggacgugggguucaccauguccaauucuauccccggaauugagagcccuuuugaacaggccaaaaaggugaucacaauguucguccaacgccagguguuugcggagaacaaagaugaaauugcucucguucuguucggcacggacgggaccgauaauccgcuuuccggaggcgaccaguaccagaacaucacagugcaccggcaucugaugcuccccgauuuugaccugcuugaggauauugaaucuaagauccaaccugggagccagcaggccgacuuccuggaugcccucaucgucuccauggacgugauucagcacgagaccaucggcaaaaaguuugagaagagacauauugaaaucuucacagaucugucuagccgguuuuccaaaagccaacuggacauuaucauucacucucucaagaaaugugauaucucccugcaguucuuucuucccuucagccugggaaaggaggacggcucuggggaccgcggagauggcccuuuuagacucgggggacauggccccuccuucccucugaaagggaucaccgaacagcagaaggagggacuugagauuguuaagauggugaugaucagccuggaaggcgaggacggccucgaugaaauuuauucuuucuccgagagccugcggaaacugugcgucuuuaagaaaaucgaacgccacuccauucacuggccguguagacucacaaucgggucuaaucugagcauccggauugcugccuacaaguccauccuucaagagcgcgugaaaaagaccuggacgguggucgacgcuaaaacccugaagaaggaggauauucagaaagaaacaguuuauugccucaacgacgaugacgagaccgaagugcugaaggaggauaucauucagggauucagauacggcagcgacaucgugcccuuuucuaaagucgaugaggaacaaaugaaguauaaauccgaggggaaguguuucagcgugcuuggauuuugcaagucuagccagguucagcggcgcuucuuuaugggcaaucaggugcugaaagucuucgccgcgagagacgacgaagccgcugccguggcucucuccucucugauccaugcccuggaugaccucgauaugguugcgauugugcgguacgccuaugacaagcgcgcuaacccucaagucgggguggccuuuccccacaucaaacauaauuacgagugucuggucuacgugcagcuuccuuucauggaagaucugagacaguauauguuuagcucccucaagaacagcaaaaaguacgcucccacagaggcccagcugaaugccguugacgcucuuauugauucuaugucccuggcgaagaaagacgaaaagaccgauacgcucgaggaccuguucccgacaaccaaaaucccuaacccccgguuucaaagacuguuccagugccuccugcaccgcgcccuucacccucgggagccccugcccccuauucagcagcauaucuggaauaugcucaacccgcccgcugaagugacaaccaagagccaaauuccucugucuaaaaucaagacccuguucccccuuaucgaggccaagaaaaaggaucaggucacagcccaggaaauuuuucaggacaaucacgaggauggaccuacggcuaaaaagcucaaaaccgagcaaggcggcgcccauuucuccgugagcucccuggcggaagggucuguuacaagcgugggauccgucaaccccgcugagaacuuuagagugcuggugaagcagaaaaaggccucuuucgaagaggccagcaaucagcucaucaaccacauugaacaauuucuggacaccaaugagacaccguauuucaugaaguccaucgacuguauucgcgcuuuucgggaggaagccaucaaauucagcgaggaacagagauuuaacaauuuccuuaaggcucugcaggagaaaguugaaaucaagcagcucaaccauuuuugggagauugucgugcaagauggcaucacccugauuacgaaagaggaagccucuggguccagcgugacagcggaggaagccaagaaguuccuggcuccuaaagacaagcccucuggagauaccgccgcugucuuugaggaaggcggggacguggaugaccuucucgauaugaucuga

SEQ ID NO: 77972 - RNA, 741 nt, Artificial Sequence
  derived and/or modified sequence opt5 from XRCC6BP1__Homo_sapiens__NP_150592
auggccggcgcucccgacgagagacggcgcgggccugccgcgggagaacagcugcaacagcagcacgugagcugccaggucuucccggagagacucgcucaaggcaacccccagcagggguuuuucuccagcuuuuucaccucuaaucagaagugucaacugcggcuucugaaaacacucgaaacgaacccuuacguuaagcugcuucuggaugccaugaaacauuccggaugcgccgugaauaaggaccgccacuuuucuugugaggauugcaacggcaaugugagcgggggauucgacgcuuccaccucucagaucguccucugucagaacaauauucauaaccaggcccacaugaauagagugguuacacaugaacugauccacgcuuuugaucacugccgggcccauguggacugguucaccaacauucgccaccuggcguguagcgaggucagagccgcuaaucucuccggcgauugcagccuggugaacgagaucuuucggcuucauuucggccugaaacaacaccaccagacauguguucgcgacagagccacccucucuauucuggcugugcggaauaucuccaaggaagucgccaagaaagcgguggaugagguguuugaaagcugcuucaacgaccaugagcccuuugggcgcaucccucacaauaagacauaugccagauacgcucaucgggauuucgagaaccgcgacagauauuacucuaacauuuga

SEQ ID NO: 77973 - RNA, 1830 nt, Artificial Sequence
  derived and/or modified sequence opt5 from XRCC6__Homo_sapiens__NP_001275905
augagcggcugggaguccuacuauaagaccgaaggggacgaggaagccgaggaagaacaggaggaaaaccuggaggcuucuggagauuacaaauauagcggcagagacucccucaucuuccugguggaugccucuaaggcgauguuugaaagccaauccgaggacgagcuuacacccuucgauaugucuauucagugcauccagagcgucuacauuuccaaaaucauuagcucugaccgggaucugcucgcuguuguguuuuaugggacggaaaaggacaaaaauuccgugaacuucaagaauaucuacguccugcaggagcuugauaacccuggagccaagcgcauccuggaacucgaccaauuuaaaggccagcaggggcagaagagauuccaagauaugaugggacacggcagcgacuauucucuguccgaggugcuguggguuugugccaaucucuuuagcgaugugcaguucaaaaugucucauaagcggauuaugcuguuuaccaacgaagacaauccgcacggcaacgacuccgcuaaagccagccgcgcuagaacaaaggccggggaucuucgggacaccggaaucuuccuggaucucaugcaucugaagaaacccggcggguuugacauuucccuuuucuaccgcgauaucauuucuaucgcggaggacgaggaucugagaguccacuuugaagagagcuccaagcucgaagaccugcugcggaaagugcgcgccaaggagacaagaaaacgggcucucagccgccugaaacuuaagcugaauaaggauauuguuaucucugugggaaucuacaaccucguccagaaggcccugaaaccucccccuauuaaacuuuauagagaaaccaaugagcccgugaagacaaagacccggacguucaacaccuccacaggcgggcugcuccugccuagcgacaccaaacgcucucagaucuacggaagcagacaaauuauccuggagaaggaagagacagaagaacucaagcgguucgaugacccgggccugaugcuuaugggcuuuaaaccccuggugcuccugaagaaacaucacuaucuuagaccuucccuguucgucuaccccgaagagucucucguuauugggagcuccacccuguuuagcgcucugcucaucaagugccuggagaaagaaguggccgcgcuuugucgcuauacgccucggagaaauauucccccguacuucguggcccuggucccucaggaggaggagcucgacgaucagaagauccaagugacacccccuggauuucagcugguuuuccugcccuuugcugacgauaagcgcaaaaugcccuucaccgagaagaucauggccacaccugaacaggugggcaaaaugaaggcuauugucgagaaacuucgguuuaccuauagaucugacuccuucgaaaacccggugcuccagcaacacuuucgcaaucuggaggcccuggcccucgaucugauggaacccgagcaggcuguugaccuuacccugccuaagguggaggcgaugaacaagcggcucgggagccuggucgaugaguucaaagagcugguguaucccccugacuacaaccccgaaggaaaggucacaaaaagaaagcaugauaaugagggcucuggguccaaacgcccgaagguggaauacagcgaggaggaacuuaaaacgcacaucuccaagggaacccucggcaaguuuacaguuccuaugcugaaagaggccugccgggcuuacggccugaagucugggcucaaaaagcaggaacugcuugaggcccugaccaaacauuuccaggacuga

SEQ ID NO: 77974 - RNA, 5085 nt, Artificial Sequence
  derived and/or modified sequence opt5 from XRN1__Homo_sapiens__NP_001269786
augggcgugcccaaguucuacagauggaucagcgagcgguauccuugccuguccgaagucguuaaagagcaccagauuccggaauuugacaaccucuaccuggauaugaaugggaucauucaucaauguucucaccccaacgacgaugacgugcauuuccgcaucagcgaugacaagauuuuuaccgauaucuuccacuaucuugaggugcuguuuagaaucauuaaaccucggaaggucuucuuuauggccguggacggaguugcuccccgcgccaaaaugaaucagcagagaggccggcgcuucagauccgcgaaggaagcugaggauaagaucaaaaaggccauugagaaaggggaaacacucccuacggaggcccgguuugacucuaacugcaucacccccggaacagaguucauggcucgccugcaugagcaccuuaaguacuuugugaauaugaaaauuagcaccgauaaguccuggcagggcgucacaaucuauuucucugggcacgagaccccuggagaaggcgagcauaagauuauggaauuuaucagaagcgagaaagccaagccggaccacgaucccaacacacggcauugucuguacggccucgacgcugaccugaucaugcuggggcucaccucccacgaagcccacuucagccugcuucgcgaggaggugagauucggaggcaaaaagacgcaacggguuugcgcgccugaagagaccacauuucaucugcuccaccugucucuuaugcgcgaauauauugauuacgaguucuccgugcugaaagaaaagaucaccuuuaaauacgacauugagagaaucauugaugacuggauccucaugggguuccuggucggaaaugauuuuaucccccaucugccucaccuccauauuaaccacgacgcccugccccuucuguauggcacauacgugaccauccucccggagcucgggggauauauuaaugaaagcggccaccuuaaccugccucgguucgagaaguaccucgugaagcugucugauuuugacagagaacauuucuccgaggucuuuguugaucugaaaugguucgaaagcaaggugggcaauaaauaucucaacgaggcugccgggguggcugccgaggaagcgcgcaauuacaaggagaaaaagaagcugaaaggacaggaaaacucucuuuguuggacggcccuggacaagaaugagggcgagaugaucacauccaaagauaaccucgaagacgagaccgaagacgaugaccuguuugagacagaguuccggcaguauaagagaaccuacuacaugaccaaaaugggggucgaugugguuagcgacgauuuucuugcugaccaggccgcuugcuaugugcaagccauucaguggauccugcacuacuauuaccauggaguccaguccuggucuugguauuaccccuaucacuacgccccuuuccucagcgauauccacaacauuuccacacugaagauccauuucgagcugggcaagcccuuuaaacccuucgagcagcuccuggcugugcuuccugcggccagcaagaaucugcucccggcuuguuaccaacaccugaugacgaacgaagacucucccauuaucgaguauuacccucccgauuuuaaaaccgaccugaaugggaagcagcaggaaugggaggccguugugcuuauuccuuucaucgaugaaaaacgccuccuggaggccauggagacaugcaaccauucccugaagaaggaagaacggaaaagaaaucaacacagcgaaugucucaugugcugguaugaccgcgauaccgaguuuauuuaccccucuccguggccugaaaaguuccccgcuaucgagcgguguugcacaagauauaaaaucauuagccuggacgccuggcgcgucgacaucaacaagaauaaaauuacccggaucgaucagaaggcgcuuuacuuuugcggauucccuacgcugaaacauauuagacacaaguuuuuccucaagaaauccggcgugcaggucuuucagcaaucuagccgcggcgagaacaugaugcuggaaauccugguggacgcugaguccgaugaacuuacaguugagaauguggccagcucuguccucgggaaguccguguucguuaacuggccccaccuggaggaagcccggguggucgcugugagcgacggagagaccaaauuuuaucuggaagaaccucccggcacccagaagcucuacucugggagaacagccccgccuuccaaagugguucaucugggagauaaggaacagagcaauugggcuaaggagguccagggcaucuccgagcacuaccuucggcgcaaagggauuaucauuaacgaaaccucugccgugguguaugcgcaacugcucacaggcagaaaguaccagaucaaucagaacggagagguccggcuggaaaaacaguggagcaagcaagugguucccuucguguaucagacgauugucaaagacaucagagccuucgauucccgcuuuucuaauaucaagacccuggacgaucuuuucccccuccggagcaugguguuuaugcugggcacaccuuacuauggguguaccggagagguucaggacuccggcgaugugauuacagaagggagaauccgcgucauuuucagcaucccgugcgagcccaaccuggacgcucucauucagaaccaacauaaguacucuaucaaauauaauccuggauacgugcuggccuccagacuuggcguuagcggguaccuggugucucgguuuaccggcuccaucuucauuggacgcggcagcagacggaacccccacggggaucauaaggcuaaugucggacucaaccugaaauuuaauaagaaaaacgaggaagugccuggcuauacgaagaagguggggucugaguggauguacagcuccgccgcggaacagcugcuugccgaguaucucgaacgcgcucccgagcuguucagcuacaucgccaaaaauucucaggaggacgucuuuuaugaagacgauauuuggccuggagagaacgaaaauggcgcugagaagguucaagagaucauuaccuggcugaaagggcaccccguguccacacucagcagauccucuugugaccugcagauccuugaugccgccauuguggaaaagaucgaggaagaggucgaaaaaugcaagcagcggaaaaacaauaagaaggugcgcguuaccgugaaaccgcaucugcuguacagaccucuggagcagcaacacggcgucauccccgaccgggaugcugaguucugucuguuugaccgcgugguuaacgugagagaaaauuucagcgucccugugggacuucggggcacaauuaucgggauuaagggagcgaacagagaggccgauguucuguucgaagugcucuuugacgaggaguuccccggcgggcugaccauccgcugcuccccgggacggggcuauagacucccuacgucugcucuggucaaucuuagccacgggucccgcucugagacaggcaaccagaaacugaccgccauugugaagccccagccugccgugcaucagcacagcuccuccucuuccgucagcucuggacaccucggcgcucugaaccauagcccccaaagccuguuuguucccacacaggugccuaccaaagaugacgaugaguucuguaauaucuggcagucucuucagggguccggaaagaugcaauacuuucagccgaccauccaggaaaagggcgccgugcugccccaagagauuagccaggucaaccagcaccauaaauccggguucaaugacaacagcgugaaguaccagcaacggaaacacgacccucauagaaaguuuaaagaagagugcaagucucccaaggcggaauguuggagccagaaaauguccaauaagcagccuaacucuggaaucgagaauuuccucgcuagccugaacauuuccaaagagaaugaaguucagucuagccaccacggcgagcccccuuccgaagaacaucucucuccgcagagcuucgccaugaagggcacacgcaugcugaaagagauccuuaagauugauggguccaacacgguggaccacaagaaugaaaucaaacaaaucgccaacgagauucccgucagcucuaaucggagagaugaauauggacugccuucccagcccaagcagaacaaaaagcucgcuagcuacaugaauaaaccucauucugccaacgaguaucacaacgugcaauccauggacaauaugugcuggcccgcgccgagccagaucccucccguuuccacccccgugacagaacugucucgcauuuguagccuggucggcaugccucagcccgauuucuccuuucuucggaugccucagaccaugacagugugccaagucaagcugagcaacgggcuccuggugcacggaccgcagugccauucugagaaugaggcuaaggaaaaagccgcccucuucgcucugcagcaacuuggcucccuggggaugaacuuuccccugccuagccagguuuucgccaauuaccccucugcugugccucccggaaccaucccgccugccuuucccccucccacggcgaacauuaugccuagcuccucucaccucuuuggcagcaugcccuggggcccguccgucccugugcccgggaagcccuuccaucacacacuguauucuggaaccaugccuauggccggcgggaucccgggaggcguucauaaucaguuuauuccccuucaggugaccaaaaagagagucgcuaacaaaaagaauuucgagaacaaagaagcccaaagcucccaggcuacaccugugcagaccagccagcccgacucuuccaauaucgugaagguuagcccucgggaguccucuagcgccucccugaagucuagccccaucgcccaaccugcuuccagcuuucaggucgaaacagcgucucaggggcacuccauuagccaccauaaaucuacgccgaucuccagcucucgcagaaagagccggaaacucgccgugaacuucggaguguccaagcccucugaguga

SEQ ID NO: 77975 - RNA, 2853 nt, Artificial Sequence
  derived and/or modified sequence opt5 from XRN2__Homo_sapiens__NP_036387
augggcgugcccgccuucuuuagauggcugagccggaaguacccuuccaucauugucaacugcguugaggaaaaaccgaaggaguguaauggggugaaaauccccguggacgcuucuaagccuaaccccaaugaugucgaguucgacaaccucuaucuggauaugaauggaauuauccacccuugcacccaucccgaagacaaaccugccccgaagaacgaagaugagaugaugguggcgauuuuugaguacaucgaccgccuuuucagcaucguuagaccccggcgccugcucuauauggcuauugauggcguggccccuagagccaagaugaaucagcaacggucccgcagauuucgggcuucuaaagaagggauggaggccgcugucgaaaagcagcgcgugagagaggagauccuggccaaaggaggcuuccuucccccugaagagauuaaggaacgguuugacagcaacuguaucacacccgggacggaguucauggauaaucuggcgaaaugccuccgcuacuauauugccgacagacugaacaaugauccgggauggaagaaccugaccguuauccucuccgacgcuucugccccuggcgaaggcgagcacaagauuauggauuacauccggcgccagagagcucagcccaaucaugacccuaacacacaccauugucugugcggggccgacgcggaucuuaucaugcugggacucgccacccacgagcccaauuuuacaauuauccgggaagaguucaaacccaacaagccuaaaccguguggccugugcaaccaauuugggcacgaagugaaggacugugagggacuucccagagagaaaaagggcaaacaugaugaacuggcugacagccucccuugcgccgagggggaguucauuuuucugcgccugaauguccuccgggaauaucuggaaagagagcuuaccauggcuucccugcccuucacauucgauguggaacgcagcaucgacgauuggguguuuauguguuucuuugucggaaacgacuuccucccucaccuccccucucuugagauucgggagaaugccaucgauagacugguuaacaucuacaagaauguggugcauaagaccggcggcuaccucacggaauccggguaugucaaccugcagcgcgugcagaugauuaugcuggccguuggagagguggaagacagcaucuuuaaaaagcggaaagaugacgaggacucuuucagacgccggcagaaggagaaaagaaagcgcaugaagcgggaucaaccggcuuuuaccccuuccggcauucucacaccccacgcgcuggggagcagaaauucuccuggaucccaggucgccagcaacccccggcaggcugccuacgaaaugcgcaugcagaauaacuccucuccuagcaucucccccaauaccagcuucacaucugacggcuccccgagcccucuugggggaauuaaaagaaaggccgaggauucugacagcgaacccgagcccgaagauaacgugcggcugugggaggcuggcuggaaacaaagauauuacaagaauaaauuugacguugaugccgcggacgagaaguuccgccggaaggugguccaguccuauguggaaggccucugcuggguccugagauacuauuaccaggggugcgcuucuuggaaaugguacuauccuuuucacuacgccccguucgccagcgauuuugagggaaucgcugacaugcccuccgauuucgaaaagggcaccaaaccuuucaagccccuugagcaacugauggggguguuuccugccgcuagcggaaacuuccugcccccuucuuggcgcaaacugauguccgaccccgauagcucuaucauugacuuuuauccggaagacuucgccaucgaucugaauggcaagaaguacgcguggcaggggguugcccuccugccuuuuguggacgagagacggcuucgcgcugcccuggaggaagucuaucccgaucucacgccugaggaaacaagacggaacucccugggcggagacgugcuguucguuggcaaacaucacccccuucaugauuuuauucucgagcuguaccagaccgggagcacagaaccgguggaggucccucccgagcugugucacggaauccagggcaaguucucccucgacgaagaggcuauucugccugaucaaaucgugugcucucccgugcccaugcuucgcgaccugacccagaacaccguugucagcauuaauuuuaaagauccucaguucgccgaagacuauaucuuuaaggcggugaugcucccgggggccagaaaacccgcugccgugcugaagccuuccgauugggagaaaucuagcaacggacggcaguggaagccccaacugggcuucaaucgcgacagacggccuguccaucuugaucaggcugccuuucgcacacucgggcacgugaugcccagaggcuccggaacgggcaucuacagcaacgccgcuccuccgcccguuaccuaccaggggaaucuguaucggccucugcucagaggacaggcgcaaauucccaagcugaugucuaacaugcgcccucaggacuccuggcgggggcccccgccucuuuuccagcagcaaagauucgaccgcggcgugggagccgagccccugcuccccuggaaucggaugcugcagacacagaacgcugccuuucaaccuaaucaguaccagaugcuggccggccccgggggcuauccuccgagacgcgaugaccggggaggcagacagggguacccccgcgaaggacggaaauauccucuucccccucccagcggcagauacaacuggaauuga

SEQ ID NO: 77976 - RNA, 1797 nt, Artificial Sequence
  derived and/or modified sequence opt5 from XRRA1__Homo_sapiens__NP_001257309
auggccuucagcggcaucuacaagcuggacgaugggaaacccuaucucaacaauugcuuuccugcuagaaaccugcuucgggugccggaggaaggacagggccacuggcuggucguucaaaaggggaaucucaaaaagaaacccaagggacuggugggcgcccaggcggagcgcagagaaucccuuaaggcuaccucuuucgaguuuaaagggaagaaagaaagccggcgcgagaaccagguggaccugccuggacauauucucgaucaggccuuccugcugaagcaccauugugucagaaaacccuccgaccucugcacaaucaaugccaaggagaacgauuuuaagcacuuccauucugugauuuacaucaaugcuagcgaaaaccugcuuccucuggaggccuuucacacguuccccgcucucaaagaacuggaccuugccuuuaauggcauuaagaccaucuauguuaaauacggcgauuucaagcugcucgaguuucuggaccuguccuucaacucucucacaguggaggcgaucugugaucuggggauucuuccucaucugcggguccuccugcuuaccggaaauggccugacaagccucccgcccaaccuggccguggcugaacaagaggccuccguuaccagccugacaucuaaacgcuauauccucagauuuccugcucuggaaacccuuaugcuggacgauaaucggcucuccaaccccagcugcuucgccucucuggcggggcuucgcagacugaagaaacucucccuggacgagaaucggauuauccgcauuccuuaccugcaacaggugcagcucuaugaugaaagcgucgacuggaacggaggcagagggucuccccacaaggagccgcaauucaugcugcaguccaagccucggaugcuugaggacagcgaugaacagcuggacuacacggugcuccccaugaaaaaggauguggaccgcaccggagucccuccccugcugaaauccuuucuucaggagagacucggcauccaccugauucggagaaagaucguuaaacccaagcaucacgugcugaugucucgcaaggaaagcuggaaagugaaguccgagaucccuaaagucccgaagcaaccccucgugcugcaccauccucggaugacaaccacaaaaagccccucuaaggauaugcuugaaccugaggccgagcuggcugaagaccuccccaccacgaaguccacaagcguugagucugaaaugccgaccgagaaccuggaaggccacagcccuuccuguagaacauucgugccccugccucccauuugcucuaauagcaccguccauuccgaggagacccuuagccaccucucugauacaacggugcgccuguccccugaacggcccagcgacgaggauucuaaauccaccgaaagcaucuuucugacacagguuuccgagcucccgucuagcgugauucauaaggacgaucuggagcuuaaagaaaaggaccagaaaaagccucccaccgcccccagagaggucaaggggacacgccggaaacugccuaccgcuuuccucccguccaaguaccacggauaugaggaacugcugacggccaaacccgacccugccuuuaucgaacccaagggcauucagaaaaacgcucaggcgcuucagcagaugcucaagcacccucugcugugucauucuagcaaacccaagcucgauacacugcaaaagccuuacgugcacaaagagaagagaguccuuuccugcaccagcgggcagaauggaggcugguga

SEQ ID NO: 77977 - RNA, 1182 nt, Artificial Sequence
  derived and/or modified sequence opt5 from XXYLT1__Homo_sapiens__NP_689744
augggccugcucagagggggacugcccugcgcccgggcuauggcccgccuuggcgcggugagaagccacuacugugcucugcuccuggccgccgcucuugccgucugcgcuuucuauuaccugggguccggacgggagaccuuuucuagcgccacaaagcgccucaaagaagcgagagccggcgcuccugccgcuccgucucccccugcccuggagcuggcgcggggguccguugcccccgcuccuggagccaaggcuaaaagccucgaaggcggcggggccggacccguggacuaucaucugcuuaugauguucacgaaggccgagcacaacgcugcgcugcaggccaaagcucgcguggcccucagaucccugcuucggcuggccaaguuugaagcucaugagguccucaaucugcacuucgugucugaggaagccagccgcgagguugcgaagggccugcucagagaacugcuuccuccggcugccggguuuaaauguaaggugaucuuccaugaugucgccgugcugaccgacaaacucuuucccauuguugaggcuaugcaaaagcacuucuccgccggacugggcacauacuauagcgauucuaucuuuuuccuuuccguggcuaugcaccagauuaugccuaaagagauccugcagauuauccagcucgaccuggaucugaaguuuaagaccaacauccgggaacucuucgaggaauuugacagcuuccugcccggggccauuaucggaauugcgcgcgagaugcaaccugucuacagacauacauucuggcaguuucggcacgaaaauccccagacccgcgugggcggcccgccucccgaggggcuuccuggauucaacucuggcgugaugcugcucaaucuggaggccaugagacagagcccccuuuauucccggcugcucgaacccgcucaaguccagcagcuggccgauaaauaccauuuuagagggcaccugggagaccaggauuucuuuacaaugaucggcauggagcacccuaaacucuuccauguucuggacugcaccuggaaccgccaacuuuguacgugguggcgggaucacggguacucugacguguuugaggcuuauuucagaugcgaaggacaugugaagauuuaccacggcaauuguaacaccccgauccccgaagauuga

SEQ ID NO: 77978 - RNA, 1611 nt, Artificial Sequence
  derived and/or modified sequence opt5 from XYLB__Homo_sapiens__NP_005099
auggccgagcacgcucccagacggugcugucugggcugggacuucagcacccagcaagugaaggucguugccguggaugcggaacucaacguguuuuacgaggaauccguccauuucgaccgcgaucugccugaguuugggacacagggaggcgugcacguucauaaagacgggcuuacggugaccucuccgguccugaugugggugcaggcucucgauaucauucuggaaaagaugaaagccagcggauucgacuuuucccagguucuugcccugucuggcgcugggcaacagcacggaagcaucuauuggaaggccggcgcucagcaggcccucacaucccugucucccgaucugagacuccaucaacagcugcaggacugcuucagcauuuccgauuguccuguguggauggacagcucuaccacagcgcagugccggcaacuugaggccgcugucggcggggcccaggcucuguccugucucaccggaagccgcgccuacgagagauuuacaggcaaucagaucgcgaaaauuuaucaacagaaccccgaagccuacucucacaccgagcggaucucccuggugagcucuuucgcugccucccuuuuucuggggagcuauuccccuaucgauuacucugacggaagcggcaugaaucuccugcagauucaggauaagguguggucccaagccugccugggggccugugcuccccaccucgaagagaagcugagcccuccgguccccucuugcuccguugugggagcuaucagcucuuauuacgugcagcgcuacggcuucccucccggcuguaaagucguggcguuuacgggggacaacccugccagccuugcuggaaugagacuggaggaaggcgacauugccguuucccucgggaccucugauacacuguuccuuuggcugcaggagcccaugccggcccucgaaggacauaucuuuugcaauccuguggacagccagcacuauauggcucugcuguguuucaagaacggcucccucaugcgggagaaaauucgcaaugaaagcgucucuagauccuggagcgauuucucuaaggcccugcaauccaccgagauggggaacggaggcaaucuuggcuuuuacuucgacgugauggagaucacacccgaaauuaucgggcggcaucgcuuuaacaccgagaaucacaaaguugcggcuuucccuggagauguggaagucagagcccugaucgagggccaguuuauggccaagcggauucacgcugaagggcucggauaucgcgugaugagcaagacgaaaauccuggccacaggcggggcuucccauaacagagagauucuucagguccuggccgacguguucgaugcgcccguuuacgugaucgacaccgccaauucugcuugcgucggcagcgccuaucgggcuuuucacggacucgccggcgggacagaugugcccuucuccgagguugugaagcuggcgccuaacccgagacuggccgcuacccccucuccuggagccagccaggucuacgaagcucuccugccccaauaugccaaacuugagcagcgcauucugucccagacccggggcccucccgaauga

SEQ ID NO: 77979 - RNA, 2880 nt, Artificial Sequence
  derived and/or modified sequence opt5 from XYLT1__Homo_sapiens__NP_071449
augguggccgcucccugcgccagacggcuggcgcgcagaagccacuccgcucuccuggccgcccuuaccguccugcuccugcagacacuuguuguguggaacuucucuagccuggacuccggcgcuggggagcggcgcggaggcgccgcugucgggggaggcgaacaaccuccgcccgccccugcgcccagacgggagcgcagagaucucccugccgaacccgcugccgcucgcgggggaggcggcgggggaggcgggggaggcgggggacggggcccucaggccagagcgcggggcgggggaccgggcgagccccgcgggcagcagccugccucuagaggagcucugcccgcccgggcucuggacccucaucccagcccgcucaucacgcuggaaacccaagauggcuacuuuucccaccgcccuaaggagaaagugagaacagacucuaauaacgagaauagcgugcccaaggauuucgaaaacguugacaauuccaacuuugccccucggacccagaaacagaagcaucagcccgagcuugccaaaaagcccccuagcagacaaaaggaacugcucaaacgcaagcuggagcagcaggagaaagggaagggacacacauucccgggcaaaggccccggggaagugcuuccucccggagaucgggcugcggccaauucuucccauggcaaggacgucagcagaccuccccacgcucgcaagaccgggggaucuuccccggagacaaaauaugaucagccucccaagugugacauuagcggcaaagaagccaucucugcccugucccgggcuaagagcaaacacugcagacaagagauuggggaaaccuacugucgccauaagcucggccugcugaugccugagaaagugacgcgguuuugcccccucgagggaaaggccaacaagaauguucagugggaugaagacuccguggaguauaugccugcgaaccccgucagaaucgcuuucgugcuggugguccacggccgcgccucucggcagcuucaaagaauguuuaaagccauuuaccauaaggaucacuucuauuacauccacguugacaaacgcagcaauuaucugcauagacaggugcuccaggugucccggcaguacagcaacguccgggugaccccguggcgcauggcuacaaucuggggaggagccucucugcuuuccaccuaccugcaaagcaugagagaccuccuggaaaugacagauuggccuugggacuuuuucauuaaucugucugcugccgauuaucccauccggaccaacgaccagcucguugcguuucugagcagauaccgcgauaugaauuuccuuaagucccacggccgggacaacgccagauuuauucgcaaacaggggcuggauagacucuuccuggagugugacgcucauauguggcggcuuggagaucgcagaauccccgaaggcauugccguggacgggggcucugauugguuccugcucaaccggcgcuuugucgaguaugugacguucagcacagacgaccugguuaccaagaugaagcaguuuuacuccuauacacugcucccugcugagagcuucuuucacaccgugcuggaaaauucuccgcauugcgauaccauggucgacaacaaucuuagaaucacaaacuggaaucggaaacugggauguaagugccaauacaaacacauuguggauugguguggcugcucccccaacgacuucaagccucaggauuuucaccgcuuccagcagacggccagacccaccuuuuucgcgcggaaauuugaggccgucgugaaucaagaaaucaucgggcagcucgacuauuaccuguacggaaacuauccugcuggcacacccgggcugcgcagcuacugggagaauguuuaugaugaaccugacgggauucauucucuuuccgaugugacccucacacuguaccacagcuucgccagacugggccuccggagagcugagaccucccugcauacggacggggagaacucuugucgcuauuaccccaugggccacccggccagcguccaccuuuauuuucuggccgaucgguuccagggauuccucaucaagcaucacgcuacaaaucuggcgguguccaagcuggaaacccuugagaccuggguuaugccuaaaaagguguuuaaaauugccucucccccuagcgacuucggcagacuccaguuuuccgaagucgggacagauugggacgcuaaggagcgccuguuccggaacuuuggaggccugcucgggcccauggacgagccggugggaaugcaaaaauggggcaaggggccuaaugugaccguuacagucaucuggguggaucccgugaacgucauugccgccacguacgacauccugaucgaaagcaccgcugaguucacacauuacaagccuccccuuaaucugccccucagaccuggcguguggaccguuaaaauucugcaccauugggugccggucgccgaaacaaaguuucugguggcgccccuuaccuucucuaaccgccagccuaucaaacccgaggaagcucucaagcugcacaacggaccucugcggaaugccuauauggagcaguccuuucaaagccucaaccccguucugucucuuccuauuaauccggcccagguggagcaggcuagacgcaacgccgcguccacgggcaccgcucuggaaggguggcucgauagccuggucggaggcauguggacagccauggacaucugcgccaccgggcccacagcuugcccugugaugcagaccuguucucaaacggccuggagcuccuucagccccgauccuaaaucugagcugggagcuguuaagcccgacggccggcuuagauga

SEQ ID NO: 77980 - RNA, 2598 nt, Artificial Sequence
  derived and/or modified sequence opt5 from XYLT2__Homo_sapiens__NP_071450
augguggccagcgcuagaguccagaagcugguucggcgcuacaaacucgccaucgcgaccgcucuggccauucuucugcuccaaggccugguggugugguccuucucugggcuugaggaagacgaggccggagaaaagggcagacagcggaaaccccgcccucuggauccgggggagggaagcaaggacacagauuccucugcuggcagacgggggagcacgggacgcagacacggccgguggcgcggcagagccgaaucccccggggucccuguggcuaaaguugugcgggccgucaccucucgccagagagcgagccggcgcgugcccccugcucccccuccggaggcccccggaagacagaaccucuccggcgccgcugccggggaggcgcugguuggagccgcuggcuuuccuccccauggggacacaggaagcguggaaggcgccccucaacccaccgauaauggcuucacaccgaagugcgagaucgucgggaaggacgcucugucugcccucgcccgggcuuccaccaaacagugucagcaggaaauugcgaacguggugugccugcaccaagccggaagccuuaugccuaaggcuguccccagacauugucagcugacaggcaaaaugucuccugggauccagugggaugagucccaggcccaacagcccauggacggacccccuguucgcauugccuauaugcucguggugcacggccgggcuaucagacagcugaagcgccuucugaaagccgucuaccaugagcaacacuuuuucuauauccacguggauaagcggagcgacuaccuccauagagaaguuguggagcuggcgcagggguaugauaauguccgcgugaccccguggcggaugguuacgauuuggggaggcgcuucucugcucagaauguaccugcgcuccaugcgggaccuucuggaagugcccggcugggccugggacuuuuucaucaaccucagcgccaccgauuauccuacaagaaccaaugaggaacuggucgcuuuucuuuccaagaaccgcgacaaaaauuuccugaagucucacgggcgggauaacagcagauuuauuaaaaagcagggacucgaccggcuguuccaugagugcgauucccacauguggcgccugggcgagagacagauccccgccgggauuguggucgacggaggcagcgauugguuugugcucacacggucuuucguugaauacguggucuacaccgacgauccucugguggcucaacuuagacaguuuuauacguacacacugcuccccgccgaguccuucuuccacaccguucuggaaaauagccuugcgugugagacacugguggacaacaaucuccgcgucaccaacuggaaucggaaacuggggugcaagugucaguauaaacauaucguggauuggugcggcuguucuccgaacgacuuuaagccucaggauuuccugagacuccaacaggugagccgccccaccuuuuucgccagaaaguuugaauccacaguuaaucaggagguccuggagauucuugacuuccaccuguacggaucuuauccucccggcacgccugcucucaaagccuacugggaaaacaccuaugacgcugccgaugggcccagcggacuguccgacgugaugcugacagcguacaccgccuuugcucggcuuagccuccaucacgccgcuacagccgccccgccuaugggcacgccccugugccgcuucgagcccagagggcugccuucuuccgugcaucucuacuuuuaugaugaccacuuccagggauaccuggucacccaagcugugcagccgagcgcgcagggccccgccgaaacacuugagauguggcugaugccucaggggucucucaagcugcugggccgguccgaucaagcuagccgccuucagucccucgaaguuggaaccgacugggaucccaaagagagacuguuucggaacuucggcgggcugcucggaccucuggacgagcccguggccguccagcgcugggccagaggcccuaaucuuaccgcuacagugguuuggaucgaucccaccuauguggucgccacaucuuacgacaucacgguggauaccgaaacagagguuacccaauauaagccgccucugagccggccccuccgcccugggcccuggacagugagacugcugcaguuuugggaaccgcuuggagagacccgguuccucguccugccucugacguucaacagaaaacucccccugcgcaaggacgaugcguccuggcuucacgcuggcccuccccauaaugaguacauggaacagucuuuucaggggcugagcuccauucucaaccugccccaaccugagcuggccgaagaggccgcucagcggcacacccagcuuacaggcccggcccucgaagcguggaccgacagagagcugagcucuuucugguccguggcuggacugugugccaucggccccagcccuugccccucucucgagccuugccgccugacauccuggagcucucuuagccccgacccuaaguccgaacuggggccggugaaagccgauggacggcucagauga

SEQ ID NO: 77981 - RNA, 621 nt, Artificial Sequence
  derived and/or modified sequence opt5 from YAE1D1__Homo_sapiens__NP_001269375
augagcugggugcaggccgcuucccugauccaaggccccggggacaagggagaugucuucgacgaggaagccgaugagucucuccuggcgcagagagaauggcagagcaacaugcagcggcgcguuaaagagggcuacagagacgggauugaugcuggaaaggccgugacccuucaacagggcuuuaaucagggguauaaaaagggagccgaagugauccugaacuacggccggcuccgcggcacacugagaaauuccacggacuggucucuucuggggcuccgggcuccucugcgcagcccggaggucggaacccagcugcuccccagaccucugcccgugccuggccacauggccuccggggcuacacccaaacaaccuaccgagcuugaagccacacugcucucucugguuccgcagagcggacgggcgacaccccgcuucccugccagacuucgggcucccggcccugggacccccucccaucgcagacgguuucgcagaaagccgcaccgggauccugccgcugccugccccgcguggccucccgaggcccccagcaacucugaaacccauuucuccacguauaauagaauuaucauucgcggaggccacaucuga

SEQ ID NO: 77982 - RNA, 1515 nt, Artificial Sequence
  derived and/or modified sequence opt5 from YAP1__Homo_sapiens__NP_001123617
auggaccccggccagcaaccuccgccccagccugcuccccaggggcagggacaaccucccagccagccuccgcagggccaggggcccccuuccggacccggccaaccugcccccgccgcgacccaggcugccccgcaggccccucccgcugggcaccagaucgugcaugucagaggagauucugaaacagaccuggaagcccucuucaacgcuguuaugaauccuaagacggccaacgugccccaaaccgugcccaugcggcugcgcaaacuuccugauagcuuuuucaagccgcccgagccuaaaucccacucuagacaggcgagcacagacgccggcaccgcuggcgcccugacaccccagcauguccgggcucacuccucuccugccagccuccaacugggggcggugucccccggaacccuuacaccgaccggcguugugagcgggccugccgcuacgcccaccgcccagcaucugcgccagucuuccuuugaaauuccugaugacgucccccucccugcuggaugggagauggccaagacaagcucuggccagagauacuuccugaaucacaucgaucaaaccacaaccuggcaggacccccggaaagccaugcugucccagaugaacgugacggcuccgacaagcccucccguucagcaaaauaugaugaacucugcguccgggccccucccugauggaugggaacaggccaugacccaggacggcgagauuuauuacaucaaucacaagaacaagacaaccagcuggcuggauccgcgccuugaccccagauuugcuaugaaucagcggauuucccaaucugccccugugaaacagcccccuccccuggccccucagagcccccagggcggggucaugggaggcuccaacagcaaucaacagcagcaaaugcgccuccagcagcugcagauggagaaggaaagacuucggcugaaacaacaggagcuccugcgccaggcuaugagaaacaucaauccgucuaccgccaacuccccuaagugccaggaacuggcgcuccggagccaacugcccacacuugagcaggaugggggaacgcagaauccugugucuagccccggcaugucccaggagcugcgcaccaugacaaccaacucuagcgacccguuccucaacuccgggacauaucauagcagagacgaaucuaccgauuccggacugagcaugucuuccuacagcgugccucggacgcccgacgauuuucuuaauuccgucgacgagauggauacaggcgacaccaucaaccaaucuacccugccuagccagcagaauagauuccccgauuaucucgaagcuauucccggcacaaacguugaccuggggacccuggagggagauggcaugaauaucgaaggggaggagcucaugccuucccugcaagaagcccuuucuagcgacauucugaacgauauggaguccgugcucgccgcuacaaaacuggacaaggagagcuuucuuacguggcuguga

SEQ ID NO: 77983 - RNA, 1434 nt, Artificial Sequence
  derived and/or modified sequence opt5 from YARS2__Homo_sapiens__NP_001035526
auggccgcucccauccugcggagcuucuccuggggcagauggucugggacccucaaccugagcgugcuucugccucucggacugcgcaaggcccacuccggcgcgcaggggcuucuggcugcccaaaaagccagaggacucuuuaaggacuucuuuccggagacaggcacgaaaauugaacugcccgagcuguucgaucgggggaccgcuucuuuuccucagacaaucuacugcggauucgaccccaccgccgauagccuccaugucggccaccuccuugcucugcucggccuguuucaucuucagcgcgccgggcacaauguuauugcgcuggugggaggcgccacagcuagacucggggacccuuccggacggaccaaggaacgcgaggcccuggaaacagagagagugcgggcuaacgcccgcgcgcugagacucggccuggaggcccuugcugccaaucaucagcaacuguucaccgaugggcggucuugggggagcuuuacgguccucgacaacuccgcuugguaucagaaacagcaccugguggauuuccuugccgccguuggcggccacuuucgcauggggacccugcucagcagacagucugugcaacugcggcugaagucccccgaaggaaugagccucgcugaguucuuuuaccagguccugcaggcguaugacuucuacuaucuuuuccagcgcuacggcuguagagugcaacugggaggaucugaucagcucggcaauaucauguccggguaugaauuuauuaacaagcugacaggagaggacguuuucggcaucaccgugccucuuaucacaagcaccacgggcgccaaacuggggaagucugcuggaaaugccgucuggcucaaccgggauaaaacauccccguuugagcuguaccaguucuuugugagacaacccgacgauagcguggaacgcuaccugaagcuguucaccuuucugccucuucccgagauugaccauaucaugcagcugcacgucaaagaaccugagcggagaggcccccagaagcgccucgccgcugaaguuacaaagcuggugcaugggcgggagggacuggacuccgccaaaagaugcacccaggcgcuuuaucacucuagcauugaugcucucgaggugauguccgaccaagaacugaaggagcuguucaaagaagccccguuuagcgaguucuuucucgauccuggcaccucuguccuggacacaugucgcaaggccaaugcuauccccgaugggccucggggcuacagaaugauuacggaaggaggcguguccaucaaccaccagcagguuaccaaucccgagagcgugcuuauugucgggcagcauauccugaaaaacggacucucucugcugaagaucggcaaacgcaauuucuauauuaucaaguggcuucaacucuga

SEQ ID NO: 77984 - RNA, 1095 nt, Artificial Sequence
  derived and/or modified sequence opt5 from YBX2__Homo_sapiens__NP_057066
augagcgagguggaagccgcugccggcgcgaccgcuguccccgccgccacaguuccugcuacggccgcuggggugguggccgucgugguuccggugcccgcgggagagccucagaagggcgggggagccggcgggggaggcggcgcugccuccgggcccgcugccggaaccccuucugcgcccggcagcagaacaccugggaacccggccaccgcugucuccggaacacccgccccucccgcucggucucaagccgacaaaccugugcuggccauccagguucucggcaccgugaagugguucaauguccgcaacggguacggauuuauuaauagaaacgauacaaaagaagacguguucgugcaccagaccgcuaucaagcggaauaacccccgcaaauuucugagaagcgucggcgauggcgagacgguugaguucgacgugguggaaggggagaagggagcggaagccaccaaugucacaggccccgggggagugccuguuaagggcucccgguaugcucccaaccgcagaaaaucucggcgcuuuauuccuagaccgcccagcguggccccuccgcccauggucgccgagaucccuuccgcugggaccggacccggcagcaagggcgaacgggccgaggauucugggcagcgcccuagacgguggugcccgcccccuuucuuuuaccgcagacgguucgugagaggaccccgcccucccaaucaacagcagccuauugagggcacagaccggguugaacccaaagagaccgcgccgcuugaagggcaucagcaacagggagaugagagagugccuccuccccgcuuucggcccagauaucgccggccguucagaccccgcccucggcagcagcccacgacagaaggcggggacggcgagaccaagccuucccaaggacccgcugauggcagcagaccugagccccagcgcccgcggaacagaccuuacuuucagcggcgcagacaacaggcccccgggccucagcaggcccccggaccgcggcaaccugcugcccccgaaacaucugcuccugucaauuccggcgaccccaccaccacaauccuggaguga

SEQ ID NO: 77985 - RNA, 912 nt, Artificial Sequence
  derived and/or modified sequence opt5 from YBX3__Homo_sapiens__NP_001138898
augagcgaggccggcgaagcuaccacaacgaccacaaccacacugccccaggccccuaccgaggcggcugccgccgcuccgcaagaccccgccccuaagucccccguggggucuggagcuccucaggccgcggcccccgcuccugccgcucacgucgccggcaaccccgggggagaugcggcccccgcugccacaggcaccgcugccgccgcuagccucgcgacggccgcuggguccgaagacgccgagaaaaagguucuggccaccaaagugcuuggaacagugaagugguucaaugucagaaacggcuacggcuuuaucaaucggaacgauaccaaagaagacguguucguucaucagacagcuauuaagaagaauaacccucgcaaauaucugagaucugugggggauggagagaccgucgaguuugacgugguugaaggcgagaagggggccgaagcggcuaaugugacgggacccgauggcgucccuguggaggggagccgguacgccgccgaccgcagacgguaucgcagaggauacuauggccggcgcagaggcccgccgcggaacgcuggggagaucggagaaaugaaagauggcgugccugagggggcccagcuccaaggacccguccaccgcaauccuacauacagaccccgguaucgcuccagagggcccccucggccgagacccgcuccugccguuggcgaagcggaggacaaggaaaaccagcaggccaccucuggacccaaucagccuagcgugcgccggggcuacagacgccccuacaacuaucggagacgcccgcggccucccaaugcuccuucccaagauggcaaagaggccaaggcuggggaggcccccacagaaaacccugcgcccccgacccagcagagcucugccgaguga

SEQ ID NO: 77986 - RNA, 972 nt, Artificial Sequence
  derived and/or modified sequence opt5 from YDJC__Homo_sapiens__NP_001017964
augagcagaccccggaugcgccugguggucaccgccgacgauuucggcuacugcccuagacgggacgaggggaucguugaggcuuuucucgccggagcggugacauccgugucucugcuugucaacggcgcugccacggaaagcgccgcugaacuggcccgcagacacuccauuccgaccgggcuccaugcuaaucugucugagggacggcccgugggcccugcccgcagaggggcgagcucccuucugggacccgaaggcuucuuucucggcaagaugggguuccgggaggccguugcugccggagauguggaccugccucagguccgcgaggaacuggaggcucaacucucuuguuuuagagaacugcuuggccgggcccccacacacgcggaugggcaucagcacgugcauguucugccuggagugugccaggucuucgccgaggcucuccaggccuauggcgugcgcuuuaccagacugccgcuugagcgcggggugggaggcuguacauggcuggaagcucccgcccgggccuucgcuugcgcggucgagagagacgcccgggcugccguuggcccuuuuagcagacacgggcuccgcuggaccgaugccuucgugggacuguccacauguggccggcacaugagcgcucauagagugucuggggcccuggcgcgcguccucgaaggaacccuggcuggccacacgcuuaccgccgagcugauggcccaucccggguacccuuccgugcccccgacaggaggcugcggcgaagggccugacgcuuuuagcuguucuugggagcggcuccacgagcugagaguucuuaccgcccccacacugcgcgcucaacucgcccaggauggagugcagcugugcgcgcuggacgaucucgacuccaaacggccuggcgaagagguccccugugaacccacccuggagccuuuccuugaaccgagccugcucuga

SEQ ID NO: 77987 - RNA, 684 nt, Artificial Sequence
  derived and/or modified sequence opt5 from YEATS4__Homo_sapiens__NP_006521
auguucaagagaauggccgaguuuggccccgacagcgggggacgggugaaaggcgucaccaucguuaagccuauuguguacgggaacguggcucgcuauuucggcaaaaagagagaagaggauggacacacacaucaguggacggucuacgugaaaccguaucggaaugaagacauguccgccuacguuaagaagauccaauuuaaacugcacgagucuuaugggaacccccuccgcguggucaccaagccucccuacgaaauuacagagaccggauggggcgaguucgaaaucauuaucaaaaucuuuuucauugauccuaaugagagacccgugacacuguaucaucuucugaagcucuuucagagcgacaccaacgcgaugcugggcaaaaagacaguuguguccgaguucuacgaugaaaugaucuuucaggacccuaccgcuaugaugcagcaacuucugacgaccucucggcagcucacacugggggccuacaagcacgagaccgaguucgccgaacuggaagucaaaacacgcgagaagcucgaagcugccaaaaagaaaaccagcuuugagauugcugagcugaaggaaagacuuaaagccucccgggagacgaucaauugccugaagaacgaaauucgcaagcucgaggaagaugaccaggcgaaagauaucuga

SEQ ID NO: 77988 - RNA, 1632 nt, Artificial Sequence
  derived and/or modified sequence opt5 from YES1__Homo_sapiens__XP_011524038
augggcugcaucaagagcaaagagaacaagucccccgccauuaaauacagaccugaaaauaccccggagcccgugucuacaagcgucucccacuauggggcugaaccuacgaccguuucucccuguccuagcuccucugccaagggaacagcggugaacuucagcucccugagcaugacccccuuuggcgggucuuccggagugacaccuuucggcggggcuucuagcuccuuuagcgucgugccgucuuccuaccccgccggacucaccggcggcguuacaaucuucguggcccuguaugacuacgaggcucggaccacggaagaucuuagcuuuaaaaagggggagcgcuuccagauuaucaauaacaccgagggagacuggugggaagccagauccauugcuacaggcaagaauggguauaucccuucuaacuacgucgcccccgcggauagcauccaagccgaggaaugguauuuuggaaaaaugggccggaaggacgcugagcgccugcuccugaauccugggaaccagagaggaauuuuccuugugcgggaguccgaaaccacaaaaggcgccuacagccugucuauccgcgauugggacgagauuagaggcgauaauguuaagcauuacaaaauccggaagcucgacaacgggggauauuacauuaccacgcgcgcucaguuugauacacugcagaagcuggugaaacacuauaccgaacaugccgacggccucugccacaagcugacaaccgucugucccaccgugaaaccgcaaacacaggggcuugcgaaggaugccugggagaucccuagagaaucccugcggcucgaggugaaacugggacagggcugcuucggggaggucuggaugggaacguggaauggcaccacaaagguugcuauuaaaacccuuaagcccggcacaaugaugccugaagccuuucugcaggaggcucaaaucaugaagaaacuccgccaugacaagcuggugccccuguacgccguggucagcgaagaacccaucuauauugugaccgaguucaugucuaaagggagccuccuggauuuucuuaaggagggagacggcaaauaccugaagcucccucagcugguugacauggccgcucagaucgcggaugggauggccuauauugagagaaugaacuacauccaccgggaccuucgcgcugccaauauucuggugggagaaaaccucgucuguaagaucgccgauuucggccuggcuagacugaucgaggacaaugaauacacggcccggcagggggcgaaauucccgauuaaguggacagcucccgaggccgcccucuauggcagauuuaccaucaaauccgauguguggucuuucggcauucugcaaaccgaacuuguuacaaagggacgcgugccuuaccccgggauggucaaccgggaggugcuggagcaggucgaaagaggauaucgcaugccuugcccccagggcuguccggagagccuccacgaacugaugaaccuuugcuggaaaaaggacccugaugagcggcccaccuuugaguacauccaauccuuccuggaagacuauuuuacagcuacggagccucaguaccagcccggggaaaaucucuga

SEQ ID NO: 77989 - RNA, 882 nt, Artificial Sequence
  derived and/or modified sequence opt5 from YIF1A__Homo_sapiens__NP_065203
auggccuaccacagcggcuauggggcucauggauccaagcacagagcccgggcggcucccgacccuccgccccuguucgaugacaccucuggcggguacagcucccagccuggaggcuaucccgccacaggggccgauguggcuuuuucugucaaccaucuccugggagacccuauggccaauguugcuauggccuacggcagcuccaucgcgucucacggcaaagauauggugcauaaggagcuucaccgcuucgugagcgucuccaaacugaaguacuuuuucgccguggacacggcuuauguugccaaaaagcucgggcugcuuguguuucccuauacccaccaaaacugggaaguccaguacagcagagaugcuccucugccgccccggcaggaccucaaugccccugaucuguacauucccacaauggcguucaucaccuaugugcugcucgccggaauggcucugggcauucagaagcgcuuuucuccugagguucuugggcugugcgccuccacagcucucgugugggucgugauggaagugcuggcccuucugcucggacuguaccuggccaccgucagaagcgaccucucuacauuccaucugcuugcuuauuccggcuacaaauauguugggaugauccugagcgugcucaccggacugcuuuuuggcucugauggcuacuauguggcgcuggccuggacguccagcgcucucauguacuucauuguccggucccugcgcaccgccgcccuggggcccgacucuaugggaggcccggugccuagacaacggcuccagcuguaccuuacacugggggcugccgcguuucagccccucaucaucuauuggcugaccuuccaccuuguucgcuga

SEQ ID NO: 77990 - RNA, 372 nt, Artificial Sequence
  derived and/or modified sequence opt5 from YIPF1__Homo_sapiens__XP_011539907
auguggagaaacagcaaggugaugaauaucgucuccuacucuuuccuggagauuguuugcguguauggcuacagccucuuuaucuauauucccaccgccauccuguggauuaucccucagaaagcugugcgguggauccuugucaugauugcccuggggaucuccggaucucuccuggcgaugacauucuggccggcugugcgcgaagacaacagacggguugcccuugccacgauugugaccaucguccugcuccacaugcugcugagcgugggcugucucgcuuacuuuuucgaugcccccgagauggaccaucugccuacaaccacagcuacccccaaucaaacaguugccgcggccaaguccucuuga

SEQ ID NO: 77991 - RNA, 1053 nt, Artificial Sequence
  derived and/or modified sequence opt5 from YIPF3__Homo_sapiens__NP_056203
auggccaccacagcugcccccgcgggcggggcuagaaacggagccggcccugaguggggaggguucgaagagaauauccagggcgggggaagcgccgugauugacauggaaaacauggaugacacguccggcucuagcuuugaggauaugggcgaacugcaccaacggcuccgcgaggaggaagucgacgcugaugccgcugacgccgcggccgcugaggaagaggauggggaguuccugggaaugaagggcuuuaaagggcagcuuuccagacagguugccgaccagauguggcaagcuggaaagcggcaggccucucgcgcguucagccuguacgccaauaucgauauucucagaccguauuuugacguggaacccgcucaggugcggucccgccugcuugagucuaugaucccuauuaaaauggucaacuucccccagaagaucgccggcgaacuguacgggccucucaugcugguguuuacccugguugcuauccuccugcauggaaugaaaacaagcgauaccauuaucagagagggcacacuuaugggcaccgccauugggacaugcuucggauauuggcugggcguguccagcuuuaucuacuuccucgccuaucuguguaaugcucaaauuaccaugcuucagaugcuggcgcuccugggguacggacuguuuggccacugcaucguccucuucauuacguauaacauccaucugcacgcccuguuuuaccuuuucuggcuccugguugggggacuuucuacccugcggaugguggcugugcucgucucccgcacagugggccccacccagagacugcugcucuguggcacacuggccgcccuucauaugcuguuccuccuguaccuucacuuugcuuaucacaagguggucgaagggauccuggacacccucgagggaccuaauauuccgcccauccagcggguuccucgcgauauucccgccaugcugccugcggcuagacugcccacgacagugcucaacgccaccgccaaggcuguggccgucacacugcaaagccauuga

SEQ ID NO: 77992 - RNA, 774 nt, Artificial Sequence
  derived and/or modified sequence opt5 from YIPF5__Homo_sapiens__NP_001020118
augagcggcuucgagaaccugaauaccgacuuuuaccagacauccuauucuaucgaugaccaaagccagcaguccuacgauuaugggggaucuggcgggcccuacagcaagcaguaugccggauacgacuauucccaacagggcagauucgugccuccggauaugaugcagccccagcaaccuuacacggggcagauuuaccagcccacccaggcuuauaccccugccucuccccaaccuuuuuacggaaacaauuucgaagacgagccgccccuccuggaggaacuuggcaucaacuuugaucacauuuggcagaaaacacugacaguccuccauccucugaagguugcggacggcagcaucaugaaugaaaccgaucuugcugggcccaugguguucugccuggccuuuggagccacacuccugcuggcuggcaaaauucaguucggguauguguacggaaucuccgccaucggcugucucgggauguuuugccugcuuaaccugaugagcaugaccggagucucuuucggcuguguggcuuccguucucggcuauugccugcuuccuaugauucugcucagcucuuuugccgugaucuucucccugcaagggauggucggaauuauccugacggcgggcauuaucgggugguguagcuuuucugccuccaagauuuucaucagcgcucucgccauggagggacagcagcugcuuguggcuuaccccugcgcccugcucuauggcguuuucgcgcugaucuccguguuuuga

SEQ ID NO: 77993 - RNA, 597 nt, Artificial Sequence
  derived and/or modified sequence opt5 from YKT6__Homo_sapiens__NP_006546
augaagcuguacagccucuccgugcuguauaaaggcgaggccaaggucguucuucugaaagcugccuacgacgugucuagcuucuccuuuuuccagagaucuagcgugcaagaauuuaugaccuucacaucccagcucaucgucgagcggucuagcaaggggacgcgcgcguccgugaaagaacaggauuaucugugccacguuuacgugagaaacgacagccuugcuggagucgugauugccgauaaugaguaucccucucggguugccuuuacccugcucgaaaaggugcuggacgaguucuccaagcaggucgaucgcaucgacuggccugugggcagcccggcuacaauucauuaccccgcccuggaugggcaccucucuagauaucaaaacccucgggaggcugaccccaugaccaaagugcaggccgaacuggaugagacaaagaucauucuucauaauaccauggaaucccugcucgagcgcggagagaaacuggacgaucuugucagcaagucugaaguucugggcacacaguccaaagcguuuuacaagaccgccagaaagcagaacagcuguugcgcuaucauguga

SEQ ID NO: 77994 - RNA, 6441 nt, Artificial Sequence
  derived and/or modified sequence opt5 from YLPM1__Homo_sapiens__NP_062535
auguaccccaacuggggcagauaugggggaagcucccacuacccucccccucccgugcccccucccccucccgucgcccugcccgaggcuucuccuggccccggguauagcuccucuacaaccccugccgcgcccagcuccucuggauucaugagcuuucgggaacagcaccucgcucaacugcagcagcuucagcaaaugcaccagaagcagaugcagugcguucugcaaccccaucaccucccucccccuccccugcccccuccucccgugaugcccggcgggggauacggcgacuggcagcccccucccccgccuaugcccccucccccuggccccgcccuuuccuaucagaaacagcaacaguacaagcaucagaugcugcaccaccaacgcgaugggccgccuggacucgugcccauggagcuggaaucucccccugaguccccgcccgucccucccggcuccuauaugccucccagccagucuuacaugccucccccgcagccucccccuuccuacuaucccccgacgagcucucagccuuaccugcccccugcccaacccucccccagccaguccccuccgucucagagcuaucucgcucccaccccuuccuacagcucuagcagcucuagcucccagucuuaucugagccauucccaaagcuaccuucccucuucccaggccagcccuucuagacccucccaggggcacagcaaaucccagcugcucgcuccuccgcccccuucugcgcccccuggaaauaagacaaccgugcaacaggaaccccuggagagcggcgccaaaaacaaguccacagagcagcagcaagccgcuccggaaccugaccccucuaccaugacaccccaggagcagcaacaguauugguaccggcagcaucuucugagccuccagcaacgcaccaagguucaccucccugggcacaaaaagggacccguggucgccaaagauacgccugaaccggugaaggaggagguuaccgugcccgcuacaucccaggucccugaaagccccucuuccgaggaaccuccccugccgccucccaaugaggaagugccucccccucugccucccgaggagccccagagcgaagaccccgaggaagaugccagacugaaacagcuucaagcggccgcugcccauuggcagcagcaccagcaacaucgggugggcuuccaguaccagggcaucaugcaaaagcacacccagcugcagcagauucuccaacaguaucagcagaucauucaacccccuccgcauauccagacaaugucugucgacaugcagcugcgccacuacgagaugcagcaacagcaguuucagcaccuuuaucaagaaugggagagagaguuccagcugugggaagaacagcuccauuccuacccccacaaggaucaacugcaggaauaugagaaacaguggaagaccuggcaggggcauaugaaagcuacgcaaagcuaccugcaggaaaagguuaacucuuuucagaauaugaaaaaccaguauaugggaaauaugagcaugccucccccuuucgugcccuacucccaaaugccuccgccccucccuacaaugcccccucccgugcugccgccuagccuuccgcccccugucaugcccccugcccugccggccaccgugcccccucccggcaugccucccccgguuaugccucccucucucccuacauccgugcccccucccgggaugccgccuagccuguccucugcuggaccgcccccuguccuuccgcccccuagccuguccucugcgggacccccucccgugcucccucccccgagccuguccucuaccgccccucccccuguuaugccccugccgccucucagcuccgcuacacccccgccugggauucccccuccgggagugccccagggcaucccuccccagcugaccgccgccccugugcccccugcuuccucuagccagagcucucaagugccggagaagccccggccugcccuucugcccacgccugucuccuuuggcagcgcgcccccgaccacauaccacccuccccuccagucugcugggcccuccgaacaagucaacagcaaagccccucuguccaagagcgcccugcccuauucuagcuucuccucugaccaaggacuuggcgaaagcuccgcugccccuucucagccgaucaccgcuguuaaggauaugcccgugcgcagcgggggacuccugccugaucccccuagauccucuuaccuggagagcccccggggcccgcgcuuugacgggccuagacgguucgaagaccucggcucccgcugugagggacccagaccuaaaggcccccgguuugaggggaauagaccggauggaccucgcccccgguaugaaggccaccccgccgaggggacaaagagcaaauggggaaugauuccuagaggccccgcgucucaguucuacaucaccccuuccacgagccugucuccgcgccaguccgggccccaauggaagggcccuaaacccgccuuuggacagcagcaucagcaacagccuaagagccaggcugaaccccuuuccggcaacaaggagccucuggccgacacaucuagcaaucagcagaaaaacuucaagaugcaguccgcugccuucagcauugcggccgacgucaaagaugugaaggcugcccagucuaaugaaaaccucuccgacagccagcaagagccgcccaaaucugagguuagcgaagggccuguggagcccuccaauugggaucagaacguccagucuauggaaacccaaaucgacaaggcucaggccgugacccagccugugccccuggccaacaagccgguuccugcucagagcacauuucccuccaaaaccggaggcauggaagggggcacagcggucgccacgucuagccugaccgcugauaaugacuucaagcccgugggcauugggcuuccucacuccgaaaacaaucaagauaaaggccucccccggccugacaacagagauaaucgccuggagggaaaccggggcaauuccucuagcuauagagggccgggacagagccgcauggaggacacacgggauaagggccuggugaacagagggcgcggacaggccaucucccggggccccgggcucgucaaacaggaagacuuuagagacaagaugaugggccggcgcgaggauucuagagaaaagaugaaucggggagagggcagcagagaccgcgggcuggugcggccuggauccucuagagaaaaaguucccggcgggcuucaaggaagccaggaucgcggcgccgcuggcuccagagagcgggggccuccccgcagagccggaagccaggagcggggcccgcugcgcagagcggggucucgggaacgcauuccucccagacgggcuggaucccgcgagagaggcccuccccgggggccuggaagcagagaacgcggccucggccggucugacuucgggagagaucgcggacccuuucggccggagcccggcgacgggggagagaagauguacccuuaucauagagaugaacccccucgcgccccguggaaccacggcgaggaacgggggcaugaggaguucccccuggacggaagaaaugccccuauggagcgcgagcggcuggaugacugggauagagaacgguacuggcgcgagugcgaaagagacuaccaggaugacacccuugagcucuauaaccgggaagaccgcuuuuccgcucccccuagcagaucucacgauggcgaccggagaggccccuggugggaugacugggagcgcgaucaagacauggaugaggacuacaaucgggaaauggagagagauauggaccgcgauguggaccggaucagcagaccuauggauauguaugaccgcucccuggacaacgaaugggaucgggacuacgggagaccccuggaugagcaggaaucucaguuccgcgagagagacaucccgagccucccuccccugccuccccuuccgccucugccgccccucgaucgguaucgcgacgauagauggcgggaggaacgcaauagagagcacggauacgaccgggauuuuagagaccgcggcgaacugcggauuagagaguauccugagcgcggggauacauggcgggagaaaagagacuacguccccgaccggauggauugggaacgcgaaagacuguccgaccggugguacccuagcgauguggaccgccauuccccgauggccgagcacaugcccucuagccaucacuccucugaaaugaugggaagcgaugcgucccuugacucugaucaaggccucgggggaguuauggugcugagccagagacagcaugagaucauucugaaggcugcccaggagcucaaaaugcugcgggaacaaaaggagcagcuucagaaaaugaaggacuucggcuccgaaccucagauggccgaucaucugcccccucaagagagccgccuccagaacaccucuuccagacccggcauguauccgccucccgggagcuaccggccucccccucccaugggaaagccgcccggcucuaucguccgcccuuccgcucccccugccagaagcucugugcccguuacgcggccuccggugcccauuccucccccucccccgccucccccucugcccccgccuccgcccgucaucaaaccucagaccuccgcuguggaacaggagagaugggacgaggauagcuuuuaugggcugugggacacaaacgaugaacaaggacuuaauuccgaguucaagagcgaaaccgccgcgauccccucugccccugugcugccgcccccucccguccacagcuccauuccucccccuggcccgguucccauggggaugccucccaugucuaaaccucccccggugcagcagacaguggacuacggacauggccgcgacaucagcaccaacaaggucgagcaaauucccuauggcgaacggaucacgcucagaccugauccccugccugagcgcuccacauuugagaccgaacacgcugggcagcgggacagauacgaucgcgagcgggacagagaacccuauuucgaucgccagucuaaugugauugccgaccaucgggauuucaaaagagaccgcgagacacaccgggauagagaccgcgauagaggaguuaucgacuacgaucgggaccgcuuugacagagagcggagaccucgggaugaccgcgcucagagcuacagagauaagaaggaccacuccucuagccggcgcggcggguucgauagaccguccuaugaccggaaaagcgaucgccccguguacgaaggaccuucuauguuuggcggggagagacggaccuaucccgaggaacgcaugccucuccccgccccgucccugagccaucaaccucccccugcccccagagucgaaaagaaaccugagucuaagaacguggacgauauccuuaaacccccgggacgggagucccgccccgaaagaauuguugugaucaugcggggccugccuggcagcgggaagacccacgucgcuaagcucauucgcgacaaagagguggaguucggaggccccgcgccuagaguucugucccuggaugacuacuuuaucacagagguggaaaaggaggagaaagaccccgauucugggaagaaagucaagaagaaagugauggaauaugaguacgaagccgagauggaagagacguaucggaccagcauguucaagacauuuaaaaagacccuugacgauggauucuuuccguucauuauccuggacgcuauuaaugauagagugcgccauuuugaccaguucugguccgccgccaaaacaaagggcuuugaggucuaccucgcugaaaugagcgccgauaaccagaccugugggaaacggaauauccacggaagaaagcugaaggagaucaacaaaauggcggaccauugggaaacggcuccucgccacaugaugcggcucgauauuagaucucugcuucaggacgccgccaucgaggagguugaaauggaggauuucgacgcuaauauugaggagcaaaaggaagagaaaaaggaugccgaggaagaggaauccgagcugggcuacauccccaaaagcaagugggaaauggacacaucugaggcgaagcucgacaaacuggauggccugcgcaccgggaccaagcggaaaagagacugggaggcuauugccagccgcauggaagauuaucuucagcugccugacgauuacgacacacgggccuccgagcccggaaagaaaagagugcgcugggcugaucucgaagagaagaaggacgccgaucggaaaagagcuaucggcuucguggucgggcagaccgacugggaaaagaucacagaugagucuggacaccuggccgagaaagcgcucaaccggacgaaguauauuuga

SEQ ID NO: 77995 - RNA, 2052 nt, Artificial Sequence
  derived and/or modified sequence opt5 from YME1L1__Homo_sapiens__NP_001240795
auguucagccuguccucuaccgugcagccccaagucacaguuccucucagccaccugaucaacgccuuucauacgccgaagaauaccuccgugucucuuagcggcguguccgucucucagaaccagcacagagacgugguucccgagcaugaagcuccuagcuccgagcccagccugaaucuccgggaucuggggcuuucugaacugaaaauuggacagaucgaccaacucguggagaaccugcugccuggcuucugcaaggggaaaaauauuuccagccacuggcauacaucucacgucuccgcccagagcuuuuucgaaaacaaguacguguuuauccagucucgcggauucaaaacccucaaguccagaacacggcgccugcagagcaccuccgagagacuugcggagacacaaaauauugcucccucuuuuguuaagggcuuccugcuccgggaucgcgggagcgacguggaaucccuggauaaacuuaugaagaccaaaaacaucccugaggcccaccaggacgccuuuaagacgggauucgcugaaggcuuucugaaagcccaggcucucacccagaagacaaaugauagccugagacggacccgccugauccucuucguccugcuucuguuuggcauuuaugggcuccugaagaacccguuccuuucugugagauuccggacaaccacgggacuggacuccgccguggaucccguccaaaugaaaaauguuacauuugagcaugugaagggcguggaggaagcgaaacaggagcuccaggaagucguggaguuccugaagaacccucaaaaauuuaccauccucgggggaaagcugcccaaaggcauucugcuuguugggccucccggaacaggcaagacccugcucgcccgcgcuguggccggcgaagcugacgucccguucuacuaugccagcgggucugaguuugaugagauguucgugggaguuggcgcgagcagaauccggaaucuguuucgcgaagccaaggcuaacgccccuugugugauuuucaucgacgagcuugauuccgucgggggaaaaagaauugaaucucccaugcacccuuacagccggcagaccaucaaucagcugcucgcugagauggacggcuuuaagcccaacgaaggggugaucauuaucggagccacaaacuuccccgaggcccuggacaaugcucugauuagaccuggccgcuuugauaugcaggucacggugccgcggcccgacguuaaaggcagaaccgagauccucaagugguaucugaacaaaauuaaguucgaucaauccguggacccugaaaucaucgcgcgcgggacagucggauuuagcggcgccgagcuugaaaaucuggugaaccaggcugcccucaaggccgcuguugaugggaaagagauggugaccaugaaggaacuggaguucucuaaagacaagauucugaugggacccgagcggagauccgucgaaaucgauaauaaaaacaagacaauuaccgccuaccaugagagcggccacgcgaucauugcuuauuacacgaaggacgccaugccuaucaauaaagccacaaucaugccccgcgggccgacccuuggccacgugucucuccugccugaaaacgaucgguggaaugagaccagagcucagcugcucgcccagauggacguguccaugggaggccgcguugcugaggaacugauuuucgggacagaucauaucaccacaggagccagcuccgacuuugacaacgcgacgaagauugccaaacggauggucaccaaguucggcaugucugagaaacuuggggugaugacauacagcgauaccggaaagcugucccccgaaacacaaucugcuaucgagcaggaaauuagaauccuccugcgcgacagcuaugagcgggccaagcacauucugaaaacccaugcuaaggagcacaaaaaucuugccgaagcgcuccugacguacgagacccuggaugccaaggaaauccagaucgugcucgagggcaaaaagcuggaagucagauga

SEQ ID NO: 77996 - RNA, 360 nt, Artificial Sequence
  derived and/or modified sequence opt5 from YPEL1__Homo_sapiens__NP_037445
auggugaagaugaccaaaagcaagacauuccaggccuaccugcccaacugccacagaacguauuccuguauccauugccgggcucaccucgccaaucaugacgagcugauuucuaagagcuuucaaggcucccaggggcgcgcguaccuuuucaacucugucguuaaugugggauguggcccugcugaagagagagugcugcucaccgggcugcacgccgucgccgauaucuauugcgaaaacuguaaaacaacccuuggauggaaauacgagcaugcuuuugaaagcucccagaaguauaaggagggcaaauucauuaucgagcuggcccacaugauuaaggacaaugggugggaauga

SEQ ID NO: 77997 - RNA, 360 nt, Artificial Sequence
  derived and/or modified sequence opt5 from YPEL2__Homo_sapiens__NP_001005404
auggugaagaugaccagaagcaaaacauuccaggccuaccugcccuccugccaccggacguauucuuguauccauugccgcgcucaccucgccaaccaugacgagcugauuagcaaguccuuucaaggcucucaggggagagcguaccuuuucaauagcgucguuaacgugggauguggcccugcugaggaacgggugcugcucaccgggcugcacgccgucgccgauaucuauugcgaaaauuguaaaacaacccuuggauggaaguacgagcaugcuuuugaauccucucagaaauauaaggagggcaaguacauuaucgagcuggcccacaugauuaaagacaacgggugggauuga

SEQ ID NO: 77998 - RNA, 360 nt, Artificial Sequence
  derived and/or modified sequence opt5 from YPEL3__Homo_sapiens__NP_001138996
auggugagaaucagcaagcccaaaaccuuccaggccuaccuggacgauugccaccggcgcuauuccugugcucauugcagagcccaccucgcgaaccaugacgaucugauuucuaagagcuuucaaggcucccaggggcgggcuuaccuuuucaauucugucguuaacgugggauguggcccugccgaggaacgcgugcugcucacagggcugcacgccgucgcugacauccauugcgagaauuguaaaacgacccuuggauggaaguaugaacaggccuuugagagcucccagaaauacaaggaaggcaaguauauuaucgagcugaaccacaugauuaaagauaaugggugggacuga

SEQ ID NO: 77999 - RNA, 384 nt, Artificial Sequence
  derived and/or modified sequence opt5 from YPEL4__Homo_sapiens__NP_659445
augcccagcugcgacccuggcccggggcccgccugucugccuaccaagacauucagauccuaccucccccggugccaccgcacguauucuugugugcauugcagagcucaccuggccaaacaugaugagcuuaucagcaaguccuuucagggaucucacggccgggcguaccuguucaacagcgucguuaaugugggguguggaccugcugaacaacgccuccugcuuaccggccugcauuccguggccgacaucuuuugcgagucuuguaaaacaacccucggguggaaguaugaacaggccuucgagacaagccagaaauacaaggaaggaaaguauauuauugagaugucccacauggucaaagauaacggcugggacuga

SEQ ID NO: 78000 - RNA, 366 nt, Artificial Sequence
  derived and/or modified sequence opt5 from YPEL5__Homo_sapiens__NP_001120872
augggcagaaucuuccuggaccacauugggggaacccggcucuuuagcugcgccaacugugauacaauccugacgaaucgcuccgagcuuauuucuaccagauucacaggcgcuaccgggcgggccuuucuguucaacaagguggucaaucuccaguacagcgaaguucaagaccgcgugaugcugacaggaagacauauggugcgggaugucuccugcaaaaacuguaauucuaaacuuggcuggaucuaugaguuugcgaccgaagacagccagcgcuacaaggaggggagagugauucuggaacgggcucucguucgcgaguccgagggauucgaggaacacgugcccucugauaacagcuga

SEQ ID NO: 78001 - RNA, 2184 nt, Artificial Sequence
  derived and/or modified sequence opt5 from YTHDC1__Homo_sapiens__NP_001026902
auggccgcugacagcagagaggaaaaggauggcgagcugaacgugcucgacgauauccugaccgaaguccccgagcaggacgaugaacuuuacaauccugaguccgagcaagacaaaaacgaaaagaaagggucuaagcggaaaagcgaucgcauggaguccacagacacgaagagacagaagccgucuguucacagccggcagcugguguccaaaccccucucuagcuccgugagcaauaacaagcgcauugucucuaccaaaggaaaguccgccacagaauauaaaaaugaggaguaccagagaagcgaacggaacaagcgccuggaugcggacagaaagauccggcuuucuuccagcgcuucucgcgagccuuauaaaaaucaacccgaaaagaccugcgugagaaaacgggauccugagcgcagagccaagucccccacaccugacggcagcgaacggauugggcuggagguugaucgcagagccucccggucuagccaguccagcaaagaggaagugaacucugaggaauacggauccgaccaugagaccggcagcucugggagcuccgacgaacagggaaauaacacagagaaugaggaagagggcgucgaagaggauguggaagaggacgaggaaguugaggaagaugcugaggaggacgaagagguggaugaagacggcgaggaagaggaggaagaggaagaggaagaggaggaagaggaagaggaagaggaggaagaguaugaacaggaugagagagaccaaaaggaggaagggaacgauuacgacacccgcucugaggccagcgauuccggaagcgaaucugucuccuucacggacggcagcgugcggucuggguccggaaccgacggcagcgaugagaaaaagaaggaaagaaaacgcgcucgggggaucuccccgauuguguuugacagaucuggaagcuccgccucugagagcuaugcgggcuccgagaagaaacacgaaaagcucuccucuuccguccgcgccguucggaaagaucagacaagcaagcugaaguacgugcugcaggacgcuagauucuuucucaucaaaucuaauaaccaugagaaugugucccuggccaaggcuaaaggcgucuggagcacccuucccgugaacgaaaagaaacugaaccucgccuuccgcucugcgcggagcguuauccugauuuuuagcgugagagagagcgggaaguuccagggauuugcccgccuuucuuccgaaagccaccauggcggguccccuauccacuggguccugcccgcuggaaugucugccaagaugcucggcgggguguucaaaauugauuggaucugucggagagagcugccuuuuacaaagagcgcucaccugaccaaucccuggaacgagcauaaaccgguuaagauuggacgggacggccaagaaaucgagcucgaaugcggcacgcagcugugucuucuguucccucccgaugaguccauugaccucuaccaggugauccacaaaaugcgccauaagagacggaugcacucucaaccuagaagccgcgggcggcccuccagacgcgaacccgucagagaugugggacggcgcagaccugaggacuaugauauccacaauucucggaagaaaccgcgcauugacuaucccccugaguuucaucagagacccggcuaccugaaggauccucgguaccaggaagucgaccgcagauucagcggggugcggcgcgacguuuuucuuaacggauccuauaaugauuacgugagagaguuccacaacauggggcccccgccucccuggcagggcaugccucccuauccuggcauggaacaacccccgcaucacccuuacuaccagcaucacgcucccccuccccaggcccacccgcccuauagcggacaucacccugucccccaugaggcccgguacagagacaaacgcgugcacgauuaugacaugcggguugaugacuuccugagacgcacacaggcgguggucucuggccggagaucccgcccucgggagagagaucgcgaacgggagagagaccggccccgcgauaauagacgggaccgcgaaagagaucgggggagagaccgcgagcgggaaagagagcgccucugcgaucgggacagagaccgcggagagcggggcagauaccgcagauga

SEQ ID NO: 78002 - RNA, 4293 nt, Artificial Sequence
  derived and/or modified sequence opt5 from YTHDC2__Homo_sapiens__NP_073739
augagcagacccuccucugugagcccucggcagccggcccccggcgggggaggcgggggaggcccuucccccugcgggccuggaggcggcgggcgcgcuaagggacugaaagacaucagaauugaugaagaagucaagaucgccguuaacauugcgcucgagcgguuccgcuacggcgaccaaagagaaauggaguuucccucuagccugaccuccacagaacgggcuuucauccaccgccuuucucagagccuggggcucguguccaaaagcaagggaaaaggcgccaauagauaucugacggugaagaagaaagaugggucugagaccgcccaugcuaugaugacauguaaccuuacccacaauacaaagcaugccguccggucccugauucagcgcuuuccugugaccaacaaagagagaacagaacuccugccgaagaccgagcggggaaauguuuucgcuguggaagccgagaaccgcgagaugagcaaaacgucuggcagacugaauaacggcaucccccagaucccugucaagcgcggggaauccgaguuugacagcuuccggcaaucucuccccguguuugaaaagcaggaggaaauuguuaaaaucauuaaggagaauaaagugguccugaucgugggagagaccggcuccgggaagacaacccagauuccucaguuccuucuggaugacugcuuuaaaaacggaauccccuguagaauuuucugcacacaaccgcggagacucgcggccaucgcuguggccgaacgcgucgcugccgagcggagagaacgcaucggccagaccauuggguaccagauccggcuggagagcagaguuuccccuaagacgcuucugacauuuuguaccaauggagugcuccugcgcacacugauggcgggcgauucuacccucagcaccgugacacacgucauuguggacgaaguucaugagcgggauagauucuccgacuuucugcuuacgaaacugcgcgaucuccugcagaagcaccccacccuuaagcugauccucagcucugccgcucuggacgugaaccuguucauucgguauuucggcuccugcccugucaucuacauccaagggagacccuuugaggugaaagaaauguuccucgaggauauucugcgcacaaccggauauacaaauaaggaaaugcuuaaauacaagaaagagaagcagcaggaagagaagcaacagaccacgcugacagagugguauagcgcccaggaaaacucuuuuaaacccgagagccagcggcaaagaaccguucucaaugugaccgacgaauacgaccugcuugaugacggcggggaugcugucuucucccagcugacagagaaggacgugaacugucucgagccuuggcugaucaaagaaauggaugccugccugucugacauuuggcuccacaaggauaucgacgccuuugcucaggucuuccaucugauucuuaccgagaacgugagcguugauuaccggcacuccgaaacaagcgcgacggcccugaugguggcugccggacgcggcuuugccucucaggucgagcaacucaucuccaugggggcuaaugugcauagcaaagccucuaacggcuggauggcgcuggacugggcuaagcacuucggacagaccgaaaucguugaucugcuugaguccuauagcgccacacucgaguuuggcaaucuggacgaauccucucuggugcagaccaacgggagcgaccucuccgccgaggauagagaacugcuuaaggcuuaccaccauucuuucgacgaugagaaagucgaccuggaucucauuaugcaucugcuguauaauaucugucacagcugcgacgccggagcugugcuuauuuuucucccgggcuacgaugaaaucguggggcugcgggaccgcauucuguucgaugacaagagauuugccgauuccacacaccgguaucagguuuucaugcuccauagcaacaugcaaaccucugaccagaaaaagguccugaaaaaucccccugcgggagugagaaagaucauucuuuccacgaacaucgccgagaccagcaucacagugaaugaugucguguucguuauugacucuggcaaggugaaagagaaguccuuugacgcucugaacuucgucaccaugcucaaaaugguguggaucagcaaggccucugcuauucagcgcaaagggagagccggccggugucgccccggaaucugcuuuagacuguucagccggcugcgcuuucagaauaugcuugaguuccaaacaccugaacuccugagaaugccccugcaggaacucugccugcacaccaaacuucuggcgccgguuaacuguccuauugccgauuuucucaugaaggcucccgagccucccccugcccugaucgugcggaaugcuguccagaugcugaagacgaucgacgccauggauacaugggaagaccuuaccgagcucggcuaccaccuggccgaucugcccguggagccgcaucucgggaagaugguucugugcgcugugguccuuaaaugucuggacccuauucucacaaucgcgugcacccuggccuaucgcgaucccuucgugcugcccacccaggcuucccaaaagagagccgccaugcuuugucggaaacgcuuuacagcuggagccuucagcgaccacauggcgcugcucagagcuuuucaggccuggcagaaggcccggucugauggcugggaaagagcuuucugcgagaaaaacuuucugucccaagccacgauggaaauuaucauugggaugcgcacccagcuccugggacagcuucgggcgagcggcuucgugagagcucgcgggggcggagacauccgggaugucaauacaaacuccgagaacugggccguugugaaggccgcucugguggccggcauguacccuaaucucguccauguggacagagagaaccugguucugaccgggccgaaggagaaaaaggugcgcuuccaccccgcuucuguccuuagccagccucaauacaaaaagauucccccugccaauggacaggcggccgcuaucaaagcccugcccacagauuggcucaucuaugacgaaaugacccgggcucacagaauugccaacauccgcuguugcuccgccgugacgccuguuacaauucugguguuuuguggccccgcucggcucgcgucuaaugcccugcaggaaccgagcuccuucagagucgacgggaucccuaacgauucuagcgacuccgagauggaagauaagaccaccgcuaaucuugccgcccugaagcucgacgaguggcugcauuuuacacuggagcccgaagcugccagccuucugcuccagcugcggcaaaaauggcacucucucuuccugcgcagaaugcgggcgccuuccaagcccuggagccagguggaugaggcuaccauccgcgccauuaucgccguucuuucuacagaggaacaguccgcuggacugcaacagccgagcggcauugggcagagaccucggcccaugucuuccgaggaacugccucucgccagcuccuggagaagcaacaauucucgcaaaagcuccgcggacacggaguuuucugaugaaugcaccacagcugagcgggugcugaugaaaagccccucccccgcccuucauccuccgcagaaguacaaggacagaggcauccugcaccccaagcgcggaaccgaagaucggucugaccaaagcucccucaaaucuacagauagcuccagcuauccuucucccugugccuccccuucucccccuagcuccggcaaggggagcaaauccccgucucccagaccuaacaugcccguccgcuacuucauuaugaaaagcuccaaucugcggaaccucgagaucagccagcagaagggaauuuggucuaccacgccuuccaaugaaagaaagcugaaccgcgcuuuuugggagagcucuaucguguaucuuguguucagcguccagggcuccgggcauuuucaaggauucucuagaaugagcuccgagaucggccgggaaaaaucucaggacuggggcagcgccgggcugggaggcguuuuuaagguggaguggauucgcaaggaaucccugcccuuccaguucgcucaccaccuccugaauccguggaacgacaacaaaaaggugcagaucagcagagaugggcaagagcuugagccucuggucggagaacagcuccugcagcucugggagcggcugccccuuggcgagaaaaauaccacagacuga

SEQ ID NO: 78003 - RNA, 741 nt, Artificial Sequence
  derived and/or modified sequence opt5 from YWHAB__Homo_sapiens__NP_647539
augaccauggacaagagcgagcuggugcagaaagccaagcucgcugaacaagccgagagauacgaugacauggcggcugccaugaaagccgucacagaacagggccacgagcuguccaacgaagaacggaaucuucugucuguugcuuauaagaacguggugggggcccgcagaagcuccuggcgggucaucucuagcauugagcagaaaacggaacgcaaugagaagaagcagcaaaugggaaaagaauacagagagaagaucgaggcugaacuccaggauauuugcaacgacgugcuggagcuucuggauaaauaucucauccccaaugccacccagccugaauccaagguuuucuaccugaaaaugaagggcgacuauuuucgguaccugucugagguggcgagcggggauaacaagcagacaaccgucuccaauagccaacaggccuaucaggaggcuuucgagauuucuaaaaaggagaugcagccgacacaucccauccgccucggacuggcccuuaacuuuuccguguucuacuacgaaauccugaauagcccugagaaggcuuguucucucgccaaaaccgcguuugacgaagccauugcugagcuggauacacuuaacgaagaguccuauaaagacagcacccugaucaugcaacuccugagagauaaucugacgcucuggaccucugagaaccagggcgacgaaggggaugccggagagggcgaaaauuga

SEQ ID NO: 78004 - RNA, 768 nt, Artificial Sequence
  derived and/or modified sequence opt5 from YWHAE__Homo_sapiens__NP_006752
auggacgauagagaggaccugguguaccaggccaagcucgcugaacaagccgagcgguaugaugaaauggucgagagcaugaaaaagguugcgggcauggacguggaacugaccguggaggagcgcaaccuucuguccgucgcuuacaaaaaugugaucggggccagacgggccucuuggcgcauuaucagcuccauugaacagaaggaggaaaacaaaggaggcgaggauaagcucaagaugaucagagaguaucggcagaugguugaaacagagcugaaacuuauuugcugugacauccuggaugugcucgacaagcaccugauccccgcugccaauacgggggaaucuaaagucuucuacuauaagaugaaaggagauuaccaucgcuaucuggcugaguuugccaccggcaacgacagaaaggaagcggccgagaauagccucguggcuuacaaggccgcuuccgauauugccaugacagagcugccuccgacccaccccauccggcuugggcuggcgcucaacuucucuguguuuuacuaugaaauucugaauagcccugaccgcgccugcagacuugcuaaagccgcuuucgaugacgccaucgccgagcuggacacacucuccgaagagagcuacaaggauucuacccugauuaugcagcugcuccgggacaaccugacacuuuggaccuccgauaugcaaggagacggcgaggaacagaauaaagaggcucugcaggauguugaagacgagaaccaguga

SEQ ID NO: 78005 - RNA, 744 nt, Artificial Sequence
  derived and/or modified sequence opt5 from YWHAG__Homo_sapiens__NP_036611
augguggacagagagcagcugguccaaaaggcccggcucgcugaacaggccgagcgcuacgaugacauggcggcugccaugaaaaacguuaccgaacugaaugagccccuuagcaacgaagagagaaaucugcucuccguggccuauaagaacguggucggcgcucggcgcucuagcuggagagugaucuccucuauugagcagaaaacaagcgccgaugggaaugaaaagaaaaucgagaugguucgggcuuaccgcgaaaagauugagaaggagcuggaagccgugugccaggacguccuuucccugcucgauaacuaucugaucaaaaauuguucugagacgcaauacgaaagcaagguguucuaucugaaaaugaagggagacuacuauagauaccucgcggagguugccaccggcgaaaaacgggcuacaguggucgaguccagcgagaaggccuacucugaagcucacgagauuuccaaggaacauaugcagccuacccacccgauccgccuggggcuugcccugaacuauagcguguuuuacuaugagauccagaaugcgcccgaacaggccugccaucucgcuaaaacagccuucgaugacgcuauugccgagcuggauacccuuaacgaggacucuuacaaggauuccacacugaucaugcaacuccugagagacaaucugacccucuggacgagcgaucagcaggacgacgauggaggcgaagggaacaauuga

SEQ ID NO: 78006 - RNA, 741 nt, Artificial Sequence
  derived and/or modified sequence opt5 from YWHAH__Homo_sapiens__NP_003396
augggcgacagagagcagcugcuccaacgggcccgccuggcugaacaggccgagagauacgaugacauggcgagcgcuaugaaggccgugaccgaacuuaacgagccccuguccaaugaagaucggaaccuccugucugucgccuauaaaaauguugugggggcucgcagaagcuccuggcgggugaucucuagcauugagcagaagacaauggccgacggaaacgagaaaaagcuggaaaaagucaaggcuuaccgcgagaagaucgaaaaagagcuugagacggugugcaaugauguucucucccugcuggacaaguuccucauuaaaaacuguaaugauuuucaguaugaaucuaagguguucuaccugaaaaugaagggcgacuauuacagauaucuugccgaggucgcgagcggggaaaagaaaaacuccgugguugaggccagcgaagcugccuacaaggaggcuuuugagaucucuaaagaacaaaugcagccuacccacccgauucggcugggacucgcccugaauuucuccguguuuuacuaugagauccagaacgcgcccgaacaggccugccuucuggcuaagcaagccuucgaugacgcuaucgccgagcucgauacacugaaugaagacagcuacaaagauucuacccugauuaugcagcuccugcgcgacaaccuuacacuguggaccuccgaccagcaggaugaggaggccggcgaagggaauuga

SEQ ID NO: 78007 - RNA, 738 nt, Artificial Sequence
  derived and/or modified sequence opt5 from YWHAQ__Homo_sapiens__NP_006817
auggagaagaccgaacugauccagaaagccaagcucgcugagcaagccgaaagauacgacgauauggcgacaugcaugaaagcugugacggagcagggcgccgaacugagcaacgaggagcggaaucuucuguccgucgccuauaagaacguugucgggggacgcagaucugcuuggcgggugauuagcuccaucgaacagaaaaccgacacaucugauaagaagcuccagcugauuaaagacuaccgcgagaagguggaaagcgagcuuagauccaucuguaccacagugcuggagcuccuggauaaauaucugauugccaaugcuaccaaccccgaaucuaagguuuucuaccucaaaaugaagggcgacuauuuucgguaccuggccgagguggcgugcggggaugaccgcaagcaaacaaucgauaauagccagggagccuaucaggaggcuuucgacaucuccaaaaaggaaaugcagccuacccacccgauuagacuuggccuggcccucaacuuuagcgucuucuacuacgaaauccugaauaaccccgagcuugcuuguacgcuggccaaaaccgcguuugaugaggccauugcugaacucgacacacugaaugaggauucuuauaaggacuccacccugaucaugcaacuccugcgggacaaccuuacacuguggaccagcgauucugccggggaagagugcgacgcugccgaaggagccgagaauuga

SEQ ID NO: 78008 - RNA, 738 nt, Artificial Sequence
  derived and/or modified sequence opt5 from YWHAZ__Homo_sapiens__NP_001129172
auggacaagaacgagcuggugcagaaagccaagcucgcugaacaagccgagagauacgaugacauggcggcuugcaugaaaagcgucaccgaacagggcgccgagcuguccaaugaggaacggaaccuucugucuguugccuauaagaauguggugggggcucgcagaagcuccuggcgggucgugucuagcaucgagcagaaaacagaaggagccgagaagaagcagcaaauggcucgcgaauacagagagaaaauugagacggaacuccgggauaucuguaacgacguucugucccuucuggagaaguuccucauucccaaugccucucaggcggaaagcaaaguguuuuaucugaagaugaaaggcgauuacuaucgcuaccuggccgaggucgcugccggggacgauaagaagggaaucguggaccagucccagcaggcuuaucaagaagccuucgagauuagcaaaaaggagaugcagccuacccacccgaucagacucggccuggcgcuuaacuuuucuguuuucuacuacgaaauccucaauucccccgagaaagccugcagccuggcuaagacagccuuugaugaagcuauugccgagcuggacacccuuucugaagaguccuauaaagauagcacacugaucaugcagcuccugcgggacaaccugacccucuggacaucugauacccaaggggacgaggccgaagcuggagagggcggcgaaaauuga

SEQ ID NO: 78009 - RNA, 2667 nt, Artificial Sequence
  derived and/or modified sequence opt5 from YY1AP1__Homo_sapiens__NP_001185832
auggccggcguggggagaagcggaggccccugggggcggacccgcggaggcagauccgggcggcugggagucucucucggcgcucugagcucccuuccucuggaggaacucccgcgcccccugugcuguagacggugccgcagacacuucggcuuugcccuucgcggggagacaaucccuguuucuguggcgggaagcgcuuccucucaguucgcuccccuggcccuccaucugagccugcuccugucccggauuagcgccucuagacuuacgcgguggccucccccugacaagcgcgaaggcuccgccguggauccggggaaaagacggagccuggcugccacccccucuuccagccucccuuguacacugaucgcgcuuggacugcgccacgagaaggaagccaacgagcucauggaggaccuguuugaaaccuuccaagaugagaugggcuuuucuaauauggaagacgaugggcccgaggaggaagagagagucgcugaaccucaggccaacuucaauacaccccaggcucugcgguuugaggaacuccuggccaaccuucugaaugagcagcaucaaauugcgaaagaacucuucgaacagcugaagaugaaaaagccguccgccaagcagcagaaagagguggaaaagguuaaaccucaaugcaaggaggugcaccagacccuuauccuggaccccgcucagagaaaacgccuccagcaacagaugcagcaacauguccagcugcugacacagauucaccuccuggccaccuguaacccuaaucuuaaccccgaagcuagcuccacgcggaucugccugaaggagcucggaaccuuugcccagucuagcaucgcccugcaccaucaauacaaucccaaguuccagacacuuuuucagccuuguaaccugaugggcgcuaugcagcucauugaggauuucuccacccacgugagcaucgacugcucuccgcauaaaacaguuaagaaaaccgcgaaugaauuucccugucugccuaagcaaguggccuggauucuggcuacguccaaagucuucauguaucccgagcuccugccugugugcagccuuaaggccaaaaacccccaggauaagauccuguucacaaaggccgaagacaaucuccuggcucugggccuuaaacacuuugaggggaccgaguuccucaacccgcugauuucuaaguaccugcucacauguaaaaccgccagacagcugaccgugcgcaucaagaaucuuaacaugaaccgggcgccugauaauauuaucaaauuuuauaagaagacaaaacagcugcccguccucggaaagugcugcgaggagauccaaccucaccaguggaaacccccuauugaaagagaggaacaucgccugcccuucuggcugaaggcuagccuuccguccauccaggaggagcuccggcacauggccgacggcgccagagaaguugggaacaugacgggaaccacagagauuaauucugaucagggccuggaaaaagacaacagcgagcugggguccgaaacccgcuacccucuccugcuucccaagggaguggugcugaagcucaaacccgucgcugaccgguuuccuaagaaagccuggagacaaaagcgcagcucugugcugaaaccgcugcuuauccagcccuccccuagccuccagcccucuuucaauccuggcaagacacccgcucaauccacccauagcgaggccccucccuccaagaugguucugcggauuccgcacccuauccagcccgcgacggugcugcagacagucccuggcgugcccccgcucgggguuucuggaggcgagagcuuugaauccccugccgcucugcccgccaugccucccgaggcuagaaccucuuucccccuuagcgaaucccagacccugcucagcucugccccugugccgaaagucaugaugcccuccccugcgagcucuauguuucggaagcccuaugugcgcagacggccuuccaaaagacgcggggcccgggcuuucagauguaucaagcccgccccugucauucauccggcuagcgugaucuuuacaguucccgccaccacagugaaaauugucucucugggaggcgggugcaacaugauccaaccugugaaugccgcuguugcgcagagcccccagacgauuccuaucgccacccugcuugugaaccccacauccuucccguguccucucaaucagccccuggucgcuagcucugugagcccccugaucguguccggcaacuccguuaaucucccuauucccucuaccccugaggauaaggcccacaugaacgucgacaucgccugcgcuguggccgauggagaaaaugcguuucaaggccuggagccgaaacuugagccccaggaacugagcccucucuccgcuacaguguuccccaaggucgagcacucuccugggcccccgccuguggacaagcagugucaggaaggacugagcgagaacuccgccuaccgcuggaccguugugaaaacggaagagggcagacaagcccuggagccccuuccucaggggauucaggaaucucugaauaacagcucccccggagaucucgaggaagucgugaagauggagccugaggacgcuaccgaagagaucagcggcuuccuguga

SEQ ID NO: 78010 - RNA, 1245 nt, Artificial Sequence
  derived and/or modified sequence opt5 from YY1__Homo_sapiens__NP_003394
auggccagcggcgacacccuguacaucgcuacagauggguccgagaugcccgccgaaauuguggagcuccacgaaaucgaggucgaaacgauuccuguugagaccaucgagacaaccguggugggagaagaggaagaggaggacgaugacgaugaagacggcgggggaggcgaucaugggggaggcggcgggcacggacaugcgggccaccaucaccaccaucaccaucaccaccaucacccgcccaugauugcucugcagccucuugucacagacgaucccacccaagugcaucaccaucaggagguuauccuggugcagacaagagaagaggucguugggggagacgauucugacggccuccgggccgaagauggguucgaggaccagauccugauuccugugcccgccccugcuggaggcgacgaugacuauaucgagcaaacccuugugacggucgccgcugccggcaagagcgggggaggcggguccucuagcuccggaggcgggcgcgugaaaaagggaggcggcaaaaagucugggaaaaagagcuaccuguccggaggcgcgggggccgcuggaggcgggggcgccgauccgggaaacaagaaaugggaacagaaacaggugcagauuaagacccucgagggcgaauuuagcgucacaauguggucuuccgacgagaagaaagauaucgaccacgaaaccguuguggaggagcaaauuaucggggaaaauucucccccugauuauagcgaguacaugacaggaaagaagcugcccccuggcgggauucccggaaucgaccuguccgauccgaaacagcucgcugaguucgccagaaugaagccucggaaaaucaaggaagacgaugcgccccgcaccauugccugcccucacaaaggcuguacgaagauguuuagagacaacagcgcuaugcggaaacaucugcacacacaugggccccgcgugcacgucugcgccgaauguggcaaggcuuucguggagucuuccaaacuuaagagacaccagcugguucauaccggagagaagcccuuucagugcacauucgaaggcugugggaaacgguuuagccucgacuucaaucugcgcacccacgugagaauccauaccggagaucggccuuaugucugcccguuugacggcuguaacaagaaauucgcccaauccacaaaucuuaagucucacauucugacgcaugccaaggcuaaaaacaaucaguga

SEQ ID NO: 78011 - RNA, 1239 nt, Artificial Sequence
  derived and/or modified sequence opt5 from ZACN__Homo_sapiens__NP_851321
augauggcccuguggagccuccugcaccuuaccuuccugggcuuuuccaucacacuccugcuugugcaugggcagggauuccaaggcacggcugccauuuggcccucucuguuuaacgucaaucucagcaagaaaguucaggaguccauccagauuccuaacaaugggucugcgccgcugcugguggacgugagagucuucgugagcaacguuuuuaauguggauauccuccgguacaccauguccucuaugcugcuucugcgccucagcuggcuggacacaagacuugcuuggaacaccuccgcccacccccggcaugccauuacacugccuugggaaagccucuggacaccccgccugaccauccuggaggcucucugggucgauuggagagaccagucuccucaagcccggguggaucaggacggacacguuaagcugaaucuugcucuggccaccgaaacgaacugcaauuucgagcuccugcauuuuccccgcgaucacuccaacuguagccuuucuuucuaugcgcuguccaauaccgccauggaacucgaguuucaggcucacguggucaacgagaucgugagcgugaaaagagaauacgucguuuaugaccugaagacacaggugccuccgcaacagcuggugcccugcuuccaggucacccuccggcugaaaaauacagcccuuaagucuauuaucgcucugcucgugccugccgaggcgcugcuucuggccgauguuuguggcgggcuccugccccugcgcgcuauugaaagaaucggauacaaggugacccuccugcuuuccuaucugguccuccauagcucccuggugcaggcccugccuucuagcuccagcugcaacccccuucucauuuacuauuuuacgauccugcugcuccugcuuuuccugucuacaauugagaccguucuccuggcuggccugcuugcccggggcaaucucggggccaaauccggaccgagcccugcuccccgcggcgagcaaagagaacacgggaacccuggaccccaucccgcggaggaaccuucucggggcgugaaggggagccagcgcuccuggccggagacagccgacagaaucuuuuuccuggucuacguggucggagugcuguguacccaguucguuuuugcuggcaucuggaugugggccgccugcaaaucugaugcugcccccggcgaagcggcuccucacgggcggagaccccgccucuga

SEQ ID NO: 78012 - RNA, 1368 nt, Artificial Sequence
  derived and/or modified sequence opt5 from ZAK__Homo_sapiens__NP_598407
augagcucccugggcgccucuuucgugcagaucaaguuugacgaucuccaauucuuugagaacugcgggggaggcagcuucggguccgucuacagagcuaaauggauuucucaggacaaggaaguugccgugaaaaagcugcuuaaaaucgagaaggaagcggagauucugagcgugcucucccaccggaauaucauucaguuuuauggagucauccuggaacccccuaacuacggcaucgugaccgaguaugcuucucuugggagccuguacgauuauauuaauuccaaccgcagcgaggaaauggacauggaucauaucaugacaugggccacggacguugccaagggaaugcacuaccuccauauggaggcuccggugaaagucauucacagagaucugaagucucggaaugugguuaucgccgcugacggcgugcugaaaauuugugauuucggcgccucccgcuuucauaaccacaccacacacaugagccucgucgggaccuuccccuggauggcgccugaagugauccagucucugcccguguccgagacaugcgacaccuauagcuacggagucguucuuugggagaugcugacaagagaagugccuuuuaagggccucgaggggcugcaaguggccuggcuugucguggagaaaaaugaacggcugaccauucccucuuccuguccucgcagcuucgcugaacuccugcaucagugcugggaggccgaugcuaagaagagaccguccuuuaaacagaucaucucuauucuggagagcauguccaacgacacgagccuccccgauaaguguaauucuuuccugcacaacaaagccgaauggcggugcgagaucgaagcgacccuugagcgccugaagaaacucgaaagagaccuguccuuuaaggagcaggagcuuaaagaacgggagcgcagacugaagaugugggaacaaaagcucacagagcagagcaauaccccucugcugcucccccuggccgcucggaugucugaagagagcuacuucgaguccaaaacagaagagucuaacagcgccgaaauguccugucagauuaccgcuacgagcaauggagagggccaugggaugaacccuucucuucaggccaugaugcugaugggauucggcgacaucuuuuccaugaauaaggccggcgcuguuaugcacagcgggaugcaaauuaacaugcaggcgaaacagaacucuuccaagacaaccagcaaacgcagaggaaagaaggugaauauggcccucggcuucuccgauuuugaccugucugagggggaugacgaugacgaugacgauggagaagaggaagacaacgauauggacaauagcgaguga

SEQ ID NO: 78013 - RNA, 1860 nt, Artificial Sequence
  derived and/or modified sequence opt5 from ZAP70__Homo_sapiens__NP_001070
augcccgacccugccgcucaccuuccguucuuuuacggcagcaucuccagagccgaggcggaggaacaucucaagcuggcugggauggccgauggacuuuuccugcuccggcagugccugcgcucucuuggcggguaugugcugagccucguccacgacguuagauuucaucacuuccccauugaacggcaacugaacggaaccuacgccaucgcuggcgggaaagcccauuguggaccugcugagcugugcgaauuuuauucccgcgaucccgacggccucccuuguaaucugagaaagcccugcaaccggccuucuggccuugagccgcagcccgggguguucgauugucugcgcgacgccauggugagagauuacguccggcagacauggaaacucgagggagaagcgcuggagcaggccauuaucagccaagcuccucagguggaaaaacuuauugccacgaccgcucacgagcgcaugcccugguaucacuccucucugacaagagaggaagccgagcggaaacucuacagcggcgcgcagaccgacgggaaguuucugcugcgcccuagaaaggaacagggaacauaugcccucucccugaucuacggcaaaaccguuuaccauuaucuuaucagccaagauaaggcugggaaauacugcauucccgagggaacaaaguucgacacccuguggcagcucguggaauaucugaaacuuaaggccgauggccugaucuacugucucaaggaggcuugccccaauucuuccgccagcaacgccucuggcgcugcggccccuacgcugcccgcucacccuuccacccugacacauccccagcggcgcauugacacccucaauagcgauggguauacacccgagccugccagaaucaccucuccggacaaaccccggccuaugcccauggacacguccgucuacgaaagcccuuauuccgaucccgaggaacugaaggacaaaaagcuguuucugaaaagagauaaccuccugauugccgacaucgagcuuggauguggcaauuucgggucugugcgccagggaguuuaccggaugagaaagaaacaaauugauguggcuaucaagguccugaagcagggcacagaaaaagccgacaccgaggagaugaugcgcgaagcgcagaucaugcaccaacucgauaacccguacauugugcggcugaucggggugugccaggcugaggcccugaugcucgucauggaaauggccggaggcggcccucugcacaaguuucuuguugggaaaagagaggaaauucccgugagcaauguggcugagcugcuccaucaggucuccaugggaaugaaguaucuggaggaaaagaacuucgugcaccgcgaccuggccgcucggaauguucuucucgugaacagacauuacgccaagaucagcgauuuuggccugucuaaggcgcugggggccgacgauuccuauuacacagcucgcagcgccggaaaauggccucucaagugguaugcucccgaguguauuaauuuccggaaauucucuagcagauccgacgucuggucuuacggcgugaccaugugggaagcccugagcuaugggcagaagccuuacaaaaagaugaagggccccgagguuauggcguuuaucgagcaaggaaaacgcauggaaugcccgccugagugcccgcccgaacuuuacgcccugauguccgacuguuggaucuauaagugggaggaucggccugacuuccucaccguggaacagagaaugcgggcuugcuacuauagccuggccucuaaagucgagggcccgcccggguccacacagaaggcugaggccgccugugcuuga

SEQ ID NO: 78014 - RNA, 1275 nt, Artificial Sequence
  derived and/or modified sequence opt5 from ZAR1__Homo_sapiens__NP_783318
auggccgcucugggcgacgaggugcucgauggguacgucuuccccgccugcccuccguguagcuauagauaccccuauccugcggcuaccaagggaaaaggcgccgccgggggauccuggcagcaacggggccgcgggugccugcccgcuucuagcccuuguuccgccggagcugccucucuuagcuuucccggcugcggcagacugacagcggccgaauacuucgacuccuaucagcgggagcgccucauggcucugcuugcccagguugggccuggacugggcccgagagcucggcgcgccgggucuugugauguggcggugcaggucagccccagaaucgacgccgcugugcaaugcucccucggacggcgcacgcugcagagacgggcccgcgauccugaaagccccgcuggcccuggggccgagggaaccacaggcggcgggucuuuuucccagcagcccagcagacggggacuggaacaaggcucuccgcagaacggggccccucgccccaugagauucccucggaccguugcuguguacagcccccucgcgcugagacgccuuacagccuuucuggagggacccggcccugcugccggggagcagcgguccggagccucugacggcgaaagaggcccgcccccugcucgccuccaggggcccgaggaaggagaggucuggaccaagaaagccccucggagaccccaauccgaugacgauggcgaggcgcaggcugccgugcgcgccagcugggaacagccggcugacgggccugagcugcccccucgggaagcccaagagggagaagcugcccccagauccgcgcuucgcucuccuggccagcccccgagcgccgggcgggcuagagauggcggagacggccgcgaggccgcuguugccggggagggaccuagcccccggucccccgaacugggcaaggagagacuccgguuccaguuucuggaacagaaauauggguacuaccacuguaaggauugcaauauucgcugggagucugcguaugugugguguguccaaggaacaaacaagguguacuucaaacaguuuugcagaaccugucagaaguccuauaauccuuaccggguggaagacaucacgugccagagcugcaaacaaaccagauguucuugcccggucaagcugcgccauguugaccccaaacggccucacagacaggaucucuguggccgcugcaaggggaagagacugagcugugacuccacauucucuuuuaaauauauuaucuga

SEQ ID NO: 78015 - RNA, 966 nt, Artificial Sequence
  derived and/or modified sequence opt5 from ZAR1L__Homo_sapiens__NP_001130043
auggagagauucgugcggguccccuacggccuguaucagggguacggaagcaccguuccucucggccaaccggggcuguccggacacaagcagcccgacuggcgccagaacaugggcccucccacauuucuugccagaccugggcugcucgugcccgcuaaugccccugauuauugcaucgacccguacaaacgggcgcagcugaaggcuauucuuucucaaaugaaccccagccuguccccucgccucuguaaacccaauacgaaggaagugggaguccaggugucuccuagaguugauaaagccgugcagugcagccugggcccccggacccuguccucuuguagcccgugggacggccgcgauccucaggagccccucccugccugcggggucacaucccccgcuaccggaagacggggccugauccgccuuagacgggacggggaugaagccgagagcaaggcucugcccggaccugccgaagcgucucaaccgcagcccccuucccgcagaagcggcgccgaccggcaggaggagcccgggcagcucgaagagucuggagaaaaggaugcuccuuguccccaagagacaaaauccaaacaggugccgggcgacgccgcuagcgagccucugcgcagacccaacuuccaguuucuugaaccuaaguauggcuacuuccauugcaaggauuguaaaacccggugggagucugccuauguuuggugcauuuccgggacaaauaagguguacuuuaagcaacuguguugcaaaugucaaaagagcuucaaccccuacagagucgaagcgauccagugccagaccugcuccaaaucucacuguagcugcccucagaagaaacgccauauugaccuccggagaccccaccgccaggagcuguguggacggugcaaggauaaaagauuuuccuguggcaauaucuauagcuucaaguacgugauguga

SEQ ID NO: 78016 - RNA, 507 nt, Artificial Sequence
  derived and/or modified sequence opt5 from ZASP__Homo_sapiens__NP_001276862
augcccgccagccacgcuccuggcgccuccgcgaacccgcccugccaucugccuucugugaucgcugacagcuuccucgccucccaccugucucccagcccugagagaaccgucaugcuuggguccgcccccgauccucugccgcaggcuggaucucggcgcggccauagaggggaggccaaucccgcuccuagcccccggucccacugugccagcccuacaacgucuuggaagcgcagaggaccccgggagggcgcguccccgaccagccuccugucuuccacaccuugcuggaccgggcuucgcggagaaggcggcgggacaggacccaccccucccggcacacccggggccgaggacgcuccuggacugagagcccuccgggaagcucgcggcgaagggggacugggccugggcacccucgggcugccggccuggcuuccccugggaagcagaguuuggguggagggcccucgggugucucaagucuccugucagccccaguga

SEQ ID NO: 78017 - RNA, 2085 nt, Artificial Sequence
  derived and/or modified sequence opt5 from ZBED1__Homo_sapiens__NP_001164606
auggagaacaagagccuggaauccucucagaccgaccucaaacugguggcccaccccagagcuaagagcaaagucuggaaguacuucggcuuugauacaaaugccgaggggugcauccuucaauggaaaaagauuuauugucggaucugcauggcgcagauugcuuacuccggaaacacgucuaaucugagcuaucaucucgaaaagaaccacccugaggaguucugugaauuuguuaaauccaauaccgagcagaugcgcgaagccuucgccacagcuuuuucuaagcugaaaccggagagcucccagcaacccggccaggacgcccuugcugugaaggccgggcauggauacgauagcaaaaagcagcaggaacugaccgcggccgugcucggccugaucugcgaggggcuguauccugcuucuauugucgacgagcccacauucaaggugcuccugaaaaccgccgauccuagauacgaacuucccucccggaaguauaucagcacaaaagcuaucccugagaaguacggagccguucgcgaagugauucugaaagagcucgcggaagccaccugguguggcaucucuacggacauguggagauccgagaaccaaaaucgggcuuacgucacccuggccgcucacuuucuuggccugggggccccgaacugccucagcaugggaucucgcugucugaagacauucgaggugcccgaagagaauaccgccgaaacaauuaccagaguucuguaugagguguuuaucgaauggggcauuuccgcuaaagucuucggggcgacgacaaacuacggaaaggauaucgugaaggccugcagccuccuggacguggcuguccauaugccuugucuuggccacaccuuuaaugccgggauucagcaggccuuccagcugcccaaacucggagcucugcuuucccggugccgcaagcugguugaguauuuucaacagucugccguggcgauguacaugcucuaugagaaacagaagcaacagaacguggcucacuguaugcuggucagcaauagaguguccugguggggcagcacacuggccaugcuccagcggcugaaagaacagcaauucguuaucgccggcgugcuugucgaggauucuaacaaucaucaccugaugcucgaggcuuccgaaugggccaccaucgaagggcugguggagcuucugcagccuuucaagcagguugcugagaugcucagcgccucucgcuaccccaccauuagcauggugaagccgcugcugcauaugcuccugaacacaacgcuuaacaucaaagaaaccgacuccaaggagcugucuauggcgaaagaagucauugccaaggagcucagcaaaacauaucaggagaccccugaaaucgauauguuucugaauguggcuacauuccuggaccccagauacaagcggcuuccuuuucucuccgccuucgagcgccaacaggucgaaaacagagugguugaggaagcuaagggacugcuggauaaagugaaggacggcggguaccggcccgccgaggacaaaauuuuucccgucccugaggaaccgcccgugaagaaacucaugagaaccagcacgccucccccugcgucuguuaucaauaacaugcuggccgagaucuucugccagacaggaggcguggaagaucaggaggaauggcacgcucaagucguggaggagcuuuccaauuuuaagagccagaaggugcuggggcucaacgaagacccccugaaaugguggucugaucgccuggcccuuuucccgcuccugccuaagguucugcagaaauauuggugcgucaccgcuacccggguggcccccgagagacucuuuggauccgccgcuaauguggucagcgcgaagcgcaaccggcuggccccugcucacguggacgaacagguuuuccuuuacgagaaugccagauccggcgccgaagcugagcccgaggaucaagacgaaggcgagugggggcuggaucaggaacagguguuuucucucggagacggcgucagcgggggauucuuuggcauucgcgauuccucuuuccuguga

SEQ ID NO: 78018 - RNA, 3516 nt, Artificial Sequence
  derived and/or modified sequence opt5 from ZBED4__Homo_sapiens__NP_055653
auggagaacaaucugaagaccugccccaaagaagacggcgauuucgugagcgacaagaucaaauuuaagauugaggaagaggaugacgaugggaucccuccggacucccucgaaagaauggauuucaaaucugagcaggaggacaugaagcaaacagauagcggaggcgaacgggccgggcugggaggcacgggguguuccugcaagcccccuggaaaauaccuuucugcugagagcgaagacgauuauggcgcccuguuuucccaguacucuagcacccucuaugacgucgcgauggaggcuguuacacagucccugcuuagcucucgcaacauguccagcagaaagaaaucucccgccuggaagcacuucuuuauuuccccucgggauagcaccaaagccaucuguauguacugcgugaaggaguucucucgcggcaagaaugaaaaagaccuguccacaagcugucucaugagacaugugcggcgcgcucaccccaccguccugauucaggagaacggguccgugucugccguuagcuccuuuccuagcccgucucugcuccugcccccucaacccgcugacgccggagaucuuuccacaauccugagcccuaucaagcucgugcagaaagucgcgucuaagauucccagcccggacagaaucaccgaagaguccgugucuguugugagcuccgaagagauuagcucugauauguccgucagcgagaaaugcggccgggaagaggcccugguggggucuuccccucaucuucccgcucugcacuaugacgaaccugccgagaaucucgcugaaaagagccugccccugcccaaauccacgucuggaagccgcagacgguccgccguguggaagcauuucuaccucucuccucuggauaacagcaaggcggucuguauccacugcaugaaugaguuuucccgcggcaaaaacgggaaggaccuuggaaccagcugucugauuagacacauguggcgggcccaucgcgcuaucguucuccaggagaauggcggcacagggauuccgccccuguauucuaccccucccacacuucugccuucccuccugcccccggaaggagagcugagcucuguguccagcucuccugugaaacccgucagagaaagcccuuccgccuccucuucccccgaucggcucaccgaggaccugcagagccaccuuaacccuggcgaugggcugauggaagacguggcugccuucuccucuagcgaugacaucggagaggccuccgcuucuagccccgagaagcaacaggcggacggccucuccccgagacuguuugaaucuggggccaucuuccagcagaauaaaaagguuaugaagcgccuuaaaagcgagguguggcaucacuuuucccuggcuccuauggauagccucaaggccgaaugccgguacuguggaugcgccauuucuagaggcaaaaagggcgacgucgggacguccugccugaugcgccaccuguaccggagacaucccgaggugguuggaagccaaaaaggcuuccucggggcuucucuggccaacucccccuaugcgacacuugcuagcgccgagucuuccagcuccaagcugaccgaucucccuacaguggucaccaagaauaaccaggugauguucccggucaauagcaaaaagaccucuaaacuguggaaccacuuuagcaucuguuccgccgacucuacaaaggugguuugccugcauuguggacgcacgauuagccggggcaaaaagcccaccaaccuugggacauccugccuccugagacaucugcagcgcuuccacucuaaugugcucaagaccgaagucagcgagacagcucggccuuccucucccgauaccagagugccucgcggcacggaacugagcggagccuccagcuuugacgauacaaacgagaaauucuacgacucucaccccguugcuaagaaaaucaccucccuuauugccgaaaugaucgcgcuggaucuccaaccuuauagcuuuguggacaaugucggcuucaaccggcugcuggaguaccuuaagccccaguauucucucccggccccuuccuacuuuagcagaaccgcuauccccgggauguaugauaaugugaaacagauuaucaugucccaccugaaggaggccgaaucuggagugauucauuucacaagcggcaucuggauguccaaccagacccgggaguaccugacacucacggcucacuggguuagcuuugaaucuccugcccgccccagaugugacgaucaucacugcuccgcgcugcuugacgucagccaaguggacugugauuacucugggaauagcauucagaaacagcuggagugcuggugggaagccugggugaccuccacaggacuccaggucggcaucaccgugacagacaacgcuucuaucgggaagacccugaaugagggcgagcacagcuccguucaauguuucucucauacggugaaccugauugucagcgaagccaucaagucccagcggauggugcagaaucuucucagccuggcuagaaaaauuugcgagcgcguucaccggucuccgaaggccaaagaaaagcuggccgagcuccagagagaauaugcucugccucaacaucaccuuauccaggaugugcccuccaaauggagcaccuccuuucauaugcuggagcgccucauugagcagaagagagcgaucaacgaaaugucugucgaguguaauuuccgggaacugauuagcugcgaccagugggaggugaugcaauccguuugccgcgcccugaagccuuuugaggcugccucuagagaaaugagcacacagauguccacccuuagccaggugauccccaugguccacauccucaaccggaaaguggagaugcuguucgaagagacaaugggaauugauaccaugcugcgcucucucaaggaagccaugguguccagacugagcgcuacgcuucacgacccccgguacgucuucgccacacugcucgauccucgcuauaaagcgucucuguuuaccgaggaggaagcugagcaauacaagcaggaccugaucagagaacuugagcugaugaauagcacaagcgaagauguugccgccucucaucggugugacgcuggcagcccguccaaagauucugccgcggaggagaaccucuggagccugguggcuaaggugaagaaaaaggacccccgcgaaaaacucccugaggccaugguccuggccuaucuugaagaggaagugcuggagcacuccugcgauccccucaccuacuggaaccugaagaaagcuagcuggccugggcuguccgcccuugcuguuagauuccugggaugucccccuucuauugugccgagcgagaagcucuuuaauacccccacagaaaacggcucccuggggcagucucggcucaugauggagcauuucgaaaagcugaucuuucuuaaagucaaucugccucucauuuauuuccaguacuga

SEQ ID NO: 78019 - RNA, 2082 nt, Artificial Sequence
  derived and/or modified sequence opt5 from ZBED5__Homo_sapiens__NP_001137139
augaucgcuccccugcucugcauucugagcuacaacuucaauaccuuugccauccuuaacguguauuccaagcugacaauguucuguacgaccaauucucucccuauggaccugcuucugaaacagggcagccucaagcaagaggucgaauccuuuugcuaccagauuguuucugagagcaacgaucagaaaguggggauccugcaguccgaagacaagcaacugcagccgucugugagcaaaaaguccgagggagaacucagcagagucaaguucauuucuaauuccaacaaaaucacauuuagcaagaaacccaagcggcgcaaauaugaugagucuuaccuguccuucggcuuuaccuauuucgggaauagagacgccccucacgcccagugugugcuuugcaagaagauccugagcaacucuucccucgcucccagcaaacugcggcgccaucuugagacaaagcacgccgccuacaaagauaaggacauuuccuuuuucaaacagcaucuggauucuccugaaaauaacaagcccccuaccccgaaaaucguuaauacagacaacgagagcgcuaccgaagccuccuauaaugugagcuaccacauugcucucucuggagaggcccauacgaucggcgagcugcugauuaagcccugugcgaaggaugucgugaugagaauguuugacgaacaauacuccaaaaagaucgaugccguucagcucagcaacucuaccguggcucggcgcauuaaagaccuggccgcugauaucgaggaagaacuugucugcagacugaagaucugugacggguucagccuccagcuggacgaauccgccgaugugucuggacuugcggugcugcucgucuuuguucgguaucgcuucaauaaaagcauugaggaggaccugcugcucugcgaaucccugcagagcaacgccacaggcgaggaaaucuucaacuguauuaauucuuuuaugcaaaagcacgagaucgaaugggagaagugcguggauguguguuccgacgcuagcagagccgucgauggcaaaauugcugaggccgugacccuuaucaaguacguugccccugaaucuacauccagccacugccugcucuaucggcaugcucuggcggugaaaaucaugcccaccucccuuaagaacguccuggaccaggccgugcagauuaucaauuacauuaaagcucgcccucaccaaucuagacuccugaagauccugugcgaggaaaugggggcccagcauacggcccuccugcuuaacacagagguucgguggcugagccgcggaaaggugcucgucagacuguucgaacugcggagagagcuucucguguuuauggauuccgcuuuccgccugucugacugucugaccaauagcuccuggcuccugcggcuugccuaucuggcggauauuuuuacaaaacucaacgaggucaaucugagcaugcagggcaagaacgugaccguuuucaccguguuugacaaaaugucuucccugcuuagaaagcucgaguucugggcuagcucugucgaggaagagaauuuugauugcuuccccacacuguccgacuuucugacggagaucaacagcaccguggacaaagauaucuguucugccauuguucagcaccuccgcgggcugcgggccacacuucugaaguacuucccggugaccaaugacaacaaugcuugggucagaaacccuuuuacagugaccgugaagcccgccagccucguugcucgcgauuaugaaucccugaucgaccugacgagcgauucucaagucaaacagaauuucuccgagcuuagccucaacgacuucugguccucucugauucaggaauacccuagcaucgcccggagagcggugcgcgugcugcuccccuuugccacaaugcaccugugcgagaccggauucuccuacuaugcugccaccaagacaaaauaccggaagagacuugaugcugcgccccauaugcgcauucggcugucuaacaucaccccuaauauuaaaagaaucugugacaagaaaacacagaagcacugcagccauuga

SEQ ID NO: 78020 - RNA, 1065 nt, Artificial Sequence
  derived and/or modified sequence opt5 from ZBP1__Homo_sapiens__NP_001153890
auggcccaggcucccgccgacccuggcagagaggcggaacggccgcaacagcacgcugccaccauccccgagacaccugggccccaguucagccagcaacgcgaagaggauauuuacagauuucugaaggacaacggaccucagcgggcccucgugaucgcucaggcccugggcaugcgcacggcuaaagaugucaauagagaccuuuaucggaugaagucccgccaucugcucgauauggacgaacagucuaaagccuggaccauuuacagacccgaggauagcgggcggcgcgcgaaguccgccucuaucauuuaucaacacaacccuaucaauaugaucugccagaacggaccgaauagcuggauuuccaucgcuaacucugaggccauucagaucggccaugggaauauuaucacaagacagaccguuagccgggaagacggauccgcuggcccccgccaucugccuagcauggcccccggcgauucuuccacaugggggacccuuguggacccuuggggaccccaagauauucacauggagcagagcauccugagacgggugcagcucggccacucuaacgaaaugcgccugcacggggucccguccgagggaccugcgcauauucccccuggcagcccucccgugucugccacagcugccgggcccgaggcuuccuucgaagccagaaucccgagccccggaacccacccugagggcgaagccgcucaacggauccauaugaaauccuguuuucuggaggacgcgacgauuggcaauucuaacaagaugagcaucucccccgggguugccggaccuggcgggguggcuggaagcggcgaaggggagcccggagaggaugccggcagacgcccggccgacacccagucucggucccacuucccuagagacauuggccagcccaucacaccuagccacucuaagcucacccccaaacuggaaacaaugacccuugggaaucgcagccauaaggcugccgagggaucccacuacgucgaugaagcgucucaugagggcagcugguggggagggggcaucuga

SEQ ID NO: 78021 - RNA, 2616 nt, Artificial Sequence
  derived and/or modified sequence opt5 from ZBTB10__Homo_sapiens__NP_001099009
augagcuucuccgagaugaacagacggacccuggccuuucgcggcgggggacucgugacagcuucuggcgggggaagcacgaauaacaaugccggcggggaagcguccgcuuggcccccucagccgcaacccagacagccucccccucccgccccuccggcccugcagcccccuaacggacggggcgcugacgaggaagucgagcuugaaggccuggagccccaggaucucgaggccucugcugggccugccgcgggagccgcugaagaggccaaggaacugcuucugccccaagacgcuggcgggccgaccagccucggaggcggggccggaggcccucugcuggcggagcgcaauagacggacacucgccuuccgcggcgggggaggcgggggacugggcaacaauggguccucuagaggacggcccgagaccagcguuuggccucuucgccacuuuaacggcagaggccccgcuacaguggaucuggaacucgacgcccuggaggggaaagaacuuaugcaggauggagcuucccugagcgacucuaccgaggaugaagaggagggcgccucccucggggacggaagcggcgccgaagggggcucuugcuccagcucucggcgcuccggaggcgaugggggagacgagguggaaggcagcggggucggagcuggcgagggggaaacagugcagcauuucccccuggcgagaccuaagucccugaugcagaaacuccaauguucuuuucagaccagcuggcugaaggauuucccguggcuucgguacuccaaagacacgggccugaugagcugcggauggugucagaagacccccgccgauggcgggucuguugaccucccucccgugggacacgacgagcugucccgcggcacaagaaauuauaagaaaacccuucugcuccggcaucacgucagcacagagcauaagcugcacgaagcuaacgcccaggagucugaaaucccuagcgaggaaggguacugcgauuuuaauuccagacccaacgaaaauucuuauuguuaccaacugcuccgccagcugaacgagcagcggaaaaagggcauucuuugcgacgugagcaucguuguguccggaaaaauuuucaaggcccacaagaauauccuggucgcugggagcagauuuuucaaaacccucuauuguuuuucuaacaaggaauccccgaaccaaaauaacacgacacaucuggauauugccgcggugcagggcuucagcgugauccuugacuuucuguacucuggaaaucucguccugaccucccagaacgcuaucgagguuaugacaguggccagcuaucugcagauguccgaagugguccaaaccugccgcaauuucauuaaagaugcccucaacaucucuauuaagagcgaggcuccugaguccgugguuguggacuacaauaaccggaaacccgucaauagagauggccugucuagcucccgcgaccagaagaucgccagcuucugggcuacccggaaccuuacaaaucuggccucuaacgugaaaauugaaaaugauggguguaacguugacgagggacagaucgaaaauuaccagaugaacgauuccagcugggugcaagacggcucuccugagauggcggaaaacgaguccgaggggcagacgaaggucuuuauuuggaauaacaugggaagccagggcauccaggaaaccgggaagacaagacgcaaaaaucaaaccacaaagcgguucaucuauaacauucccccuaauaacgagaccaaucucgaagacugcucugugaugcagcccccggucgccuacccugaggaaaacacgcugcugaucaaagaggagcccgaucuugacggcgcucuccugagcggacccgauggcgacagaaaugugaacgccaaucugcucgcugaagccgggacaucccaggauggaggcgacgcggggaccagccacgauuuuaaguauggacugaugccuggcccgucuaacgacuucaaauacggccuuauucccgggaccuccaaugauuuuaaguauggacugaucccuggcgccagcaacgacuucaaguacgggcuccugcccgaguccuggccuaaacaggaaacaugggagaauggagaaucuagccugauuaugaacaagcugaaauguccccauugcuccuauguugcuaaguaccgccggacccucaaaagacaccuucugauccacacaggcgugcggucuuuuagcugcgauaucugugggaaacucuucacgcgcagagagcaugucaagcggcacucccuggugcauaagaaggacaaaaaguacaaaugcaugguuuguaagaagauuuuuaugcuugccgcuucugugggaaucagacacggcagccgccgguauggcgucugcguggauugugccgacaaaucccaaccugggggacaggagggcguggaccaggggcaagauaccgaguuccccagagacgaggaauacgaggagaacgaaguuggagaggccgaugaggaacuggucgacgauggcgaagaccagaaugauccgagccgcugggacgagucuggggaggugugcaugucccucgaugacuga

SEQ ID NO: 78022 - RNA, 1380 nt, Artificial Sequence
  derived and/or modified sequence opt5 from ZBTB12__Homo_sapiens__NP_862825
auggccagcggcguggagguccugagauuccagcuccccgggcacgaagcugccacccugcggaacaugaaucagcuucgcgcggaggaaagauuuugcgacguuacaaucguggcugauucccugaaguuccggggacauaaagugauucucgccgccuguucuccuuuucugcgcgaccaguuccuucugaacccgagcuccgagcuccaggucucucugaugcacagcgcuagaaucguggccgaucugcuccuguccugcuacacgggcgcucuugaauuugccguucgggacauugugaauuaucugaccgcggccucuuaccuccagauggagcaugucguggagaagugucgcaacgcucugagccaauucaucgaacccaaaauugggcuuaaggaggauggaguuuccgaagccagccuggugucuuccaucagcgcuacaaaaucucuccugccucccgccagaaccccuaagcccgcgccuaagccgcccccucccccuccccugccgccuccccuccugcggccugucaaacuugaguuuccccuggacgaggaucucgaacugaaggccgaggaagaggacgaagaugaggacgaggauguguccgacaucugcauugugaaagucgaaagcgcucuugagguugcccaccgccugaagcccccuggcgggcucggaggcggccuggggaucggaggcucugucgggggacaucugggcgaacucgcucaguccagcgugccgcccuccacaguggccccuccccagggggugguuaaagccuguuauucucugagcgaggaugcugaaggagagggccuucugcucauuccuggcgggagagcguccgugggagccaccagcggccuggucgaggcugccgccguggcuauggccgcgcgcggggcuggaggcucucuuggggccggaggcucccggggcccccugccugggggauucagcggcgggaauccgcucaagaacaucaagugcacaaaaugucccgaaguuuuucagggaguggagaagcuggucuuccacaugagagcccaacacuuuauuuucaugugcccucgguguggcaaacaguuuaaucauucuagcaaccugaaucgccacaugaacgugcauagaggggucaagucccacucuugcggcaucuguggaaaaugcuucacccaaaagagcacgcuccacgaccaucugaaucuucacuccggcgcucggcccuacagaugcagcuauugugacgugcgcuucgcccauaaaccugcuauucggagacaccugaaggaacagcaugggaagaccacagccgagaacguucucgaagcgucuguggccgagaucaauguccugauccgcuga

SEQ ID NO: 78023 - RNA, 1350 nt, Artificial Sequence
  derived and/or modified sequence opt5 from ZBTB14__Homo_sapiens__NP_001137295
auggaguucuuuaucagcauguccgaaaccauuaaguacaacgacgaugaccacaaaacacuguuccucaagacgcugaaugagcagagacuugaaggcgaguuuugcgauaucgccauuguggucgaagacguuaaauuccgggcucaucgcugugugcuggccgcgugcucuaccuauuuuaagaaacucuucaagaagcuggagguggauagcuccucugucaucgagauugacuuucuuagaagcgauaucuucgaagaggugcugaacuacauguauacagcuaaaaucuccguuaagaaagaagacgugaaucucaugaugucuagcgggcaaauucugggaauccgguuucuggauaagcucuguucccagaaacgcgacgucagcucucccgaugagaacaauggccaguccaagagcaaguacugccugaaaauuaacagaccuaucggggacgccgccgauacccaggacgacgauguggaggaaauuggagaccaagaugacucuccguccgaugacacaguugagggcacacccccuagccaggaagaugggaagucucccaccaccacgcuucgggugcaggaggcuauccugaaagaacucggauccgaggagguccgcaaggugaauuguuauggccaggaaguggagagcauggaaaccccugaguccaaagaccugggcucucaaacaccccaggcccuuaccuucaacgaugggaugagcgaagucaaggacgagcagacaccuggauggaccacggcugccuccgauaugaaauuugaguaccugcucuauggccaccauagagaacagauugcgugccaagccugugggaagacauucagcgacgagggacggcugcgcaagcacgaaaaacugcauaccgcugacagaccguuuguuugcgagauguguacaaagggcuucaccacccaggcccaccucaaagaacaccugaagauccauacaggguacaaacccuacucuugcgagguguguggaaaguccuucauccgggcuccugaucuuaagaaacacgagcgcgugcauagcaaugaaagacccuuugccugccacaugugcgacaaggcguucaaacacaagucucaucugaaagaucacgagcggcgccauagaggcgaaaagccuuuugucuguggcagcugcacgaaggccuucgcuaaagccuccgaccucaagcggcacgagaacaauaugcauucugagagaaaacaggugacccccagcgcuauucaauccgaaacagagcagcugcaggccgccgcuauggcggccgaagcugagcagcaacuugaaaccaucgccuguagcuga

SEQ ID NO: 78024 - RNA, 2022 nt, Artificial Sequence
  derived and/or modified sequence opt5 from ZBTB16__Homo_sapiens__NP_001018011
auggaccugaccaagaugggcaugauccagcuccaaaaccccagccaccccacagggcugcuuugcaaagccaaucagaugagacuggcuggaacgcucugugauguggucauuaugguugacucccaggaguuccaugcccaccggaccgugcuggcgugcacaucuaagauguuugaaauccuuuuccaucgcaacagccagcacuacacccuggauuuucucuccccgaaaacauuccaacagauucuggaguaugcuuacaccgccacacugcaggccaaggcugaagaccucgaugaccugcuuuaugccgcugagauccuggaaauugaguaccucgaggaacagugucugaaaaugcuugagaccauccaagccucugaugacaaugauacggaagcgaccauggccgacggcggggcugaggaggaagaggauagaaaggcccgguaucugaagaacaucuuuauuagcaaacauuccucugaagagagcggauacgcuuccguggccggccagagccuccccgggccuauggucgaccagucucccuccgugagcacaucuuucggacuguccgcgaugagcccuaccaaggccgcuguugauucucugaugacaaucggccagucccuccugcaaggcacccuucagcccccugccgggccggaggaacccacgcuggcuggaggcgggcgccacccuggaguggccgaggucaaaacagaaaugaugcaaguggacgagguucccagccaggacuccccuggcgccgcugaaucuagcauuuccgggggaaugggcgauaagguggaggaaagaggcaaagaggggcccggaaccccgacacggagcucugucaucaccuccgcgcgcgagcuccacuauggcagagaagagagcgccgaacaggugccucccccugcugaggccgggcaggcccccaccggacggcccgaacauccugcuccgcccccugagaagcaccugggcauuuacucugugcuucccaaucauaaggccgacgcgguccugagcaugccuuccucuguuacaagcgggcuccacgugcagcccgcucuggccguguccauggauuuuagcacguacggaggccugcucccgcaaggcuucauccagcgcgagcuguuuucuaaacuuggggaacuggccgucggaaugaaguccgagagcagaaccauuggcgaacagugcucugugugugggguugagcucccugacaacgaggcuguggaacagcaccggaaacugcauuccggaaugaagacauauggcugcgagcuuugugggaaacgcuuccuggauagccucagacugcggaugcaucugcucgcccacuccgcuggcgccaaggcguuugucugcgaccaauguggagcccaguucucuaaagaagaugcucuggagacccaccgccagacacauaccggcacggacauggccguguuuugccuucugugugggaagagauuccaggcucaaagcgcccuccagcagcacauggaaguucacgcgggagugcgguccuacaucugcucugagugcaauagaacauuccccagccauaccgcccugaagcgccaucugcggucccacaccggcgaucacccuuaugagugugaauuuugcgggagcuguuucagagacgagucuacacuuaaaucccacaagcgcauccauaccggagaaaaacccuacgagugcaacggcugugggaagaaauuuagccucaagcaccagcuggaaacacauuaucggguccacacgggcgagaagccuuucgagugcaaacugugucaucaaagaucucgcgauuacuccgcuaugauuaagcaccuccggacccacaauggagccagccccuaucagugcacaaucuguaccgaauacugcccgucucugagcuccaugcagaaacauaugaagggccacaaaccugaggaaauuccucccgacuggagaaucgagaagacauaccuuuaucuguguuacguguga

SEQ ID NO: 78025 - RNA, 2205 nt, Artificial Sequence
  derived and/or modified sequence opt5 from ZBTB17__Homo_sapiens__XP_011540387
auguacaccgccaagcugagccucucccccgagaacguggacgauguccuggcuguugccacauuccuucagaugcaagacaucauuacggcgugccacgcucugaaaucucucgccgaaccugccaccagcccgggcgggaaugcugaggcccuggcuacagaaggaggcgauaagagagccaaagaggaaaagguggcgaccuccacacuuucucggcuggagcaggccgggcgcagcacccccaucggaccuuccagagaccucaaagaggaacggggcgggcaggcucagucugccgcuagcggagccgagcaaacagaaaaggcggaugcccccagagagccucccccuguggagcugaagccggaccccaccuccggcauggcugccgcugaagccgaggccgcucugagcgaaucuuccgagcaggaaauggaggucgagccugcgagaaaaggcgaagaggaacagaaggagcaggaggaacaagaggaagagggggccggacccgcugaagugaaagaggaaggcagccagcucgagaacggggaggccccugaagagaaugaaaacgaggagucugccggaacggauuccggccaggaacuggggagcgaggcucggggacuucgcucuggcaccuauggcgacagaacagaauccaaggccuacgggagcguuauucauaaaugugaggauugcggaaaggaauuuacccacacaggcaauuucaagcggcauauccgcauucacaccggggagaaacccuuuuccuguagagagugcucuaaggcguucagcgacccggcugccuguaaagcccaugaaaagacgcacuccccucugaaacccuauggaugcgaggaauguggcaagagcuaccggcucaucucucugcuuaaccugcacaaaaagcgccauuccggggaggcuagauaucggugcgaagauuguggaaagcucuuuacaaccagcggcaaucugaaacgccaccagcuggugcauucuggcgagaagccuuaccaaugcgacuauugugggcgcagcuucuccgaucccacaucuaaaaugcggcaccucgagacccacgacaccgacaaggaacauaaaugcccccacugcgauaagaaguuuaaccaggucggaaaucugaaagcccaucuuaagauccacauugcugacggcccucugaaauguagagagugcgggaagcaguucacaacgagcggaaaccucaaacgccaucugcggauccacuccggcgaaaagccguacguguguauucacugccaaagacaguuugccgaucccggggcgcuucagcgccauguucggauccacaccggcgagaagccuugucagugcgugauguguggaaaagccuucacacaagcuagcucucugauugcccaugucagacagcacaccggcgaaaagcccuacgugugcgagcgcugugggaaacgguuugugcaguccagccagcucgcuaaucacaucagacaucacgacaacauucgcccucauaagugcucugucuguuccaaagccuucguuaaugugggagaucugagcaagcacaucaucauucauacaggcgagaagcccuaucugugcgacaaaugcgggcggggauuuaacagaguggauaaucuccgcucccacgucaagaccgugcaccaaggcaaagcggggaucaagauucuggaaccggaggaaggcucugagguuagcguggucacgguggacgauaugguuacacuugccaccgaggcucuggccgcuaccgccgugacacagcucaccggaccugccacacugcccgcugucgugccugucggcgcggccgugacggcugacgaaaccgagguucuuaaagccgaaaucuccaaggccgugaaacagguccaggaggaagaucccaacacacauauucuguacgcuugugacucuugcggggacaaguuccucgaugccaacagccuggcgcaacacgugcggauccauaccgcucaggcccugguuauguuccagacagacgccgauuuuuaucagcaauacggaccuggcgggaccuggcccgcuggacaggugcuccaggccggcgagcuggucuucagaccgcgggacggggcggagggccaaccugcucuugccgaaacgucccccaccgcccccgaguguccuccgcccgcugaauga

SEQ ID NO: 78026 - RNA, 1596 nt, Artificial Sequence
  derived and/or modified sequence opt5 from ZBTB18__Homo_sapiens__NP_991331
augugccccaagggcuacgaggacagcauggaguucccugaucacuccagacaucugcuccagugucugucugagcaacggcaccagggguuucuuugcgacuguaccgugcuggucggagaugcccaguuccgcgcucauagagccguucucgcgagcugcuccauguauuuucaccuguucuacaaagaccagcuugauaagcgggacaucgugcaucugaacucugauauugugacagcuccggccuuugcccuccugcuggaguucauguaugaaggcaaacuccaauuuaaggaccugcccaucgaagauguccuugcugccgcuagcuaccugcacauguaugacauugugaaaguuuguaagaagaaacucaaggagaaagccacgaccgaggcggauuccacaaagaaagaagaggacgccucuagcugcuccgauaagguggaaagccugucugacggguccagccacaucgcuggagaccuuccuucugaugaggacgagggcgaagaugagaagcugaauauucuccccuccaaacgcgaccuggccgcugaaccugggaacauguggaugagacugcccagcgauucugccggaaucccucaggcgggcggcgaggccgaaccgcaugcuaccgccgcugggaagacagucgccucccccuguagcuccaccgagucucucagccagcgguccgugacaagcguucgcgacucugccgauguggacugcguccuggaucuuuccgugaaaagcucucugagcggaguggagaaucucaacuccucuuacuucagcucccaggacguccugagaagcaaucuuguucaagugaagguggaaaaagaggcuucuugugaugaauccgacgucggcaccaacgacuaugauauggagcacagcacggugaaggaaucuguuuccaccaauaaccgggugcaguacgagccugcgcaucuggcuccccuccgcgaggacagcguccugagagaacuggaucgggaggacaaagccuccgaugacgaaaugaugacaccugagucugaacgcgugcagguugaagggggaauggagagcucccuccugcccuacgugucuaauauccuuagcccggccggccagauuuuuaugugcccucuguguaacaaggucuuccccuccccucacauccuccaaauucaccugagcacccauuuuagagaacaggaugggauccggucuaagcccgccgcugacgugaauguccccacaugcucccuuugcggaaaaaccuucagcuguauguauacgcugaagcgccacgagagaacacauucuggcgaaaaaccuuauaccugcacacaguguggcaaguccuuucaauacagccacaaccucucucggcaugccgugguucacaccagagagaaaccgcacgcgugcaaguggugugagcgccgguucacccagagcggggaucuguacagacauauucgcaaguuccacugcgaacuggucaauucccucagcgugaaaucugaggcucugucccuucccacagugcgggacuggacgcuggaagauagcucccaggagcucuggaaguga

SEQ ID NO: 78027 - RNA, 2226 nt, Artificial Sequence
  derived and/or modified sequence opt5 from ZBTB20__Homo_sapiens__NP_001157814
augcuggagagaaagaaacccaagaccgccgaaaaccagaaagcuagcgaggaaaaugagaucacacaaccuggcggguccucugccaagccgggacuccccugccugaacuucgaagcggugcuuagcccugaccccgcucugauucacuccacgcauucucucaccaauagccacgcccauacaggcuccucugauugugacaucagcugcaaagggaugaccgagcggauucacuccaucaaccugcauaauuuuagcaacucuguccuugagacacugaaugaacagcgcaacagaggacacuucugugauguuaccgugcggauucacggcuccaugcuccgcgcccauagaugcgugcuggcugccgggagccccuuuuuccaggacaagcugcuccugggauacucugauaucgagauccccuccgucgugagcguucagucugugcaaaaacuuauugacuuuauguauuccggcguccugcgggugagccaguccgaagcucuccagauccugacagccgcgucuauucuucagaucaagaccguuauugaugaguguacgcgcaucgugagccaaaaugucggcgacguguucccugggauucaggauuccggacaggacaccccgagaggcacacccgagagcgggaccucuggacaguccagcgauacagaaucuggcuaccugcaaagccacccucagcauuccguggaccggaucuauucugcccucuacgcuugcagcaugcagaacggguccggagagcgcagcuuuuauucuggcgccgucguuucccaccacgaaaccgcucugggccugcccagagaucaucacauggaggacccuagcuggaucacgcggauucaugaacgcucucaacagauggagagauaccucuccacaacccccgagacaacccacugucggaagcagccgcgcccugugagaauccagacccugguggggaauauucauaucaaacaagaaauggaggacgauuaugacuacuacggacagcagcggguccagauucuugaaagaaacgagagcgaagagugcacagaggauacggaccaagccgaaggcaccgaguccgaacccaagggggagucuuucgauagcggaguguccucuagcaucggcacagaaccugacuccguugagcagcaguuugggcccggagcggcccgcgauagccaggcugagcccacccaaccugaacaggccgcugaggccccggccgaaggcggcccccagacaaaucagcuggagaccggggcuucuuccccugagcggagcaacgaaguggagauggacucuacggucaucacaguguccaauagcucugauaaaagcguucuccaacagcccuccgugaacaccagcauuggacagccucugcccucuacccaacuuuaucugagacagacagaaacccucacauccaaccugcgcaugccgcugacgcucaccagcaauacacaggucaucggcaccgcggggaacacauaccugccugcccuuuucaccacgcagcccgcuggauccggcccuaagcccuuucuguucucucucccucaaccccuggccgggcagcagacccaguuugugacagucagccaaccgggccuuuccaccuucacagcccagcugccugcuccccagccccucgccucuagcgcgggacacuccaccgcuucuggccagggggagaagaaaccuuaugaauguacgcugugcaauaagacauucaccgccaaacaaaacuacgugaagcacauguuuguucauacaggagagaaaccgcaccaguguagcauuugcuggcgguccuucagccugaaggacuaucucaucaaacauauggugacccacaccggcgucagagccuaccagugcucuauuuguaauaagcgcuuuacacaaaaguccagccugaacgugcacaugcggcuucauagaggggagaaaucuuaugaaugcuacaucuguaagaaaaaguucucccacaaaacgcugcucgagcgccauguugcucugcacagcgccucuaauggaaccccuccugcuggcacacccccuggggcccgggcgggacccccuggcguggucgccugcaccgaaggcacaaccuacguguguuccgugugccccgcuaaguuugaucagaucgagcaguucaacgaccauaugagaaugcacguuagcgacggguga

SEQ ID NO: 78028 - RNA, 3201 nt, Artificial Sequence
  derived and/or modified sequence opt5 from ZBTB21__Homo_sapiens__NP_001091872
auggagggccugcuccacuacaucaaccccgcccaugcuauuagccugcuuuccgcccugaaugaagagagacucaaggggcagcugugcgacgugcuucugaucgucggagaucaaaaauuccgggcgcacaagaacguucucgcugccucuagcgaauauuuucagucccuguucaccaauaaagagaacgaaucucagacaguguuucagcuggacuucugugagccugaugccuuugacaaugugcucaacuacauuuauagcuccucucuguucgucgagaagucuucccuugcugccgugcaagaacugggcuacagccucgggaucucuuuucugacgaauauuguuuccaaaaccccgcaggcucccuucccuacaugccccaaccgcaagaagguguuugucgaggaugacgaaaauagcucucagaaaagauccgugaucguuugucagagccggaacgaggcccaaggaaagaccgugucucagaaucagccugaugucucccauacaagccgccccuccccuucuaucgcggugaaagccaacaccaauaagccgcacgugcccaaaccuauugagccccuucauaaccugagccucacagaaaaguccuggccuaaggacagcucugucguuuaugcuaaaucccuggagcacagcggcucucuggaugaccccaauagaaucagccucgugaagcggaacgccgugcugccguccaaaccucuucaggaucgcgaagcuauggacgauaagcccggggucucuggacaacugccuaaaggcaaggcccucgagcuggcgcuuaaaagaccccggcccccugugcugagcguuugcuccagcucugaaaccccguaccuccugaaggagacgaacaagggcaaugggcagggagaggaccgcaaccugcucuauuacuccaaacugggccuugugauucccagcucuggguccggaagcggcaaucaguccaucgacagaucugggccucuggucaagagccuccugcggcgcucccuuucuauggauagccaagugcccguuuacuccccuagcauugaccugaaaucuucccagggaagcagcuccgugagcucugaugcccccggcaacguccucugugcucugagccagaaguccagccugaaagacugcucugaaaagaccgcccucgaugacagaccucaggugcugcaaccgcaccggcuucgcuccuucagcgcuucccagucuacagauagagagggcgccagccccgucaccgaagugcggaucaagacagagccuuccucuccccugagcgacccuuccgauauuaucagaguuaccgugggggacgccgcuacgacagcggccgcuucuagcuccagcgucacccgcgaucucucucugaaaacagaagacgaccagaaggauaugucccggcugcccgccaaaagacgcuuucaggccgaccggagacuuccguucaagaaacucaaggugaaugagcauggaagcccuguuucugaggauaacuuugaagagggcuccagccccacccugcuggacgcugauuuccccgacucugaucucaauaaggacgaguucggggagcuggaaggaacccgcccuaacaaaaaguuuaaauguaagcacugccuuaaaaucuuccgguccacagccggccugcauagacacgugaauauguaucacaacccggagaagcccuacgcgugugauauuugccauaagcgcuuucacacgaauuucaaagucuggacccauugucaaacacagcacgggaucgugaagaacccuagccccgcuuccagcucucaugccgugcucgacgagaaauuucagcggaagcugauugauaucguuagagaacgcgagauuaaaaaggcccugaucaucaaacuucggagaggaaagccuggcuuccagggccaaagcuccucucaggcucagcaggucauuaagcggaaucuccgcagcagagccaaaggggcuuauaucugcaccuacugcggaaaggccuaucgguuucugucccaauucaaacagcacauuaagaugcaccccggcgaaaaaccucugggggugaacaagguggcgaagcccaaagagcaugccccgcucgcuucuccugucgagaauaaggaaguguaccaguguagacugugcaacgccaaacuuagcucccugcucgagcaaggaucucacgaacgccugugucggaacgcugccguuugccccuauuguagccugagauuuuucuccccugagcuuaagcaggaacaugagagcaaaugcgaguacaagaagcucacaugucuggaaugcaugcgcaccuuuaaaucuuccuucagcaucuggagacaccagguggagguccacaaucagaacaauauggcgcccacggaaaacuuuucucugccggugcucgaccauaauggcgauguuacaggguccagccggccucaaucccagcccgagccuaacaaggugaaucacauugucaccaccaaagacgacaacguguucucugauagcuccgaacagguuaauuucgacagcgaggauucuuccugucugcccgaggaccuuagccugucuaagcagcucaaaauccaagugaaggaagaacccgucgaagaggccgaagaggaggcuccugaagccagcacagcuccgaaggaggccggccccuccaaagaagccucucuguggccuugcgagaaguguggaaaaauguuuaccgugcauaagcagcuggagcgccaccaggaacuucucugcagcgugaaacccuucaucugccaugucuguaacaaggcuuuuagaacaaauuuccggcuguggucccacuuucagucucacaugagccaagcguccgaggaaagcgcccauaaagagucugaaguuugcccugugcccacgaacuccccuagcccgcccccucugcccccucccccgccucuccccaagauucagccccuggagccugauucccccaccggccuuucugagaauccuacaccggcuaccgaaaagcuguucgugccccaggagagcgacacacucuuuuaccacgccccuccccuguccgccaucaccuucaaacgccaauuuauguguaagcugugccauagaacguucaaaaccgcuuuuucucuuuggagccacgaacagacacauaacuga

SEQ ID NO: 78029 - RNA, 1905 nt, Artificial Sequence
  derived and/or modified sequence opt5 from ZBTB22__Homo_sapiens__NP_001138810
auggagcccagcccucuguccccgucuggcgccgcucucccccugccucuuagccuggcgcccccuccccucccucugccggccgcugccgugguccacguuuccuuccccgaagugaccucugcccuucuggagagccucaaccagcaaagacugcaggggcagcugugcgacguguccauccggguccagggacgcgaauuuagagcucaucgggccgugcucgcugccucuagcccuuacuuccacgaucaaguucugcuuaagggcaugacauccauuagccugcccucugugauggacccuggggcguuugagacgguccucgccuccgcuuauaccggacgccugagcauggccgcugccgauaucgugaauuuccuuacaguuggcucugugcugcagauguggcauauugucgacaaauguaccgaacuccugagagaggggcgggcguccgccacaaccacaaucaccacggcugccgcuaccagcgugacagugcccggagccggcgucccgucuggcuccgggggaaccguugccccugcuacaaugggcagcgcgcgcucccacgccucuagcagagcuuccgagaaccagagccccucuuccagcaauuacuuuucuccucgggaaagcaccgauuucuccucuagcucccaggaggccuuugccgcuagcgccguggggucuggagaacgcagaggcgggggacccguguuccccgcgccugucgugggcuccggcggggcuacgagcggaaagcugcuccuggaggccgacgagcuuugcgaugacggcggggauggacggggcgccguugugccgggggcuggacugcgcagacccacauauaccccucccucuauuaugccucaaaaacauugggucuacgugaagcggggcggcaacugucccgccccgacaccucucguuccccaggacccugaucuggaagaggaagaggaagaggaggaccuugugcugaccugcgaagaugacgaggacgaggaacucgggggauccagccgcguccccgugggcgggggaccugaagcuacccuguccaucucugaugucagaacacugagcgagcccccggacaaaggcgaggaacaggugaauuuuugugaguccucuaacgauuucgggccuuaugaaggcggaggccccguugccgggcucgacgauagcggaggccccacgccuuccagcuacgcgccgucucaucccccucggccccugcuuccucuggacaugcaggggaaucaaauccucguguuucccuccucuagcuccagcucuagcucccaggccccuggacagcccccgggcaaccaagcugagcacggggccgucaccgugggcggaacaagcguuggcucucugggggugccuggauccgucggcggggugcccggaggcaccgggagcggcgauggaaauaagauuuuccuuugccacuguggcaaggcuuuuucccacaaaucuaugagagaccgccaugugaacaugcaccugaaucuccggccuuucgauugccccguuuguaacaagaaauucaagaugaaacaccaucugacagaacacaugaagacccauacggggcugaagccguaugagugcggagucugugccaaaaaguuuauguggagagacagcuucaugcgccaccggggccauugcgagagacgccaccggcucgggggagugggcgcggugccugggcccggcacaccuaccggacccucccugcccucuaaaagagaaagcccuggcgucgggggaggcuccggggaugaggccucugcugccaccccgcccagcucccgccggguguggagcccucccagaguucacaagguggaaaugggauuuggcggcgggggaggcgcuaauuga

SEQ ID NO: 78030 - RNA, 2094 nt, Artificial Sequence
  derived and/or modified sequence opt5 from ZBTB24__Homo_sapiens__NP_055612
auggccgagaccagccccgaaccuuccggccagcuggugguccacucugacgcucauagcgauacaguucucgccuccuucgaggaccaaagaaagaaaggguuucugugcgauaucacgcuuauuguggaaaacgugcacuuccgggcgcauaaggcucugcucgccgccucuagcgaguacuuuuccaugauguucgcugaagagggagagaucggccagucuauuuauaugcuggaagggauggucgccgacaccuuuggaauccuucuggaguucauuuacacaggcuaucuccacgcuagcgaaaaauccaccgagcagauccuggccacagcgcaguuucugaagguguacgaucucguuaaagccuauaccgacuuccaaaauaaccauagcucuccgaagcccacaacccugaauacggcuggggccccuguggucgugaucuccaacaagaaaaaugaucccccuaagcgcaaaagaggacggcccaagaaaguuaacacccuucaggaggaaaagagcgagcuggcugccgaagaggaaauucagcuccgcgugaauaacucuguccagaauagacaaaacuuuguggugaagggcgacuccggcguccugaaugagcagaucgcggccaaagagaaggaagagagcgaaccuacaugugagccgucucgggaagaggagaugcccguugaaaaagaugagaacuacgacccuaagaccgaagaugggcaggcuucccagagccgcuauuccaaaagacggauuuggcgcucugugaaacuuaaggacuacaagcuggugggagaucaagaggaccacggcagcgccaagagaaucugcgggcggcgcaaaagacccggaggcccugaagcucgguguaaggacugcgggaaagucuucaaguacaaucacuuucucgccauucaucagcgcucccacacaggagagagacccuucaaauguaacgagugcggcaagggcuuugcccagaagcauagccugcaagugcacacccggaugcacacgggggaaagaccguauacauguaccguuugcucuaaagcucugacaaccaagcauucccuccuggagcacaugagccuucauucuggacagaaauccuucaccugugaucagugcggcaaguacuucagccagaaucgccaacugaaaucucacuaucgggugcauacagggcacagccucccugaauguaaggacugccacagaaaguuuauggaugucucccagcugaaaaagcaucuucgcacgcacaccggagagaaacccuucacaugcgagaucuguggcaagagcuuuaccgcgaaaucuucccugcagacacauauucggauccacagaggggaaaagccuuacagcugcggaaucuguggcaagucuuucuccgacagcuccgccaaacgccggcacugcauucuccauaccggcaagaaacccuuuucuugucccgagugcaaccugcaguucgcuagacuggauaaccucaaggcccaccugaaaauccauagcaaggaaaaacacgccuccgacgcuucuagcauuuccgggagcucuaauacggaggaagugcgcaacauccuucaacugcagccuuaucagcucuccacaagcggagagcaggagauucaacugcuuguuaccgauucugugcauaauaucaacuuuaugccgggccccucccaggggaucagcauugucaccgccgaaucuagccagaauaugacagcggaccaggcugccaaccugacccuccugacacaacagccugagcagcugcaaaaucucauccuguccgcccagcaggaacagacggagcacauucaaagccuuaacaugaucgaaucucagaugggacccucccagaccgagccugugcacgucauuacacugagcaaggagacccucgaacaucugcacgcucaucaggagcaaacagaggaacugcaccuugccaccuccacgucugaucccgcucagcaucuccagcugacccaggaaccgggcccucccccucccacacaccacgugccucaacccaccccgcuggggcaggagcagagcuga

SEQ ID NO: 78031 - RNA, 1545 nt, Artificial Sequence
  derived and/or modified sequence opt5 from ZBTB2__Homo_sapiens__NP_065912
auggaccuggccaaccacggccucauccugcuucagcaacugaaugcucagagagaguucggguuucucugcgauuguaccguggccauuggagacgucuacuucaaggcgcauaaaagcguucuggcuuccuuuucuaacuauuucaagaugcuuuuugugcaccagacaagcgaaugcgugcggcugaaacccacggauauccagccugacauuuucuccuaccuccugcaucugauguauaccggcaagauggccccgcaacucaucgaucccguccgccuggagcaggggauuaaauuucuucacgccuacccucugauccaggaggcuucucucgccagccagggagcuuucucccaucccgaccaaguguuuccucuggccucuagccuuuauggcauccagauugcggaucaccagcugagacaggccacaaagaucgcuuccgcccccgaaaagcucgggcgggacccucgcccgcaaaccagcagaauuucucaggaacagguucccgaggcuucccaacugagccagcugacaucuaaucucgcccaggugaaccggaccaauaugacaccuuccgauccccugcagaccagccuuucuccugagcuggucuccacgcccgugccgccucccccucccggagaagagaccaaccucgaagcgagcuccucugacgagcaacccgccagccugacaaucgcucacguuaaaccuuccauuaugaagcgcaauggcagcuucccgaaauacuaugccugucaucuuugcggcagacgguuuacccugagaucuucccuccgcgagcaucugcagauccacacaggggugcccuucaccagcucucagcagggagaaagccgggucccucugacgcucuguuccaacgcugccgaucugggcaaggacgccauggaggugcccgaagcugggaugauuucugauagcgagcuucaacacaucuccgacagcccuaucauugacggacagcagcagucugaaacacccccgccuuccgauaucgcggacauugauaaucuggagcaagccgaccaggagcgcgaagugaaaagacggaaguacgagugcaccaucuguggccgcaaguuuauucagaaaagccacuggagagaacauauguacauccacacagggaagcccuucaaaugcucuaccugugauaaguccuucugccgggcuaaccaggccgccagacaugucugucucaaucaaagcaucgacaccuauacaaugguugauaaacagacgcuggagcuuugcaccuuugaagagggaucccagauggacaacaugcuggugcaaacaaauaagccuuacaaaugcaaccucugugauaagaccuucucuacacccaaugagguggucaagcacagcugccagaaccagaacuccgacguguuugcucuggaugaaggccgcucuauucugcucggcagcggggacuccgagguuaccgaaccugaccaucccgugcuggccagcaucaaaaaggagcaggaaacgguccuucuggauuga

SEQ ID NO: 78032 - RNA, 1464 nt, Artificial Sequence
  derived and/or modified sequence opt5 from ZBTB32__Homo_sapiens__NP_055198
augagccugcccccuaucagacucccgucccccuacggcucugaccggcuggugcagcuugccgcucgccugagaccugcccucugcgauacccugauuacagucgggagccaagaguuccccgcgcacucccuuguucuggcuggagugucucagcagcucggccggcgcgggcagugggcccugggagaaggcaucagcccuuccacguuugcccaacugcucaacuucguguauggggagucugucgaacugcagcccggagagcuuagaccucugcaggaagcugcccgggcucucggcgugcagagccuggaggaggccuguuggcgcgcgagaggcgaccgggccaagaaaccggaucccgggcuuaagaaacaucaagaggaaccugaaaagcccucccgcaauccugagagagagcugggagaccccggcgaaaaacagaagccggagcagguuagccggaccgggggacgcgaacaggagaugcuccacaagcauucuccucccagaggccggccugaaauggcuggggccacacaagaggcucagcaggagcaaacccgcuccaaagaaaagagacugcaggcccccgugggacagcggggcgcggauggcaaacacgggguccugacauggcucagagagaaccccggaggcagcgaagagucucugcgcaagcugccugggccgcugcccccugccggaucccuccagaccagcgugacaccccggccuucuugggcugaagcccccuggcugguuggcgggcaaccggcucuuugguccauucugcucaugccucccagauacggaaucccuuuuuaucauagcacccccacgaccggcgccuggcaggagguguggcgcgagcagcggauuccucugucccugaaugcccccaaaggccucuggucucagaaccaacuggcuagcuccagcccgacaccugggucucuuccccagggacccgcgcagcuguccccuggcgaaauggaggaaagcgaccaggggcacaccggagcccucgcuacaugcgccggccacgaggauaaggccggguguccgcccagaccucaucccccucccgcuccucccgcccgcucucggccguacgcgugcagcgucuguggcaagagauucucccugaaacaccaaauggaaacccauuaucgcgugcacacgggagagaagccuuuuucuugcagccuuuguccccagcgguccagagacuucagcgcuaugacaaaacaccuucgcacccauggcgccgccccuuaccggugcucucucuguggggcuggaugccccucccuggccagcaugcaggcucacaugagaggccauucuccgucccagcugccucccggguggacaauccggagcaccuuucucuauuccucuagccgcccuuccagacccucuaccagccccuguugcccuuccagcucuacaacguga

SEQ ID NO: 78033 - RNA, 2019 nt, Artificial Sequence
  derived and/or modified sequence opt5 from ZBTB33__Homo_sapiens__NP_006768
auggagagcagaaagcugaucuccgccaccgacauucaguacucuggcagccuccugaacucccuuaaugaacaacgggggcacggacuguucugcgaugugacagucaucguugaggaccgcaaauuuagagcucauaagaacauucucucugccagcuccacguauuuccaccagcuguuuucuguggcgggccagguggucgaacuuagcuucauccgggcugagauuuuugccgaaauccugaauuacaucuauuccagcaaaauugugcgcguuagaucugaucuccuggacgagcugaucaaguccgggcagcuccugggagugaaauucauugccgagcuuggcgucccccugagccaagugaagucuaucuccgggaccgcucaggauggaaacacagaaccucucccgcccgacagcggcgauaagaaucugguuauucagaaaucuaaggacgaggcccaggauaacggcgcuaccaucaugccuauuaucacagaauccuuuagccuuuccgccgaggacuacgagaugaaaaagaucauugugaccgauucugacgaugacgacgaugacgucaucuucuguagcgaaauucugcccacaaaagagacccucccuuccaauaacacgguggcgcaagugcagagcaaucccgggccugucgccaucucugauguugcuccguccgccagcaacaauucucccccucugaccaacauuacacccacccagaagcugccuacacccgugaaucaggcuacccucagccaaacgcagggauccgaaaagcugcuugugucuagcgccccgacacaucugaccccuaacaucauccuccugaaucagacaccccuuuccaccccucccaacgucuccucuucccugcccaaccacaugccuagcucuauuaaucuccuggugcaaaaccagcagaccccgaauagcgcgauccugacaggcaacaaagccaaugaggaagaggaggaagagauuaucgacgaugacgaugacacgauuagcuccucucccgauagcgcuguuuccaacaccucucucgugccucaggccgacacaagccaaaauaccuccuuugaugggagccugauccagaagaugcagauccccacacuucugcaggaaccucucucuaacucccugaaaauuagcgacaucauuacccggaauacgaacgaccccggagucggcucuaagcaucuuauggaggggcagaaaaucauuacacuggauaccgcuaccgaaaucgagggacucuccacaggcugcaagguguaugccaauauuggcgaggacaccuacgauaucguuaucccggugaaagacgauccugacgaaggggaggcccgccuggaaaacgagauucccaagacaagcggaucugaaauggcuaauaagagaaugaaagucaagcacgaugaccacuaugagcugaucguggauggccgggucuacuacauuuguaucgugugcaaacgcagcuauguuugucucacgucccugagacggcauuucaacauucacagcugggagaagaaauacccuugccgcuauugugaaaagguguuuccccuugcggaguacagaaccaagcaugaaauccaccacacaggggagcggcgcuaucaaugccuggccuguggaaaaucuuucaucaauuaccaguuuauguccagccauauuaaguccguccacucucaggacccuagcggcgauuccaaacucuauagacugcaucccugccggucucugcaaaucagacaguacgcuuaccuuagcgaccgcuccucuaccauuccggccaugaaggaugacgggaucggauauaaaguggacacaggcaaggagccucccguuggcaccacgaccagcacacagaacaagcccaugaccugggaagauauuuucauccagcaagagaacgacuccaucuucaaacagaaugugacagaugggagcaccgaauuugaguucauuaucccugaaucuuacuga

SEQ ID NO: 78034 - RNA, 1503 nt, Artificial Sequence
  derived and/or modified sequence opt5 from ZBTB34__Homo_sapiens__NP_001092740
auggacagcuccucuuucauccaguuugaugugcccgaguacagcuccaccguccugucucaacucaacgaacugagacuucagggcaagcugugcgacauuaucguucacauucaggggcagccuuuccgggcccauaaagcugugcucgccgcgagcuccccguauuuucgcgaucacucugcucugagcacaauguccggacuuagcaucucugugauuaagaaucccaacgucuucgagcaacugcucuccuuuuguuacacgggcagaaugagccugcagcugaaagacgugguuucuuuccucaccgccgccuccuuucugcagaugcagugcgugaucgauaaguguacacaaauccuugaaagcauucauucuaaaaucuccgucggggacguggauagcguuaccgugggagcugaggaaaauccugagucccggaacggcgucaaggacucuagcuucuuugccaaucccguggagauuuccccucccuauugcagccaggggcgccagccuacagcuucuuccgaucugagaauggaaaccacaccgagcaaggcccuccggucucgccugcaggaggaaggacacagcgacagaggcuccucuggcagcguguccgaguacgagauccaaauugaaggggaucaugagcagggagaccuucugguccgggaaagccagaucaccgagguuaaagugaagauggaaaaaucugaucgccccuccuguagcgacucuuccagccucggcgacgauggguaucacacggagaugguggacggagagcaagucguggcgguuaacgugggcuccuacgggucuguccugcagcacgccuauagcuacucccaggcugccucucagccuaccaaugugagcgaggcuuucggaucccugagcaacucuucccccagcagaucuaugcucuccugcuuucggggcggccgcgccagacaaaagcgggcgcugagcguucaucuucacucugaucugcaggggcucgugcagggaagcgacuccgaagccaugaugaauaacccuggcuacgaaagcucuccccgcgagagauccgcucgggggcauugguauccguacaaugaaagacugauuuguaucuauugcggaaagagcuucaaccagaaaggcucccuugaucgccacaugcggcugcacauggggaucacaccuuuugucuguaaguucugcggcaaaaaguacaccagaaaagaccaacucgaguaucauauucgcggacacacagaugacaagcccuuccggugugagaucugcggcaaaugcuuuccuuuccaggggacccugaaucagcaucugagaaagaaccaccccggaguggccgaaguccgcucucggauugagagccccgaaagaacggauguguacguugagcagaaacucgaaaaugacgcuuccgccucugagaugggccuggauagccgcauggagauccauacaguguccgacgccccugacuga

SEQ ID NO: 78035 - RNA, 3588 nt, Artificial Sequence
  derived and/or modified sequence opt5 from ZBTB38__Homo_sapiens__NP_001073881
augaccgugaugagccuguccagagaccucaaggaugacuuccacucugauacaguccugagcauccuuaacgagcagcggauucgcggcauccugugcgacguuacgauuaucguggaagauaccaaauuuaaggcccauuccaaugugcucgcugccucuagccuguacuucaaaaacaucuuuuggucccacacaauuuguaucucuagccauguccuugagcuggacgaucucaaggcggaaguguucaccgagauucugaauuauaucuacuccagcacaguuguggucaaaagacaagaaaccgugacagaccuggcugccgccgggaagaagcucggaauuucuuuucuggaggaucuuaccgaccggaacuucuccaauagccccggcccuuauguguuuugcaucacggagaaagggguugucaaggaagagaaaaacgaaaagcgccacgaggagccggcuauuaccaauggacccagaaucacaaacgccuucucuauuaucgaaaccgaaaauuccaacaauauguuuagcccucuggaucuccgggcuucuuucaaaaagguguccgacagcaugcgcacagccucccugugucuugaaagaaccgaugugugccaugaggcggaacccguccggacgcuggccgagcacucuuacgcuguuagcuccguggccgaggcuuaucgcagccagccugugagagaacacgacgggucuucccccggcaacacaggaaaggagaauugugaagcccucgcggccaaaccuaagaccugccggaaaccgaagacauuuagcaucccccaggacucugauagcgcuaccgagaacauuccucccccucccgucuccaaucuggaagugaaccaggagcgcucuccgcaaccugccgcuguucugaccagaagcaaaucccccaacaaugagggcgacgugcauuucagccgggaagaugagaaccagucuuccgacgucccuggcccucccgccgccgaagugcccccgcucguuuacaauuguagcugcuguucuaaggcuuuugauuccagcacacugcuuuccgcgcacaugcagcugcauaaacccacgcaggagccucucgugugcaaguauuguaacaagcaauucaccacacugaaucgccuugacagacacgaacagaucugcaugcggucuagccacaugcccauuccugggggaaaccagagauuccuggagaauuaccccaccaucggccagaacgggggauccuuuacaggcccggagccucuccugucugaaaaucgcauuggggaguucagcuccaccggaagcacgcugcccgauacagaccauauggucaaauuugugaacggccaaaugcucuacucuugcgucguguguaagcgguccuauguuacccugagcucucuuagacgccacgccaaugugcauuccuggcggagaaccuacccuugccacuauuguaacaaagucuucgcucuggccgaauaccgcacacggcaugagaucuggcacaccggcgagagacgcuaucagugcaucuuuugucucgaaacauucaugacguacuauauucugaagaaucaccagaaaucuuuucaugccaucgaucaccggcuuucuauuagcaagaagaccgcuaacgggggacugaaacccuccguguacccuuacaagcucuauagacugcugcccaugaaaugcaagcgcgccccguacaaaagcuaucggaauagcuccuacgagaacgcgagagaaaacagccaaaugaaugaguccgcuccuggcacauauguugugcagaacccccauucuagcgaacuccccacccugaauuuccaggacacagucaacacccuuaccaauuccccugccaucccgcuggagacgucugccugucaggauauucccacaagcgcuaacgugcaaaaugccgaggggaccaaguggggagaagaggcucucaagauggaccuggacaacaauuuuuacuccacagaagugucuguuagcuccaccgagaacgccgucagcucugaucugcgggcgggcgacgugccugugcuuucccucagcaauucuuccgaaaacgccgcuagcgucaucucuuauuccgggagcgcccccuccgugaucguucacagcucucaguucagcuccgugauuaugcacucuaaugcuaucgccgcgaugacgagcuccaaccaucgcgccuuuucugauccugcugucagccagucccugaaagacgauucuaagcccgagccugacaaagugggaagauucgccagccggcccaaguccauuaaagagaagaagaaaacaaccagccacacaagaggcgaaaucccggaggaaucuaauuacguugcugauccuggcgggucccugagcaagaccaccaacauugccgaggaaacaucuaaaaucgagacguacauugccaagcccgcucucccuggaaccuccacaaacagcaauguggcgccccugugccagaucaccgucaaaaucggcaacgaggccauugugaagcgccauauccuuggguccaaacuguuuuauaagcggggaagacgcccgaaguaccaaaugcaggaggagccucucccccagggcaaugacccugaacccucuggggauagcccccugggccugugucaguccgagugcauggagaugagcgaaguuuucgacgaugcuucugaccaagauuccacagacaaaccuuggagaccguauuacaacuauaagcccaaaaagaaaagccggcagcuuaagaagaugcgcaaagugaauuggagaaaggagcacggaaaccggucuccuagccauaaauguaaguaccccgccgaacucgacugcgccgucggcaaagcuccucaggauaagcccuucgaggaagaggagaccaaggaaaugccuaaacugcagugcgagcugugugacggggauaaggccgugggagcgggcaaucaagggcgcccgcacagacaccucacgucccggcccuaugcuugcgaacugugugccaaacaguuucagucuccuagcacacuuaagaugcauaugcgcugccacaccggagagaaacccuaccaauguaagaccugcggcagauguuucuccgugcaggggaaccugcagaagcaugaacggauucaccucggccugaaagaguuugucugccaguacuguaauaaggccuucacacugaacgagacccuuaaaauccaugaacgcauucacacaggagagaagagauaucacugccaauuuuguuuccagcgguuucucuaccugucuacgaaaagaaaucaugaacagcgccacauccgggagcauaacggcaagggguaugcuugcuuccagugcccuaaaaucuguaagaccgccgcggcucugggaaugcaccaaaagaaacaccucuuuaagagccccucccagcaggagaaaauuggcgacguuugccaugaaaauagcaacccgcuggagaaucagcacuucaucgggucugaagauaacgaccaaaaggauaacauucagacaggaguggagaaugugguccuuuga

SEQ ID NO: 78036 - RNA, 2730 nt, Artificial Sequence
  derived and/or modified sequence opt5 from ZBTB41__Homo_sapiens__NP_919290
augaagaaaagacggaaggugaccagcaaccuggagaaaauccaccucggcuaccauaaggacuccucugaagggaaugucgccguugagugcgaucaggugacauauacgcacagcgcuggacgccccaccccugaagcccugcauuguuaccaagagcuuccgcccuccccugaccagagaaaacugcucucuagccugcaguauaacaagaaucuucugaaguaccucaacgaugaccggcagaaacaacccuccuucugcgaucugcugauuaucguggaaggcaaggaguuuucugcgcacaaagucgugguugcuguggggagcuccuauuuccaugccugucucagcaagaauccuucuacagacgucgugacccuggaucacguuacacacuccguguuucagcaucuucuggaguuccucuacaccagcgaauuuuucgucuauaaauacgagauuccccuggugcuugaagccgcuaaguuucuggacaucauugaugccgugaagcuccugaacaaugagaacgucgcuccuuuccacucugagcugacagaaaaauccagcccggaggaaacccucaaugagcugacgggacgccuuucuaacaaucaucagugcaaguuuuguuccagacacuucugcuacaaaaagagccuggaaaaccaccucgccaaaacccaucggucccugcuucugggcaagaaacacgggcucaagaugcuggagcgcucuuuuagcgcgagacgguccaagcgcaauagaaaaugucccguuaaguucgacgauacaagcgacgaugagcaggaaucuggagacggcuccgacaaccugaaucaagagaacuuugauaaagaaaagagcgaccggaacgauucugaggacccuggcagcgaauauaaugccgaggaggaugaacucgaggaagagauguccgacgaauacucugauaucgaggagcagagcgaaaaagaccauaacgaugcugaggaggaacccgaggccggggacuccgugggaaaugugcacgaaggccugaccccugucgugauccagaacagcaauaagaagauucuucagugccccaaaugugauaagacauucgaccgcaucgggaaauaugagucucauaccagaguucacacgggagaaaagccguucgagugcgacauuugucaccaacgguacuccacaaaaagcaaccugaccgugcaucgcaagaagcacucuaaugaaacagaguuucauaaaaaggagcacaaaugcccuuauugcaacaagcuccacgcuuccaaaaagacccuggccaagcaugucaaaagauuccaccccgaaaaugcgcaggaguuuaucagcauuaagaaaaccaaguccgaaucuuggaaaugugauaucugcaagaaauccuucacacggagaccucaucuugaggaacacaugauucugcauagccaggacaagcccuuuaaguguacguacugcgaggagcacuucaaaucucgcuuugcccggcucaagcaccaagaaaaauuccaucugggccccuuuccuugugauaucugcgggagacaguucaacgacaccggaaaucugaagcgccacaucgaguguacacauggcggcaaacggaaguggaccugcuuuauuuguggaaagagcgugagagaacgcacaacccucaaagagcaucugcggauccacuccggggaaaagccgcaccuuugcagcauuuguggccagucuuucagacacggguccagcuaucgccugcaucuccggguucaccaugaugacaaaagauacgagugcgaugagugcggaaagacguuuauccgccacgaccaccugacaaaacauaagaagauucacucuggcgaaaaagcucaucagugugaggaaugcgggaaguguuucggacggagagaucaccugaccgugcauuacaaauccguccaccuuggcgagaagguguggcaaaaauauaaggccaccuuccaccagugcgacgucuguaagaaaaucuuuaagggcaaaagcucucucgagaugcauuuccggacacacagcggggaaaagcccuacaaaugccagaucuguaaccaguccuuucgcauuaagaaaacccugacaaagcaucuggugauccacagcgaugcuagaccuuucaauugccaacacuguaacgccacguuuaagcggaaagacaagcucaaauaucauauugaucacguucaugagaucaagucucccgacgacccucuguccaccagcgaagagaaacuugugucccugcccgucgaauacucuagcgaugacaagauuuuccagacagagaccaagcaguauauggaucagccgaaaguguaccaauccgaggccaagacaaugcuccagaauguuucugcugaagugugcgucccugugacccuggugcccguucagaugccugacacgcccagcgaucuggucagacacaccacaacccuuccucccuccucucaugagauccucagcccgcagccucaauccacagacuauccccgcgcggccgaucuggcuuuucuggaaaaauacacccucacgccccagccugccaacaucgugcacccggugcggcccgagcagaugcuggacccuagagaacaaagcuaccuuggaacacugcucggccuggauucuaccacagggguccagaacauuuccaccaaugagcaccauagcuga

SEQ ID NO: 78037 - RNA, 1770 nt, Artificial Sequence
  derived and/or modified sequence opt5 from ZBTB46__Homo_sapiens__XP_005260254
augaacaauagaaaggaggacauggaaaucaccagccacuaccggcaucugcuccgcgagcugaacgaacagagacaacacggcgugcuuugcgaugucuguguugugguggaggggaaagucuucaaggcccauaaaaaugugcugcucggauccucucgguauuuuaagacacuguacugccagguucagaaaacgagcgaacaggcuaccgugacacaccuugacauugucaccgcccaaggcuucaaggcgaucauugauuuuauguauuccgcucaucuggcccucacaucucgcaacgugaucgagguuaugagcgccgcuuccuuccugcagaugaccgacauugugcaggccugucacgauuuuaucaaggcugcccuggacaucucuauuaaaagcgaugcguccgacgagcucgccgaguucgagaucggggcuagcagcuccagcucuacagaagcccugauuuccgcugucauggccggaagaagcaucucucccuggcuugcgcggcgcaccuccccugccaauagcuccggcgauucugcuauugccagcugccacgacgggggauccagcuacggcaaggaggaucaggagccgaaagcugacggccccgaugacgugucuucccaaccucuguggcccggggacgugggauauggcccucucagaaucaaggaagaacaggucagccccucucaguacgggggaagcgaacugccuuccgccaaagauggcgccguucagaacucuuuuagcgagcaauccgcuggggacgcguggcagccgacgggacggcgcaagaauagaaagaacaaagaaaccgugcggcauauuacacagcaaguggaggaugacagccgcgccucuucccccgucccuagcuuccuucccaccucuggcuggccuuuuuccagcagagauuccaaugcugaccugucugugacagaggccagcuccucugauagccggggcgaacgcgccgagcucuaugcucagguugaagaggggcugcugggaggcgaagccuccuaccucgggcccccgcugaccccugagaaggacgaugcgcuucaccaggcuacggccguggccaaccugagagcugcccucaugagcaaaaauucucugcuuucccugaaggcugacguccucggagaugacggcagccugcuguucgaguaccuccccagaggggcccauucucugucccuuaacgaauuuacagugauccggaaaaaguucaaauguccuuauugcagcuuuucugcgaugcaccaguguauccugaagcgccacaugcggagccauaccggagagagacccuaccccugcgaaauuuguggcaagaaauucacacgccgggagcacaugaagagacauacccucguucacuccaaagacaagaaauaugugugcaaggucuguagccgcguguucaugucugccgcuuccgucggcauccggcaugggagcagacgccacggagugugcaccgauugcgccggccgggggauggcuggaccucuggaccacggcgggggcggaggcgaaggguccccggaggcccuuuuucccggagauggcccuuaccuggaggaccccgaagauccuagaggggaggcggaggaacucggagaggacgaugaaggccuggcccccgaggacgcucugcucgccgaugacaaggaugaagaggacucuccgcgcccucggucucccccugggggccccgauaaagacuucgcuuggcuguccuga

SEQ ID NO: 78038 - RNA, 1140 nt, Artificial Sequence
  derived and/or modified sequence opt5 from ZBTB48__Homo_sapiens__XP_011539612
augagaaagcacaccggcgagaaacccuucgaaugcccuaagugugggaaaugcuacuuucggaaggagaaccugcucgaacaugaggcccgcaauuguaugaacagaagcgaacagguguucacaugcuccgucugucaagagacguuucggcgcagaauggagcugcggguucacauggugucucauaccggagaaaugccguauaaaugcagcuccuguucucagcaguucaugcagaagaaggaccuucaaagccacaugaucaaacugcauggcgcucccaagccucacgccugccccacaugugcgaaaugcuuucucucccgcaccgagcugcagcuucacgaggcuuucaagcauagaggggaaaaacuguuugugugugaggaaugcggacaccgggccucuagccgcaauggccuccagaugcauauuaaggccaagcacagaaacgagcggccucacgucugcgaguucuguucccaugcuuuuacacagaaagccaaucugaacaugcaccuucgcacccauacaggggaaaagcccuuccaaugccaccucuguggaaaaaccuuuagaacgcaggcuagccuggauaagcauaaucggacccacacaggcgaacgcccuuucucuugcgaguuuugugagcagagauucaccgaaaaaggcccgcuucugcggcacguggccuccagacaucaggaggggcgcccccacuucugccaaaucuguggaaagacauuuaaagcgguugaacagcuccgggugcaugucagacgccacaagggcgugcggaaguucgagugcaccgaauguggguacaaauuuacgagacaggcccaucugcgccggcacauggagauucacgacagaguugagaacuauaauccucgccaacggaagcugagaaaccugaucauugaagaugagaaaaugguggucguggcucuccagcccccugccgaacuggaggugggaagcgcugaagucaucguugagucucuggcccagggcgggcucgcgucccagcugcccggacaacgccuuugcgccgaggagagcuucacaggcccgggcgugcuggaaccuucucucaucauuaccgcugccgugcccgaagacugugauacauga

SEQ ID NO: 78039 - RNA, 2298 nt, Artificial Sequence
  derived and/or modified sequence opt5 from ZBTB49__Homo_sapiens__NP_660334
auggaccccguggccacccacagcugccaucugcuccagcaacugcacgagcagagaauccagggccuucugugugauugcaugcucgucguuaaggggguguguuucaaagcucauaagaacgugcuggccgcguuuucccaguacuuccggucucuuuuucaaaauagcuccucucagaaaaacgacgucuuccaccuggaugugaagaauguuagcggaauuggccagauccucgacuuuauguauacaucccaucuggaucugaaccaggacaauauucaagugaugcucgauacggcucagugccugcagguccagaacgugcuuucucugugucacaccuuccucaaaagcgccacaguugugcaaccuccggggaugcccugcaauuccacccugagccuucagucuacacugaccccugacgccacaugugucaucuccgaaaacuacccuccucaccuccugcaggagugcagcgcugaugcccaacagaauaagacccuggacgaaucucauccccacgcuuccccuagcgugaaccgccaucacucugccggagagauuuccaagcaggcgccggauacgagcgacggcuccuguaccgaacuccccuuuaaacagccuaauuauuacuauaagcugagaaacuucuacucuaaacaauaucacaagcaugccgcugggcccagccaggagcggguggucgagcagccuuuugccuucuccacaagcaccgaucuuacaaccguugaaucucagcccugcgcugugucccacagcgaguguauccuggaaucuccggagcaucucccuagcaauuuucuggcccaacccgugaacgacuccgcgccucaccccgagucugacgccacgugccagcagcccgucaaacagaugcgccuuaagaaggcuauccaucugaaaaagcucaauuuccugaaaagccaaaaguacgccgaacagguguccgagccuaaaagcgaugacggacugacaaagagacucgaaucugcuuccaaaaacacccuggagaaggccagcucucaguccgccgaagagaaggagagcgaagagguuguguccugcgaaaacuuuaauuguauuucugagacagaacggccggaggaucccgcugcgcuugaggaccagagccaaacccugcagucccagcgccaauacgccugcgaacucuguggcaaaccuuucaagcaccccucuaaccuggagcuucacaaaagaagccauaccggcgaaaagccuuucgagugcaauaucugugggaaacacuuuucccaggcuggaaaccugcagacacaucuccggcgccacagcggcgaaaagcccuauauuugcgagaucugugggaagagauucgccgccucuggagauguccagcggcacauuaucauucauuccggcgagaaaccgcaccugugcgacaucugugggcgcggauuuagcaauuucucuaaccugaaggaacauaaaaagacgcacaccgcugauaaaguguuuacaugcgacgaguguggcaaguccuucaauaugcaaagaaagcucguuaaacaucggauccgccacaccggcgaaagaccuuacagcugcucugccugcgggaaguguuuuggaggcagcggggaucugcggagacacgugcgcacacauaccggagagaaacccuauacgugcgagauuuguaacaagugcuucacacgguccgcgguccuuagacgccacaaaaagaugcauuguaaggcuggcgacgaaagcccugaugugcuggaggaacucucucaggccaucgagaccuccgaccuggagaaaagccaguccucugacagcuuuucccaggauaccucugucacacugaugcccgugagcguuaaacuuccugugcaccccgucgaaaauuccguggccgaguucgacucucauagcgggggauccuacugcaagcuccggagcaugauucaaccgcacggcguuucugaucaggaaaagcugucccuggacccuggcaaacucgcuaagccccagaugcagcaaacccagccccaggccuaugcuuacagcgauguggacacacccgccgggggagagccgcugcaagcggauggcauggccaugaucagaucuucccuugcugcccuggacaaccacgggggagauccccucggcagccgcgcuucuuccacgaccuaucggaauagcgaagggcaguuuuucuccagcaugacacuguggggccuggccaugaaaacccuucagaacgagaaugaacucgaccaguga

SEQ ID NO: 78040 - RNA, 3042 nt, Artificial Sequence
  derived and/or modified sequence opt5 from ZBTB4__Homo_sapiens__NP_065950
augcccccuccggccgaggugaccgaccccagccacgcuccugccguccugagacagcucaacgaacaacggcugcgcggccuuuucugcgauguuacacugaucgcgggggacacgaaguuucccgcucauagauccgugcucgccgccucuagcccuuucuuucgggaggcucugcuuaccuccgcuccccugccucucccgcccgcuacaggaggcgccgcgccuaaucccgccaccacaaccgcugccucuagcuccucuagcuccucuagcuccucuagcuccucuagcuccagcgcuuccucuagcuccucuagcuccagcucuagcccucccccggccuccccucccgcgucuagcccuccccgcgugcuggaacugcccggggucccugccgcugccuucuccgaugugcucaacuuuaucuacagcgcuagacuggcccuuccgggaggcgggggagacggcgccgcuguugcggagaucggcgcccuggggcggcgccucggaauuucuagacugcagggccuuggggaaggaggcgaugcuugggugcccccuacacccgccccuauggccaccucccagcccgaggaggacagcuucgggccgggaccucggcccgcuggcgaaugggagggcgaucgcgccgaagcgcaggcuccugaccugcaauguucucuccccagacggccucugcccugcccgcagugugggaaauccuuuauccacccuaagcgccugcagacgcaugaggcccagugcagacggggagccagcacccgcggcuccacagggcucggagcuggcggggccggacccggcggccccgcuggggucgaugccucugcgcugccuccgcccgugggauucagaggcgggccugagcacguugugaaagucgugggaggccaugugcuuuaugucugugccgcuugcgaacggagcuacguuacccuguccucucucaagagacacagcaaugugcacuccuggcgccggaaauaucccuguagauacugcgagaagguguuugcccuggcugaauaucgcacaaagcaugaggucuggcacaccggggaacggagauaccaauguauuuucugcugggagacguuugugacauauuacaaccuuaaaacccaucagcgcgccuuccacggcaucagcccuggacugcucgcgucugagaagacacccaauggcggguacaaaccuaagcugaacacccugaaacucuaucggcugcuucccaugagagccgcuaagcgcccguacaagaccuauucccagggagccccugaagcuccccugagcccuacacucaauacgcccgccccgguugccaugccugcuucucccccucccggcccucccccggcgcccgagccugggcccccucccuccgugaucaccuuugcccacccugcuccgagcgucauugugcauggaggcucuagcuccgggggcggaggcagcgggacagccucuaccggaggcucccaggccgcuagcguuaucacauacaccgcgcccccucggcccccuaaaaagagagaauaucccccgccuccucccgagcccgccgcuacgcccacauccccugccaccgccgugucuccggcuaccgccgcggggcccgcuauggccacaaccacagaagaggccaaaggacgcaacccucgggcuggcagaacgcugaccuacacagccaagcccgucgggggcauuggaggcgggggaggcccucccaccggggcuggacggggcccgagccaacuucaggccccucccccucugugucagaucacagugcgcauuggggaggaagcgaucgucaaaagacggauuuccgagaccgaccucagacccggcgaacugucuggagaggaaauggaggagagcgaagaggaugaagaggaggaagacgaggaagaggaagaggaggaugaagaggaauccaaggccggcggggaggaccaacuguggcgcccuuauuacucuuacaaacccaagcggaaggcuggagccgcuggcggggccagcgugggaggcuccggccucccgagagggcgcagaccuccccgguggcgccagaaacuggaaagacggagcugggaggagacgcccgccgcugaaucuccugcgggacgcgccagaaccgagcggcgccacagaugcggcgacugcgcucagacauucaccacacuucggaagcugcgcaaacaucaggaagcccacgggggaggcucccauagcucuagagccgggcggagaccguccacccgcuucacguguccccacugcgcuaagguuuguaaaacagccgcggcucucagccggcacggacaaagacaugccgccgagcgcccuggcggcacccccacaccugugaucgcuuauucuaagggguccgccggaacccggcccggcgaugucaaggaagaggcgccucaggagaugcaagugagcuccagcucuggggaagcuggaggcgggagcaccgccgccgaggaagccuccgagacagccucucugcaggacccgaucauuagcggaggcgaggaacccccuguuguggcuuccggcgggucuuacgucuaucccccugugcaggaguuuccccuggcccuuaucggaggcgggagagaaccgggaggcgggcgcggaaaaagcggcuccgagggcccugugggggcgggagaaggcgaucggauggaggggauuggagccgcuaagguuacguucuaccccgagcccuauccucucgucuacggcccccagcugcuggccgcuuauccuuacaauuuuucuaaccucgccgcccugccgguggcucuuaauauggugcugcccgacgaaaaaggggcgggagcccucccuuuccugcccggcgucuuuggcuacgcugugaacccucaggccgcucccccggccccucccaccccucccccucccacacugccgccucccauucccccuaagggggagggagaaagagccggcguugagcgcacccagaaaggggaugugggauga

SEQ ID NO: 78041 - RNA, 2034 nt, Artificial Sequence
  derived and/or modified sequence opt5 from ZBTB5__Homo_sapiens__NP_055687
auggacuuccccggccacuuugagcagaucuuccaacagcugaacuaccagagacuccaugggcagcugugcgauugugugauugucguuggaaaucggcacuuuaaggcccaucgcagcgugcuugcugccugcuccacccacuucagagcgcuguuuucuguggcugaaggcgaccaaacaaugaacaugauccagcucgauagcgaggucgugacggccgaagccuucgcugcccugauugacaugauguauaccuccacacuuaugcugggggagucuaauguuauggaugugcuccuggcugccagccaucugcaccucaacuccgucgugaaagcguguaagcacuaccugaccacacggacccuuccuaugucuccgcccagcgaacgcguucaggagcaguccgccagaaugcaacggagcuuuaugcugcagcagcucggacugucuaucguguccagcgcucuuaauucuucccagaacggcgaggaacaaccugcccccaugucuagcuccaugcgcagcaaucuggaccagagaacaccuuuccccaugcggcgccuccauaaaagaaagcaguccgcugaggaacgggcccgccaaagacugcggccuucuauugaugagagcgcgaucuccgacgucaccccggagaacgggcccagcggagugcacucucgcgaagaguuuuucuccccugauagccugaaaaucguggacaaucccaaggccgauggcaugacggacaaccaggaagauucugcuauuauguuugaccagagcuucggcacccaggaggacgcccaagucccuucccagucugauaauagcgcugggaacauggcccagcucuccauggccagcagagcuacacagguugaaaccucuuuugaccaagaggcggcccccgagaaguccagcuuccagugcgaaaauccggaggugggacugggcgaaaaagagcauaugcggguggucgugaagucugaaccucuuuccagccccgagccucaggaugagguuuccgacgugacaucucaggcugaagggagcgaguccgucgaaguggagggaguuguggucucugccgagaaaaucgaucugagccccgaauccagcgacagaucuuucuccgauccccaaagcucuaccgaccgcgugggcgauauucacauccucgaggucacgaacaaucuggaacacaaguccacauuuagcauuucuaacuuccuuaacaaaagccgggggaauaacuuuaccgccaaucagaacaaugacgauaacaucccuaauacaaccuccgacuguagacuggagagcgaagcuccguaucuccugucucccgaggccggaccugcgggcggccccuccagcgcuccugggucccauguggagaaccccuucucugaaccggccgacagccacuuuguucgcccuaugcaggaggugaugggacugcccugcguccagaccuccggcuaccaagggggagaacaguucggcauggauuuuucucggagcgggcucggacugcauuccucuuucagcagagugaugauuggcuccccucgcggcggggccagcaauuuucccuauuaccggagaaucgcuccuaagaugcccguugugacaucuguccgcuccagccagaucccggagaacucuacguccagccaacuuaugaugaauggagccaccucuuccuucgaaaacggccacccuagccagcccgggcccccucagcugacacgggcuuccgccgacgugcucagcaaguguaaaaaggcgcugucugagcauaaugugcuuguugucgagggagccagaaaauaugcuugcaagauuuguugcaaaaccuuucugacacucaccgauuguaagaaacacauccgcgugcacacgggcgaaaagccguacgccugccugaagugcgggaaacgguucagccaguccucucaucuguacaagcacagcaaaacaaccugucucagauggcaauccucuaaccugcccagcacccuucuguga

SEQ ID NO: 78042 - RNA, 1860 nt, Artificial Sequence
  derived and/or modified sequence opt5 from ZBTB7C__Homo_sapiens__NP_001034449
auggccaacgacaucgaugagcugauuggcauccccuucccuaaucacagcuccgaagugcucugcucucugaacgagcagagacaugacgggcuucugugugauguccuccugguugugcaagaacaggaguaccggacccaccgcagcgugcuugcugccugcuccaaguauuuuaaaaagcuguucacagcgggaacgcucgcuucucagccguacgucuaugaaauugacuuugugcagcccgaggcccuggccgcuauccuggaguucgccuacaccagcacacucaccauuacagcuggcaauguuaaacauauccugaacgccgcgagaaugcuugaaauccaauguauugugaaugucugccuggagaucauggaaccugggggagauggcggggaggaggacgauaaggaagacgaugacgaugacgaggaugacgacgaugaagaggacgaagaggaggaagaggaagaggaagaggaugacgaugacgauaccgaggacuuugccgaucaggaaaaccuccccgacccucaggauauuuccugucaccagucucccagcaaaacagaccaucugaccgagaaggcuuauuccgacacgccucgggauuucccggacagcuuucaagccggaucucccggccaccuuggcgugauccgcgauuucuccauugaaagccugcucagagagaaucuguacccuaaggcuaacauccccgaccggcgcccuucucugucccccuuugccccggauuucuuuccucaccucuggcccggggacuucggagcguuugcccagcugccugaacagcccauggauagcggcccccuugaccugguuauuaaaaauagaaagaucaaagaggaggaaaaggaggaacucccuccgcccccucccccucccuucccgaacgauuucuuuaaagacauguucccugaucugcccgggggaccucuuggccccaucaaggcugagaaugacuauggggccuaccugaacuuucucucugcuacccaucugggaggccuguucccucccuggccgcucguggaggaacggaagcugaaaccuaaggccucccagcaaugccccauuugucacaaagucaucaugggcgccgggaaacuuccccgccauaugagaacacacaccggagagaagccuuacaugugcacaauuugugaagugcgguuuacccgccaggauaagcugaaaauccacaugagaaagcauacgggcgagcggccguaucucugcauucacuguaaugcuaaguucgugcauaacuacgaccugaaaaaucacaugcgcauccauacaggggucagacccuaucagugcgaauuuugcuacaagagcuucacccgguccgaccaccuucacagacauaucaaacgccaaucuugucggauggcgagaccucgccggggaagaaagcccgccgcuuggcgcgccgccagccugcucuuuggcccugggggacccgcuccugauaaagccgcguucguuaugcccccggcucugggcgaggugggcgggcaccugggaggcgccgccgugugccucccugggcccuccccugcuaagcauuuucuggccgcucccaagggagcccuuagccugcaggagcucgaacggcaguucgaggaaacacagaugaaacuguuuggcagagcgcaacuggaggccgaacgcaacgcugggggccuucucgccuucgcucuggccgagaacgucgcggccgcucggccguauuucccucugcccgacccuugggccgcuggacucgccggccugcccgggcuugccggacugaaucacguggcuucuauguccgaggcgaacaauuga

SEQ ID NO: 78043 - RNA, 1422 nt, Artificial Sequence
  derived and/or modified sequence opt5 from ZBTB9__Homo_sapiens__NP_689948
auggagacccccacaccucugccgcccgugccugccagccccacgugcaacccugcucccagaaccauccagauugaguucccucaacacuccucuagccuccuggaaucccuuaaucggcaucgccuggaaggcaaguuuugugacgucucucuccugguucaggggagagagcuucgggcccacaaagcggugcuggcugccgccagcccguacuuccaugauaagcuccugcugggagacgcuccccgccucacacugccuuccgugaucgaagccgaugcuuuugagggccuucugcagcucauuuauucugggagacugcggcuuccccuggacgcccucccugcgcaucugcuggucgccagcggacuccagauguggcaagugguugaucagugcuccgagauccugcgcgaacuugagaccagcggcgggggaauuucugcuagaggcggcaacuccuaccacgcccugcucagcacaaccucuuccacagggggaugguguauccggagcucucccuuccagaccccggugcaguccagcgcuuccacggaaucuccugccagcaccgagucccccgucggcggggagggaagcgaacugggcgaggugcuucaaauccagguugaagaggaagaggaggaagaggaagacgaugacgaugaggaccaggggucugcgacacugucccagaccccucaaccccagcgcgugagcggagucuuucccagaccucacggcccgcacccccucccuaugacagccacgccccggaaacugccugaaggcgagucugcuccccuggagcucccggccccucccgcucugccucccaagauuuucuauaucaaacaggaaccuuuugagcccaaggaagagauuagcggguccggaacccaaccgggcggggccaaggaagagacaaaaguguucucuggaggcgauaccgaggggaauggagaacuuggcuuucugcucccuagcggccccgggcccacauccggaggcgggggaccuagcuggaagccgguggaccugcauggcaacgagauccuuucugggggcggaggccccgggggagccggccaggcuguccacgggccuguuaaacugggaggcacacccccugcggaugggaagcgcuucggcugccucuguggaaaaagauuugccgugaagcccaagcgggaccgccauauuaugcugaccuucucccugagaccuuuuggcugcgggaucuguaauaaacgguucaagcucaaacaccaccugaccgaacauaugaagacgcacgcuggagcccuucaugccugcccccacuguggcagacgcuuccgggugcaugcuugcuuucugagacaccgcgaccucuguaaagggcagggaugggccaccgcgcacuggacauacaaguga

SEQ ID NO: 78044 - RNA, 669 nt, Artificial Sequence
  derived and/or modified sequence opt5 from ZC2HC1B__Homo_sapiens__NP_001013645
auggccggcgcugagcccuuccuggccgacgggaaccaggaacucuuuccuugcgagguguguggaagacgguucgcggcugauguccuggaacgccacggcccgaucugcaagaaacuuuuuaauagaaagcggaaacccuucagcucccugaagcaacgccuccaggggaccgacauuccuacaguuaaaaagacgccccagucuaagagcccucccgugagaaaauccaacuggcggcagcaacaugaggauuuuaucaaugccauucgcucugccaagcaguguaugcuggcuaucaaagaaggaagaccucuuccgcccccucccccucccagccugaacccggacuacauucagcggccuuauugcaugcgcagauucaaugaguccgccgcugagcggcacaccaacuuuuguaaggaucagucuagccgcagaguguucaaucccgcccaaacagcggccaaacucgcuucccgggcccagggccgcgcucagauggggccuaagaaggaacccaccgucacaagcgccgugggagcgcugcugcagaacagaguucucguggccaccaaugagguccccacaaaaucuggccuggcuauggacccugccuccggcgcuaaacuucggcaaggguuuagcaagucuuccaagaaagauuga

SEQ ID NO: 78045 - RNA, 1305 nt, Artificial Sequence
  derived and/or modified sequence opt5 from ZC3H10__Homo_sapiens__NP_116175
augcccgacagagauagcuacgccaacggcaccggguccucuggaggcgggccuggaggcgggggaagcgaggaggcuuccggcgccggcguggggucuggaggcgcgagcuccgacgcuaucugccgggauuuccugcgcaaugucuguaagagagggaaacggugccgcuauagacacccggacaugucugaaguuagcaaccucggaguguccaagaaugaauuuauuuucugucaugauuuucagaacaaagagugcagccggcccaauugucgcuucauccacggcucuaaggaagacgaggauggguacaaaaagacaggagagcugccucccagacuucggcaaaagguggccgccggccugggccucuccccugcugaccugcccaacgggaaagaagaggucccuauuugccgcgauuuucuuaagggagacugucagagaggcgccaaaugcaaguuccggcaucugcagcgcgauuuugaguucgacgcuagagggggaggcgggacgggaggcggcagcaccgggucugugcucccgggacggcgccacgaucuguaugacaucuacgaccugcccgauagaggcuuugaagaccaugagccugggcccaaacggagacgcggaggcuguugcccucccgaugggccgcacuucgaauccuaugaguacagccucgccccuccccggggcguugaauguagacugcuugaggaagagaaugcgaugcugcgcaagcggguggaggaacucaagaaacaggucucuaaccugcuugccacaaaugaggugcugcucgaacaaaacgcucaguuuagaaaucaggccaagguuauuacccuguccagcacagcuccugccaccgagcagacacuggcgcccaccgugggaacggucgccaccuucaaccacggcaucgcucaaacacauaccacacucuccucucaggcccugcagccccgcccugugagccagcaagaacuuguggcuccggccggggcccccgcugcgccucccaccaaugccgcuccucccgccgccccgccucccccucccccucaccugacgcccgagaucacaccgcucuccgcugcccuggcgcagaccauugcucagggaauggccccuccucccgucagcauggcccccguugcugugucuguggccccggucgcucccguggccguuuccauggcgcaaccucuugccggcaucacaaugagccauaccaccacacccauggugacguauccuauugcuucucagagcaugcggaucaccgccaugccccacuga

SEQ ID NO: 78046 - RNA, 2433 nt, Artificial Sequence
  derived and/or modified sequence opt5 from ZC3H11A__Homo_sapiens__NP_055642
augcccaaccagggcgaggacugcuacuucuuuuucuauagcaccuguacaaagggggauuccugcccuuuuagacacugugaagccgcuaucggaaaugagacggugugcacccuguggcaagaaggccgguguuuccgccaggucugcagauuucggcauauggagauugacaaaaagcgcucugaaaucccguguuacugggagaaccagcccacagggugccagaaacucaauugugccuuccaccauaacagaggacgguauguugauggccuguuucuuccucccagcaagaccgugcugccuacagugcccgaguccccugaagaggaagucaaagcgucucaacucagcgugcagcagaauaagcuguccguucagucuaacccgagcccccaacuucgcuccgugaugaaggucgagagcucugagaaugugccuucccccacccacccucccguugugauuaacgcugccgacgaugacgaagaugacgaugaccaguucagcgaggaaggggaugagacaaaaaccccgacgcugcagccuacccccgaaguccauaauggacucagagugacaucugugcggaagccugccgucaacaucaaacagggcgagugccugaauuuuggcauuaagacccuggaggaaaucaaauccaagaagaugaaagagaagucuaaaaagcaaggggaaggaucuuccggcguuagcucccuccugcuucaccccgagcccgugccugggccggaaaaagagaacgugcgcacagucgugagaaccguuacgcugucuacaaagcagggagaggaaccccucgugcggcugagccuuaccgagcgccugggcaaaagaaaguucuccgcugggggagacagcgauccuccccucaagcggucucuggcccagcgccugggcaaaaaggucgaagcuccugagacaaauaucgacaaaacccccaagaaagcccaaguguccaagagccucaaggaaagacugggcaugucugcggacccggauaacgaggacgccaccgauaaaguuaauaaggugggggagauucacgucaaaacacuugaagagauccugcucgaacgggcuagccagaagagaggagagcugcagacgaaacuuaagaccgagggcccuuccaagacagacgauucuaccagcggggcccgcuccagcucuacaauucggaucaaaaccuuuuccgaagugcuggcugagaagaaacauagacagcaagaagccgagcgccaaaagagcaaaaaggacacgacauguauuaagcucaaaaucgauucugaaauuaagaaaaccgucgugcugcccccuaucguugcgucccggggacagagcgaggagcccgccggcaagaccaaauccaugcaggaagugcacaucaagacacuggaggaaauuaaacucgagaaggcucugagaguccagcagucuagcgaauccucuaccagcuccccuagccagcaugaggccacacccggggcucgccggcuucugagaaucacgaagcgcaccggaaugaaagaggaaaagaaccuccaggagggcaacgaaguggacucucaauccagcauucggacagaggccaaagaagccucuggcgagaccacagggguugauaucaccaagauucaggugaaaagaugcgagacgaugcgcgaaaagcacaugcagaagcagcaagagcgggaaaaauccguccugaccccgcuuagaggagacguggcuagcugcaauacacagguggcggagaagccuguucugaccgccguccccggcaucacacggcaccucaccaaacgccugcccacgaagucuagccagaaaguggagguggaaacauccgggaucggagauagccugcucaacgucaagugugcugcccaaacccuggagaagagaggcaaagccaagccuaaagugaauguuaagccgucuguggucaaagugguuuccagccccaaacuugcuccuaagcggaaggccguggaaaugcaugcggcugucauugccgccgugaagccccuguccucuagcuccguucuccaggagccucccgcuaaaaaggccgcuguggccgucgugccucuggugucugaagacaaaagcgucacaguucccgaggcggagaacccgagagacucccuggugcuuccucccacccagucuagcuccgauagcucuccucccgaaguguccgggccgagcagcucccagaugagcaugaagacccgccggcucucuuccgccagcacaggcaaaccuccccuguccgucgaggacgauuucgaaaagcugaucugggagauuagcggaggcaagcucgaagcugagaucgaccuggauccugggaaagacgaggaugaccuucugcucgaacugucugagaugauugauagcuga

SEQ ID NO: 78047 - RNA, 2652 nt, Artificial Sequence
  derived and/or modified sequence opt5 from ZC3H12C__Homo_sapiens__NP_203748
augcccggcgggggaagccaggaguacggcgugcugugcauccaagaauauagaaagaacuccaaagucgagucuagcacccggaauaacuucauggggcucaaggaccaccugggacaugaucuuggccaccuguacguugaauccacagacccucagcucucuccggccgugcccuggagcacgguggagaauccuuccauggauaccgucaacguggggaaagacgaaaaggaggcuucugaggaaaaugccagcuccggagauagcgaggaaaacacaaauucugaccaugaguccgagcagcugggcagcauuucuguugaacccggccuuaucaccaaaacacaccgccagcuguguagauccccuugccucgagccccauauucugaagcggaacgaaauccugcaagauuuuaagccugaggaaagccagaccacaucuaaagaggcgaagaaaccgcccgacgugguccgcgaguaucagaccaagcucgaauuugcucugaaacuuggguacuccgaggaacaggugcaacugguucucaauaagcugggaacggaugcccuuauuaacgacauccugggcgagcucgugaagcuggggaauaaaagcgaagccgaucagaccgucuccacaaucaacaccauuacaagagagaccucuagccuggagucccagcggagcgaaucuccuaugcaggagaucgugacggacgauggagaaaaucuccgccccauugugaucgacggcuccaacgucgcuaugagccacgggaauaaggagguuuucucuuguagaggaauuaaacuggccguggacugguuccuugaacggggccacaaggauaucacaguguuugucccugcuuggcgcaaagagcaaagcagacccgacgcccugauuaccgaucaggagauccuccggaagcuggaaaaagagaagauccuuguguucacaccgucccgcagaguucagggccggcgcguggucugcuaugacgauagauuuauugugaagcuggcguucgaaucugacgggaucauuguuagcaacgauaacuaccgggaccucgccaaugagaaaccugaguggaagaaauuuaucgaugaaagacugcugauguauuccuucgugaacgacaaguuuaugcccccugaugacccccucggacgccauggccccagccuggacaauuuccuucggaaaaagccuauugucccggagcacaagaaacaacccuguccuuacgggaagaaaugcaccuacggacauaaguguaaauauuaccaccccgaaagaggcucucagccucagcgcuccguggcugaugagcugcgggccaugagcagaaacaccgcugccaagacagcgaaugaagggggacucgucaagucuaacuccgugcccugcagcacgaaagccgacuccaccucugauguuaagcgcggcgcuccgaaacggcagagcgacccuuccaucagaacacaaguguaucaggaucuggaggagaaacuucccaccaaaaauaagcuggaaacacgcucugucccuagccucguguccauccccgccaccagcacggcuaagccucagucuacaaccucccugagcaacggccugcccucugggguucacuuuccgccucaggaccaacggccccagggacaguaccccuccaugaugauggccaccaaaaaucauggcacaccuaugccguaugagcaguaccccaagugugauagcccuguggacauuggguauuacucuaugcucaacgccuacagcaaucugucccuuagcggacccagaucuccugaacgccgguucucccuggauaccgacuauagaaucagcuccgucgcuucugauugcagcuccgagggcucuaugagcuguggguccucugacagcuacgugggcuauaacgaucgguccuacgugagcucucccgacccucaacucgaagagaaucugaaaugccagcacaugcauccccacucccgccugaacccgcagccuuuccuucagaauuuucaugacccccucacaagaggacaaagcuauucucacgaggaaccuaaguuccaccauaaacccccgcugccucaccuggcgcuccaucugccccacuccgccguuggcgcucggagcucuugcccuggggauuaccccuccccucccagcuccgcccacagcaaggccccgcaucuuggaagaucucuggucgcuacgcgcauugacagcaucuccgauucucggcucuaugacagcucccccucuagacagcgcaaaccuuacagcagacaggagggccugggguccugggaacggcccggauacggcauugaugccuauggguaccgccaaaccuauucucugccugacaacagcacacagcccuguuacgagcaguuuaccuuccagucccuuccugaacaacaggagccggcguggagaauccccuauugcggcaugccucaggaucccccucgguaccaggacaaccgcgagaagaucuauauuaaucucuguaacaucuuucccccggaucuggugagaauugugaugaagcggaauccucacaugacagacgcucaacagcuggccgccgcuauccucgucgaaaagagccagcugggauacuga

SEQ ID NO: 78048 - RNA, 1584 nt, Artificial Sequence
  derived and/or modified sequence opt5 from ZC3H12D__Homo_sapiens__NP_997243
auggagcaccccagcaagauggaguucuuucagaaacugggcuacgacagagaagaugugcuccggguccuggggaaacuuggagaaggcgcccugguuaacgacgugcuccaagagcugauccgcaccggguccagaccuggagcucuugaacauccggccgcgccccggcuggugccucgcggcucuugcgggguccccgauagcgcucagagaggaccuggcacagcccucgaggaggacuuccggacgcuggccuccucucugcgccccauugugaucgauggcagcaauguugcuaugucccacgggaacaaggaaaccuuuucuuguagaggaauuaagcucgccguggacugguuccgggaucgcggccauacauauaucaaagucuuugugccuagcuggagaaaggacccgccccgggcugauaccccuauucgcgagcagcacguucuggccgaacuugagagacaggcggugcuggucuacacacccucccggaaggugcaugggaaacgccucgugugcuaugacgauagauacaucgucaagguugccuaugagcaagacggagugaucgugagcaaugauaacuaccgggaccugcagucugaaaauccugaguggaaaugguucauugaacagagacuucugauguuuuccuucgucaacgaccgcuuuaugcccccggaugacccucucggccggcacgggcccagccugucuaauuuccuguccagaaagccuaaaccucccgagcccagcuggcagcacuguccguauggaaagaagugcaccuacggcaucaaauguaaguuuuaccaucccgaacgcccucaccaugcucaacucgccguggcugaugagcugcgggccaaaacaggcgcgagacccggggccggagcugaggaacagcgcccuccccgggccccgggcgggucugcuggagccagagccgcuccucgcgagcccuucgcgcacucccuuccucccgcccggggcagcccugaccuggcugcccucagaggguccuuuucucgccuggccuucagcgaugaccuuggaccccugggcccgccucuccccguucccgcuugcucccugaccccucggcugggcgggccggauugggugagcgccggaggcagaguccccgggccucucucucugcccuccccugaaagccaguucucucccggagaccuuccucccccgccuggccugcagcuccaaccccgcggggagcaccggccuagagaucugcauggcgaccuucugagcccccggagaccgccugaugaccccugggcgcgcccuccccgguccgacagauuucccggacgcucugugugggcugaaccugccuggggcgauggggccacgggaggccucagcguuuaugcuaccgaggacgaugagggggacgccagagcucgggcccgcauugcgcuguacuccguguucccgagagaucaggucgaccgggugauggccgcuuuucccgaacugagcgaucucgcccgccugauccuucugguccagagaugucaaucugcuggagccccucucggcaagcccuga

SEQ ID NO: 78049 - RNA, 2208 nt, Artificial Sequence
  derived and/or modified sequence opt5 from ZC3H14__Homo_sapiens__NP_001153575
auggagaucggcaccgaaauuagcagaaagauccgguccgccauuaaagggaagcugcaggagcucggagcuuacgucgacgaagaacugcccgauuauaucauggucaugguugccaacaaaaagucucaagaccagaugacagaagaucuuagccuguuccucggcaauaacacgauucgcuuuaccguguggcugcacggggugcuugacaaacugagauccgucacaaccgagccuucuagccucaaguccucugauacaaauaucuucgacagcaacgugccguccaauaagagcaacuuuucucggggagaugagcgcagacaugaagcggcuguucccccucuggccauccccuccgcccggccugagaaacgcgacagcagagugucuaccuccagccaggaaucuaagacaaccaauguccggcagacguacgaugacggcgcugccacccgccugauguccacagugaaaccccucagagagccugcuccgagcgaggauguuauugacaucaagcccgaaccugaugaccugauugacgaggaucuuaacuucgugcaagaaaauccccugucccagaaaaagccuaccgucacacucaccuaugggucuagccggcccuccaucgagauuuaccgcccgccugccagcagaaacgcggacucuggagugcaccugaaucggcuucaguuucagcaacagcagaacuccauccaugccgcuaagcagcuggauaugcaaagcucuuggguguaugaaacgggccgccucugcgagcccgagguccugaauagccuggaagagacauacuccccuuucuuuagaaacaauucugagaaaaugagcauggaggacgaaaacuuccggaagagaaaacuccccguuguguccagcguggucaaggugaaaaaguuuaaccacgauggcgaggaggaagaggaagacgaugacuaugggucucgcaccggauccauuucuagcuccguuagcgugcccgccaaaccugagcggagaccgucccugcccccuucuaagcaggcuaauaagaaccuuauccugaaagccaucagcgaagcgcaggaguccgucacaaagaccaccaauuacucuacagugccccaaaaacagacgcucccuguugcuccccgcacccggacaagccaggaggaacugcuugccgaggugguccagggccaauccagaaccccgcgcauuagcccucccaucaaggaagaggagacaaaaggggauucuguggaaaagaaccagggaacccagcagcggcaacugcucuccagacugcagauugacccugucauggccgagacgcugcagaugagccaggauuacuaugacauggaaucuauggugcaugcugacacacgcuccuucauccucaagaaacccaagcugagcgaggaaguuguggucgccccuaaucaagagucuggcaugaaaaccgccgauagccuucgggugcuguccgggcaccucaugcagaccagagaccugguucagcccgauaagccggcuagcccuaaauuuauugugacacuugacggaguccccucucccccuggcuacauguccgaucaggaggaagacauguguuucgagggcaugaagccggugaaccaaaccgcggccagcaauaaggggcugcgcggacuccugcacccccagcagcugcaucuccugucccggcaacuugaagauccuaacggcucuuuuagcaaugcugagauguccgaacugucuguggcccagaaacccgagaagcuccuggagagaugcaaauauuggccugccuguaagaacggggacgaaugcgcuuaccaccaucccaucagcccuuguaaagccuuccccaauugcaaguucgcggagaagugucuguuuguucacccgaacugcaaauaugaugcuaaguguacaaaaccugacugccccuucacgcacgucucccggcgcaucccugugcuuucucccaagccgguggccccucccgccccucccagcuccagccagcucuguagauacuuucccgcuugcaaaaagauggaaugcccuuucuaucauccgaaacacugucgguuuaauacccagugcacaagacccgauuguaccuucuaccauccuacaauuaacgugcccccucgccacgcccugaaguggauccggccccaaaccucugaguga

SEQ ID NO: 78050 - RNA, 1281 nt, Artificial Sequence
  derived and/or modified sequence opt5 from ZC3H15__Homo_sapiens__NP_060941
augcccccuaagaaacaggcccaagcuggcgggagcaagaaagccgagcagaagaaaaaggaaaagaucauugaggacaaaaccuucggacugaagaacaaaaagggcgcgaaacagcagaaguuuaucaaggcugugacacaccaagucaaauucgggcagcagaauccgagacagguugcccaauccgaagccgagaagaaacucaagaaagaugacaagaaaaaggaacugcaggagcuuaacgagcuguuuaagcccgugguggcugcccagaaaauuucuaagggagcugauccuaaaagcgucgugugcgccuucuuuaagcagggccaauguacgaaaggggacaagugcaaguucucccaugaucucacccuggaacggaaaugugagaagcgcucuguuuacaucgacgcgagagaugaagaacuugagaaagacacaauggauaauugggacgaaaagaaacuggaggaaguggucaacaagaagcacggagaggccgagaaaaagaaacccaagacccagauugugugcaaacauuuucucgaggcuaucgagaauaacaaguauggcugguucuggguuuguccuggcgggggagauaucugcauguaccggcacgcccugcccccuggcuuugugcugaagaaagacaagaaaaaggaagagaaagaagaugagauuagccucgaagaccugaucgagcgcgagagauccgcucuugggccgaaugucacaaagauuacccuggaaucuuuccucgccuggaaaaagcggaagcgccaggagaaaaucgacaagcuggaacaagauauggagagacggaaagcggacuuuaaggccggaaaagcucuugugauuagcggccgcgaaguguucgaguuuagacccgagcuggucaacgaugacgaugaagaggccgacgauacacgguauacccaggggacgggaggcgacgaaguugaugacuccgugagcgugaaugauaucgaccucucucuguacauuccucgcgacgucgaugagaccggcaucacaguggcuucccuggagagauucagcaccuauacaucugacaaggaugaaaacaagcucuccgaggccagcgggggacgggccgaaaauggcgagcgcucugaccuggaagaggauaacgagagagaagggaccgagaauggagcuaucgacgcgguucccguggaugaaaaccuuuucacgggcgaggaccuggaugaacucgaggaggaacugaauacacuugaccuggaggaauga

SEQ ID NO: 78051 - RNA, 2847 nt, Artificial Sequence
  derived and/or modified sequence opt5 from ZC3H3__Homo_sapiens__NP_055932
auggaggaaaaggagauccugagacggcagauucgccuccugcaaggccuuaucgacgauuacaaaacccugcacgggaacgcccccgccccuggaacaccggccgcgagcggcuggcagcccccuacguaucauuccgggagagcuuucucugcccgguacccccgcccuagcagacggggauauuccucucaccauggccccagcuggcgcaagaaauacucccucgugaauagaccuccggggcccucugacccucccgccgaucacgcuguccggccucugcauggagcccgcggcggccagcccccgguuccucagcaacacgugcuugaaagacaggugcagcugagccaggggcaaaacgucgugauuaagguuaaacccccuuccaagagcggaucugcuuccgccagcggcgcgcagcgggggucucucgaggaauuugaggagacccccugguccgaccagcgccccagagaaggagagggcgaaccuccgcgggggcagcugcaacccagccgcccuacaagagcccggggaaccugcucuguggaggauccccugcucgucugucagaaggagccuggcaaacccagaauggugaaguccguuggcagcgugggggacuccccgcgcgaaccucggagaacagucucugagagcgugaucgcugugaaagccuccuuccccagcucugcucugccuccccgcaccggagucgcccuuggccggaagcuggggucccacagcguugcgucuugcgccccucagcuccugggagauagacgcguggacgcuggccauacagaucaacccgugccgagcggguccgucggaggcccugcccggcccgcuucuggccccagacaggcccgcgaagccagccuugugguuaccugucggacgaauaaauuuagaaagaacaauuauaaguggguggcugcguccagcaaaucuccucgcgucgcccggagagcucuguccccgcggguggccgccgagaacguuugcaaggcuagcgccgggauggcgaauaaaguggaaaagccccagcucauugcugacccugagcccaaaccucgcaagcccgccaccucuuccaaaccuggaagcgcccccuccaaguacaaguggaaggcuucuagcccguccgccucuagcuccagcucuuucagauggcaguccgaggcuagcucuaaggaucacgccucccaacugagcccuguccugucucggagccccuccggcgacagaccugcgguggggcauagcggacucaaaccccugucuggcgaaacaccgcuuuccgccuauaaggucaaaagccgcaccaagaucauccggagacgcuccucuacaagccugccuggggauaagaaauccggcaccucucccgcugccacggcuaagagccaccucucccugagacggcgccaggcccuuagaggaaaaucuagcccugugcugaagaaaacacccaacaagggccucguucaggugaccacacaccggcugugucgccugcccccuuccagagcgcaucucccgaccaaggaggccagcucucugcacgcuguccggaccgcccccacauccaaagugauuaagacgcgcuacagaaucguuaaaaagaccccugcuagcccccuuucugccccucccuuuccucugucccucccgagcuggcgggcccgcagacugucucuuucccggagccuggugcucaauagacugcgccccgucgcuuccgggggaggcaaagcgcagccugggagccccugguggcggucuaagggauacagaugcauuggcggggugcuguauaaggugagcgccaacaaacucuccaagacaucuggccaaccuagcgacgcuggaucccgcccccugcuucggaccggcagacuggacccggccgggucuuguagccgcucccucgccucucgggcuguucagagaagccuggccaucauucgccaggcgcggcagagacgggaaaaacgcaaggaguacugcauguauuacaauagauucggacgguguaaccgcggcgaaagaugcccuuauauccaugaucccgagaaagucgcuguguguacacgguuugugagagggaccugcaagaaaacggacggaacaugccccuucucccaccaugucagcaaggagaagaugccuguguguucuuacuuucugaaaggcauuugcuccaauagcaacugucccuauucucacguuuacgugucccgcaaggccgaagucugcagcgauuuccuuaaaggguacuguccucucggcgccaagugcaaaaagaagcacacccugcuguguccggacuuugcucggagaggagccugcccccgcggcgcgcaaugucagcuccugcaucggacccagaaaagacacucccgccgggcugccacaucuccugcccccgggccuagcgaugcuaccgccagaucccgcgugagcgcuucucauggacccagaaagccguccgccagccagcggccuacacgccaaacgcccucuagcgcggcccuuaccgcugccgcuguugccgccccuccccacugcccuggcggguccgcuucucccagcuccucuaaagcgagcuccucuagcuccagcuccucuagcccgccugccucccuggaccacgaggcucccucucuccaggaagccgcccuggcugccgcguguagcaauagacugugcaaacuucccuccuucaucagccuccagucuuccccuagcccgggagcucaaccccgggugcgcgccccuagagcuccccugacaaaagauucuggcaagccucugcauaucaagccccggcucuga

SEQ ID NO: 78052 - RNA, 3912 nt, Artificial Sequence
  derived and/or modified sequence opt5 from ZC3H4__Homo_sapiens__NP_055983
auggaggccgcucccggcaccccuccgcccccucccagcgaauccccucccccuccgucucccccucccccuagcacacccuccccgccucccugcucuccugacgccagacccgcgacgccccaccugcuccaucaccggcugccucuuccggaugaccgcgaggauggggaacuggaggaaggagagcucgaggacgauggcgcugaagagacccaggacacaagcgggggacccgaaagaucccggaaggagaaaggcgagaagcaucacucugauagcgacgaagagaaaucccaucgcagacugaagcggaaacgcaagaaggaaagagagaaagaaaagcggcgcagcaaaaagagacggaaaucuaagcacaagcgccacgccuccagcucugaugacuucuccgauuuuagcgacgauucugacuucuccccuagcgagaaagggcauagaaaguaccgggaguauucccccccuuacgcccccucucaccaacaguauccgccuagccaugcuaccccccuuccuaaaaaggccuacuccaaaauggacagcaagucuuauggaauguacgaagauuaugagaacgaacaguacggcgaguacgaaggcgacgaggaggaagauauggggaaagaggacuaugaugacuuuacaaaggaacugaaucaguaccgcagagcuaaggagggauccagccggggcagagggucucgcggacggggcagaggguaucgcggacggggcagcagaggcgggucccgcggacggggcauggggagaggaucucgcggccgggggagaggaagcaugggcggcgaucaccccgaagacgaggaggauuucuacgaagaggaaauggacuauggggaguccgaggaaccuaugggagaugacgacuacgaugaguauagcaaagaacucaaccaauaccgccggucuaaggacuccagaggccgggggcugagccgcggaagaggccgggggucuagaggccgcggaaaaggcauggggcggggaagaggccgcgggggauccagaggcgggaugaauaagggcggaaugaacgaugacgaggauuuuuacgacgaagauaugggcgacgggggaggcgggagcuaucggucccgcgaucacgacaaaccccaucagcagucugauaagaagggaaaagugaucuguaaguacuucgucgagggcagaugcaccuggggggaccacuguaauuuuagccaugauauugagcugccgaaaaagcgggaacucugcaaauucuauaucacaggcuuuugugcccgcgcggagaacugcccuuacaugcacggagacuuccccuguaagcuguaucauaccacgggcaauugcauuaacggggacgauuguauguuuucccacgacccccuuaccgaagagacaagagaacugcucgauaagaugcuggccgacgaugcugaggccggagcugaggacgaaaaagagguugaagagcuuaagaaacagggcaucaauccucugccgaagcccccucccggggugggacuccugccuacccccccucggcccccgggcccucaagcccccacaucuccuaacgggcgccccaugcagggcggaccgccucccccuccccccccuccgcccccucccccuggccccccucagaugccgaugcccgugcacgaaccucugagcccccagcaacuccagcagcaagauauguacaauaaaaagauuccuucccuguucgagaucgucgugagacccaccgggcagcuugcggagaagcugggaguucgguuuccgggcccugggggaccccccggcccuaugggccccgggccuaacaugggaccgcccggcccuauggggggacccaugcauccugacaugcaccccgauaugcauccggacaugcacccugauaugcacgccgacaugcaugcugauaugcccaugggcccugggaugaaucccggaccucccaugggcccgggcgggccucccaugaugcccuauggaccuggcgacagcccgcacucugggaugaugcccccuauccccccugcccagaacuucuacgaaaauuucuaccagcaacaggagggaauggaaauggagcccggccuccugggggacgcugaggauuauggacauuacgaagagcuuccuggcgaaccgggcgagcaccuguuucccgaacauccucucgagcccgacuccuucagcgaggggggaccucccggccgcccgaaaccuggggccggagugcccgauuuucugcccucugcccagagagcucuguaucuccggauucagcaaaagcagcaggaagaggaagagagagcgcgccggcuggccgaauccagcaaacaggacagagagaacgaggaaggcgauacggggaacugguacucuagcgacgaggaugaaggaggcuccagcgucacaucuauccuuaagacccugcgccaacagacauccagccggccucccgcuuccgugggcgagcucucuagcuccgggcugggagacccuagacuucagaaaggccacccgaccgggucucgccuggccgauccccggcucagcagagacccucgccugacccggcacguugaagccuccggaggcucugggcccggagauagcggcccuuccgaccccagacuggcucgggcccucccgacaagcaagccugagggcucucugcauuccagccccguggggccuucuuccagcaaaggaucuggccccccucccacggaggaagaggaaggggagcgcgcgcuuagagagaaggcugucaauauuccgcuggacccucuccccggacacccccugcgggauccucgcucccagcugcaacaguucagccauaucaagaaagacgugacccuuuccaagccgagcuuugccagaacagugcucuggaaccccgaagaucugauuccucugcccaucccuaaacaggacgccguccccccuguucccgcugcccuccaaucuaugccgacccuggauccucggcuucacagagcugccacagcgggccccccuaaugcccgccagcggcccggggcuagcaccgacuccucuacgcagggagccaaccugccggauuucgagcuccugagcagaauucugaagacagugaaugcuaccggcuccucugccgcgccuggcagcuccgacaaacccucugauccccgcgugcggaaggccccuaccgaccccagacuucagaagccuacagauagcaccgcuuccagccgcgccgcuaaaccggggcccgccgaagccccuucucccacagcuuccccuagcggagacgcgucucccccugccacggcuccguaugauccccggguccucgccgccggcgggcugggacaaggcgggggaggcggccaguccagcgugcuguccgggaucucucucuacgacccuagaacccccaacgcuggaggcaaggccacagagccugcggcugacaccggggcccagcccaaaggagccgaaggcaaugggaagagcuccgcuagcaaagccaaggagccgccuuuuguucgcaagucugcgcuggagcagcccgaaacaggcaaagcuggagccgauggcgggacccccacggacagauauaacuccuacaaucggccucgccccaaggccgcugccgcuccugccgcgaccacagccaccccgcccccugagggagcucccccucaacccggcgugcauaaccuuccggucccuacacuguucgggaccgugaaacagacgcccaagacaggaagcggcucuccuuuugccgggaauagccccgcuagagaaggcgagcaggaugccgccucccucaaagacguuuucaagggauuugauccgaccgcuucuccuuucugccaguga

SEQ ID NO: 78053 - RNA, 2916 nt, Artificial Sequence
  derived and/or modified sequence opt5 from ZC3H7A__Homo_sapiens__NP_054872
augagcaacguguccgaggaaagacggaagcgccagcaaaauaucaaagagggccugcaguucauucagucuccccucagcuacccugggacccaggaacaauaugccgucuaccugagagcucuuguucggaaccuguuuaaugagggaaacgacguguaucgcgaacacgauuggaauaacuccaucucucaguacacagaggcccucaauauugcggacuaugcuaagagcgaggaaauccugauuccgaaagagaucaucgaaaagcuguacauuaacagaaucgccugcuauuccaauaugggcuuccaugauaaagugcuggaggacuguaacauuguccucucucugaaugccagcaacugcaaggcucuguaccggaaguccaaagcccucagcgaucuggggcgcuacaagaaggcuuaugacgccguggcgaaguguucucuugccguuccccaggaugagcacgugaucaaacugacgcaggaacucgcucaaaagcugggauuuaagauuagaaaagccuacguccgggcugagcuuucccuuaagagcgugccuggcgacggggccaccaaagcgcucaaucauucuguugaagauaucgagcccgaccugcugacaccucgccaggaagccgugcccgucgugucccucccugcuccgagcuucucucacgaggugggauccgagcuggccagcguccccguuaugccucuuaccuccauucugccccuccagguggaagagucugcucugccuagcgccgugcuugccaacggcggcaagaugcccuuuacaaugccggaggcuuuccuggaugacggggauaugguccucggagacgaacuggacgaucugcucgacuccgcgccugaaaccaaugagacagugaugcccagcgcccugguuagaggcccucuucagaccgcuucugugucccccagcaugcccuuuucugccagccugcucgggacgcugccuaucggagcccgguaugcuccgcccccuuccuucucugaguuuuaucccccucuuaccagcucccuggaagauuucugcagcucucucaacuccuuuagcaugucugaguccaaacgcgaccugagcacauccaccucuagagaaggcacaccccugaacaauagcaacuccucucuccugcuuaugaaugggccgggaagccuguucgccuccgagaacuuucucggcaucagcucucaaccucggaaugauuucggcaacuucuuuggguccgcggucaccaagcccuccucuuccgugacgccucgccauccccuggaaggaacacacgagcugagacaggcuugucagauuugcuucguuaaaagcggcccuaaacuuauggacuuuaccuaccacgccaauaucgaucauaaguguaaaaaggacauucucaucgggcggauuaaaaacguggaggauaagucuuggaaaaagaucagaccccgcccgacaaagaccaauuacgaaggaccuuauuacaucugcaaagacgucgccgcugaggaagagugucgguacagcggccacugcaccuucgccuauugucaagaggaaauugauguguggacacuggagagaaagggggcuuuuucccgcgaagccuucuuuggaggcaacggcaaaaucaaucugacggucuucaagcuccugcaggagcaucuuggggaauuuauuuuccugugcgagaaaugcuuugaccacaagccccggaugaucagcaagagaaacaaagacaauucuaccgcguguucccaccccgugacaaagcaugaguucgaagauaacaaaugccucguucacauucugcgcgagaccacagugaaguacagcaaaauccgguccuuucauggacagugucagcuggaccuuugcagacacgaaguccgcuauggcugucuccgggaggaugaaugcuucuacgcccauucucugguggagcugaagguuuggaucaugcaaaaugagaccgggauuagccacgacgcuaucgcccaggaauccaagagauauuggcagaaccucgaggcuaacgugccuggagcccagguccugggcaaucaaauuaugccgggguuccuuaacaugaaaaucaaguuugugugugcgcagugccugcgcaauggccaggugauugaacccgauaaaaaccggaaguacuguucugccaaagcuagacacagcuggacgaaggaccggcgcgccaugagaguuauguccaucgagcggaaaaaguggaugaauauuagaccucuccccacaaagaaacagaugccucugcaauucgaucugugcaaccauaucgcuucuggaaagaaaugucaguaugucggcaauugcagcuuugcccacucccccgaggaacgcgagguguggaccuacaugaaggaaaacgggauccaggacauggagcaguucuacgaacuuuggcucaaaagccaaaagaaugagaagucugaggauauugccucccagagcaacaaagaaaauggaaagcagauccauaugccuaccgacuaugcugaggugacagucgauuuucacugcuggauguguggcaaaaacugcaauucugaaaagcaauggcaggggcacauuuccagcgagaaacauaaggaaaagguguuccacaccgaggacgaucaguacuguuggcagcaucgguuucccacaggauauuucucuaucugcgacagauacaugaacggcacguguccggaggggaauagcugcaaauuugcgcacggcaacgccgaacugcaugagugggaggaacgcagagacgcucugaagaugaaacucaacaaggcccggaaagaucaccugauuggaccuaaugacaacgauuucggcaaguauagcuuucuuuucaaggaccugaauuga

SEQ ID NO: 78054 - RNA, 2934 nt, Artificial Sequence
  derived and/or modified sequence opt5 from ZC3H7B__Homo_sapiens__NP_060060
auggagagacagaagcggaaagccgacaucgaaaagggccugcaauucauucagagcacccucccccugaaacaggaggaauacgaggcuuuucuucugaagcucgugcagaaccuguucgccgaagggaaugaucuuuuucgcgagaaagacuauaagcaagcgcugguccaguacauggagggacucaacguugcugauuaugccgccuccgaccagguggcucugccuagagaacugcucugcaagcugcacgugaaucgggccgcuuguuacuucacaaugggccuuuaugagaaagcccuggaagauucugagaaggcgcucgggcuggacagcgaguccauccgcgcccuuuuuagaaaagcucgggcccugaacgaacucggacgccauaaggaggcuuacgaaugcucuagcagauguucccuggcccugccgcacgaugagucugucacgcagcucggccaagaacuggcgcagaaacuugggcugcgggugcgcaaggccuauaagagaccccaggagcucgagaccuucagccugcuuuccaauggaacagcugccggcguugcugaccagggcaccagcaacgggcugggaucuauugaugacaucgaaacagauugcuacguggacccucggggcucccccgcccuccugccuagcacccccacaaugccucuguuuccgcauguccucgaucugcuugcuccccuggacucuucccgcacccucccuagcacggacucucuggaugacuucuccgauggggacguguuuggacccgagcuugauacccugcucgacagccugucccugguucaaggcgggcucucuggaagcggcgugccuuccgaacugccccagcuuauuccggucuucccuggcgggacaccccugcucccucccguggugggaggcagcauccccgucucuuccccucugccgcccgccagcuuugggcugguuauggauccuucuaaaaagcucgcggccagcgugcuugacgcucuggaucccccuggacccacccuggacccgcucgaucugcuuccuuacuccgagacaagacuggacgcccucgacucuuucggcagcacccgggggucccuggauaaacccgacagcuuuauggaagagacaaauucucaggaucaccgcccucccuccggagcccaaaagccugcucccagcccggagccuuguaugcccaacacggcccugcuuaucaaaaauccccucgcggcuacccaugaguucaagcaggccugccagcuguguuauccuaaaacaggcccgagagccggcgacuacaccuaucgggaggggcuggaacacaagugcaagagagauauucuccugggacgccuucggucuuccgaggaccagaccuggaaaagaauccgcccccggccuacaaagacgagcuucgugggcuccuacuaucuguguaaagauaugauuaacaagcaagacugcaaauacggggauaauuguaccuuugcuuaucaccaggaagagaucgacgucuggacagaggaaagaaagggaacccucaaccgcgaucugcuguucgacccccuuggcggggugaagcggggcucucucacaauugccaaacugcugaaggagcaucagggaaucuuuaccuuccucugcgaaauuugcuuugauagcaaaccuagaaucaucuccaagggcacgaaagacucucccagcguuuguuccaaucuggcugccaagcacagcuucuacaacaauaagugccuugugcauauuguccgcucuacaucccugaaauacagcaagauccggcaguuucaagagcacuuccaguuugacguguguagacacgagguucgcuaugggugccuccgggaagauucuugucauuucgcgcacuccuuuauugagcugaaaguguggcugcuucagcaguacagcggaaugacccaugaagacaucguccaagagucuaagaaauauuggcagcagauggaagcccacgcuggcaaggccagcuccagcaugggggcuccuagaacccauggacccucuacauucgaucuccagaugaaguuugugugcggccaauguuggcggaacgggcaggucguggagccggacaaagaucugaaguacugcuccgccaaagcgcgccacuguuggaccaaggagagacggguucugcucgugaugagcaaagccaagagaaaaugggucuccgugcgcccucugcccucuauucggaacuucccucagcaauaugaccuuugcauccacgcucagaauggcagaaagugucaguacguuggaaacugcagcuucgcccauucccccgaagaacgcgauauguggacauuuaugaaggaaaauaaaauccuggacaugcagcaaacguaugauauguggcucaagaaacacaacccgggcaagccuggggagggaacccccauuucuagcagagaaggcgagaaacagauccagaugccuacagacuacgcugauauuaugaugggguaccauugcuggcuguguggaaagaacuccaauucuaagaaacaguggcaacagcacauccagagcgagaagcacaaagaaaagguguucaccuccgacagcgaugccucuggcugggccuuucgguuccccaugggggaguuucgccugugcgacagacuucagaaaggcaaggcuugucccgacggagauaagugccggugugcgcauggccaagaggaacugaaugaauggcucgaccgcagagagguccugaaacagaagcucgccaaagcucggaaggauaugcugcuuugcccucgcgacgaugacuucgggaaauauaacuuucugcuccaggaggauggagaccuggccggcgccacaccggaagcucccgccgcggcugccaccgccacgaccggggaguga

SEQ ID NO: 78055 - RNA, 2709 nt, Artificial Sequence
  derived and/or modified sequence opt5 from ZC3HAV1__Homo_sapiens__NP_064504
auggccgaccccgaggugugcuguuucaucaccaagauucugugcgcucacggcgggagaauggcccucgaugcgcugcuucaggaaaucgcucugagcgagccucaacucugugaaguccugcagguugccggaccggaccgguuuguggugcuugagacaggcggggaagccggaauuacgcgcuccgucguggcuaccacaagagcccggguuugccgcagaaaauacugucagcggcccugcgauaaccugcaucucuguaagcugaaucugcucggccgcugcaacuauucucagagcgagagaaaucuguguaaauacucccacgaggugcuuucugaagagaacuucaagguccugaaaaaucaugaacucagcgggcugaacaaggaggagcuugcugugcugcuccugcaauccgaccccuuuuucaugcccgaaaucugcaagucuuauaaaggagagggccggcagcagauuuguaaucagcaaccucccugcagccgccugcacaucugcgaucauuuuaccagaggcaacugucgguucccuaauugccuccgcucccacaaccugauggacagaaagguucuugccaucaugcgggaacacgggcugaauccggaugugguccagaacauucaggacaucuguaauagcaaacauaugcagaagaacccuccuggaccccgcgcgccuucuucccacagacggaauauggccuacagagcucgcagcaaaucucgggauagauuuuuccaaggcucccaggaguuucucgccagcgcuucugccuccgcggaacgcagcugcacacccuccccggaccagauuucucaucgggccagccuggaggaugcuccuguggacgaucuuaccagaaaguucacauaucuggggucccaagaccgcgcccggcccccuagcggaucuuccaaggcuaccgaccucggcgggacgagccaggccggaaccucucagagauuucuggagaacggcagccaggaagaucugcuccacggcaaccccggguccacauaccuggccucuaauagcaccuccgcucccaacuggaaaagccuuacaucuuggaccaaugaccaaggagcgcgccggaagacgguguucuccccuacacugccggccgcuagaagcucucucggcucccugcagacccccgaggccgucacaacccgcaaagggaccggacuucugagcuccgauuaucggaucauuaacggcaagucugggacacaggacauccagccuggaccccucuuuaauaacaaugccgauggcguugcuacggacauuaccagcacaagaucccugaacuacaaaucuaccagcuccggccaccgggaaaucagcucuccucgcauccaagaugccgggcccgcguccagagacgugcaggcuacaggacggauugccgaugacgccgauccgagaguggcucuggucaaugacagccucucugacgugaccuccacgacaagcucucgcguugaugaccaugauagcgaggaaaucugucuggaccaccuuugcaagggcuguccucugaacggguccugcagcaaagugcauuuccaccuccccuaccgguggcagaugcugauuggaaagaccuggaccgauuucgagcauauggagacaaucgaaaagggcuauuguaauccugggauucaccugugcucugucggcuccuacaccaucaacuuuagagugaugagcugugacuccuuccccauccgcagacuuucuacaccuagcuccguuacgaaacccgccaauucuguguuuaccacaaaguggauuugguauuggaaaaacgagagcggaaccuggauccaguacggcgaagagaaggauaaacggaaaaauuccaacgucgacucuagcuaucucgaaucccuguaccaaagcugcccgcgcgggguggucccuuuccaggcuggaucuagaaacuaugagcuguccuuucagggcaugauucagacaaauaucgccagcaagacccaaaaggaugugauucggcgccccacguucguuccccagugguacgugcagcaaaugaagagagggccugaccaccagccggcgaaaaccucuuccgucagccucacagccaccuuucggccccaggaggauuucugcuuucugucuuccaagaaauacaaacuuagcgaaauccaucaccuucauccugaguaugugcgcguuuccgaacacuucaaggcuagcaugaagaacuuuaagaucgagaaaauuaagaaaaucgaaaauucugagcuccuggacaaguucacauggaagaaaagccagaugaaggaggaaggaaaacugcuguuuuacgccaccuccagagcuuauguggagucuauuuguagcaacaauuucgauuccuuccuccacgaaacgcaugagaacaaguacggcaaagggaucuauuuugccaaggacgcgauuuacucucacaaaaauugccccuaugacgccaagaacgucgugauguucguggcucaaguucuggucggcaaguuuacagagggaaauaucaccuacacaagcccucccccucaguucgauuccuguguggacacccggucuaaccccagcguguuugucauuuuccagaaagaucagguguacccgcaauauguuaucgaauacaccgaggacaaggccugcgugaucuccuga

SEQ ID NO: 78056 - RNA, 1446 nt, Artificial Sequence
  derived and/or modified sequence opt5 from ZC3HC1__Homo_sapiens__NP_001269119
augagaggccugccccggaagcgcgaggccuggacccagccucacccgcucgaagcucuguacgagagccuuagagugcuggaaaaagacacauccgccacgucucaaagcgucaacgggagcccccaggcggagcagccuucucucgaaagcaccuccaaggaggcuuucuuuucucggguugagacauucagcucccugaaaugggccggaaagcccuuugaacuuagcccucuggugugcgccaaauauggcugggugaccgucgagugugauaugcucaaguguucuuccugccaggcuuuccugugcgccagccugcaacccgcuuuugacuucgaucgcuacaagcagagaugugccgaacucaaaaaggcgcugugcacagcccaugagaaauuuuguuucuggccugacucuccgucccccgaucgguuugggaugcuuccucuggacgagcccgcuauccucgugagcgaguuccuggaucgcuuucagucucuuugccaccuggaccuccagcugccuucccugagacccgaggaucucaagaccaugugucugacagaagacaaaauuagccuucugcuccaucugcuugaggaugaacuggaccaccggaccgaugagcgcaagacgaccaucaagcucggauccgacauucaaguucaugugacagccugcauccugucugucuguggcugggcuugcagcuccagccuggagucuaugcagcucucccugauuaccugcagccaguguaugagaaaaguggggcuuuggggauuccagcaaaucgaaucuagcaugacagaccuggaugccuccuuuggccucaccucuagcccgaucccuggccuggaggggcggcccgaacgccuuccucugguucccgagucccccagacggaugaugacgcgcagccaggacgcgacauucucuccuggauccgaacaggccgaaaagagcccgggccccauugugucuagaacccgguccugggauagcuccucuccugucgacagacccgagccugaagcugccagccccacaacccgcacccggccggugacaagauccauggggacgggagauaccccuggccucgaggugcccucuagcccucugcgcaaagcuaagcgggccagacugugcuccuccucuuccagcgacacaucuucccgcagcuucuuugaucccaccucucaacaccgggacugguguccuugggucaauaucacacucgggaaagaaagcagagagaacggaggcaccgaacccgaugccuccgcuccggcggagccuggcuggaaggccguucugacgauucuucuggcucacaaacagagcucucagcccgccgagacagacuccaugagccucuccgaaaagucucgcaagguguuccggaucuuuagacagugggagagccugugcuccuguuga

SEQ ID NO: 78057 - RNA, 531 nt, Artificial Sequence
  derived and/or modified sequence opt5 from ZC4H2__Homo_sapiens__NP_001171504
auggccgacgagcaggaaaucaugugcaagcuggagagcauuaaagaaaucagaaacaagacccuccaaauggagaaaauuaaggcucggcugaaagccgaguucgaggcgcuugaguccgaagaacgccaccugaaggaauacaagcaggagauggaucuccugcuucaggagaaaauggcucauguggaggaacugagacucauccacgccgacauuaaugucauggaaaacacaaucaagcagucugagaaugaucugaacaaacugcucgaaagcacgcggcgccugcaugacgaguauaagccccuuaaagagcacguugaugcccugagaaugacccucggccugcaacggcuuccugaccugugugaagaggaagagaagcucucccuggaaccggcuugccaugugacaucuaaguuuaccgggaugcaccuguacgcccucuucgcucgccccagagugggaccuggcacacccaaaagccggaaugggucccgcaugaacaaggagagagagucuaccuga

SEQ ID NO: 78058 - RNA, 3915 nt, Artificial Sequence
  derived and/or modified sequence opt5 from ZCCHC11__Homo_sapiens__XP_011539402
auggaggaaagcaagacccugaaauccgagaaccacgaacccaagaaaaaugugaucugcgaggaaucuaaggccguccagguuauuggcaaccaaacacucaaagcuagaaaugacaagagcgugaaggagaucgagaacuccucuccuaaucggaacagcuccaaaaagaauaaacagaacgauauuuguaucgaaaagacggaggugaaaucuugcaaggucaaugccgcgaaccugccggggcccaaggaccuuggacuggugcuccgcgaucagagccauuguaaagcuaagaaauucccuaauucccccguuaaggccgaaaaagccaccauuagccaggcuaagucugagaaagccacaucccugcaagcuaaggccgaaaagagcccuaaaucucccaacuccgugaaggcggaaaaagccagcucuuaccagaugaaguccgagaaagucccuagcuccccggcugaagccgagaagggccccucucuucugcucaaggacaugagacagaaaaccgaacugcagcaaaucgggaagaaaaucccuagcuccuuuacaagcguggauaagguuaauauugaggcugugggaggcgagaaaugcgcccugcagaacucuccccggucccagaagcagcaaaccuguacagacaauaccggggauagcgacgauucugcgagcggaaucgaagacgucuccgaugaccucucuaagaugaaaaacgaugagagcaacaaggaaaauuccagcgagauggacuaucuggaaaacgccacggugauugacgagucugcucuuaccccugagcagcgccugggccucaaacaggccgaagagagacuggaacgggaucacaucuuccgccuugagaagagaucccccgaauacacaaauugccgguaucuguguaaacucugccugauucauaucgagaacauucaaggcgcucacaagcauaucaaggagaaacgccacaagaaaaauauccuggaaaagcaggaggaaagcgagcucagaucucugccgccucccuccccugcccaccuugccgcucugagcguggcggucauugagcucgccaaagaacaugggaucaccgacgaugaccugcggguucgccaggagauuguggaagagauguccaaggugaucacaaccuuucuucccgaauguucucugagacucuacggaagcucccugacgcgguucgcucugaaaucuagcgaugucaacauugacaucaaguuucccccuaagaugaaucacccggaucuccugaucaaagugcuuggcauucugaagaaaaacguucucuauguggacgucgaguccgauuuccaugccaaggugcccguuguggucugccgcgacagaaaaagcgggcugcuuugucgggugucugccggaaaugauauggcuugccugacaaccgaccuccugacagcccugggcaagaucgagccugucuuuauuccccucgugcuggcguucagauacugggcuaaacuuugcuauaucgacucccagaccgaugggggcauuccuagcuacuguuuugcccugaugguuauguucuuucuccaacagcgcaaacccccgcugcugccuugccuucucggaucuuggaucgaaggcuucgaccccaagcggauggaugacuuucagcugaaagggaucguggaggaaaaguucgucaaaugggaguguaacuccagcucugccaccgaaaagaauagcauugcugaggagaacaaggccaaagcugaucagccuaaggacgauacgaaaaagacagaaaccgacaaucaauccaacgccaugaaagagaagcacggaaagagcccccuggcgcucgaaacaccuaauagagugucucugggccagcuuuggcuggagcuccugaaauucuacacccuggauuuugcccuugaagaguauguuaucugcgugcgcauucaggacauccucacacgggagaacaagaacuggcccaaaagacgcauugcuaucgaagauccguucuccgucaagcggaauguggccagaagccugaacucccagcugguguacgaguauguugucgaacgcuuucgggcugccuacagauauuucgcguguccucaaaccaaagggggaaauaagucuacgguggacuuuaaaaagcgcgagaagggcaaaauuagcaacaagaaacccgugaaguccaauaacauggccacaaaugggugcauccuccugggagagaccaccgagaaaaucaacgcugagcgggaacagcccguccagugugaugagauggacugcacaucucagagauguauuaucgacaauaacaaucuucuggugaacgaacucgauuucgccgaccacggccaagauagcuccucucugagcaccuccaagagcucugagauugagccuaagcuggacaaaaagcaggaugaccuugcuccguccgaaacaugccucaaaaaggagcugagccaguguaauugcaucgaucugucuaaaucccccgacccugauaagagcacgggcaccgacugccggucuaaccucgaaacagaguccagccaucaauccguuuguaccgauacaagcgccaccucuugcaauuguaaggccacggaagacgcuagcgaucugaacgacgacgauaaccuucccacccaggagcuguacuauguguuugacaaauucauucucacauccgggaagccucccaccaucgucugcucuaucuguaaaaaggauggacacagcaaaaaugacugcccugaggauuuucgcaagauugaccugaagccccugccgccuaugacaaacagauuccgggaaauccuugaucucguguguaaaagaugcuuugacgagcugucucccccuuguuccgaacagcauaaucgcgagcagauucugaucggccucgaaaaguucauucaaaaagaguacgaugagaaggcgcggcugugccuuuuugggagcuccaaaaacggauucggcuucagagacucugaucuggacaucuguaugacccucgaagggcacgagaaugccgaaaagcugaacugcaaggagaucauugagaaucuggcuaaaauccuuaagcgccaucccggccugagaaacauucucccgaucacgacagccaaaguuccuauugugaaguuugaacaccggcgcagcggacuggagggcgacaucucccucuacaauacccuggcccagcacaacacaagaaugcuugcuaccuaugccgcgaucgauccccggguccaguaccugggguauaccaugaaaguguucgcuaagcgcugcgacauuggagaugccagcagaggcucucucuccagcuacgccuauauccugaugguucuguacuuucuucagcaacggaaaccucccgugauucccguccugcaggaaaucuucgacgggaagcagauuccucagcgcaugguggauggauggaaugccuuuuucuuugacaagacagaggaacucaaaaagagacugccgucucucggcaaaaacacggagucccugggggagcuuuggcugggccuccugcgguucuauaccgaagaguuugauuucaaggaauacgugaucagcauucgccagaaaaagcugcuuacaaccuuugagaagcaauggacauccaaauguaucgcuaucgaagaccccuucgaucugaaucauaaccucggagcgggcgucucuagaaagaugaccaauuuuauuaugaaggcuuucaucaacgggcggaagcuguucggaacgccuuuuuacccccucauuggcagagaggccacaaucagcccuaccaaaaccggguucauguccguucgcuuuacauauuuccaguacauucacagcguguggcggaucggaugcaccaaguga

SEQ ID NO: 78059 - RNA, 1209 nt, Artificial Sequence
  derived and/or modified sequence opt5 from ZCCHC12__Homo_sapiens__NP_776159
auggccagcaucauugcuagagugggcaacucccggcgccugaaugcgccccucccuccgugggcccacucuaugcugagaagccuugggcggucccugggacccaucauggcuucuauggccgaccgcaacaugaaacucuucagcggcagagucguuccugcccagggggaggaaaccuuugagaauuggcugacacaagugaacggagugcuucccgauuggaauauguccgaagaggaaaagcugaagcggcucaugaaaacgcugcgcggcccugcuagagaggucaugcgggugcugcaggccaccaaccccaaucucucuguugcugacuuccugcgcgccaugaagcugguguuuggggagagcgaauccagcgucacagcgcauggaaaauucuuuaacacccugcaggcccagggcgagaaggcuucucucuacgugauuagacuggaaguucaacuucagaaugccauccaggcuggcauuaucgccgagaaggaugcgaaccggacacgccugcagcaacuccugcuugggggagagcucuccagagaccugcggcuucgccugaaagauuuccucagaauguaugccaaugaacaggagcggcugccuaacuuucuugaacugaucagaauggugcgcgaggaagaggacugggaugacgcuuucauuaagcggaaaagaccgaagcgcagcgagucuauggucgaacgggccgugucccccguggcuuuucagggcagcccucccaucgucauugggucugccgauugcaauguuaucgagauugacgauacccucgacgauuccgacgaagacgugauccugguggagagccaggauccuccccugccguccuggggagccccuccccucagagaccgcgcucggccucaagaugaaguccuggugauugacucuccccacaacagcagagcgcaguuccccuccacaagcggcgggucuggauacaaaaauaacggcccuggcgagaugcgccgggccagaaagcgcaagcauaccauccgguguuccuauugcggggaggaaggacacagcaaagagacgugugauaacgaaucugacaaggcucagguuuuugagaaucuuaucauuacccugcaagaacucacacauaccgagauggagagaagccggguggccccgggcgaauacaacgauuucuccgagccccuguga

SEQ ID NO: 78060 - RNA, 2850 nt, Artificial Sequence
  derived and/or modified sequence opt5 from ZCCHC14__Homo_sapiens__NP_055959
auggccagcaaccaccccgcuuucuccuuucaucagaagcaagugcugagacaggagcucacccagauccagucuagccugaauggcgggggaggccacgggggaaaaggcgccccugggccgggaggcgcgcuucccacaugcccugcuugucauaagauuacgccccggaccgaagccccugucuccucuguuagcaacucccuggagaaugcccuccacacaucugcucauagcaccgaagagucccugcccaaacgcccucuuggcaagcacagcaaagugucuguggaaaagaucgaccugaaggggcucucccacacaaagaacgauagaaaugucgagugcagcuucgaggugcuguggucugacuccagcauuaccucuguuacaaaguccagcuccgaagugaccgaguuuaucucuaaacugugucaacucuacccggaagagaaccuggagaaacuuauucccugccuggccggaccugaugcuuucuaugucgaacggaaucauguggaccucgauagcggccugcgcuaccuugccucccugcccagccacguucucaaaaacgaccaugugagacgguuucugucuacguccagcccuccccagcagcugcagucuccgagcccugggaaucccucccucucuaaggucggaaccgugaugggcgugagcgggcgcccugucuguggaguugcgggcauccccuccagccaaucuggcgcccagcaccacgggcagcaucccgcuggauccgccgcuccucugccgcacugcagccaugccggcucugcgggguccgcccuugcuuauagaacacagauggauaccagccccgccauccugaugccuuccucucuccaaacaccccagacccaggagcaaaacggcauucuggacuggcuucggaagcugcgccuccacaaauacuauccuguguucaagcagcugagcauggaaaaauuucugucccucacggaggaagaucugaauaaguucgagucucuuacaaugggagcuaaaaagaaacugaagacccagcucgagcuggaaaaggagaaaagcgaaagacggugucuuaaccccuccgccccgccucuggugacaagcucuggggucgcccgcgugcccccuaccucccauguuggacccgugcagagcggcagaggcucucacgcugcggagcuccgggucgaaguggagcaaccucaccaucagcugccccgcgagggguccagcucugaauacagcuccucuagcuccagcccgaugggaguucaggccagagaggaauccucugacagcgcugaggaaaaugaucggagaguggagauccaccuggaguccucugacaaggaaaaaccugucaugcuccugaaccauuuuaccagcuccucugcccgccccacagcccaggugcuucccguccaaaaugaggcuagcuccaacccuagcggccaccacccgcugcccccucagaugcucucugccgcgucccauauuacgcccauccggaugcugaacagcgugcacaagccugaaagagggucugcugauaugaaacugcuuuccagcucuguucauucccuccugagccuggaggagcgcaauaagggauccggcccccggagcucuaugaagguggacaagagcuucggguccgccaugauggacguccucccugccucugcuccccaccagccggugcagguucugagcggccuuuccgaaucuagcuccaugucuccuaccgugagcuuuggacccagaacaaaggucgugcaugccuccacccuggaucgcgugcucaaaacagcucaacagccugcccugguugucgagaccagcacggcggccacaggcacccccucuaccgugcugcacgcugcccggccgccuauuaaacuucuccuguccagcucugugcccgcugacuccgccaucagcgggcagacauccugcccuaacaauguccagauuucugugccucccgcgaucaucaaccccagaaccgcccuguauacagcuaauacgaaaguugccuucagcgcuauguccagcaugccggugggaccccuccaaggcggguuuugugccaacucuaauaccgccuccccuagcucucaccccagcacauccuucgcuaacauggcgacccugccuucuugccccgccccuagcuccucuccggcucuuagcuccguccccgaaagcucuuucuacuccagcuccggaggcgggggcucuacaggaaauauuccugccagcaaccccaaucaucaccaucaccaucaccaccagcagccucccgccccgccucaacccgcucccccucccccuggcuguaucgugugcaccuccugcggguguucuggaagcugcggcuccagcgggcugacgguuucuuacgccaacuauuuucagcauccguucuccggacccagcguguuuaccuucccuuuucuccccuucucuccuauguguuccagcggcuacgucucugcgcagcaguaugggggcggaagcacauuucccgugguucacgcuccguacuccucuagcggcaccccugaucccgugcuguccgggcaaagcacauucgccgucccucccaugcagaauuuuauggccggaaccgcuggcguguaucagacgcaggggcuggugggauccucuaacggcagcucccauaagaagucugggaaucuuagcugcuacaacuguggcgccacaggacaccgcgcgcaagacugcaaacagccuuccauggauuucaaccggcccggcaccuuuagacucaaguaugcuccgccugccgagucucuggacagcacagauuga

SEQ ID NO: 78061 - RNA, 3537 nt, Artificial Sequence
  derived and/or modified sequence opt5 from ZCCHC2__Homo_sapiens__NP_060212
augcugagaaugaagcucccccugaaaccuacccacccggccgagcccccucccgaagcugaggaaccugaggccgacgcgcggcccggcgcuaaggccccuagccgcagacggcgcgauugcagaccgcccccucccccucccccgccugccgggcccucccggggaccucuucccccucccccgcccccucgcggccuggggcccccuguggcuggaggcgccgcugccggggcgggaaugcccggcggcgggggaggcccgucugccgcucucagagaacaggagcgggucuacgagugguucgggcugguucuuggaagcgcccaacgccuggaauuuauguguggccuccuggaccugugcaacccucucgagcugagauuccuuggguccugucuggaagaucucgcucggaaagacuaucauuaccugcgcgauucugaggccaaggcgaauggacuuagcgaccccggcccucuggccgauuuuagagagcccgcugugcggucccgccucaucguguaucuggcccugcucggcucugaaaacagagaggcugccgggcggcugcacagacuucugccucaggucgacagcgugcucaaaucccugcgcgccgcucggggagaaggcagcagagggggagcggaggaugaacgcggcgaggacggggauggagagcaggacgccgaaaaggauggcucuggccccgaagggggaauuguugaaccgcgggugggcgggggacuuggcuccagagcucaggaggaacugcuccugcuguucacaauggccagccuccauccugccuuuucuuuccaccaacgcgucacgcugcgggagcaucuugagagacugcgcgcugcccucagagggggccccgaagacgcggagguggaaguugagcccugcaaguuugcuggaccuagagcccagaauaacuccgcccacggcgacuacaugcagaauaacgaaagcucucugaucgagcaggcuccgauuccccaagaugggcuuaccguggccccucaccgcgcucagcgggaggccguccauaucgagaaaauuaugcugaagggagugcagagaaaacgggcggacaaguauugggaguacacauucaaagugaauugguccgaucucagcgucaccacaguuaccaagacacaccaggaacugcaagaguuucugcucaagcugcccaaagagcuuuccucugaaaccuucgacaagacgauccugcgcgcccucaaccagggcagccugaaaagagaggaacggagacauccugaucuggagcccauccuucgccagcucuuuuccuccucuucccaggcuuuccugcaaagccagaaggugcacagcuuuuuccagucuauuuccucugacagccugcacuccaucaauaaccuccaaagcucucugaaaaccuccaagauucuugaacaucugaaagaggauagcucugaggccuccagccaggaagaggacgugcuccagcacgcuaucauucauaagaagcacacagggaaauccccuaucgucaauaacauuggaaccucuuguagcccccuggauggccugacaaugcaguauuccgaacaaaaugggaucguggacuggcggaagcagucuugcaccacgauccagcauccggagcacuguguuacaagcgccgaucagcacuccgcggaaaaacggagccuuucuuccauuaacaagaaaaagggcaagccucaaaccgagaaagagaagaucaaaaagacagacaaucgccucaacagcagaauuaacggaauccggcugucuaccccucagcaugcccacggcgggaccgugaaagacgucaaucuggauauuggauccggccaugacacaugcggggaaacgagcucugagagcuacuccagccccucuagcccccgccacgauggaagagagagcuucgaauccgaagaggagaaggaccgggauaccgacucuaacagcgaagauuccggcaauccgucuacaacccgcuuuacaggguacggcagcgugaaccagaccguuacggugaagccucccguccagaucgcuucccucggaaaugagaacggcaaucugcuugaagacccucugaacucucccaaauaucaacacaucagcuucaugcccacacuccauugugugaugcacaauggggcccagaaguccgaggucgugguuccugcuccgaaacccgccgauggaaagaccauuggcaugcuggugccuagccccgucgccaucucugcuauuagagaguccgcgaacagcaccccuguggggauccugggacccacagccugcaccggcgaaucugagaaacaucuugaacuccuggcuuccccucugccgauucccagcacauuucucccucacucuuccacgcccgcccugcaucuuaccguucagcggcugaagcucccucccccgcaagggagcuccgagagcuguacagugaauaucccucagcagccucccggcucucugagcaucgccucccccaacaccgcuuucauucccauccacaauccuggaucuuuuccgggcagccccgucgccacaaccgacccuauuacgaaguccgcgucucaggugguggggcugaaccaaaugguuccccagaucgaaggaaauaccggcacagucccucagcccaccaacgugaaagugguccuuccggcugccgggcucagcgccgcucagccucccgccuccuacccucugcccggaucuccucuggcggcuggcgugcuccccagccaaaacuccagcguucugucuacagccgccaccuccccgcagccugcuagcgccggcauuucucaggcucaggccacggugccucccgcgguccccacacacaccccggggcccgccccuucccccagcccugcucuuacacauuccaccgcccaaucugauagcaccuccuauaucagcgcugugggaaauacaaacgccaauggcacgguugugcccccucagcagauggggucuggaccgugcggcuccugcgggcgcagauguagcugcggaaccaacggcaaucugcaacucaacucuuacuauuaccccaauccuaugcccggcccuauguaucggguccccagcuucuuuacacugccguccauuuguaacgggucuuaccugaaucaggcccaccagagcaacggaaaucagcuuccuuucuuucugccccaaacccccuacgcuaacggccucgugcaugacccuguuauggggucccaggcgaauuauggaaugcagcagauggccggcuucgggcgcuuuuaccccguguauccugcuccgaacgucguggccaauacaucuggaagcggccccaagaaaaacggcaacguguccugcuacaauuguggggucagcggacacuaugcccaagauugcaagcagucuuccauggaggcuaaccagcagggcaccuacagacugcgguaugccccuccccucccucccagcaaugacacgcuggacuccgcggauuga

SEQ ID NO: 78062 - RNA, 1212 nt, Artificial Sequence
  derived and/or modified sequence opt5 from ZCCHC3__Homo_sapiens__NP_149080
auggccaccggcgggggagcugaggaagagagaaagcggggccgcccccagcugcucccuccggccagacccgcggcucgcggggaagaggccgacggaggccgggaaaagauggggugggcccaaguggucaaaaaccuggcugagaaaaagggagaguucagagaaccucggcccccucgcagagaggaagagagcggcggcgggggaggcuccgccgggcuuggaggccccgcugggcuggccgcgccugaucucggagacuuuccgcccgccggccggggcgauccuaaagggcgcagacgggaccccgcuggagaggccguugauccucgcaagaagaaaggcgcugccgaagcggggagacggaagaaagccgaggcugccgcugccgccauggcuacacccgcgcgcccgggagaagccgaggacgcugccgaaagaccucugcaggaugagcccgccgcugccgcgggcccugggaagggacgguuccuugugagaaucugcuuucagggcgacgagggcgcuugucccacgcgcgauuucguggucggggcccugauucuccggucuaucggaauggaccccagcgauauuuacgccgugauccagauuccuggcuccagagaauuugacguuucuuuccgcagcgcugagaaacuggcccuguuucuccggguguaugaagagaagagagaacaagaggauugcugggagaauuucgucgugcuggggcgcuccaagucuagccuuaaaacccuguuuauccucuuccggaacgaaacaguugacguggaggacaucgucaccuggcugaagagacacugugaugugcuugcugugccggucaaaguuacagaccgcuuuggaauuuggaccggcgaauacaagugcgagaucgaacugcggcagggggagggcggagugagacaucuccccggcgccuucuuucugggggcggagcgcggauauuccugguacaaaggccagccuaagacauguuucaaaugcgggagccggacccacaugucuggauccuguacgcaggauagaugcuuccgguguggcgaagaggggcaucugagccccuauugccgcaagggcauuguguguaaucucugcggaaagagaggccacgccuuugcucaaugcccuaaagccguccauaacucuguggcugcccagcugaccgggguugcgggacacuga

SEQ ID NO: 78063 - RNA, 4488 nt, Artificial Sequence
  derived and/or modified sequence opt5 from ZCCHC6__Homo_sapiens__NP_001171988
augggcgacaccgccaagcccuacuucgugaaaagaacaaaggaucgggggacgauggacgaugacgauuuucgcagaggacacccucagcaagacuaucugaucauugaugaccaugcuaaaggccacgggagcaagauggagaaaggacuccagaagaagaaaaucaccccgggcaacuacgggaauacaccccggaagggaccuugcgccgucuccucuaaccccuaugcguucaaaaauccuauuuacagccagcccgcuuggaugaacgauucccauaaggaccagucuaaacgcuggcugagcgaugaacacaccggcaauuccgacaacuggagagaguuuaagccuggcccgcggauccccguuauuaaucgccaaagaaaggauucuuuccaggaaaacgaggacggguaucgguggcaggacacacgcggauguagaaccgugcggcgccuuuuucauaaagaucugacaagccucgaaaccacguccgagauggaggccggcagcccugaaaauaagaaacagagaucucggccccgcaagccuagaaaaacccggaacgaggaaaaugagcaagacggggaucuggagggacccgugaucgacgaauccguccuuagcacaaaggagcugcucggccugcagcaggccgaagagagacugaaacgcgauugcaucgaccggcucaagagacgcccgcggaacuacccuaccgcuaaguauacauguagacugugcgaugugcuuauugaaucuaucgccuucgcucacaaacacauuaaggagaaacgccauaagaaaaauaucaaggagaagcaggaagaggaacugcucaccacgcugcccccucccacacccucccaaauuaacgccguugggaucgcgauugacaaagugguccaggaguuuggacuucacaaugaaaaccuggagcagcggcucgagaucaagagaaucauggaaaacguguuccaacauaaacugccugauuguagccugcgccucuacgggucuuccugcagccggcugggcuuuaaaaauuccgacguuaacauugauauccaguucccggccauuaugucucagcccgacgugcuucugcucguccaggagugucugaaaaauagcgacuccuuuaucgauguggacgcugauuuccacgccagagugccugucguugugugccgcgaaaagcaaagcgggcuucuguguaaggugucugcuggaaacgagaaugccugccucaccacaaaacaccugaccgcgcugggcaagcucgaacccaaacuggucccucuugugauugccuuucgguacugggcuaagcuguguuccaucgacagacccgaggagggcggacucccgccuuauguuuucgcccugauggcuaucuucuuucuucagcagcggaaagaaccccugcucccuguguaccugggcagcuggauugagggguucucucugagcaagcucggaaacuuuaaucugcaggauaucgaaaaggacgucgugauuugggagcauaccgauuccgccgccggcgacacaggcaucacgaaagaggaagcuccccgcgagaccccuauuaagagagggcaaguuucucuuauccuggaugugaaacaccagcccagcgucccggugggacagcucugggucgaacugcugcgguucuaugcgcuugaguuuaaccucgccgaccuggugaucuccauuagaguuaaggaacuggugagccgcgagcucaaagauuggccuaagaaacggaucgcuauugaggaccccuacucugucaagagaaauguggcccgcacacugaacucccagcccguuuucgaauauauccuucauugccugagaaccacauacaaguauuuugcccucccucacaaaauuaccaagagcucucugcugaaaccgcuuaaugcuaucacgugcauuuccgagcauagcaaggaagugaucaaccaccaccccgauguccaaacaaaagacgacaagcucaaaaauuccgugcuggcccagggcccuggggcgaccucuagcgcugccaacaccuguaaagugcagccccugacacucaaggagaccgccgaauccuucggaucuccucccaaagaggagaugggcaaugaacauaucagcguucacccugagaacuccgauugcauucaggcugacgucaacagcgaugacuacaagggggauaaaguguaccaucccgaaacaggccggaagaaugagaaggaaaaagugggacgcaagggcaaacaucugcuuacggucgaccaaaagagaggggagcacgugguuuguggaucuacccggaacaaugaguccgaaagcacacuggaucucgagggcuuucagaacccgaccgccaaagaaugcgaggggcuggcuacacuggacaauaaggccgaucuugacggagagucuaccgaaggcacggaggaacucgaggauucccugaaccacuucacccacagcgugcaggggcaaacaucugaaaugaucccuagcgacgaggaggaagaggaugacgaagaggaagaggaggaagaggaaccccgccugaccauuaaucagagagaggacgaagauggcauggcgaacgaggacgagcucgauaauacauauaccggauccggcgacgaagaugcccugagcgaggaagacgaugagcuuggggaggcugccaaguacgaagacgucaaagaguguggaaagcauguggaacgggcucugcucguugagcugaacaaaaucucucugaaggaagagaaugugugcgaggaaaagaacuccccugucgaucagagcgacuuuuucuaugaguuuuccaagcucauuuucacgaaaggcaagucucccacagugguuuguagccucugcaagcgcgaagggcaccugaaaaaggauuguccggaggacuucaaaagaauccagcuggaaccucuucccccucugacccccaaguuucuuaauauccuggaccaagugugcauucaguguuacaaagauuucucccccacaaucauugaggaccaggcccgggagcauauccgccagaaccucgaaucuuuuauuagacaagauuucccuggaaccaagcugagccuguuuggcuccucuaagaauggguucggcuuuaaacagagcgaccuugaugucugcaugaccaucaacggacuggagacagcggaaggccucgacugcgugcggacgaucgaggaacuggccagagugcuccgcaagcacuccgggcugcggaacauucuuccgaucaccacagcuaaaguccccauuguuaaguucuuucaccugagaagcggacucgagguggauaucucucuguauaauacccuggcccuucauaacacacgccugcucuccgcuuacagcgccauugacccucgggugaaauaucuguguuacaccaugaaggucuucacgaagaugugcgauaucggcgacgccucuagagggucccucagcucuuacgcuuauacacugauggugcuuuacuuucugcagcagcgcaaucccccuguuauccccgugcuccaagagauuuauaaaggagaaaagaaaccugagaucuucgucgauggcuggaacauuuacuuuuucgaccagaucgaugaacugccgaccuauugguccgagugugggaagaauaccgagagcgugggccagcuguggcuuggacugcuccgguucuacacagaagaguuugacuucaaagaacacguuauuuccaucagacgcaagagccugcucaccacauuuaagaaacaauggacgucuaaguauauugugaucgaggaccccuucgaucugaaccauaaucuuggcgcggggcugagccggaaaaugaccaacuuuaucaugaaggccuucauuaauggaagacgggucuuuggcaucccugugaaaggguuccccaaggacuacccuuccaagauggaauacuuuuucgaucccgacguucugacagagggagagcucgcuccgaacgaucgcugcuguagaauuugcggcaaaaucggccacuuuaugaaggacuguccuaugcggcgcaaagugagacggagacgcgaucaggaagacgcccugaaucagcgguaucccgagaacaaggaaaagagaucuaaggaggauaaagaaauucauaauaaguacaccgagcgcgaggucagcacaaaggaagacaaacccauccagugcaccccucaaaaggccaaacccaugcgggcugccgcggaucuugggagagagaagauccugcgcccuccgguggaaaaauggaagcggcaggacgauaaggaccucagagagaaacgcuguuucauuugcggaagagaaggccacaucaagaaagaguguccccaguucaagggguccucuggaagccuguccucuaaauauaugacgcagggcaaggcuagcgccaagcggacccaacaggaguccuga

SEQ ID NO: 78064 - RNA, 2124 nt, Artificial Sequence
  derived and/or modified sequence opt5 from ZCCHC8__Homo_sapiens__NP_060082
auggccgcugagguguacuucggcgaccuggaacucuuugagcccuucgaucacccugaagagagcaucccgaagcccguccauaccagauuuaaagacgaugacggggaugaagaggacgagaacggaguuggcgaugccgaacugcgggagcgccuuagacagugcgaagagacaauugagcaacugcgggcggaaaaucaggagcucaagcgcaaacugaacauccuuacgagaccuuccgggauucuggugaaugacaccaagcucgauggacccauccugcagauucuguucaugaacaaugcuaucucuaaacaguaucaccaagaaaucgaggaauuugugagcaaccucgucaagcgguucgaggagcagcagaagaaugacguggagaaaacauccuuuaaccugcuuccucagcccucuagcauuguucuggaggaagaucauaagguggaggaauccugugccaucaaaaauaacaaggaggccuucucugucgugggcagcguucucuacuuuaccaauuucugccuggacaaacuugggcaaccucugcucaacgagaauccgcagcuguccgaaggaugggagauucccaaguaucaccagguguuuagccauaucgucucucuggaaggccaggagauucaagugaaggcuaaacgcccuaagccccacuguuucaacugcggcuccgaagaacaccagaugaaagauuguccuaugcccagaaaugccgcucggaucagcgagaagcgcaaagaauacauggacgccugcggggaggcgaacaaccagaauuuucaacagagauaucaugccgaagagguggaggaacgguucggacgcuucaagccgggcgucauuucugaggaacuccaggacgcucuggggguuacagauaaaucccuuccucccuuuaucuacagaaugcggcagcugggauauccucccggcuggcucaaggaggccgaacuggagaacagcgggcuugcucuguacgacggaaaggauggcaccgacggcgagacagaagugggggagauccaacagaauaaaucugugaccuacgaucucuccaagcuggucaacuaucccggauucaauauuagcacgccucgcggcaucccggacgaauggagaauuuuuggguccauccccaugcaggccugucagcaaaaagauguguucgcgaacuaccugaccucuaauuuucaggccccuggaguuaagagcggcaacaaacgguccagcucucacuccagccccgggucuccuaagaagcagaaaaaugagagcaacuccgcuggaucucccgccgacauggaacucgauagcgacauggaggugccgcauggcucccagagcucugaguccuuccaauuucagccuccccugccucccgauacaccuccccuuccgagaggcaccccuccucccgucuucacacccccgcugcccaaggggaccccuccccucacgccuagcgacucuccccagacacgcaccgcuuccggagccguggacgaagaugcccugacacuugaggaacuggaggaacagcaacggagaauuugggcugcgcucgagcaggccgagagcguuaauuccgacucugaugugccugucgacacaccccugaccggcaacagcguggcuuccucuccgugcccuaaugaacuggaucuccccgucccugaggggaaaaccagcgaaaagcagacgcuggacgagcccgaggugccggaaaucuuuaccaaaaaguccgaggccggacacgccagcucuccugauuccgaaguuacaagccuuugucaaaaggagaaagcugaacuggcccccgugaacaccgagggcgcgcuccuggacaaugggucugucgugccuaacugcgauaucuccaacggcggaagccagaagcuguuccccgcugacacaucucccagcaccgccacgaaaauucacuccccuaucccggauaugagcaaguuugccacaggcauuacccccuucgaguuugaaaauauggcugagucuaccgggauguaucuucgcauccggucccuccugaaaaacagcccuagaaaucagcagaagaacaagaaagccuccgaauga

SEQ ID NO: 78065 - RNA, 654 nt, Artificial Sequence
  derived and/or modified sequence opt5 from ZCRB1__Homo_sapiens__NP_149105
augagcggcgggcuggcccccuccaagucuaccguguacgucagcaaccucccuuucucccugacaaauaacgaccuuuauagaaucuuuucuaaauacggaaagguugugaaagugacgauuaugaaggauaaagacacccggaaaagcaagggcgucgcuuucauccuguuucucgauaaagacuccgcccaaaauugcacacgcgcgauuaacaauaagcaacuguucgggagagugaucaaggcuucuauugccaucgauaacggacgggccgcugaguuuauccgcagacggaauuauuucgacaagagcaaauguuacgaaugcggcgaguccgggcaccuuagcuaugccuguccgaagaacaugcugggagaacgcgagcccccuaagaaaaaggagaaaaagaaaaagaaaaaggcucccgaaccugaggaagagauugaagagguugaggaaucugaggaugaaggcgaggaccccgcccucgauucccugagccaggcgaucgccuuucagcaggcuaagauugaagaggagcagaaaaaguggaaaccuucuuccggcgugccgagcaccucugacgauuccagacggccccgcaucaagaaaagcacauacuucuccgacgaagaggaacugucugauuga

SEQ ID NO: 78066 - RNA, 1575 nt, Artificial Sequence
  derived and/or modified sequence opt5 from ZCWPW1__Homo_sapiens__NP_001244937
augaugaccacacugcagaacaaggaggaaugcggcaaagggcccaagagaaucuucgccccuccggcccaaaagagcuacucccuccugcccuguucuccuaauagccccaaggaggaaacgccuggaauuuccucucccgagaccgaagcccggaucagccuuccuaaagcgucccugaagaagaaagaggagaaggcuacaaugaaaaacgugccgucucgcgaacaggagaagaaaagaaaggcccagauuaauaagcaggccgagaaaaaggagaaagagaaaagcucccucaccaacgcugaauuugaggaaaucguccaaauuguucugcagaaaagccuucaggagugccugggcauggggucuggacucgacuucgccgaaacauccugugcucagcccguggugagcacccaaucugauaaggagccuggcaucacagccuccgcgaccgacacggauaaugccaacggggaggaagucccccacacccaggagaucagcgugucuugggaaggagaggcugccccugaaauucggacauccaaacugggccagcccgacccggcuccuagcaagaagaaauccaaucgccugacccucucuaagcggaaaaaggaggcccaggaugagaaaguugaaaagacacaaggcgggcaugagcacagacaggaagaccgccugaagaaaaccgugcaggaucauagccaaaucagagaccagcagaagggagagauuuccggcuuugggcagugccuugucugggugcaauguagcuuccccaacugcggaaaauggcggcgccuguguggcaauaucgauccuucuguucuccccgacaacugguccugcgaucagaauacggacgugcaguauaacagaugugauauucccgaagagacauggaccgggcuggagagcgacgucgcguacgccucuuauaucccuggaagcauuaucugggcuaagcaguacggcuauccgugguggcccggcaugaucgaauccgacccugaucuuggggaguacuuucuguucacaucucaccucgacagccugcccuccaaauaucaugugaccuuuuucggagaaaccgugagccgggccuggauuccugucaauaugcugaagaacuuucaagagcucucucuggagcuuuccguuaugaagaaacgcagaaaugauugcagccagaagcugggcguggcucucaugauggcccaggaagccgagcagaucucuauucaagaacgggugaaccuguucggguuuuggucccgcuucaacggaagcaauuccaacggcgagagaaaagaccuucagcugucugggcucaauagccccggauccugucuggaaaagaaagagaaggaggaagaacuggaaaaggaggaaggcgagaaaacagcucuccggaagaaccugaaacuuccgagagcgcgcccuuggcagcccgccuuucagcgggagaagaaacuggaacaaugccagagaacgugggcuuaccagcgcguccggggcccugcuccccaccucagaaagaaaucuccugauaccgggaaucccuga

SEQ ID NO: 78067 - RNA, 7065 nt, Artificial Sequence
  derived and/or modified sequence opt5 from ZDBF2__Homo_sapiens__NP_065974
augcagaagagacagggcuacugcagcuauugucgggugcaguacaauaaucuggagcagcaccucuucuccgcccagcaucgcucucugacaagacaaagccggcgccagaucugcacauccucucuuauggaaagauuucugcaggacguccuccagcaccaucccuaucacugucaagagagcuccucuacgcaggacgaaacccauguuaacacagggagcuccagcgagguggugcaccuggacgacgcuuucucugaagaggaggaagaggacgaagauaaggucgaggacgaggaugccaccgaagaacggccuuccgaagugagcgagccgauugaggaacuucacucucgcccccauaagucccaggagggaacacaggaaguuagcgugagaccuucugucauccaaaagcuggagaagggccagcagcaaccccucgaauuugugcacaaaauuggggccuccguucggaagugcaaucugguggacaucggacaggcuaccaacaaucgcagcaaccuggucagaccucccgugauuuguaaugccccugccuccugccuccccgagucuagcaacgaucggcccgugacagcuaauaccacgucccugccucccgccgcucaucuugacagcgucucuaagugugauccuaacaaaguugaaaaguaccuggagcagcccgacggcgccucccgcaauccggugccuagcucucacguggagaccaccagcuucuccuaucagaaacacaaggaaucuaacagaaaaagccuccggaugaacagcgauaagcugguccuuuggaaggacgugaaaagccaagggaagacccugucugcgggacucaaauuucaugagcgcaugggcacaaagggcucccugagaguuaaaagccccucuaagcuggccgugaacccuaauaaaaccgacaugcccuccaacaaggggaucuucgaagauacgaucgcuaagaaccacgaggaauuuuucagcaauauggacugcacacaggaggagaaacaucucgucuuuaacaagaccgccuucugggaacagaaauguuccgugucuagcgagaugaaguuugauugcauuucccugcagucugcuagcgaccaaccccaggaaacagcccaggaucuuucccuguggaaagaggagcagaucgaccaagaagauaauuacgagagccggggaucugaaauguccuucgacuguuccucuagcuuucacagccucaccgaucagucuaagguuagcgcgaaggaggugaaccuguccaaagaagucagaaccgacgugcaguauaagaauaacaaaagcuacgucucuaagauuuccagcgauugcgacgacauccuucaucuggugacaaaucagucccaaaugauuguuaaagagaucucucuccagaacgcccgccacauuagccugguggaucaguccuacgagucuagcuccucugaaacgaauuucgacugcgaugcuagcccucaauccaccagcgacuauccgcagcagucugucacagaggugaaccugcccaaggaaguucacaucggccucguggauaagaauuacggguccuccucuuccgaggucagcgccgacucuguguucccucugcaguccgugguugaucggcccccugucgcugugaccgaaacaaaacuuagaaagaaagcccauaccagccugguggacaacuauggauccagcuguucugagacgagcuuugauugcgacgucucccucgagucugugguugaucacccccaacugacagugaagggccgcaaucuuaaagggcggcagguccaucugaagcacaagaaaagaaagccgagcuccgccaaagcucaccucgacugugaugugucucugggaaccguugcggacgaaagccagcgcgccguggagaagaucaaccugcucaaagaaaagaaugcugaccugauggauaugaacugcgagucccauggcccugaaaugggcuuccaggccgacgcccaacuugcugaucagucucaggucgccgagauugagcggcagaaaguggacguugaucuggaaaacaagagcgugcaauccagcagaucuucccucagcucugacucccccgcgagccuguaccacuccgcucaugaugagccucaggaagcccuggacgaggucaaucuuaaggagcucaacaucgauauggaagugcgcucuuaugacuguagcuccagcgagcugaccuuugauucugaucccccucugcucuccgugacagaacagagccaccuggaugccgaggggaaagaacggcauauugaccuugaggacgagucuugcgaaagcgauuccucugagaucaccuucgacagcgauauuccccuguacuccgucaucgaccaaccggaaguugcuguguaugaggaagagacaguggaucucgagucuaagagcaaugaauccugugucagcgagaucacguuugacucugauauuccucugcacuccggaaacgaccaccccgaaguggccguuaaagaggugauccagaaggaagaguacauucaucuggagcgcaagaaugaugaacccagcggcuccgagaucucuagcgacucccacgcuccucuucauucugucaccaacagcccggaaguggccguuaagaagcucaauccccagaaagaggaacaggugcaccuggaaaacaaggagaaugaaccuauugauuccgaggucagccuggacuacaacaucaucuuccauucugugacagggcgcuccgaagaccccauuaaagagaucagccuccacaccaaggagcacauguaucuggaaaauaaaucuguuuuugagacaucccuugauagcgacgugccucugcaagcggccacccauaagcccgaagucauugugaaggagacguggcuccagcgggaaaaacacgcugaguuccagggaagaucuaccgaguuuagcggcuccaagacaucucuggauagcggggugccucauuacuccgucaccgaaccccagguugccgugaacaaaaucaaucggaagaaacaauaugugcuggagaacaagaaugacaagugcagcggauccgaaauuauccuugauucuaacgucccgccucagagcaugacagaccagccccagcucgcuuuccugaaagagaagcacgugaaccugaaagauaaaaauuccaaaucuggcgacagcaagauuaccuuugauuccgaacaacuccaggaggccguuaaaaagaucgaccaguggaaggaggaagugaucggccugaaaaacaagauuaaugagccuucuacguacaaacuuauccaccaucccgaugucagcgugcaguccguugcggaccaaccgaagguggccauuaaacacgucaaccuggggaaugaaaaccauauguaucucgaggugaagaauagccaguacucuuguuccgagaugaaccuggauagcggauuccugggccagucuaucgucaaucgcccucaaauuacaauccuugaacaggagcacaucgaacucgaggggaagcauaaccagugcuguggauccgaagugagcuuugacucugacgauccccugcaguccguugcugacagacugcgggagaccgugaaagagauuagccucuggaaggaugaagaggucgacacagaagauagacgcaaugaggccaaaggcuucgaaaucauguaugacuccgaugugcugcaaccuguugcugggcagcccgaggagguggucaaggaagugagccuuuggaaagagcacguggaccuggaaaacaagauuguuaagcccaccgauucucggaucaauuucgacagccacgagccucuccaguccgucaccaacaaaauuccgggcgccaauaaggaaaucaaccugcugagagaggagcaugugugccuugaugacaaaggauacgugcccucugauagcgaaaucauuuacgucuccaacaucccucugcagucugugauuaagcaaccccacauccucgaggaggagcaugccagccuggaggacaaauccucuaauagcuauuccccugaagagagcucugacuccaacgauagcuuucaggcugcggccgacgaacuccagaagcccguuaaggagauuaaucuguggaaagaagaucacaucuaccuugaggacaagucuuauaaacugggcgauuucgacguguccuacgcuagccacaucccuguccaguuugugacagaucaauccucuguuccggugaaggagauuaaccuccagaaaaaggaccauaaugaucuggaaaacaagaauugcgaggucugugggagcgaaaucaaaugccacuccugugugcaucugcagagcgagguugaccaaccccaggugucuuauaaggaagccgaucuucagaaagaggagcacgucgugauggaagagaagacggaccagccuuccgacagcgaaaugauguacgauucugacgugcccuuccaaauugucguuaaccaguuuccuggaagcgugaaagagacccaucugcccaaggugguccucguggaucugguuccgggcgacuccgauuaugaagugaucucugacgauauuccucuccagcuggucacagauccgccccagcuuaccgugaaagauaucagcugcauuaauacagaguguaucgacaucgaggauaaguccugcgacuucuuugggucugaaguucgcuguaacugcaaggccagcaccccuuccaugacgaaucaauguaaagagacauucaagauuaucaacagaaagaaagauuacauuauccugggagaacccagcugccagucuuguggcuccgagaugaauuuuaacguggacgcuagcgaccaguccaugaccuacgagucucaggggccugaugagaaaauggucaaguauauugacagcgaggauaaguccugcggcuacaauggaucuaaaggcaaguucaaccucgaagacaccagccaccggacaacccaccgccugcaaaaagcccauaaggaggcgucccugagaaaagauccgcggaaugcugggcuuaagggaaagagcugccagucuuccgccagcgccguggacuuuggcgcuucuuccaaaagcgcccugcaccgcagagcggauaagaaaaagcggucuaaacucaagcaucgcgaccuggaagucuccugugagcccgauggguucgagaugaacuuucagugcgcuccuccccucccuagcgacacagaucagccccaagaaacggugaagaaaagacacccguguaagaaaguuucuagcgaccugaaggagaaaaaccacgacucccagagcuccucugugcuuaagguggauagcguccggaaucugaaaaaggccaaggacguuaucgaagauaacccugacgagcccgugcuggaagcccucccucaugugcccccuuccuucgucggaaaaaccuggucucagaucaugcgcgaggaugacauuaagaucaaugcucuggugaaagaguucagagaaggccgguuucacugcuauuucgaugacgauugugagacaaagaaaguuagcuccaaggggaagaaaaaggugaccugggccgaccuucaaggcaaagaagauacagcucccacccaggccgucucugagagcgacgauauugugugcggaaucuccgacauugacgaucugagcgucgcgcucgacaagccgugucauagacacccucccgccgaaagacccccuaaacagaagggccggguggcuucucagugccaaacggccaagaucucccauagcacccagacaucuuguaaaaacuacccgguuaugaagagaaaaaucauucgccaggaggaggaucccccuaaguccaaaugcagccggcugcaggacgauagaaagaccaagaaaaaggugaaaaucgggacagucgaauuucccgcuucuuguaccaaggugcucaaaccuaugcaacccaaggcccugguuugcgugcuuuccagccugaauauuaaacugaaggagggagaaggccucccuuucccgaagaugcgccaccacucuugggacaacgauauccgguuuauuugcaaauauaagagaaauaucuucgacuacuaugagccccugauuaaacagaucgucaucuccccuccccuuagcgugauugugccugaguuugaacgccggaacuggguuaagauccauuucaauagaagcaaccaaaauuccucugccggggauaacgacgcugauggacagggcagcgcguccgcgccccugauggcugucccggcccgguacggguuuaauucucaccaaggcacaagcgacuccucucucuuccuggaggaaagcaaagugcuccaugcccgcgagcugccuaagaagagaaacuuucagcuuaccuuccugaaucacgauguggucaaaauuucccccaagagcguucggaacaaacugcucgaaucucaguccaagaaaaagauccauggaaagcgcgugacgacaagcucuaacaaacugggcuuccccaagaaaguguacaagccuauuauccuucaacagaaacccagaaaggcuuccgagaagcagagcaucuggauucggaccaaaccuuccgacaucauuagaaaguauaucucuaaauacagcgucuuucugcgccaccgguaucaguccagaucugccuuccucgggcgcuaccugaagaaaaagaaaagcgugguuucccggcucaaaaaggcgaaaagaaccgcuaaggugcugcuuaauagcucugucccgcccgccggagccgaggaacuguccagcgcuauggccaacccucccccuaaacgccccgugcgggcgucuuguagaguugcucgcagacggaagaaaacagacgagagcuaucacggccgccaaaaggggccguccaccccugugagagccuacgaucugcggucuagcuccugccuccagcagcgcgaaagaaugaugacgcggcuggccaauaaacuuagaggaaacgaggucaaauga

SEQ ID NO: 78068 - RNA, 1239 nt, Artificial Sequence
  derived and/or modified sequence opt5 from ZDHHC11__Homo_sapiens__NP_079062
auggacaccagaagcggcucccagugcucugugacacccgaggccauccugaacaaugaaaagcucguccugccuccgcggauuagccgcguuaacggguggucccuuccccugcacuacuuccaaguggugacgugggcugucuuugugggacucucuagcgccaccuucggcaucuuuauuccuuuccugccccaugcguggaaauauaucgcuuacguugugacagggggaaucuuuuccuuccaccuugucgugcaucugauugccucuuguaucgauccugccgacagcaauguuagacucaugaagaacuauucccagcccaugccucuguuugaucggagcaaacacgcucaugugauucagaaucaguucugccaccuguguaaggucaccgugaacaaaaagacaaagcacugcaucucuuguaauaaaugcguguccggcuuugaccaucacuguaaguggauuaacaauugcgucgggagccgcaacuacugguucuuuuucucuaccguugccuccgcuacagccggaaugcucugucugaucgcgauucuucuguaugugcucgugcaauaccuggucaauccgggcgugcuuagaaccgauccccgguaugaggacguuaaaaacaugaauacguggcugcucuuucugccucuguuccccgugcagguccagacccucaucgugguuauuaucggcaugcuggugcuucugcucgauuuccuggggcuuguccaucugggacagcuccugaucuuucacauuuaccugaaggccaaaaagaugacaaccuucgaauaccucaucaacaaucgcaaggaggaaagcucuaaacaccaagcugugagaaaggacccuuauguccagauggauaaaggcgugcugcagcagggggccggagcucuuggcuccagcgcccaagggguuaaggcgaaauccucucugcucauucauaagcaccugugccauuuuuguacaagcgugaaccaggacggagauuccaccgcccgggagggcgacgaggaucccugcccgagcgcucuuggcgccaaagcucgcaacucuagacugaucugccggcgccucugucaguucuccacgagaguccacccugacgggggaagcauggcccaagaagccgacgaugcucccucuauuagcacacugggccugcagcaggagaccacagaaccuaugaagaccgacuccgcggagucugaggauuga

SEQ ID NO: 78069 - RNA, 804 nt, Artificial Sequence
  derived and/or modified sequence opt5 from ZDHHC12__Homo_sapiens__NP_116188
auggcccccugggcucugcucagcccuggcgugcuggucagaaccgggcacacaguucuuacguggggaaucacccugguccucuuccugcaugacacagagcuucggcagugggaggaacaaggcgaacugcuccugccgcugaccuuucuccugcuugugcuggggucccuccugcuuuaccuggccgugucucucauggaucccggauaugugaacguucagccucagccccaggaggaacugaaggaggagcaaacagcgauggugccucccgcuauuccucugcgcagaugccgguacugucucguccugcagccgcuucgcgccagacacugccgggaaugucgcagaugcgugcggcgcuaugaccaucacugucccuggauggagaauugcguuggcgaaagaaaccauccucuguucguggucuaccucgcccugcagcuuguggugcugcucugggggcuguaucuggcuuggagcggacuccgguuuuuccagcccuggggccuguggcuucgcuccucuggccugcucuuugccaccuuccugcuucugagccucuuuucccuggucgcuucucugcuccugguuagccaccuuuaccugguggccuccaauacaaccacgugggaguucaucagcucucacagaauugcguaucuccggcaacgcccuuccaaccccuuugauagagggcugacccggaaucuggcccauuucuuuuguggauggccgagcggcucuugggagacacuuugggcugaagaggaagaggaaggguccagcccugccguguga

SEQ ID NO: 78070 - RNA, 1479 nt, Artificial Sequence
  derived and/or modified sequence opt5 from ZDHHC13__Homo_sapiens__NP_001001483
auggugauccugcuccugcagcacggcgccgaccccacccuuauugauggggagggauucagcuccauccaucuggcuguccucuuucaacacaugccuauuaucgccuaccugauuucuaagggccagagcguuaacaugacagacgugaaugggcagacgccgcuuaugcuguccgcgcauaaagugaucggacccgaaccuaccggcuuccuccugaaguuuaaccccucucugaaugucguggauaaaauccaccagaacacaccucuccauugggcuguugccgccgggaaugugaacgcugucgacaagcugcuugaggccggaagcucccuggauauucaaaaugugaaaggcgaaacaccccucgacauggcucugcagaacaagaaucagcuuaucauucacaugcugaagaccgaggccaaaaugagagcgaaccagaaguuccggcucuggcgcuggcugcaaaaaugcgaacuguuucuccugcuuaugcugucuguuaucaccaugugggccauuggcuauauccucgauuucaauagcgacuccuggcugcuuaaggggugucugcucgugacacuguuuuuccugaccagccucuuuccuagauuccuggucggauacaaaaaccuuguguaucugccgacggcuuuucuccugucuuccguguucuggauuuuuaugaccugguucauccuuuucuuucccgaucuggccggcgcuccuuucuacuuuagcuucaucuuuucuauugucgccuuccucuacuuuuucuauaagacaugggcgaccgaccccggguuuacaaaggccuccgaggaggagaaaaagguuaauaucauuacccuggcugaaacgggaagccuggauuuccggacauuuugcaccucuugucucauccgcaaaccucugagaucccuucacugccauguguguaacugcuguguggcccgguaugaccagcacugccuguggacaggccgcuguauuggguucggaaaucaucacuacuacaucuuuuuccucuucuuucugagcauggucugcggcuggaucauuuauggcuccuucaucuaccugucuagccacugugcuaccaccuuuaaggaagaugggcuuuggacauaucucaaccagauuguggccugcucccccuggguucuguacauccugaugcucgccacguuccauuuuagcuggucuaccuuccugcuucugaaccagcucuuucaaauugcuuuccugggacugacaucccacgagagaaucagccuucagaaacagucuaagcauaugaaacaaacccucagccugcggaagacaccguauaaucugggcuuuaugcagaaccucgcggacuucuuucagugcggguguuucggacuggugaagccuugcgucguggacuggaccucccaguacacgaugguuuuucaccccgcccgcgagaaagugcuuagaucugucuga

SEQ ID NO: 78071 - RNA, 1467 nt, Artificial Sequence
  derived and/or modified sequence opt5 from ZDHHC14__Homo_sapiens__NP_078906
augcccccuggcgggggaggcccgaugaaggacugcgaguacagccagaucuccacccacucuagcucccccauggaaucuccucauaaaaagaaaaagauugccgcuagacggaaaugggagguguuccccgggcgcaacaaguuuuucuguaauggaagaaucaugauggcccggcaaacaggcgucuuuuaucugacgcucguucugauucuugugaccagcgggcuguucuuugcguucgauugcccuuaccucgcugugaagaucacacccgccauuccugccgucgcuggaauccuguuuuucuuugugaugggcacccuucugcgcacauccuucucugacccgggcguucuccccagagccaccccugaugaagcugccgaccuggagcggcagaucgauauugcgaacgggacaagcuccggaggcuauagacccccuccccgcaccaaagaagugaucauuaaugggcagacggucaagcugaaauacuguuuuaccugcaagaucuuccggccgccucgcgccagccacuguucucucugcgacaacuguguggagagauuugaucaucacugccccuggguuggaaauugugugggcaaacggaacuaucgcuucuucuacauguuuauucugucccuuagcuuccugacagucuuuaucuucgcuuuugugauuacccaugugauccucagaucucagcaaacaggguuccugaaugcccuuaaggacuccccugcuagcguccuggaggccguugugugcuuuuucucugugugguccaucgucggacucagcggcuuucacaccuaucugauuuccucuaaccagacgacaaaugaagauaucaagggcagcugguccaacaaacgggggaaggagaauuacaaccccuacagcuauggaaauauuuucaccaacuguugcguggcgcugugcggccccaucucuccuucccucauugaccgcagaggguacauccagccggauacaccccagccugccgcucccagcaauggaaucaccauguauggcgccacccaaucucagagcgacaugugugaucaggaccagugcauucaauccacaaaauuuguucugcaggcugccgccacgccucuucugcagucugaacccagccucaccuccgacgagcugcaccuuccggggaagccuggacugggcacacccugugcuagccucacccugggcccucccacaccucccgcgucuaugccgaaccuggccgaggcuacccucgccgaugugaugccucggaaagacgaacauauggggcaccaauuccugacgcccgaugaggcccccuccccuccgagacuucuggcugccggaagcccccucgcgcauucucgcacaaugcacguccugggccuugcuucccaggacagccugcacgaagauuccgugcgggggcucguuaagcugucuagcguguga

SEQ ID NO: 78072 - RNA, 987 nt, Artificial Sequence
  derived and/or modified sequence opt5 from ZDHHC15__Homo_sapiens__NP_001139728
augagacggggcuggaagauggcccugagcgggggacuccgcugcuguagacgggugcuguccuggguccccguucuugugaucgugcuggucgugcucuggucuuacuaugcuuacguuuucgagcugugccuugugauuuaucugauccucuaccacgccauuuuugucuucuuuaccuggacauauuggaaaagcaucuucacgcugccucagcaaccgaaccagaaguuucaucuguccuacaccgacaaagaacgcuaugagaaugaagagagacccgaagugcagaagcagaugcucguugauauggcgaaaaagcugccuguguacacacggaccggcucuggggcuguccgcuucugugacagaugccaccuuauuaagcccgaucggugucaucacugcagcgugugugccaugugcgugcugaaaauggaccaucacuguccuugggucaacaauugcaucggauuuuccaacuacaaguucuuucuccaauuccuggccuauucuguucuuuacugucuguauaucgcuacaaccguguuuagcuacuucauuaaauauuggcgcggcgagcuccccuccgugagaagcaaguuucacguccuguuccuccuguucguggccugcauguuuuucguuucucuggugauccuuuuuggguaccauugcuggcuggucucccggaauaaaacaacccucgaggcuuucuguacgccuguguuuaccagcggaccggaaaagaacggcuucaaucugggcuuuauuaagaacauccagcagguuuucggggauaaaaagaaauuuuggcuuauucccaucggaucuuccccuggcgacgggcacagcuuccccaugcgcucuaugaaugagucccagaacccucugcucgccaaugaagagacaugggaggauaacgaagacgauaaucaagacuaucccgagggaagcuccucucuggcgguggaaaccgagacauga

SEQ ID NO: 78073 - RNA, 1899 nt, Artificial Sequence
  derived and/or modified sequence opt5 from ZDHHC17__Homo_sapiens__NP_056151
augcagagagaggaaggcuucaacaccaagauggccgacgggcccgaugaguacgacacagaagcuggaugcgugccucugcuccacccggaggaaaucaaaccccaaagccauuauaaucacggcuacggggagccucugggacggaagacgcauauugaugacuauuccaccugggauaucgucaaagccacacaguacggcauuuaugagcgcuguagagaacuuguugaggcgggguacgacgugcggcagcccgauaaggaaaacgugacccugcuccacugggcugccaucaauaaccgcauugaccuggucaaauauuacaucucuaagggagccaucguggaucagcuuggcggcgaccugaauagcacaccucuccauugggcuaccagacaagggcaccuguccaugguugugcagcugaugaaguacggagccgaucccucucucauugacggcgaggggugcagcuguauccaccuggcugcccaguuuggacauacauccauugucgcguaucuuaucgccaaaggccaggauguggacaugauggaccaaaacgggaugaccccucugaugugggcugccuaccggacgcacucuguugauccgacccgccuccugcuuacauucaaugugagcgucaaccugggagacaaguaucauaaaaauaccgcucuccacugggccgugcuggcgggcaacacaaccgugauuucccugcuccuggaggccggcgcuaaugucgaugcccagaacaucaagggggaaagcgcucuugaccuggccaaacagagaaagaauguuuggaugauuaaccaccuccaggaggcccggcaagcuaagggauacgauaaucccucuuuucugcgcaaacuuaaggcggacaaagaguucagacagaaggugaugcugggcacgccuuuucucgugaucuggcuggucggguucaucgccgaucugaacauugacuccuggcucaucaaaggacugauguauggcggggugugggcuacaguucaguuucuuagcaagucuuucuuugaucauuccaugcacagcgcccugccccucggaauuuaccuggccaccaaauucuggauguaugugacaugguuuuucugguuuuggaacgaccuuaauuuccuguucauccaucucccuuuucuggcuaacucugucgcccuguucuacaauuuuggcaaguccuggaaaagcgaucccggcauuaucaaggcgaccgaagaacaaaagaaaaagaccaucguggagcucgcugagacagggucccuggaccuuucuauuuucugcagcacgugucugauccggaaaccgguucgcuccaagcacugcggaguguguaacagaugcauugccaaguuugaccaucacuguccuugggucggcaauugcgugggggccggaaaccaccgguacuucaugggcuaucucuuuuuccugcuguuuaugaucuguuggaugauuuacgggugcaucagcuauuggggccuucauugcgaaaccacauacaccaaagauggauucuggacauauaucacccagauugcuacguguucucccuggauguuuuggauguuccucaauuccgucuuucacuucauguggguggccguucugcugaugugccagauguaccagaucagcugucucggcauuacaaccaacgagcgcaugaaugcuagacgguauaagcauuucaaagugaccacaaccucuaucgaaagcccuuuuaaccacgggugcgucagaaauauuaucgacuucuuugaguuccgcuguugcggacuguuucggcccgugauuguugauuggacaagacaauacacgaucgaauacgaccagaucuccggcucuggguaucagcuuguguga

SEQ ID NO: 78074 - RNA, 1458 nt, Artificial Sequence
  derived and/or modified sequence opt5 from ZDHHC1__Homo_sapiens__NP_037436
auguacaagaugaacaucugcaauaaacccagcaacaagaccgccccugagaaauccguguggacagcuccggcccagcccucuggcccuagccccgaacugcaagggcagagaucccggcgcaauggauggucuuggccuccccacccucuccagauugucgcguggcugcuuuaucuguucuuugcuguuaucggcuucgggauucucgugccgcugcuuccccaucacugggugccugccggauacgccuguaugggcgcuaucuuugccgggcaucuggucgugcaccucacggcuguuagcauugaccccgccgaugcgaacgugagagacaaguccuaugccggaccucugcccaucuucaaucggucucagcaugcucacgucaucgaggaucugcacugcaaccucuguaauguggacguuagcgcccgcuccaaacauugcagcgcuuguaacaagugcguguguggcuuugaucaccauugcaaguggcugaauaacugugucggcgaaagaaauuaccggcuuuuccugcacucuguggccuccgcgcuccugggggugcuucugcucguccugguugccaccuauguguuuguggaguucuuugucaacccgaugcgccugagaacaaaucggcacuucgaagugcucaaaaaccauaccgacguuugguuuguguuccugccugcugcccccgucgagacacaagcuccugccauucuugcccuggcugcgcuccugauccuucugggacuccugagcaccgcccugcucggccaucugcuuugcuuucacauuuaccugauguggcacaagcucacaaccuaugaguacaucgugcagcaucgcccuccccaggaagcuaaagggguucacagagagcuggaaucuugucccccgaagaugcggcccauucaggagauggaguucuacaugcgcacguucagacacaugcggccugaacccccuggacaagccggccccgccgcugugaaugccaaacauucccgcccggcgagcccugaucccaccccugggagacgggacugcgcuggacccccuguccagguggagugggauagaaagaagccccuuccguggcgcucuccucugcuccugcuggccauguggggcccccaggcucccccuugccucugucggaaaagaggccgcggggccugcaucaagugugaacggcugagaccgcgcauucggagacgcggacuugggcccccugccgcugcccccgcgcggagacgcaucccucggacacccgcccugugcaccccucucgcucugcccgccccgacaaccagacggcgccaguccccuuggacgagauuucaauggcggagacgcgcuugggccgcgccccuguggccuccccggggcgccggagcugacagcccgagauggcgcggcagacggguccgcccucccuucuccuga

SEQ ID NO: 78075 - RNA, 1104 nt, Artificial Sequence
  derived and/or modified sequence opt5 from ZDHHC2__Homo_sapiens__NP_057437
auggcccccagcggcccuggguccucugcuagacggcgcugcagacgggugcuguacuggaucccggucguuuucauuacccuccugcuuggauggagcuauuacgccuaugcgauccagcuguguauuguguccauggagaacacaggcgaacaaguggucugccucauggcuuaccaucugcuuuuugccauguucguguggucuuauuggaagacgaucuuuacccugcccaugaauccuagcaaagaguuccaccucuccuacgccgaaaaggaccugcuggagcgcgaacccagaggggaggcucaccaggagguucuccggcgcgccgcuaaagaucugccuauuuauacaagaaccaugucuggagccauccgguacugugaccgcugccagcuuaucaagcccgauagaugucaccacugcagcgugugugacaaaugcauucugaagauggaucaucacuguccuugggucaacaauugcgugggcuuuuccaacuacaaguucuuucuccuguuccuugcguauagccugcucuacugucuguuuaucgccgcuacagaccugcaguauuucauuaaauuuuggaccaaugggcucccggauacacaagccaaguuccacaucauguuucuguucuucgcugccgcgauguuuucuguuucccuuagcucucuguucggauaccauugcuggcucguguccaaaaacaagagcacccuggaagccuuucggucucccgucuuccgccacggcacggacaaaaauggcuuuucccuuggguucagcaagaacaugagacagguguuuggagaugagaagaaauauuggcugcucccuauuuucuccucucugggcgacgggugcagcuuucccaccugucuggugaaucaggauccugaacaggcuuccacacccgccggacucaacagcaccgcuaagaaucuggagaaccaucaauucccggccaaaccucuucgggagucucagucccaucugcucacagacagccagucuuggaccgaaagcuccaucaaucccggcaagugcaaagccgggaugucuaacccugcucugacgauggagaaugaaacauga

SEQ ID NO: 78076 - RNA, 1038 nt, Artificial Sequence
  derived and/or modified sequence opt5 from ZDHHC7__Homo_sapiens__NP_001139020
augcagcccagcggccacagacugcgggacguggagcaucacccucuccuggccgaaaacgauaauuacgacuccucuagcuccucuagcuccgaggcugaugucgccgaccgcguuugguucaucagagaugggugcggaaugauuugugcggugaugaccuggcuucugguggcuuaugccgacuuugucgugacauucguuaugcuccugccgucuaaggauuuuugguacagcguggucaacggcgugaucuucaauugccuugccguucuggcucucuccagccaucugcggacgaugcugaccgaccccgaaaaaucuuccgauugucgcccuagcgccugcacagugaagaccgggcucgaccccacacuggucggaauuuguggcgaggggaccgaaucugugcaaucccuucugcucggagcugugccuaaaggcaacgccacaaaggaguauauggagagccugcagcuuaaacccggcgaagucaucuacaagugcccuaaguguugcuguauuaaaccggagagagcgcaccauugcucuaucuguaagcggugcauccgcaaaauggaucaccacugccccuggguuaauaacugugugggggaaaagaaucagagauuuuucgugcuguuuaccauguauauugcccucuccagcguccaugcucugauccugugcggauuccaguuuauuuccugugugcggggccaauggacggagugcucugacuucagcccucccaucaccguuauucuccugaucuuucuuugucuggaggggcuccuguucuuuacauucaccgccgugauguucggaacacagauucacuccaucugcaacgaugaaaccgagaucgaacgccuuaaaagcgagaagccuacgugggaaagacggcugcgcugggagggcaugaagucugucuuugggggacccccgucccuccuguggaugaauccuuucgugggcuuuagauuccggcgccugcccacaagaccucggaaaggcgggcccgaguuuagcguuuga

SEQ ID NO: 78077 - RNA, 2298 nt, Artificial Sequence
  derived and/or modified sequence opt5 from ZDHHC8__Homo_sapiens__NP_037505
augcccagaagcccuggcacccggcugaagccggccaaauacauccccguggcuacagccgcggcucuccuggucggguccucuacgcuuuucuuuguuuuuaccugcccuuggcugacacgcgccgugagccccgccgugccugucuauaacggaauuaucuuucucuucgugcuggcuaauuuuuccauggccaccuucauggaccccggcguuuuuccuagagcugaugaggacgaagauaaggaggacgauuuccgggccccgcuuuacaaaaacguggacguccgcgggauucaggugagaaugaaguggugugcgacaugccacuuuuaucggcccccucgcuguucucauugcagcguuugugauaauugcguggaagacuucgaucaccauugucccugggucaacaauugcaucggaagacggaacuaccgcuauuucuuccuguuucuccugucccugucugcccacauggugggcguggucgcuuucgggcucguuuacgugcugaaucaugccgagggacuuggcgcugcccacaccacaauuaccauggcggugaugugugucgccggccuguucuuuaucccugugaucgggcucacgggauuccacguugugcuggucaccagaggccggacaaccaacgaacaagugacagggaaauuucgcggaggcguuaaucccuucaccagagggugcuguggaaacguggagcauguccuuugcagcccgcuggcuccucgguauguggucgagcccccucgccucccccuggccgugucccugaagcccccuuuucucagaccggaacugcuugaccgggcugccccucugaagguuaaacucagcgauaauggccugaaggccggccuugggagaucuaaauccaagggaagccuggaccgccucgaugagaaaccucuggaccuggggcccccucugcccccgaagauugaagcugggacguucucuuccgaccuccagacaccucggcccggaagcgcggagucugcccuuuccgugcagagaaccagcccucccacacccgcuauguacaaguuucgccccgccuucccgaccggcccuaaaguccccuuuugcgggcccggagaacaggugccuggcccggauucccugacccucggcgacgauucuauccggagccuggacuucguuuccgagcccagccuugaucugccugacuacgggcccggaggccuccacgccgcuuauccucccucuccuccccuguccgccagcgaugcguuuucuggggcucugagaagccucucccugaaggccucuagccgccggggaggcgaccauguggcccuucaaccgcugagauccgagggcggcccucccacaccucaccgcagcauuuucgcuccccacgcccucccgaaccggaauggaucucuguccuacgauagccugcuuaacccuggcucucccgggggacaugcuuguccugcccaccccgcggucggcguggccggguaucauucccccuaccuccacccuggagcuacgggcgacccgcccagaccucugccccgcagcuuuuccccugugcuggggccccggccuagagaaccgucucccguucgguaugauaaucucagccgcaccaucauggccuccauucaggagagaaaagaccgggaagagagagagcgccugcuucggucucaggcugacagccuguucggcgauuccggagucuacgacgccccuagcucuuauucccuccagcaagcgagcgugcugucugaaggccccagagggccugcccugcgcuacggauccagagaugaccuuguggcuggccccggguucggaggcgcccggaacccggcucuccagacaagccugucuagccuguccagcucugucucccgcgccccuagaaccagcuccucuagccuccaggccgaucaggcuuccucuaacgcgcccgggccccggccuagcuccggcucucaucgcagccccgccagacaaggacugccuuccccgcccggcacaccucacagccccucuuacgcugggccuaaggccguggccuuuauccacaccgaccuucccgagccgccucccucccugacgguucagcgggaucauccucagcucaaaacacccccuagcaagcugaauggacaaucucccggccuggcucgccuugggccggccaccggaccucccggccccuccgcgagcccuaccagacacacacucgugaaaaaggucucuggggugggcggaaccacauaugaaauuuccguuuga

SEQ ID NO: 78078 - RNA, 1095 nt, Artificial Sequence
  derived and/or modified sequence opt5 from ZDHHC9__Homo_sapiens__NP_001008223
augagcgugauggucguuagaaagaaagugacccggaagugggagaaacugcccggccgcaacacauucugcugugacgggagagugaugauggcccggcagaagggaaucuuuuaccucacgcuguuccuuauucuggggaccugcacacucuuuuucgcuuuugaaugucgcuaucuggccguccaacuuuccccugcgaucccgguguucgcugccaugcuguuucucuucucuauggccacccugcugagaacaucuuuuuccgaucccggcguuauuccucgggcucuccccgacgaggccgcuuucaucgaaauggagauugaagccaccaauggagcggugccucagggccagagacccccuccgcgcaucaaaaacuuucagaucaauaaccaaauugucaagcugaaguacugcuauacauguaaaaucuuccggcccccucgcgccucucacugcagcauuugugauaauugcguggagagauuugaccaucacugucccuggguugggaacugcgugggaaagcggaauuaccgcuauuucuaccuuuucauccugucccucucucugcuuaccauuuaugucuuugcuuucaacaucguguacguggcccugaaaagccucaagauuggcuuucuggagacgcugaaagaaaccccuggcacaguccucgagguucugaucuguuucuuuacccuuugguccgugguggggcugacaggauuccauaccuuucucgucgcucugaaucagacgacaaacgaagauaucaagggcagcuggaccgggaagaauagagugcagaaccccuacucucacggaaauauuguuaaaaacugcugcgaggugcuuuguggcccgcugccucccuccguccucgaccggcgcgggauccugccucuggaggaaagcggaucuagaccucccuccacacaggagaccagcagcucccuccugccccaaagcccggcccccaccgaacaucuuaauuccaacgagaugccugaagauucuagcacacccgaggagaugccucccccggaaccucccgagccuccccaggaagcggccgaggcugaaaaguga

SEQ ID NO: 78079 - RNA, 3327 nt, Artificial Sequence
  derived and/or modified sequence opt5 from ZEB1__Homo_sapiens__NP_001121600
augaaggugaccaacuacaauacagucguugagacgaacagcgacuccgaugacgaagauaaacugcacaucguggaggaagagucugugaccgacgccgcugauugcgaaggcguccccgaggacgaucucccuacagaccagaccgugcugccggggagaagcuccgagcgggaaggaaaugccaagaacuguugggaggaugacacaggcaaagaagggcaagagauucuuggacccgaggcgcaggcugaugaagccggcugcaccguuaaggacgaugagugugaaucugacgccgagaaugaacagaaccaugacccuaauguggaggaguuccugcagcaacaggauacagcugucaucuuucccgaagccccugaggaagaccagcgccaggggacccccgaggcuagcggacacgaugaaaacggcacgccugacgccuucucccaacuccugaccugcccguauugugauagaggcuacaaacgguuuacaucucuuaaggagcauauuaaguaucgccacgagaaaaaugaagacaacuucagcugcucccuguguagcuacaccuuugcguauagaacacagcucgagcggcauaugaccucucacaaguccgggcgcgaucagagacacgugacgcagagcggaugcaaucggaaauucaaguguacagaaugcggcaaagccuuuaaguacaagcaucaccugaaagagcaucugcgcauccacucuggggaaaagcccuaugaguguccuaacugcaaaaagagauucucccacagcggaucuuacuccagccauauuuccucuaaaaagugcaucagccucauccccguuaauggccggccucgcaccgggcugaaaacaucccaauguagcucucccucccuuagcgcuucuccgggaagcccuaccagaccccagauucggcagaagaucgagaacaagccucugcaagaacagcucuccgugaaucagauuaaaaccgagcccgucgacuacgaauuuaagcccaucgugguggccucuggcauuaacugcagcacaccucugcagaacggcgucuucaccgggggaggcccgcuucaagcuacguccagcccccaggggaugguucaggccguggugcugccuacagucggacucgugucucccaucuccauuaaucugagcgauauccagaacguucugaaaguggcggucgacggcaaugugauccgccaaguucucgagaacaaucaggccaaccuggcuucuaaggagcaggaaaccauuaaugccuccccuauccagcaagggggacacagcgugauuuccgcuaucucucuuccccuggucgaucaggacggcacaaccaaaauuaucaucaacuauagccucgagcagccgucccagcugcaaguggucccucagaaucuuaagaaggaaaaccccguggccacgaauagcuguaaaagcgagaagcugccugaagaccucacaguuaaauccgagaaggauaagagcuuugagggcggggugaacgacucuaccugccugcugugugaugacugccccggagauauuaaugcccucccugaacugaaacauuacgaccuuaagcagcccacccaaccgccuccccugcccgcugcggaggccgaaaaaccugaguccagcgucucuuccgcuacaggcgaugggaaccucagcccgucucagcccccucugaagaaucuucugagccuccugaaagccuauuacgcccugaacgcucagcccuccgccgaagaacucagcaagaucgcggacucugugaaccugccucuugauguugugaaaaagugguucgagaagaugcaggcuggacaaauuuccguccagagcuccgaacccucuagcccugagcccggcaaagugaauaucccggccaagaacaaugaccagccucaguccgccaacgcuaaugaaccccaagauucuaccgugaaccugcagagcccucucaaaaugacaaauucccccguucugccggucgggucuacgaccaacggcagcagauccagcacaccuucucccuccccucugaaucuuucuucuucccggaacacccagggauaucucuacacagccgagggcgcucaggaagaaccccaaguggagccccuggaccugagccucccuaagcagcagggggaacugcuugagagaucuaccauuacguccguguaucaaaauagcgucuacuccgugcaggaggagccgcugaaccucagcugugccaaaaaggagccccagaaagauucuugcguuaccgacagcgaaccuguggucaaugugauucccccuuccgcgaaccccaucaauaucgccaucccuacaguuaccgcucagcugccgacaauuguggccaucgcugaccaaaacucuguccccugucugcgcgcccuugcggccaacaagcagaccauucucaucccucagguggcuuacacguauagcacaaccguuucccccgccgugcaggagccuccccugaaggucauucaaccgaauggaaaccaggaugaacggcaggacacaucuagcgagggcguguccaauguggaagaucagaacgacucugauagcaccccucccaaaaagaaaaugagaaagaccgagaaugggauguacgcuugcgaccugugugauaaaaucuuucaaaaguccagcucucuccugcgccacaaguaugagcauacaggaaaacggccccacgaaugcggcaucugcaagaaagccuucaagcacaaacaucaccuuauugagcauaugagacugcacuccggggaaaagccuuaccagugugacaagugcggcaaacgcuucagccacucuggauccuauagccagcauaugaaccaccgguacuccuauuguaagagagaggccgaggagcgcgauucuacggagcaggaagaggcuggccccgaaauccucagcaaugagcaugucggggcgcgggccuccccuagccaaggagacucugaugaaagagagucccugacccgcgaggaagacgaggauagcgaaaaagaggaggaagaggaagacaaggagauggaggaacugcaggaggaaaaagagugcgaaaagccgcagggcgacgaggaagaggaggaagaggaagaggaaguugaggaggaagagguggaagaggcugagaacgaaggggaggaagccaagacagagggacuuaugaaagaugaccgggccgaaucucaagcuagcucccucggccagaaggugggggagucuagcgagcaggucuccgaagagaaaaccaaugaagccuga

SEQ ID NO: 78080 - RNA, 3573 nt, Artificial Sequence
  derived and/or modified sequence opt5 from ZEB2__Homo_sapiens__NP_001165124
augaagcagcccaucauggccgacggcccuagaugcaaacggcgcaagcaagcuaacccgagacggaaaaauguggucaacuacgauaauguuguggacaccgggagcgagacagaugaagaggacaagcugcacauugccgaagaugacggaaucgcgaacccccucgaucaggagacguccccugcuucugugcccaaucaugaaagcuccccucacgucucucaggcccugcuuccccgcgaggaggaagaggacgaaauuagagagggcgggguggagcauccuuggcacaacaaugaaauccugcaggccagcguugauggaccggugaaaaacgcuaauuguaccuccgacuucgaggaauauuuugccaagcggaagcucgaggaacgcgauggccaugcugucucuauugaggaguaccugcaaagaagcgacacagccaucaucuaucccgaagcgccugaggaacuuucccggcuggggacccccgaggccaacggacaggaagagaaugaucucccucccggcacaccggacgcuuucgcccagcugcugaccugcccuuacugugaccgcggcuauaaaagacucacaagccugaaggagcacauuaaauaccggcacgaaaagaacgaggaaaauuuuucuugcccccuuuguuccuauaccuucgcuuaccgcacgcagcuggagagacauauggugacccacaaaccugggacagaucaacaucagaugcucacccagggagccggcaaccggaaguuuaagugcacagaaugugggaaagcguucaaguacaaacaccaccugaaggagcaucuucgcauccacagcggagagaaacccuaugaaugccccaauuguaagaaaagauuuucucauuccggcagcuacucuucccacauuagcuccaagaagugcaucgggcugauuucuguuaacggacggaugagaaacaauaucaaaaccggcagcuccccuaacagcgugucuuccagcccgacaaauucugccauuacgcagcuccgcaacaagcuggagaauggcaaaccccugagcauguccgaacaaaccgggcuccugaagaucaaaacagagccucuugacuucaacgauuauaagguccugauggcuacccauggauuuucuggcaccagccccuucaugaaugggggacucggcgccacauccccucugggggugcaccccagcgcucagucuccgaugcagcaccuuggagugggcauggaggccccucugcucggcuuucccacgaugaacuccaaucugagcgaaguccaaaagguucugcagaucguggacaacaccgugucucggcagaaaauggauuguaaggccgaggaaauuuccaaacucaagggguaccauaugaaagacccuugcagccagcccgaggaacaaggagucacauccccuaauauucccccggugggccugccuguugugucucacaacggggcuaccaagagcaucaucgauuauacacuugagaaggucaaugaggcgaaagccugccugcagucccucaccacggacucuagacgccagauuagcaacaucaagaaagaaaagcugcggacacuuaucgaucuggugaccgacgauaaaaugauugagaaucauaacaucuccacccccuucagcugucaguuuugcaaggaaucuuuccccggaccuauuccgcuccaccaacacgagagauaccuguguaagaugaacgaagagaucaaagcuguucugcagccccaugagaauauugugccuaacaaggccggcgucuucguggacaauaaagcccuccugcuuuccagcguccugucugaaaaggggaugacaucccccaucaacccuuauaaagaccacaugagcgugcucaaggcuuacuacgccaugaauauggagcccaacucugaugaacugcugaaaaucagcauugcgguuggccuuccucaggaguuugugaaggaaugguucgagcagcgcaaggucuaucaauacuccaauagccggucucccucccucgagagaagcuccaaaccgcuggcuccuaacucuaaucccccuaccaaggacagccugcucccccgcuccccggugaaaccuauggauucuaucacaagccccuccauugccgaacugcauaacucuguuacgaauugcgacccuccccuucggcugaccaagcccagccacuuuacaaacaucaaaccuguggagaagcucgaucauuccagaagcaauaccccgucuccccugaaccuguccagcacaucuuccaagaauagccacucuuccagcuauaccccuaacuccuucagcucugaagaacuucaggccgagccccucgaccugagccugccuaaacagaugaaggaacccaaauccauuaucgcuacgaagaacaaaaccaaggccucuagcauuucccucgaucacaauucugucagcuccucuagcgagaacuccgacgaaccucugaaucuuacauuuaucaagaaagaguucagcaacucuaauaaccuggauaauaaguccaccaacccgguguuuagcaugaaucccuucucugcuaaaccucucuacacagcccugcccccucaguccgcguuucccccggccaccuucaugccucccgugcaaacgagcauccccggacugcgcccuuaucccggccuugaccagauguccuuucucccucauauggcuuacacauauccgaccggggccgcuacauucgccgauaugcagcaacggagaaaguaccagcggaaacagggauuucagggcgaacugcuggacggggcgcaagauuacaugucuggacucgacgacaugaccgauagcgacuccugucugagccgcaagaagauuaaaaagaccgagucuggcauguaugccugcgaucuuugugacaaaacauuccagaaguccagcucucugcucagacacaaauacgagcauacggggaagcggccccaccagugccagaucuguaaaaaggcuuucaagcauaaacaccaccugauugaacauagcagacugcacuccggcgagaagccuuaucaaugcgauaaauguggaaagcgcuuuucucauagcggcuccuacucucagcacaugaaccaccgguauagcuacugcaaaagagaagccgaggaacgcgaggcugccgagagagaagcccgggagaaggggcaucuugaacccaccgagcuccugaugaaucgcgcuuaucugcaguccaucacaccucagggauacagcgacucugaagagagagaguccaugccccgggauggcgaaagcgagaaggaacacgagaaagagggggaagacggauacggcaagcucgggcgccaagauggcgacgaggaguucgaggaagaggaggaagaguccgaaaacaaaucuauggauaccgacccggagacaauuagagaugaagaggagaccggagaccauagcauggacgauuccucugaagacggcaagauggagacgaaaagcgaucacgaagaggacaauauggaagaugggauguga

SEQ ID NO: 78081 - RNA, 684 nt, Artificial Sequence
  derived and/or modified sequence opt5 from ZFAND3__Homo_sapiens__NP_068762
augggcgacgccgggagcgagagauccaaggcucccucucugccuccgcggugccccuguggauucuggggcagcuccaaaaccaugaaccucugcucuaaguguuuugccgauuuccagaaaaagcaaccugacgaugacagcgcgcccuccacaucuaauagccaguccgaucuguuuagcgaagagacgaccucugacaacaauaacacauccaucaccacaccuacccuuagccccucucagcagccucugccgacagaacucaaugugaccucccccagcaaagaggaaugcgggccuuguacggauaccgcucacgucucucugauuacacccaccaagcgcuccugcggaacagacagccaauccgagaacgaggccucuccuguuaagagaccccggcuucuggaaaauaccgagcgcagcgaagagacguccagaagcaaacagaagucucggcgcagauguuuccagugccagacaaaacucgagcuggugcaacaggaacugggcuccugucggugcggguacguguuuuguaugcuccaucgccugccggagcagcacgauugcaccuucgaccauaugggaagaggccgggaagaggccaucaugaagauggucaaacuugaucgcaaggugggcagaagcugccagcggauuggggaaggauguucuuga

SEQ ID NO: 78082 - RNA, 642 nt, Artificial Sequence
  derived and/or modified sequence opt5 from ZFAND5__Homo_sapiens__NP_001095891
auggcccaggagaccaaccaaacacccggcccuaugcugugcagcacgggguguggauucuacggcaauccgagaaccaacgggaugugcuccguguguuauaaggaacaccuccagcggcagcaaaauucuggacgcaugagccccaugggcacagcuuccgggucuaacagcccuaccuccgacucugccagcguccagagagcggauacaucccugaauaacugcgagggagcugccggcagcaccucugaaaaaucccggaauguucccguggccgcccuuccugugacacagcagaugaccgagaugagcaucucucgcgaagacaagauuacgacccccaaaacagaggucuccgagccugugguuacccagccgagccccucugugucccaaccuagcacaucccagucugaagagaaggcucccgaacugccuaaacccaagaagaacagauguuuuaugugccggaaaaaggucggccucaccggguucgauugucgcugcggaaaucuguuuuguggccuucauagauacagcgacaaacacaacugcccguaugauuacaaggcugaggccgcggccaaaauccggaaggagaauccugugguuguggcugaaaagauucagcgcaucuga

SEQ ID NO: 78083 - RNA, 591 nt, Artificial Sequence
  derived and/or modified sequence opt5 from ZFAND6__Homo_sapiens__NP_001229846
auggcccaggagaccaaccacagccaagugcccaugcugugcuccacaggcuguggguucuacggaaauccuagaacgaacggcaugugcucugucuguuauaaggaacaucuccagcggcagaauagcuccaacgggcgcaucucuccgcccguucagugcaccgacggaagcgugccugaggcucaauccgcccuggauucuacaagcuccagcaugcagcccucuccuguguccaaucagagccuucugucugaauccgucgcgagcucucagcucgacuccaccagcguggauaaagcuguucccgagacagaagacgugcaagccuccgucucugauaccgcccagcagccuagcgaggagcaguccaagagccuggaaaaaccgaagcagaaaaagaacagauguuuuaugugccggaagaaagugggccuuacaggguucgagugucgcugcggaaauguuuacuguggcgugcacagauauucugacguccauaacugcuccuacaauuauaaggcugaugccgcugagaaaauucggaaggaaaaccccgugguggucggcgagaaaauccaaaagauuuga

SEQ ID NO: 78084 - RNA, 3696 nt, Artificial Sequence
  derived and/or modified sequence opt5 from ZFAT__Homo_sapiens__NP_001025110
augugcaaguguugcaaccuguucagccccaaucaguccgagcuccugucucacgugagcgaaaaacauauggaggaaggcgucaacguugacgagaucauuaucccucuuagaccgcuguccacccccgaaccucccaauucuagcaagacaggggaugaguuucucgugaugaaacggaagcgcggaagaccuaaaggcuccacgaagaagucuagcaccgaggaagaacuggccgaaaacauugugucccccacagaggacagcccucuugcuccggaggaagggaauagccugcccccuuccagccucgaguguucuaaaugcugucggaaguucuccaacacccgccaacugagaaaacacaucugcauuaucguccugaaucucggagaagaggaaggcgaggccgggaacgagagcgaucuggaacuugagaagaaauguaaggaagacgaucgggagaaggcgucuaaacgccccagaucccagaagacagaaaaagugcagaagaucagcggaaaagaggcucggcagcuguccggcgccaagaaaccuauuaucucuguugugcucaccgcccaugaggcuauucccggcgccacaaagaucgucccgguggaagcugggccucccgagaccggagccacgaauagcgaaaccacauccgcggaccugguuccucgcagaggcuaccaagaguaugccauucagcagacccccuacgaacagcccaugaagucuucucggcuugggccuacacaacugaaaaucuuuaccugcgaguauuguaacaagguguucaaauuuaagcacucccuccaggcucaucugcgcauucacacgaaugagaaaccguacaagugcccccaguguagcuaugccucugcuaucaaggccaaccugaauguccaccucagaaaacauacaggagaaaaguucgcgugcgauuacugcagcuuuaccugucuguccaaaggccaccuuaaggugcauaucgagcgggugcacaaaaagauuaagcagcacugccgcuucuguaaaaagaaauauucugacgucaagaaccugaucaaacauauuagagaugcccacgacccucaagauaagaagguuaaagaagcucucgacgagcugugccuuaugacacgggaggggaagagacagcugcucuacgauugucauaucugcgaacgcaaauuuaagaaugagcuggaccgggacagacacaugcuggugcauggagauaaauggcccuucgccugugaacucugcggccacggcgcuaccaaguaccaggcccuggagcuucacgugcgcaaacauccuuuugucuaugugugugccguuugccggaagaaguucgugagcuccauuagacugcgcacccacaucaaagaaguccauggggcugcgcaagaggcccucguguuuacaagcucuaucaaccaguccuucugucugcuugagcccggaggcgacauucagcaggaagcucugggggaucaacuccagcugguugaggaagaguucgcccugcagggagugaacgcccucaaggaagaggcuugcccgggcgacacgcagcuggaggaagggcggaaagagccugaagcccccggagagaugccugcgcccgcuguccaccuugccagcccucaagccgaaucuaccgcucugcccccgugcgagcucgagacaaccguggucuccagcuccgaucugcacucucaggaagugguuagcgacgauuuucugcuuaagaaugacacauccucugccgaggcucaugccgcgccugaaaaaccucccgauaugcagcacagaagcuccgugcagacccaaggcgaggucaucacgcuccugcugagcaaggcccagucugcuggcuccgaccaggagagccauggggcccagucuccccucggagaaggccaaaacauggcugugcuguccgccggggauccggaccccagccgcugucuucggucuaauccugcggaggccagcgaccugcugcccccuguugcuggaggcggggauacaauuacccaccagcccgacuccugcaaggccgcuccugaacauagaagcggcaucaccgccuucaugaaagugcucaacucucugcagaagaaacaaaugaauacaucccuuugugagcgcauucggaaggucuacggagaucucgaaugcgaguauuguggcaaacuguuuugguaccaggugcacuucgacaugcacgugagaacccauacacgggagcaccuguauuacugcagccagugucauuauuccucuaucacgaagaacugccucaagcgccacguuauccagaaacauagcaauauucugcuuaagugucccaccgaugggugcgacuacuccacaccggauaaauacaagcugcaagcccaccucaaaguccacaccgcucuggacaagagaucuuauagcuguccugugugcgaaaaguccuuuucugaggaucggcugaucaaaagccauauuaagacaaaccaccccgaaguguccaugagcaccaucucugagguccuuggaagacgcgugcagcucaaaggccugauugggaagcgggcgaugaaaugcccuuacugugacuucuauuuuaugaagaauggauccgaucugcagagacauaucugggcccacgaaggcguuaaacccuucaagugcagccucugugaguacgcuacgcgcucuaaguccaaccugaaagcccacaugaauagacauagcaccgagaagacacaccuuugcgacaugugugggaaaaaguuuaaaucuaagggcacccugaagucccauaaacuccugcacacagccgauggaaagcaguucaaaugcaccgugugugacuauacggcugcccaaaagccgcagcugcuucggcauauggaacagcacgucagcuuuaaaccuuuccgcugcgcgcacugucauuacuccugcaacauuagcggcucucucaagagacacuauaaucggaagcaucccaacgaggaauacgcuaauguggggacaggagagcuggccgccgaaguucugauccagcaaggcgggcucaaauguccugugugcagcuuugucuacggaaccaagugggaguucaaccgccaccugaaaaacaagcacggccuuaaagugguugagaucgacggggaucccaagugggaaacagcuaccgaggcccccgaagaaccuuccacccaguaucugcauauuacagaggcggaagaggacgugcagggcacgcaagcugccgucgccgcucuccaggaucugagauacaccucugaaagcggagaccggcuggauccgacagccgugaauauccuucagcagauuaucgagcugggcgcugaaacccacgacgccacagcgcucgccuccguggucgcuauggcccccgggaccguuacgguggugaagcaagucacagaggaggaaccuucuagcaaccauaccgugaugauucaggagaccguucagcaggcuuccguggaacuggccgagcaacaccaucucgucgugucuagcgaugacguugaaggaaucgagacagugaccgucuauacacagggcggggaggccuccgaguucaucguguacguucaggaggcuaugcagcccguggaggagcaagcggucgaacagccugcccaggagcuguga

SEQ ID NO: 78085 - RNA, 5970 nt, Artificial Sequence
  derived and/or modified sequence opt5 from ZFC3H1__Homo_sapiens__NP_659419
auggcuaccgcugacacacccgccccugcgagcuccggccucucucccaaggaagaaggggaacucgaagauggagaaaucagcgacgaugacaacaauucccagauuagaucucggagcuccucuagcuccagcggcgggggacugcuucccuacccucgcagacggcccccucacucugcucgcggcgggggauccggcggcgggggaggcagcucuagcuccucuuccagcucccaacagcagcugagaaacuucucucggagccgccaugccuccgaaagagggcaccuccggggacccagcucuuaucgcccuaaagaaccguuuagaucccaucccccuagcgugcggaugcccucuagcucccugucugagagcuccccucgccccagcuucugggaaagaucucaccuugcccuggaucgguuucgcuucagaggccggccguacagagggggaucccgcuggagccggggcagaggcgucggggagcgcggaggcaagccugggugccggcccccucucggaggcggggcuggaucuggcuuuuccagcucccagucuuggagagaacccuccccuccccgcaaauccucuaagagcuucggccgguccccgagcagaaaacaaaauuauucuuccaagaacgagaauuguguugaggaaacguuugaggaccugcugcucaaguacaaacagauccagcuggaacuugagugcauuaacaaggaugaaaaacuggcccucagcucuaaggaggagaaugugcaggaagaccccaaaacccugaacuucgaggaucaaacauccaccgacaaugugagcaucacaaaggauucuagcaaggaagucgcuccugaggagaaaacccaggugaagacauuucaggccuucgagcuuaaaccccugcgccagaagcucacccugccuggggacaaaaaccggcugaagaaaguuaaggauggagcgaagccccucucccugaaaagcgacacgaccgacucuucccaaggccuucaggauaaggagcagaaucugacaagacgcauuagcaccuccgacauccucucugagaaaaagcugggggaggaugaagaggaacuuagcgagcugcaacuccggcugcuggcccuccaguccgcuucuaaaaaguggcagcagaaggagcaacaggugaugaaagaaagcaaggagaaacugacaaagaccaaaacgguccagcagaaggugaagacauccaccaaaacacauucugccaagaaaguuagcaccaccgcuaagcaagcccuuagaaaacagcagacaaaggcguggaagaaacugcagcaacagaaggaacaggagcggcagaaagaggaagaccaacgcaagcaggccgaggaagaggaaagacggaaaagagaggaggaaauccgcaagauucgggaucucuccaaccaggaggaacaauauaauagauuuaugaaacuggugggaggcaagcgcagaagccggucuaaguccagcgacccggaucuucgcagaucucuggacaaacagccuacggauuccgggggcggaaucuaccaguaugacaacuacgaggaagucgcuauggauaccgacagcgagacaucuucccccgccccuagccccgugcagccucccuucuuuuccgaguguagccucggcuacuucucuccggcuccuagccugucccugccgcccccuccgcaagugucuagccugcccccucucucccagcccuaugucgaagggcuuugcguuucucuggagccucugcccccucugcccccgcugccuccccuuccucccgaagacccggagcagccucccaagccucccuucgccgaugaagaggaggaagaggaaaugcuccugcgggaggagcugcucaaaagccuggccaauaagcgcgcuuuuaaacccgaagagaccuccucuaacagcgacccuccgucucccccugugcuuaacaauagccaccccgugccuagaagcaaccuguccauugucagcaucaauacagugucucagccccggauucaaaacccuaaguuccaccgcggaccgagacucccccggaccguuaucucccugccuaagcauaaaagcguggucgugacgcugaaugauuccgacgauucugaaagcgacggcgaggcguccaagagcacaaacucuguuuuugggggacuugaauccaugauuaaagaggcccgcagaaccgcugagcaggccagcaagcccaaagugccucccaagucugaaaaggagaaugauccgcuccggaccccugaagcccugcccgaggagaaaaagaucgaguacagacugcucaaagaggaaaucgcuaaccgcgagaagcagcggcugauuaaaagcgaccagcuuaagacauccucuagcucccccgccaauucugaugucgaaaucgacggcauugggagaaucgcgauggugaccaagcaagucacagaugcugagagcaaacugaagaaacaccgcauucuccugaugaaggacgaauccgugcugaaaaaccuuguucagcaggaggccaagaaaaaggagagcgugcggaaugccgaagcuaagaucacgaaacucaccgagcaacugcaggccacagaaaagauccugaacgucaauagaauguuccucaaaaagcugcaggagcagauucaucgcgugcaacagcggguuaccaucaaaaaggcucuuacacugaaguauggcgaggaacucgccagagcgaaagccguggcuucuaaggagauuggaaaacgcaagcuggaacaggaucgguuuggcccuaacaaaaugaugagacuggacuccagccccgucuccucuccucggaagcacagcgccgagcuuaucgcuauggaaaagcgcagacuccagaaacuggaguacgaguaugcccugaagauucaaaaacucaaggaagcgcgggcccugaaagcuaaggagcagcagaauaucuccccggugguggaagaggaacccgaguucucucuuccucagcccagccugcacgaccucacccaagauaagcugacgcuggacaccgaggaaaacgauguugacgaugagauccuuuccgggagcucucgcgaaagacggagauccuuucuggagagcaacuacuucacaaaaccuaaucucaagcauaccgacacagccaacaaagaauguauuaauaagcugaacaaaaauaccgucgagaagcccgagcucuuucugggacuuaagaucggcgaacugcagaaacucuauucuaaggcugauucccugaaacagcugauucuuaagacgacaaccgggaucacagagaaagugcugcacggacaggaaauuagcguggacgucgauuucgugaccgcccaaucuaagaccauggagguuaaaccgugcccuuuucgccccuaccauagcccucuccugguguucaaguccuaccgguuuucucccuauuacagaacaaaggagaaacucccucugagcuccgucagcuauuccaacaugaucgaacccgaccaguguuucugccgcuucgaucuuacgggcaccuguaaugacgaugacugccaguggcaacacauucaggacuacacacugucucggaagcagcucuuucaggauauccugagcuauaaccugucccuuaucgggugugccgagaccucuacaaaugaagagauuaccgcuagcgcggaaaaauacguggagaagcuguucggcguuaacaaagacagaauguccauggaucaaauggccgugcuccuggucucuaauaucaacgagagcaagggacauacgccgccuuuuacaaccuauaaggacaaacgcaaguggaaacccaaguucuggcggaaacccauuuccgauaauagcuuuucuuccgacgaagaacagagcaccggcccuaucaaguacgcuuuccagccggaaaaccagauuaaugugcccgcccucgauacaguugugaccccugacgaugucagauacuuuacaaacgagacggacgauaucgccaaccuggaggcuucugugcuugagaaucccucccacgugcaacuguggcugaagcucgccuauaaauaccugaaccagaaugagggggaaugcagcgagucucuugacuccgcgcugaacguccucgcucgcgcccuggaaaauaacaaggacaauccugagaucuggugccacuaucucagacuguucagcaaacggggaaccaaggaugaaguucaggagaugugugagacagccguggaauacgcucccgacuaucaguccuuuuggaccuuccuucaucuggagagcacauuugaagagaaagauuacgugugcgagcgcaugcuggaguuccucaugggcgccgcgaagcaagagaccucuaacauucugagcuuucagcuucuggaagcucuccuguucagaguccagcuccacaucuucacggggcggugucaauccgcccuggccauucuucagaaugcucugaagucugccaacgacggaaucguggcugaguaucugaaaaccagcgaucgcugccucgccuggcuggcguacauucaucuuaucgaauuuaauauccugccuuccaaguucuacgacccgucuaacgauaaucccagcagaauuguuaacacagaguccuuugugaugccuuggcaggccguccaggacgugaaaaccaaucccgauaugcuccuggcuguuuucgaggacgccgugaaggcuuguacagaugaaucucucgccgucgaggaacggaucgaggccugccugccucuuuauaccaacaugauugcucugcaccaacugcucgaaagauacgaggcggccauggagcuguguaaaagccuucuggaauccugccccaucaacugucagcuccuggaggcucugguggcccucuaucuucagacaaaucagcacgacaaggcccgcgcuguuuggcugaccgccuuugagaaaaacccgcaaaaugcggagguguucuaccauaugugcaaguuuuucauucugcagaaccggggcgauaaucuccugccuuuucuuagaaaguucaucgcuagcuuuuucaaacccggguucgaaaaguauaacaaucuggaccucuuucgcuaccugcugaacauccccggcccuauugacauccccucucggcucuguaaaggaaauuucgaugacgauauguuuaaccaccaggucccuuaucuuuggcugauuuacugccugugccauccgcuccaguccagcaucaaggagacgguggaggccuacgaagccgcucugggcguggccaugagaugugacauuguccagaaaaucuggauggauuaucuuguuuucgcgaauaaccgggcugccgggucucgcaauaaggugcaagaguuuaaguucuuuacagaccuggugaacagaugccucgucaccgugcccgcccgguacccuauucccuucuccagcgcugauuauugguccaauuacgaauuucacaaccgcguuaucuucuuuuaucugucuugugugccuaaaacccagcauagcaagacacuggagagauucugcuccgucaugcccgccaauagcggacucgcccuucggcugcugcagcacgagugggaagagucuaacgugcaaauccucaaacugcaggccaagauguuuaccuacaacauuccgacgugucuugcgacauggaaaaucgccauugcugccgaaaucguucugaagggccagcgcgaggugcacagacucuaucaacgggcucugcagaagcugccucucugcgccucccuuuggaaagaccagcugcuguucgaagccagcgaagggggaaagaccgauaaucuccgcaaacuggucucuaagugucaggagauuggcgugagccuuaacgaacugcucaaucugaacuccaauaaaacagagucuaagaaccauuga

SEQ ID NO: 78086 - RNA, 4569 nt, Artificial Sequence
  derived and/or modified sequence opt5 from ZFHX2__Homo_sapiens__XP_006720345
augaccuucacaacgaaggugcugagcgcccccacccucuccccucuggacaacggccaggagccgcccacacacgggccugaacccaccccuucuagagaucaagcugccgagggacccaaucuuacaccugaagcgagcccggacccccugccugagcccccucucgcuuccgucgaaguucccgauaaaccgucuggcagcccugggcagcccccuucccccgcccccucuccugugccggagcccgacgcccaggcugaggauguggccccucccccuaccauggcugaagaggaagagggaacaaccggcgagcugcggagcgccgaacccgcgccggccgacucccgccauccucuuacguacagaaagaccacaaacuuugcucuggauaaauuccucgaccccgcccggccuuauaagugcaccgucuguaaagagagcuuuacacagaagaauauccugcuggugcacuacaacucuguuucccaucuccacaagaugaaaaaggcugccauugaucccagcgcgccugcccgcggggaagcuggagcucccccgaccacgacagcugccaccgacaaaccuuucaagugcacaguguguagagucucuuauaaucaauccagcacccuggagauccauaugcggucugugcuucaccagacccgcuccagaggcacaaaaacggauagcaagauugaaggccccgagcggucccaggaggaacccaaggagggggaaaccgagggagaaguuggcacagagaaaaaggggccugacaccucuggauuuaucagcggccugccguuccucuccccuccucccccuccccuggaucuucaccgcuuuccugcuccccuguucacaccgccugugcugcccccuuuuccccuggucccggagagccugcucaaacugcagcaacagcagcuucugcucccuuucuaccugcaugaccuuaagguggggcccaaacugacccucgcuggaccugcgcccgugcugucucugcccgccgcuacgccuccgcccccuccccagccucccaaggccgaacucgccgagagagaaugggagcggccuccgauggcuaaagaaggcaacgaggccggccccuccagcccucccgacccucugcccaaugaggcggcucgcacagccgccaaggcccuucuggaaaacuuuggguucgagcucgucauucaauauaaugaaggaaagcaggccguuccgccuccucccaccccucccccuccggaggcucugggcgggggagauaaacuugccugcggcgcgugugggaagcuguuuucuaacaugcucauccugaaaacccacgaggaacaugugcacagacgguuccugcccuucgaggcccucagccgcuacgcugcccaguuuagaaaguccuaugacucucuguacccuccccuugcugaaccucccaaaccgccugauggaagccuggacucccccgugccucaccucgggcccccuuuccugguccccgagccggaagccggcgggacacgggcgccugaggagagaagccgcgccggaggccauuggcccaucgaagaggaagagucuucccgggggaaucugcccccucuugugccggcuggaagacgcuuuagccggaccaaguucacagaauuucaaacgcaggcccuccagucuuucuuugagaccuccgcuuaccccaaggauggcgagguugaaagacuggccagccugcucgggcuggccucccgcguggucgugguuugguuccagaacgcucggcaaaaagcgagaaagaaugccugcgagggcggaucuaugccuacaggcgggggaaccggcggggcuagcggaugucgccggugccacgccacauuuuccuguguguucgaacuugucagacaucugaaaaagugcuaugacgaucagacccucgaggaagaggaggaagaggccgaacgcggcgaggaggaagaggaaguggaggaagaggaggucgaagaggaacaggggcuggagcccccugcuggccccgaaggaccucugccggagcccccugacggcgaggaacuuucucaggccgaggcgacgaaagcugggggaaaggaacccgaggaaaaggccaccccuagccccuccccggcccacacaugugaucaaugcgcuauuagcuuuucuucccaggaccuccugaccagccaucggagacugcacuuccucccuucucugcagcccuccgccccuccccagcuucuggaucucccccugcugguguuuggcgagcggaacccccuuguugcggcuacaagcccgaugcccgggccuccccucaaacgcaagcacgaggacggaucucugagcccuaccggcuccgaagccgggggcggaggcgagggggaacccccgagagacaaacggcugagaacgacaauccucccugagcaacuggagauucuuuaccgcugguauaugcaggauagcaaucccacccggaagaugcuggacugcaucucugaagaggugggacucaaaaagagagucgugcagguuugguuccagaacacacgcgccagagaacggaagggccaauuccgcuccaccccugggggagugcccagcccugcugucaaacccccggccaccgcuacgccugccucccugcccaaguuuaaccugcuucucggcaaaguggaugacgggacaggcagagaggcgcccaagcgggaagccccugcuuucccguaccccaccgccacacuggcuucuggaccucagcccuuucugccucccggcaaagaggccaccacaccuacccccgagccgccucucccccugcuuccucccccgccucccagcgaagaggaagggcccgaggaaccucccaaggccuccccugagucugaggcuuguagccuguccgcgggagaucucucugacagcuccgccagcucucuggcugaaccggagucccccggcgccgggggaacgagcggcggcccugggggaggcacaggggugcccgauggaaugggccagcgcagauaucggacccaaaugucuucccugcagcuuaaaauuaugaaggccugcuacgaagccuaucgcaccccuacaaugcaggagugugaaguucugggggaggagaucggacuccccaagagagucauucaggugugguuccaaaaugcccgggcgaaagaaaagaaagcuaagcugcagggcaccgccgccggcagcacagggggaucuuccgagggccuccuggcugcccagcgcacggacugcccuuacugugaugugaaauacgacuuuuaugucagcugcagagggcaucuuuucucccggcagcaccuggcgaagcucaaggaagcugugagagcccaacugaaaagcgagucuaaguguuacgaucuggccccggcucccgaggccccucccgcucuuaaagccccucccgcgaccacaccggccagcaugccucugggagcugcccccacccucccccgccuggcuccuguucuccuguccggccccgcccuugcccagccuccgcuggggaaccucgcucccuuuaauucuggaccugcggccagcuccggccugcugggccuugcuacaucugugcugcccaccacgaccgucgugcagacagccgggccuggacggccccucccgcagagaccuaugcccgaccaaaccaacacaagcaccgccggcacaaccgauccuguucccgggccgccuacggaaccccugggagacaagguguccucugagcgcaaacccgucgcuggcccuacaagcuccagcaaugacgcccucaagaaccugaaggcgcuuaaaaccaccgugcccgcucugcucgggggacaguuccucccuuuuccgcugcccccugccggcggcacagccccucccgcuguuuucgggccccagcuucaaggagccuauuuucagcagcuguacggcaugaagaaaggccucuuccccaugaauccgaugaucccccagacccugaucggacuccugccuaacgcgcuucugcaacccccuccccagccgccugaacccacggccacagcucccccuaagcccccugagcugccggcccccggcgaaggggaggcuggagagguggaugaacuccugaccggcucuacaggcauuuccaccgucgacgugacacaucgguaucuuugcagacaguguaaaauggccuuugauggggaggcuccugccaccgcgcaccagcgcagcuucugcuucuuuggacggggcucugggggauccaugcccccuccccugagagugccgaucuguacguaccacugccucgccugcgaaguccugcucagcggccgcgaggcucuggccucccaucuucggucuagcgcucacagacggaaggccgccccuccccaagggggaccucccauuuccaucaccaaugcugcgacagccgcuagcgccgccguugcuuucgccaaggaagaggcgcgccugccucauaccgacucuaaccccaaaacaaccacgacauccacccugcucgcccuguga

SEQ ID NO: 78087 - RNA, 8370 nt, Artificial Sequence
  derived and/or modified sequence opt5 from ZFHX3__Homo_sapiens__NP_001158238
augagacugggcgggggacagcucgugagcgaggaacugaugaaccuuggcgaguccuucauccaaaccaaugaccccucucugaagcucuuucagugcgcuguguguaacaaauucacaacggauaaucuggacaugcuugggcugcacaugaacguugaacggagccucuccgaggaugaauggaaggcugugaugggagacucuuaccagugcaaacugugucgcuauaauacccagcugaaggccaacuuucaacuccacugcaaaacagauaagcacgugcagaaguaccagcugguggcccauauuaaagagggcgggaaggcuaaugaguggagacuuaaauguguggccaucggaaacccuguucaccugaagugcaaugccugugacuauuacaccaacagccucgaaaaacugcggcuucauacagucaauagccgccacgaggcuucucugaagcucuauaagcaucugcaacaacacgaaagcggcgucgagggcgaguccugcuacuaucacugugugcugugcaacuacagcaccaaagccaagcucaaucugauucagcauguuagaucuaugaaacaccagcgguccgaaagccuucgcaagcugcagagacuccaaaaagggcugcccgaggaagaugaggaccuuggacagaucuucacaauucggcgcugucccucuaccgauccugaagaggcuaucgaggacguggaaggccccuccgagacggccgccgauccugaggaacuggccaaggaccaggaagggggagcuagcucuagccaagccgagaaagagcucaccgauagccccgcuacauccaagagaaucucuuuuccuggcagcuccgaaagcccccugucuuccaagcggcccaaaaccgccgaggaaauuaagccugagcagauguaccagugccccuauugcaaauacagcaacgccgacgucaaucgccugagagugcacgccaugacacagcauucugugcaaccuaugcuccgguguccccugugccaggacaugcuuaacaacaagauccaucugcagcuccaucugacccaccuucauagcgucgcuccggauuguguugaaaaacugauuaugacggugacaaccccugagauggugaugcccuccucuauguuccucccugccgcuguccccgaccgcgaugggaauagcaaccuggaggaagccggaaagcagcccgagacauccgaagaccugggcaagaauauccucccuagcgccucuaccgagcaauccggcgaucugaaaccgagccccgcugacccugggucugugagagaggauuccggauuuauuugcuggaagaaaggcuguaaccagguuuucaagaccagcgcggcccuucagacacacuuuaaugaagugcacgcuaaacggccccagcugccugucuccgacagacauguguauaaguaccgcugcaaccaauguucucucgccuucaagacgaucgagaaacugcagcugcacagccaguaucauguuauucgggccgcuaccaugugcugucuuugccagagauccuuucgcacauuccaagcccucaagaaacaccuggaaaccucucaccuggagcucagcgaagcggauauccagcagcuguacgggggacuucuggcuaauggcgaccuccuggccaugggggaucccacacuggccgaggaccauaccaucauuguggaggaagacaaggaggaagaguccgaucuugaagacaaacaaagcccgacgggaucugauuccggcagcguccaggaggacucuggcuccgagccuaagcgggcucuccccuuuagaaaggggccuaacuucacaauggaaaaauuccuggaucccagccgcccuuauaaguguaccgugugcaaagagucuuuuacccagaagaauauccugcucguccacuacaacagcgugucccaucugcacaaacuuaagcgggcccugcaggaaagcgcuacaggacaacccgagccgaccucuuccccugacaauaaacccuucaagugcaacacauguaauguugccuacagccaguccucuacgcucgaaauucauaugagaagcgugcugcaccagaccaaggcgcgcgccgcuaaacuggaggccgcuuccggcucuagcaacgggacaggaaauuccucuagcaucucccuuuccucuuccacccccagcccugucucuacauccggcagcaacaccuuuacgaccucuaacccguccagcgccgggauugcgcccuccagcaaucuccugucucaggugccuacagagagcguuggcaugcccccucugggaaaccccaucggcgccaauaucgcuuccccuucugaacccaaggaggccaaccggaaaaagcucgcugauaugauugccagcagacaacagcagcagcaacagcagcaacagcagcagcaacagcagcagcaacagcagcaggcccaaacccuggcucaggcgcaggcccaggugcaagcucaccuucagcaggaacugcaacagcaggccgcccucauccagucccaacuguucaauccgacacugcuuccucauuuucccaugaccacggagacacuccugcagcugcagcagcaacagcaccuccuguucccuuuuuauauucccucugcugaguuccagcuuaacccggaagucagccugccugugaccuccggggcccucacacugaccggaaccggccccgggcugcuugaggaccugaaagcccaggugcaaguuccucagcagucucaucaacagauccucccccagcagcaacagaaucagcugagcauugcucagucccacagcgcccuccugcaacccucucagcauccugaaaagaagaacaaacuugucaucaaggagaaagaaaaggagucccagcgcgagcgggauagcgccgaaggaggcgaggggaauacaggcccgaaagaaacgcugcccgacgcucucaaggccaaggagaaaaaggaacuggcgccuggaggcgggucugagcccuccaugcugccucccagaaucgcuagcgaugcccggggaaacgccaccaaagcccuucuggagaauuuuggcuucgaacucgugauucaguacaacgagaauaagcaaaaagugcagaagaagaacgggaaaacagaccagggagaaaaucuggagaagcucgaaugcgauuccuguggcaaacuguuuucuaacauccuuauucucaagagccaccaggagcacguccaucaaaacuauuucccuuuuaaacagcucgagcgcuucgccaagcaguacagagaccacuaugacaaacuguacccgcugcggccccaaaccccugaacccccucccccgccuccgcccccucccccuccgccccuuccugcugcgcccccucagcccgcguccacaccggccaucccugcuagcgcgcccccuauuaccucucccacgaucgcuccugcccagcccuccgugccgcugacacagcucagcaugccuauggagcugcccauuuucucuccccucaugaugcaaaccaugccucugcagacccuuccggcccagcugcccccucagcuggggcccguugaaccucuccccgcugaucuggcgcaacuuuaucagcaucagcugaauccuacacuccugcagcaacagaacaagagaccgcgcacccggaucacagacgaucagcucagagugcugcgccaauacuuugacaucaauaacagccccuccgaggagcagauuaaggaaauggccgauaaaucuggccuuccucagaaggucaucaaacacugguucagaaauacgcuguuuaaggagcggcagcgcaacaaagacagccccuacaauuucuccaacccucccauuaccucucuggaagaacugaagaucgauagcagaccgccuucccccgaacccccuaagcaagaguauuggggaagcaaacggucuucccgcacaagauuuaccgacuaccagcugcgggugcuucaggauuucuuugacgcuaaugccuaucccaaggaugacgaguucgaacagcugagcaaccuccugaaucucccuacacgcguuauuguggucugguuucaaaacgccagacagaaagcucggaagaauuacgagaaccagggcgaagggaaagauggagagcgcagagaacugaccaaugaccgguauaucagaacguccaaccuuaacuaccagugcaagaaguguucucugguguuccaacgcaucuuugaccugauuaaacaccagaagaaacucugcuauaaggaugaggacgaggaaggccaggaugacagccaaaaugaggauuccauggacgccauggaaauccugaccccgacaucuagcuccuguagcacccccaugccuucucaggcguacuccgcucccgccccuagcgccaacaauacagcuucuuccgccuuccuucagcugaccgcggaggcugaggagcucgccacauuuaacagcaaaaccgaggccggggaugaaaagcccaagcuggcugaggccccgucugcucagccuaaucaaacgcaggaaaaacagggacagcccaagccugagcuccaacagcaggagcagcccgaacagaagacaaacaccccucagcagaagcugccccagcuuguuagccugccgucccugccucaaccgcccccucaggccccgcccccucagugcccccucccucaaucuagccccuccccuagccagcugucccaucuuccccugaaaccgcuccacaccucuacaccucagcagcuggcgaaucugcccccucaacucauucccuaccagugugaccagugcaaacuugccuucccgagcuucgagcauuggcaggaacaccaacagcugcauuuucuguccgcucagaaccaguucauccacccucaauuucucgaucggucucuggacaugcccuucaugcuuuuugaucccagcaauccucugcucgccucccagcugcugucuggcgcuauuccccagaucccugccagcuccgccaccagcccgucuacgcccacauccaccaugaacacacucaagagaaaacuugaggaaaaggcuagcgcgucuccuggggagaaugacuccggcaccggaggcgaggaaccccaacgcgacaaacggcugagaacaaccaucacgccugagcagcuggaaauucucuaucagaaguaccugcuugauagcaaccccacccgcaaaaugcuggaccacaucgcccaugagguggggcucaagaaacgggucguccaggugugguuccaaaauacaagagcucgcgaacggaagggacaguuuagagccgucggcccugcccaggcucaccggcgcuguccguucugcagagcccuguuuaaggcgaaaaccgcucuggaggcccauauucggucucgccacuggcacgaggccaagagagcuggguauaaccucacacuuuccgccaugcugcuggauugcgacggaggccuccagaugaaaggcgauaucuucgacgggaccagcuuuucccaucugcccccuagcucuagcgauggacaaggcguuccccuuuccccugugucuaagacgauggaacugagcccccggacacuccuguccccgucuagcauuaaaguggaggggaucgaagacuucgaguccccuucuaugagcuccgucaaucugaacuucgaucagaccaagcucgacaaugaugacuguagcucugugaacacagcgaucaccgauaccacaacgggagacgaaggcaacgccgacaaugauuccgcuaccgggauugccacagagaccaaguccucuuccgcucccaacgagggacuuacaaaagccgcuaugauggccaugagcgaauacgaggacagacuguccucuggccugguuagccccgcgccuuccuuuuauagcaaggaauacgauaaugagggcaccguggacuauucugagacguccagccucgccgaucccugcucuccuagcccgggggcuuccggaucugccggcaaaagcggggacuccggagaucgccccggccagaagcgguucagaacacagaugaccaaccugcaacuuaaaguccugaagucuuguuuuaaugacuaccgcaccccuacaaugcucgaaugcgaggugcuggggaacgauaucggacugcccaagcggguugugcaggucugguuccagaaugcuagagccaaagaaaagaaaagcaagcucuccauggccaaacacuuuggcauuaaccagaccagcuacgagggcccuaagacagaauguacgcuuugcgggaucaaguauucugcucgccuguccgugcgggaccauauuuucagccaacagcacaucuccaaaguuaaggauaccauuggaucucagcuggacaaagagaaggaguacuuugaucccgcgacagugagacaacucauggcccagcaggaacuggaccgcaucaaaaaggcuaaugagguccuuggccuggccgcccagcaacaggggauguucgacaacaccccgcuccaggcucugaaucugccuacagccuaucccgcgcuccagggaaucccucccgugcuucugccgggccugaacagcccuucccuccccggguuuacccccucuaauacggcccugaccagcccuaaacccaaccuuaugggacugccuuccacaaccgugccgagccccggccucccuacaucuggccugcccaauaagccuuccagcgcuucucuguccagccccaccccugcccaagcuacaauggccauggggccgcagcagcccccucagcaacagcagcaacagcagcagccccaaguccagcagccucccccgccucccgcggcccagcccccucccacgccucaacucccgcuucagcagcagcaacagagaaaggauaaagacucugaaaagguuaaagagaaggaaaaagcucauaagggaaagggcgagccccugccugugcccaaaaaggagaaaggggaagccccuaccgcuacagccgcuaccauuuccgcgccccugccgaccauggaguacgcgguggauccugcccagcuccaagcucugcaggccgcucuuacaagcgaccccacggcccugcucaccucucaguuccugccuuauuuuguccccggauucagcccuuacuaugcgccccagaucccgggcgcgcugcaauccggguaccuccagcccauguacggaauggaaggccuuuuuccuuauagccccgcucugucccaggcccugaugggccucucuccugggagccugcuucagcaauaccagcaguaucagcaaucccugcaggaggcuauucagcagcaacagcagcggcaacuccagcagcagcaacagcagaaggugcagcaacagcagccgaaagccucucagacacccguuccucccggagccccuagccccgauaaggacccugcuaaggaaucccccaaaccggaggagcaaaagaacaccccucgcgaagugucuccccugcugccuaaacuccccgaggaaccggaggccgagagcaaguccgcggauagccuuuacgacccuuucaucguccccaaagugcaguauaagcugguuuguagaaagugccaggccggcuucucugaugaagaggcugcccggucccaccugaaaagccucuguuucuucgggcaaucuguggucaaccugcaggaaauggugcuucacguccccacaggaggcgggggaggcggcuccgggggaggcgggggaggcgggggaggcggcgggggaggcgggagcuaccauugccuggcuugugagucugcccucugcggagaagaggcgcugucccagcaccuggagagcgcccuccauaagcaccgcaccauuacgagagcugcccggaaugcuaaagaacacccuucucugcuuccccauuccgccugcuuuccugacccgagcacagcuagcaccucccagucugccgcgcacagcaacgauucucccccucccccuagcgccgcugcccccagcuccgcuucuccgcaugccagcagaaaguccuggccucaagugguuagccgcgccucugcggcuaaacccccuuccuuucccccucuguccucuuccagcaccgugacauccucuagcuguuccaccucuggcguccagcccagcaugccgacagacgacuauuccgaggaaagcgauaccgaccucucucagaaguccgaugggcccgccagcccuguggagggccccaaagacccuucuugccccaaggauagcggacugacguccguuggcacagacaccuuucggcuuuga

SEQ ID NO: 78088 - RNA, 10851 nt, Artificial Sequence
  derived and/or modified sequence opt5 from ZFHX4__Homo_sapiens__XP_011515897
auggagaccugcgacucucccccuaucuccagacaggaaaacggccaauccacaagcaagcugugugggacgacccagcucgacaaugaggugcccgaaaaaguggccggaauggagcccgaccgggaaaacuccucuaccgaugacaaucugaagaccgaugagcgcaaaagcgaggcucugcucggcuucuccguugaaaacgccgcggcuacacaggugaccucugccaaggagauuccuugcaaugaaugugccaccuccuuucccucccuccagaaauacauggagcaccauugcccuaacgcucggcugcccgugcuuaaggacgauaaugagagcgaaaucucugagcuggaagacuccgaugucgagaaccucaccggggaaauuguguaucaaccugacggaagcgccuacaucauugaggauucuaaggaguccggccagaaugcucagacgggggccaacagcaaacuguucucuaccgcgauguuucuggacucccucgccagcgcuggagaaaaguccgaucagucugccagcgcuccgauguccuucuauccccaaaucaucaauacauuucacauugccagcucucugggcaaaccuuucaccgcggaccaggccuuucccaacacauccgcucuugccggcguugggccugugcugcauagcuuccgggucuacgaccuccgccacaagcgcgagaaagauuaucugaccucugacggaagcgcuaagaauagcugugugucuaaggauguucccaacaauguggaccuuagcaaauuugauggcugcgucuccgacgggaagcggaaacccgugcugauguguuuccucugcaagcugagcuuuggauacauccgcucuuucgugacgcaugccguccacgaucacagaaugacacugaacgacgaagaacagaaacuccuguccaacaaguguguuagcgccauuauccagggcauugggaaagauaaggaaccucuuaucucuuuucuggagcccaagaaauccaccagcguguauccucauuucuccacaaccaaucucauuggacccgaccccaccuuccggggccuguggucugcuuuucacguggagaacggcgauagccuuccugcgggguucgccuuucugaagggauccgcuucuacaagcuccagcgccgaacaaccccucggcaucacgcagaugcccaaagccgaggucaaucucgggggacugucuucccucgugguuaacaccccuaucacaagcgugucucugucccauagcucuagcgaauccagcaagaugucugaguccaaagaccaggaaaauaacugcgagcgccccaaggagagcaauguccuucacccuaacggcgaaugucccgugaaguccgagcccaccgaaccuggggacgaggaugaggaagacgcuuacucuaaugagcuggaugacgaagagguucucggagaacugacagauagcauuggcaacaaagacuucccccuucugaaucaauccaucucuccucucagcuccucugugcugaaguuuauugagaaaggcaccagcuccagcucugccacggucuccgaugacacagagaagaaaaagcagaccgcggcugugagagccagcgggucugucgccuccaacuacggaaucagcggcaaggauuucgcugacgccucugcuuccaaagauagcgccaccgcggcccaccccuccgaaauugcuagaggggacgaggauagcucugccacaccucaucagcacggauuuacccccagcacaccgggcacgccugggcccggcggagacggcucccccgggucuggaaucgaaugcccuaagugcgacaccgugcugggcagcucccgcucucucgggggacauaugacaaugaugcacagcagaaauuccuguaaaacccugaagugcccgaaauguaacuggcauuauaaguaccagcaaacacuugaggcucacaugaaggaaaaacaccccgagccuggcgggucuugcguuuauuguaagaccggccagccccauccucggcuggcccgcggagagagcuacacgugcggcuauaaacccuucagaugugaagugugcaauuacuccaccacaaccaaggggaaccucagcauccacaugcagucugauaaacaucugaacaauguccagaaccugcaaaauggaaacggcgaacagguguuugggcacuccgcgccugcccccaauacaagccuuucuggauguggcaccccguccccuagcaagcccaaacagaagccuacguggcggugcgagguuugugacuaugagacaaacguggcuagaaaucuccgcauucacaugaccuccgaaaagcauaugcacaacaugaugcugcugcagcaaaauaugaaacagauccagcauaaccuccaccuggggcuugcccccgcugaggccgagcuguaccaguacuaucucgcccaaaauauuggccugacaggaaugaagcuggaaaacccggcugauccucagcuuaugaucaaucccuuccagcucgacccugcgaccgccgcugcccuggcccccggccuggucaacaaugagcugcccccugaaauucggcuggcuucugggcaacuuaugggagaugaccugagccuccugaccgccggcgagcuguccccguacaucagcgaucccgcgcuuaaacucuuucagugcgcugugugcaacaaguucacaucugacucccuggaggcccugagcgugcauguuucuagcgaaagaucccucccugaggaagaguggcgcgccgucaucggggauauuuaucaguguaaacugugcaacuacaauacgcagcuuaaggcuaacuuucaacugcacuguaagaccgacaaacacaugcagaaguaucagcucguggcccauaucaaagaaggaggcaagucuaaugaguggcggcugaaaugcauugcgaucgggaaccccgugcaccugaaguguaaugcuugcgauuacuauacaaacagcgucgacaaacuuagacuccauaccacaaaucaccgccaugaggccgcccugaaacuguacaagcaccuccagaaacaagaaggcgcugugaacccugaguccuguuacuauuacugcgccguuugugauuauaccacgaaggugaaacugaaucuuguccagcacgugcggucuguuaagcaucagcagacagaaggacugagaaagcuccaacugcaccagcagggccuggcucccgaggaagacaaccuuagcgagauuuucuucgugaaagacugcccuccgaaugagcuggaaaccgccucccucggggcgcgcaccugugaugacgaucugacagagcaacagcuccggagcaccucugaagaacaguccgaagaggccgagggagcuaucaagcccacagccgucgcugaagacgaugagaaagacacgagcgaaagagauaacuccgagggcaaaaauucuaacaaagacagcgggauuaucaccccugagaaggaacugaaaguguccguugccggaggcacacagccccuucugcucgccaaggaggaagauguggcuaccaagcgcucuaaaccuacagaggacaauaaguuuugccaugaacaauucuaccagugccccuauuguaacuacaacagccgggaucaguccagaauccagaugcacguccugagccaacacucugugcagccggugauuugcuguccucugugccaggacguccuuuccaauaaaaugcaucugcagcuccaccugacccaucuccacagcguuucucccgacuguguggagaagcugcuuaugacggugcccgucccugaugugaugaugcccaacuccaugcugcucccugcggccgcuagcgagaaaucugaacgggacaccccggccgccguuacagcugagggcagcgggaaguauuccggagaaucucccauggaugacaagagcauggccggccuggaggauuccaaagcgaauguggaagucaagaacgaggagcaaaaaccuaccaaggaaccccuggaggugagcgaauggaauaaaaacuccucuaaggacguuaagaucccugauacacuucaggaccagcugaaugagcagcaaaaacgccagccccucagcguguccgauagacaugucuacaaguaccggugcaaccacuguucucuggcuuuuaaaaccaugcagaagcuccaaauucacagccaguaucaugccaucagagccgcuacaaugugcaaucugugucagcgcuccuuccggaccuuucaggcccuuaaaaagcaccuggaagcggggcauccggagcugucugaggcugaacuccaacagcuguacgccagccuuccugugaacggagagcugugggccgaauccgagacgaugagccaggacgaucacggccucgagcaggaaauggagagagaauaugagguugaccacgaagggaaggcuucucccgugggauccgauuccucuagcauuccugacgacaugggcagcgagcccaaacgcacacugccuuucagaaagggccccaauuuuaccauggagaaauuccucgauccgucucggccuuacaagugcaccgucuguaaagaauccuuuacacaaaagaacauccugcuugugcauuauaauagcgugucccaucugcacaagcugaaaaagguccuccaggaggccagcucucccguuccccaggaaaccaacagcaauacggacaacaaaccuuacaagugcuccaucugcaauguggcuuauucucagagcuccacacuggagauucacaugcgcucugugcuucaucaaaccaaagccagagcggccaagcuggaaccgagcgggcacgucgcuggaggccacuccaucgccgcuaacgugaacucucccgggcagggaaugcucgauagcaugucccuggccgccguuaauagcaaagacacacaucucgaugcuaaggagcugaacaagaaacagaccccugaccuuauuucugcgcaacccgcccaccauccuccccaguccccugcucagauccagaugcaacugcagcacgagcugcagcagcaagccgccuucuuucagccgcaguuccucaaucccgcuuuucugccucacuuccccaugacaccugaagcccuucugcaguuccaacagccccaguuucucuucccguuuuacauuccuggcaccgaguucagccuggggcccgaucucggacugcccggcucugcgacguuuggcaugccugggaugaccggaauggcuggcucccuucuggaagaccugaagcagcaaauccagacacagcaucacguggggcaaacccagcuccagauccugcagcaacaggcccagcaguaccaagccacacagccccagcuucagccucaaaaacagcagcaacagccgcccccuccccagcagcaacagcagcagcaagcuagcaagcugcucaaacaggagcaguccaacauugucucugccgauugucagaucaugaaggacgugccuagcuauaaggaagcggaggauauuuccgagaaacccgaaaagccgaaacaagaguucaucagcgaaggagagggccugaaggaggggaaagacaccaagaagcagaaaucucuggaaccuuccauucccccuccccggaucgccagcggagcucgcggcaaugccgcuaaggcccuccuugagaacuuuggcuucgaacugguuauccaguacaaugagaacagacaaaaagugcagaagaaagggaagucuggagaaggcgagaauacggauaagcuggagugcgggacauguggaaaacucuuuagcaacguccugauucuuaagucccaucaggaacacgugcauggccaguucuuuccuuaugcugcccuggagaaauucgcgcggcaauaccgcgaagccuaugacaagcucuaccccaucucuccgagcuccccugagacaccgcccccuccgcccccucccccuccccugccucccgcuccgccucagcccucuagcauggggccugucaaaauucccaauacaguguccaccccgcugcaggccccuccgcccaccccucccccuccgcccccucccccucccccuccgcccccucccccucccccgccuccgcccagcgcuccuccccagguucaacucccugugucucuugaccugccgcuguuccccuccaucaugaugcagccuguccagcaccccgcccucccuccccagcuggcccuucaacugccgcagauggaugcucucagcgcggaccugacacagcugugccagcaacagcucggacuugauccuaacuuucugagacacucccaguucaagcggccccgcacgagaauuaccgacgaucaacugaaaauccuccgggccuauuuugacauuaauaacucuccuagcgaagaacagauccaggagauggcugaaaaguccggccugucucagaaggugaucaaacauugguucagaaauacacuuuuuaaggagcgccaacggaacaaagauagccccuacaacuucuccaauccgccuauuaccguucuggaagacaucagaauugauccccagcccacaagccucgagcacuacaagucugacgccuccuuuagcaaaagaucuagccggaccagauucacggauuaucagcugcgcgugcugcaggacuuuuucgacacaaacgccuacccuaaggaugacgaaaucgagcaacucagcaccguccuuaaucugcccacccgggugauugugguuugguuucagaacgcuagacagaaggcccgcaaaucuuaugagaaucaggcggaaacaaaggauaacgagaaacgggaacugaccaaugagagauacauccggacauccaacaugcaauaucaguguaagaaaugcaaugucguguucccucgcaucuuugaccucauuacgcaucagaagaagcaauguuacaaagaugaggacgaugacgcccaggaugaaagccagaccgaggacucuauggaugcuacagaccagguggucuauaagcacugcaccgugagcggccaaacagaugccgcuaaaaacgccgcggccccggcugccuccagcggguccggaaccucuacgccccugaucccuagccccaagccugaacccgagaaaaccuccccuaagccggaauaccccgcugagaagccuaaacagucugaccccagcccucccucccagggcacaaagccggcccuuccucuggcuucuaccagcuccgauccgccccaggccagcacagcgcaaccucagccccagccucagccgcccaaacaaccucagcucauugggagacccccuucugccucccagacccccguuccgagcucuccucugcagaucuccaugacaagccugcaaaauucucugcccccucagcuucugcaguaccaaugugaucagugcacgguggcuuuccccacccuggagcucuggcaggaacaucagcacaugcacuuccuggccgcucaaaaccaguuucuucauuccccuuuccuggagcggcccauggacaugccguauaugauuuuugaucccaauaacccucucaugacaggacagcugcugggcagcucucucacccagaugcccccucaagccuccagcagccacaccacagccccgacgaccgucgcggcuucccuuaagcgcaaacuggacgauaaggaagacaauaacuguucugagaaagaagggggaaacagcggcgaggaucagcauagagacaagcggcugagaacaaccaucacacccgagcagcucgaaauccuguacgagaaguaucuucuggauuccaauccuacccgcaaaaugcucgaccacauugcccgggaagugggccugaagaaaagaguugugcaggucugguuccaaaacacgcgcgcucgggagagaaaggggcaguuucgcgccgugggacccgcccagucucacaaacggugcccuuucugcagagcucuguuuaaggccaagagcgcgcucgaaucccauauccgcucuagacacuggaaugagggcaaacaagccggguacagccuucccccuagcccccugauuagcacagaggauggaggcgaaucuccgcagaaguauaucuacuucgacuauccuucccugccccucaccaaaauugaccugagcucugagaacgaacuugcuuccaccguuagcacaccuguguccaagaccgccgagcugucucccaaaaaucuccugagcccguccucuuuuaaggcugaguguagcgaagaugucgagaaccugaaugccccucccgcggaagccggguacgaccagaacaagacagauuucgacgagaccuccagcaucaauacggcuauuucugaugccacaaccggagacgaaggcaacacagagauggaguccaccacgggcagcucuggggaugugaaacccgcucucagcccuaaggaacccaaaacccuugacacacugccuaagccggccaccacacccaccacagaggugugcgaugacaaauuucuguucucccucaccucuccuagcauccauuuuaaugauaaggacggagaucacgaccaguccuucuacaucacggacgaucccgacgauaacgcugaccggagcgaaacaucuuccauugccgauccuagcucccccaauccguucggcucuagcaacccuuuuaaguccaaaucuaaugaccgccccgggcauaagagauuccggacccaaaugagcaaccugcagcuuaaaguccugaaggcguguuuuuccgauuaucgcaccccuacaaugcaggagugcgaaaugcucggaaacgagaucggccugcccaaaagaguuguccaggugugguuccaaaaugcccgggcuaaggagaagaaauuuaagauuaacaucgggaaaccuuucaugauuaaucagggcggaaccgaaggcacaaagcccgaguguacgcugugcggggucaaauacucugccagacucagcauccgcgaccacaucuuuuccaagcagcacauuagcaaagugcgggaaaccguuggaucucagcuugauagagagaaggacuaucuggcuccgacaaccgugcgccaacugauggcccagcaggaacucgaucggaucaagaaagccuccgacguccugggccuuacagugcaacagcccgggaugauggauuccucuucccugcauggaauuagccucccuaccgcguaccccggccugccugggcugcccccuguucuccugccgggcaugaacggacccucuagccuuccuggcuucccccaaaauuccaacacgcugaccccucccggggcuggaaugcucggcuuuccgacaagcgccaccuccucuccugcccugagccuuuccucugcucccacaaagccucugcuccagacacccccucccccgcccccucccccuccgcccccucccagcuccucucugagcgggcaacagacggagcagcagaauaaagaguccgaaaagaaacaaacaaagccuaacaaggugaaaaagaucaaagaggaggaacuggaggccaccaagcccgaaaaacacccuaagaaggaggagaagauuagcucugcucucuccguccugggaaagguggucggcgagacacauguggacccgauccagcuucaggcccugcagaaugcgaucgccggggaccccgcuagcuucauuggcggacaauuucucccuuauuucauccccggcuuugccucuuacuucaccccucagcugcccgggaccguucagggaggcuauuucccgcccgugugugggauggaaucccuuuuuccuuacggacccacaaugccucagacgcuggcuggccucagccccggcgcccugcugcaacaguaccagcaauaucagcagaaccuccaggagucucugcaaaaacagcagaagcagcaacaggagcagcagcaaaaaccugugcaggcgaagaccuccaaggucgaaagcgaucagccgcaaaauucuaacgacgccuccgagacaaaagaagauaagagcaccgcuacagaguccaccaaagaggaaccccagcuugagagcaagucugccgacuucagcgauacguacguugugccuuuugugaaauaugaguucauuugcagaaagugucagaugauguuuacagacgaggaugcugccgucaaucaccagaaauccuucugcuacuuugggcaaccccugaucgacccucaggaaaccgugcuccggguucccgugucuaaguaucagugucuggcuugcgaugucgccauuagcggaaacgaggcgcuuucccagcaccuucagucuagccuccauaaggagaagaccaucaagcaggccaugcgcaaugcuaaagagcacgugagacugcugccgcauuccgucugcagcccuaaccccaacacaaccucuacaucccagagcgccgccucuuccaauaacacguacccucaccucagcuguuucucuaugaaguccuggcccaauauucuguuucaggcuagcgcccggcgcgcggcuuccccucccucuagcccgcccucccuuagccugccuucuaccgugacauccagccucugcucuaccagcggcguucaaacaucccugcccaccgagucuuguagcgacgaauccgauagcgagcuuucucagaaacuggaagaccucgacaacucccuggaggugaaggccaagccugccagcgggcuggauggaaauuucaacucuaucagaauggacauguuuuccgucuga

SEQ ID NO: 78089 - RNA, 1302 nt, Artificial Sequence
  derived and/or modified sequence opt5 from ZFP1__Homo_sapiens__XP_011521223
augcacugcuacggcgccuucaagauguggcugagcuccgcuuuuaucgugcucugucugugccccaaacuucagaagaugaacaaaucucaagggagcgucuccuucaccgacguuacaguggauuuuacgcaggaggaaugggagcagcuggacccuucucagcggauucucuauauggaugugaugcuggaaaauuacagcaaccuucuguccgucgagguguggaaggccgacgaucaaauggaaagagaccaucgcaauccggaugagcaggcgagacaguuccucauccugaaaaaccagacccccauugaggaacggggagaccuguuuggcaaggcucucaaucugaacacagauuucguuucucuucgccaagugccuuauaaguacgaccuguaugagaaaacccucaaguacaauagcgaucugcuuaacuccaauagaagcuaugccgggaaacagacagacgaauguaacgaguuuggaaaggcccugcucuaccugaaacaggagaagacccacucuggcgucgaauacuccgaguauaauaagagcgggaaagcucugucucauaaggccgcuaucuucaaacaccagaagauuaaaaaccucgugcaacccuuuaucugcacauacugugauaaggccuucuccuuuaaaagccugcuuaucucucauaagcggauucacaccggagaaaagccuuaugagugcaauguuuguaaaaagacguucucccacaaagcgaaccugaucaagcaucagcgcauucacaccggcgaaaaacccuuugagugcccugaguguggcaaggccuucacacaucagagcaaucucaucgugcaccaaagagcucacauggaaaagaaaccguacgagugcuccgaaugugggaagaccuucgcccagaaauuugagcugacaacccaucagcggauucacacgggagaacgccccuaugagugcaacgagugcgcuaagacauucuuuaaaaagucuaaccuuaucauucaucagaagauccacaccggcgagaaaagauacgaauguagcgaaugcgggaaguccuucauccaaaauagccagcugauuauccauaugcggacacacaccggagagaaaccuuaugaauguaccgagugcggcaagacauuuucucagcgcuccacgcucagacugcaucugcggauucacaccggggagaaacccuacgaauguagcgagugcggaaaggccuucucucgcaagagcagacucuccguccaccagcgggugcauaucggcgaaaaaccuuga

SEQ ID NO: 78090 - RNA, 1560 nt, Artificial Sequence
  derived and/or modified sequence opt5 from ZFP30__Homo_sapiens__NP_055713
auggccagagaccuggugauguuccgggaugucgcuguugacuuuagccaggaggaaugggagugccucaacuccuaccaacgcaaucuguauagagaugugauccuugaaaacuacucuaaucuggugagccucgccggcuguuccauuucuaagcccgacgucaucacccugcuugagcaggggaaagaaccuuggauggugguucgggaugagaagcgcagauggacacuggaccucgagagccgguaugauacgaaaaagcuguuccagggaaaagacauuuacgaaaugaaccugucccaguggaaggugauggagcgcaucaagucuugcggccucgaggaacaagagagcccgcacgaagucuguuuuagacaggugaccaaaacaaccuccgagaagaugcccacauaucggaaacugaccagccuuccucuguaccagaagucucauaaucgcgaaaaacccuaugagugcggggaauguggaaaggcguucagaguucggcagcaacucacauuucaccagcgcauucauaccggcgagaagccuuacgagugcaaagaaugugggaaggcuuucagacagugcgcccaccugucccggcaucagcgcauccacacgagcgauaaacuuuacgaguguaagaaaugcggaaagaucuuuaccuguggcucugaccugagagugcaccaacggauucauaucggcgaaaaacccuaugagugcaaggaaugcgggaaggccuucagaguccgcggacagcucaaccugcaccagcggauucauacaggcgagaaaccuuacgaguguaaggaaugcgggaaggcuuuuagacaauaugcccaccugacccgccaccagcggcucaauaucgcugagaaauguuacgaaugcaaagaguguggacaggccuuccugugcuccacaggccuuagacugcaucacaagcuccauaccggggaaaagccguaugaguguaaagagugcggaaaggcguuucgcgugcggcagcaacugacgcuucaccagcgcauucauacaggcgaaaaacccuacgauuguaaggagugcggcaaaaccuucagcagaggguaucaccugacacuccaccagcggauccauaccggagaaaagccuuacgaguguaaggagugccagaaauuuuucagacgcuacucugaacugauuucccaccaaggcauccauaucggggagaagcccuaugaaugcaaagaguguggaaaggccuuccggcuguuuagccagcucacccagcaccaguccauucacuucggcgaaaaaccuuuuaagugcaaggagugugagaaaacauucagacugcuuucucaacugacgcagcaucagagcauccacaccggggaaaagcccuacgacugcaaagaguguggaaaggcuuuucggcuccauuccagccugauucagcaccaacgcauccauucuggcgaaaaaccguauaagugcaaagaguguaagaaggccuucagacagcacucccaccuuacauaccaucagcggauucacaacgugaccuga

SEQ ID NO: 78091 - RNA, 999 nt, Artificial Sequence
  derived and/or modified sequence opt5 from ZFP36__Homo_sapiens__NP_003398
auggccaacagauacaccauggaccugacagcuaucuaugagagccuccugucccuuucucccgaugugccugucccgagcgaccacggcgggacggaauccucucccggauggggcagcuccgggccuuggucucugagccccuccgauagcucuccuuccggaguuaccagccggcuccccggccgcucuacaucccugguggaggggagaagcugcggaugggugccuccgcccccuggcuucgcgccccuugccccucggcugggccccgaacucucuccguccccuaccagccccacagcuaccuccacaaccccuucucgcuacaagacggagcuguguagaaccuuuagcgaauccgggcggugccgcuauggagccaaaugucaguucgcccacggccugggggagcucagacaagcuaaucggcaccccaaguacaaaacagagcugugccauaaguuuuaucuucagggacgcugucccuacggcagcagaugccacuucauucauaacccuucugaagaccuggccgcuccggggcaucccccuguccuccggcaguccaucagcuuuucuggacugcccagcggccgcagaaccuccccucccccgccuggccuugccgggcccucucugagcuccagcucuuucuccccuagcuccucucccccucccccgggagaucucccucugagccccuccgcguuuucugccgcucccggcacaccucuggcccggcgcgacccgacccccguguguugcccuagcuguagacgggcuacgcccauuuccguuugggggccucucggaggccuggugagaacacccucuguccagagccuuggguccgauccugacgaguaugccagcucuggauccagccugggcggcucugauucccccguguucgaagcggggguuuuugccccgccucaacccguggcugccccucgccggcuccccaucuucaauagaauuagcgucucugaguga

SEQ ID NO: 78092 - RNA, 1224 nt, Artificial Sequence
  derived and/or modified sequence opt5 from ZFP36L1__Homo_sapiens__NP_001231630
augggcagagcccggaaguccgggcugggacagcgcuccagacccaccgcuucucggagcgaggccgcggugcaaccuggcguccgcaaagcuagaggggccggaaacuggcggguuggccuccagacaggggaagccgcuccgagcccccaccgcgaccugagagauacgccugacccccggccuuggcuugcccgcacccauagaaugacaaccacacuggugucugcuaccaucuucgaucucagcgaggugcugugcaagggaaauaaaaugcuuaacuacuccgcccccucugcgggcggcugucugcucgaccggaaggccgucgggaccccugcuggaggcggguuuccgcgcagacacagcgugacacugcccuccagcaaauuccaucagaaucagcugcucucuucccugaagggagaaccugcccccgcucuuagcucucgggauucccgcuuuagagaccggagcuucucugagggcggggaaagacugcucccuacgcaaaagcagcccggaggcggccagguuaacuccagccgcuauaaaaccgagcugugccggccguuugaggaaaauggggccuguaaguacggagauaaaugccaguucgcgcacggcauucaugagcuuagaucccugacacgccacccuaaguauaaaaccgaacucugucggacauuucacaccaucggguucugccccuacggaccuagaugucauuuuauucacaacgccgaggagcgccgggcucuggccggcgcuagagaccugucugccgaucgcccccggcuccaacauagcuucuccuuugccggguuccccagcgcugcggccacggcugccgccacaggacugcuugacucuccuaccuccaucacaccgcccccuauucugagcgcugaugaccuccugggcucucccacccuuccugauggcaccaauaaccccuuugccuucagcucccaggaacuggcgucucucuucgcuccgagcauggggcugccuggaggcgggucccccacaacguuucuguucagaccuaugagcgagucuccccacauguuugacuccccucccagcccgcaggacucucucuccgaucaggaaggauaucugagcuccucuagcuccucucacagcggcuccgacagcccuacccuugauaauucucgccggcugcccaucuucuccagacucagcaucucugacgauuga

SEQ ID NO: 78093 - RNA, 1485 nt, Artificial Sequence
  derived and/or modified sequence opt5 from ZFP36L2__Homo_sapiens__NP_008818
augagcaccacacugcucuccgccuucuacgacguggauuuucugugcaagacggagaaaucucuugcuaaccugaaucucaacaauaugcuggacaagaaagccgucggcacccccguugcggcugccccuagcuccggguucgccccgggauuucuuagacggcacucugcuagcaaccugcaugcccucgcucaccccgccccuucccccggcucuuguagcccuaaguuccccggggcggccaauggauccagcugcggcucugcugccgcugggggaccuacauccuauggcacccugaaagaaccgagcggcgggggaggcacagcccugcucaacaaggagaauaaguuucgcgauagaucuuucuccgaaaacggggaccggagccagcaucugcuucaucugcaacagcagcagaaaggaggcgggggaucucaaaucaauuccacccgcuacaagacagagcucuguagacccuuugaagagagcgggaccugcaaauauggcgagaagugucaguucgcgcacggcuuucacgaacugcggucccuuacgcgccacccuaaauacaagaccgagcugugcagaacauuccauaccauuggauuuugucccuauggcccucggugccacuucauccauaacgccgaugaacgcagacccgcuccgucugggggagccagcggcgaccuccgggcuuuugggacacgcgaugcccugcaccugggauucccuagagagccccggccuaagcuccaccauucccugagcuucucuggcuuucccuccggccaccaucagcccccugggggacuugagagcccgcugcuccuggacucucccaccagccgcacgccucccccucccuccuguucuagcgccuccagcugcuccuccagcgcuucuuccuguagcuccgcgucugccgcuagcacaccguccggcgccccuaccugcugcgccucugcugccgcggcugccgccgcugcccuucuguacgggacaggaggcgcugaagaucuccuggcccccggggcgccuugugccgcuugcagcuccgccagcugugcuaauaacgccuucgcguuuggccccgagcugucuucccucauuaccccucuggccauccagacccacaauuucgcugccguggcugccgccgcuuauuacagaagccaacagcagcagcaacagcagggacuugcgcccccggcccaaccucccgcucccccuucugccacacugccggccggcgcugccgcgcccccuucucccccuuuuagcuuccagcucccccggagacugucugacagcccuguguuugaugcucccccguccccucccgacagccuuucugaucgcgacuccuaccugagcgggucccucucuagcggaucccugucuggcagcgaauccccuucucuggaccccgggcggagacucccgauuuucagccgccuguccaucagcgaugacuga

SEQ ID NO: 78094 - RNA, 1938 nt, Artificial Sequence
  derived and/or modified sequence opt5 from ZFP37__Homo_sapiens__NP_001269444
augagcguguccucuggcguccagauccugaccaagcccgagacaguugacagacggcgcagcgccgaaacgaccaaagaggcugggagaccucucgaaauggccguguccgagccggaagcgucugcugccgugagcgucacauucaagcacgugaccauggccuuuacacaaaaagaguggaagcagcuggaucccgcucaguccaaccuuuacaaugacguuaugcuggagaacuauugcaaucaggccucuaugggaugucaagcuccuaaacccgauaugauuagcaagcucgaaaagggcgaggccccuuggcuggggaaaggaaagcggcccucccagggcugcccuagcaaaaucgcgcgcccgaagcagaaagaaaccgacgggaaggugcagaaggaugacgaucaacuugagaacauucagaaaucucagaauaagcugcucagagaggucgccgugaaaaagaaaacacaggcuaagaaaaacggauccgacuguggcagccugggcaagaagaauaaccugcauaaaaagcacguucccucuaaaaagcggcuccugaaauucgaauccugcgggaagauccuuaagcaaaaucuggaucucccugaccauagccgcaacugugugaaaagaaagucugaugccgcuaaagagcacaagaaauccuuuaaucauagccuguccgacacccggaagggaaagaaacagacgggcaagaaacacgaaaaacuuucuagccacuccagcucugauaaaugcaacaagaccgggaagaaacaugacaagcuguguugccacuccagcucucauauuaaacaggacaagauccaaacaggagagaaacacgaaaagagccccucccucucuagcuccaccaaacacgagaagccucaggccugugucaagcccuacgagugcaaucaguguggcaaagugcugagccauaagcaggggcugaucgaucaccaacgcgugcauacaggagaaaaaccguaugagugcaacgaaugcggcauugcguucucucagaagucccaccucgucguucaucagagaacccacacgggcgagaaaccuuacgaauguauccagugcgggaaggcccacggacauaagcacgcucugacagaccaucuucggauucacaccggcgagaaacccuaugagugugccgaaugcgggaagacauuucgccacagcucuaaucugauccaacaugugagaucccacaccggagagaaaccuuacgaauguaaggagugcggcaagagcuuccgguauaacuccucucucaccgaacaugugcgcacacacacgggggagauucccuacgaguguaacgaaugcggaaaggcuuuuaaguacagcuccucucugaccaaacauaugagaauccacacaggcgagaagcccuucgaauguaaugagugcggcaaagccuuuagcaagaaaucccaccuuauuauccaucagcggacccacacaaaggagaagccuuauaaauguaacgaaugcgggaaggccuucggacauucuagcucccugaccuaccacaugagaacgcauacaggcgagagcccguuugaaugcaaucagugugggaaaggauucaagcagaucgagggccucacccaacaccagcgcguccacaccggggaaaaacccuaugagugcaacgaguguggcaaggcuuuuucucagaaaucccaucugauugugcaccagcggacacauaccggagaaaagccuuacgagugcaaugaaugugagaaggcguucaacgccaaaagccaacugguuauccaccagagaucucacacaggcgaaaagcccuaugagugcaaugagugugggaaaacguucaagcagaacgcuagccucaccaaacaugugaagacacacuccgaagauaagagccaugaguga

SEQ ID NO: 78095 - RNA, 933 nt, Artificial Sequence
  derived and/or modified sequence opt5 from ZFP42__Homo_sapiens__NP_001291287
augagccagcaacugaagaaaagagccaagacccggcaccagaaaggccucgggggacgcgcucccuccggcgccaagccuagacaggggaaaucuagccaggaccugcaagcggagaucgaaccgguguccgcugucugggcccuuugcgauggauacguuuguuaugagcccggcccucaggcccuugggggagacgauuucucugacugcuacauugaaugugugauccggggcgaguuuagccagcccauucucgaagaggauucccuguucgagucucuugaauaucugaagaagggcagcgagcagcaacucucccagaaaguguuugaagcuagcucucuggagugcucccuggaguacaugaagaaaggggucaagaaagaacucccucagaagaucgugggagagaacagccuggaauauucugaguacaugacaggcaagaaacuucccccugggggcauuccgggaaucgaccuguccgaucccaagcagcucgccgaguucgcucgcaaaaagccucccaucaauaaagaauaugacagccugucugccauugcguguccucaauccgggugcacgagaaagcugcggaaccgcgccgcucugagaaaacaucuccugauccacggaccccgggaucauguuugugccgagugcggcaaggcuuuuguggaaagcuccaagcugaaacgccacuuccucguccauaccggcgagaagccguuuagauguacauucgaagggugcggaaaacgguuuucucuggacuucaaucuucgcacccacgugcggauucacacaggcgagaagagauuuguuuguccuuuccaggggugcaaccgcagauuuauccagagcaauaaccugaaagcccauauucucacccacgcgaauacaaacaagaaugaacaagagggaaaguga

SEQ ID NO: 78096 - RNA, 1395 nt, Artificial Sequence
  derived and/or modified sequence opt5 from ZFP57__Homo_sapiens__XP_006715150
augagcgagaccuucaagaaccugacauccguggccagaaucuuucuccacaaacccgaacugauuacgaaacuugagcaggaagaggaacaauggcgggaguucguccaucugccuaauaccgagggccucucugaagggaaaaagaaagagcugcgcgaacagcacccgagccuuagagacgagggaacauccgaugacaagguuuuucuggcuugccggggcgccgggcaguguccccucucugcgccugcuggaaccauggaucgcacaagagugcugcaggccagccaagccgggcccccuuucuuuugcuacaccuguggcaagugcuucucccggcgcucuuaucuguacagccaucaguuugugcacaaccccaaacucacaaauuccuguagccagugcggaaagcuguucagaucuccuaaaucccuuagcuaucaucggcgcaugcaccugggcgagagaccguuuuguugcacccucugugacaagacguacugcgaugcuucuggccugucccggcaccgcagaguccaucuuggguaucggccccacagcuguucugugugcggaaaauccuuccgcgaccagagcgaacugaagagacaucaaaagauccaccagaaccaggagccuguugauggcaaucaggaaugcacccuccggauucccgggacacaagccgaguuucagaccccuaucgcuagaucccagcgcucuauucaaggacugcuggacgugaaccacgcccccgucgcgcggagccaggaaccgaucuucagaacagagggcccuauggcccagaaucaggcuuccgugcucaaaaaccaagcccccguuacccgcacgcaggcuccuaucacagggacccugugucaggaugcccggagcaauucucaucccgugaagcccuccagacuuaacgucuuuugcuguccucacugcagccugacauucucuaaaaagagcuaccucucccgccaucagaaagcgcaccugaccgagccgcccaauuauuguuuccauugcucuaagagcuuuuccagcuucucucggcuugugagacaccaacagacccacuggaaacagaaguccuaccuguguccuauuugcgaccucagcuuuggagaaaaggagggccugauggaucauuggcgcggcuacaaagggaaggaccugugucagucuucccaccauaaaugccgggugauccucggacaauggcugggcuucagccacgauguccccacaauggccggggaagaguggaagcacggaggcgaccaguccccuccccgcauucauacgccgagacggagagggcuucgggaaaaggcuuguaagggagacaagaccaaagaggccguuucuauccugaagcacaaauga

SEQ ID NO: 78097 - RNA, 2046 nt, Artificial Sequence
  derived and/or modified sequence opt5 from ZFP64__Homo_sapiens__NP_060667
augaacgccagcuccgagggcgaaucuuucgcugggagcgugcagauccccggaggcaccacaguccugguugagcucacgccugacauucacaucugcgggauuuguaagcaacaguuuaauaaccuggaugccuucguggcgcauaaacaguccggaugccagcuuaccggcacaucugcugccgccccgagcaccgugcaauuugucuccgaagagacagugcccgcuacccagacacagaccacgaccagaacaaucaccucugaaacacagaccauuacgguuagcgccccugaguucguguuugagcacggguaccaaacauaucugcccaccgaauccaaugagaaccagacagcuaccgucaucagccucccugccaagucucggaccaaaaagcccacaacgccuccggcgcagaaacgccugaauuguugcuaccccggaugucaguucaagaccgccuauggcaugaaggacauggaaagacaucuuaaaauccacacaggcgauaagccucauaaaugcgaggugugugggaagugcuuuucccggaaagacaagcugaagacccacaugcgcugucacacaggaguuaaacccuacaagugcaaaaccugugauuaugcugccgcugacagcagcucccucaacaagcaucugagaauccacagcgaugagcggccuuucaaaugccaaaucugccccuacgccucucgcaauuccagccagcugacggugcaucucagaucccacacaggcgacgcgccguuucaguguuggcugugcucugccaaguucaaaauuagcuccgaucuuaagcggcacaugcgcguccauagcggggaaaagccuuuuaaaugugaguucugcaacgugagauguaccaugaagggaaaucugaaaucucacauccggauuaagcauuccggcaacaauuuuaaaugcccccacugugacuuccucggggauagcaaggcuacccugcgcaagcauucuagagugcaccaaagcgaacacccugagaaaugcuccgaauguucuuauagcugcuccagcaaggccgcccuucggauccaugagcgcauucacuguacagacagacccuucaaaugcaacuacugcucuuuugauaccaagcagcccuccaaucugagcaaacauaugaagaaguuccacggagacauggucaaaacagaggcccucgaacggaaggacacgggcagacagucuucccgccagguugccaaacuggaugcuaagaaaucuuuucacugugacaucugcgaugcguccuucaugcgggaggacucucugagaagccauaagcgccaacacuccgaauacucugagagcaagaacuccgaugugaccgugcuccaguuucagaucgacccuagcaaacagccggccacaccccugaccgucggccaucuucaagugccucugcagcccucucagguuccucaguucuccgaagggcgggugaagauuaucgucggacaccaagugccccaggcuaauacaauuguucaggccgccgcugccgcggugaacaucgucccgccugcucucguggcccagaaccccgaggagcugccuggcaauagcagacuucaaauucugcgccaggucucucucaucgcucccccucaguccagccggugucccucugaagcuggggccaugacccaaccggcugugcugcugacgacccaugagcagacagauggagccacccuccaccagacacugaucccuaccgcgagcggcgggccccaggaaggauccggcaaccaaacguuuauuacaagcucuggcauuaccugcacagacuucgaggggcuuaaugcccugauucaggaaggaaccgcugagguuaccguggucuccgauggcgggcagaacaucgccguggcuacaacggcgcccccuguuuuuagcuccucuagccagcaagagcucccgaaacagaccuauuccauuauccagggagccgcccaccccgcucugcuuuguccugccgacucuauccccgauuga

SEQ ID NO: 78098 - RNA, 1599 nt, Artificial Sequence
  derived and/or modified sequence opt5 from ZFP82__Homo_sapiens__NP_597723
auggcccugagaagcgugauguucuccgacgucucuaucgauuuuagccccgaggaaugggaguaccucgaccuggaacagaaggaucuuuaucgggacguuaugcuggagaacuacuccaaucucgugucucugggcugcuucauuagcaaaccugaugugaucuccucucuugaacaagggaaggagccguggaaagucgugcgcaagggaagacggcaguaucccgaccuggagaccaaauacgaaacaaagaagcucagccuggagaacgauauuuaugaaaucaaucugucccaguggaaaauuauggagcgcaucgagaaccacggccucaaggggcugauccuuaaaaaugacugggaaagcacgggaaagauugagggccaggaaagaccucaagagggguacuuuucuuccguuaaaaugcccagcgaaaaggugucuuccuaucagaagcggaccagcgucacaccucaucagcgccugcacuucguggauaaacccuacgaguguaaggagugcggaaaggcuuuuagaguucggcagcaacucaccuuccaucaccgcauccauacaggcgaaaaaccuuacgaguguaaagaaugcggcauggccuuuagacagaccgcgcaccugacacggcaccagcgccuucauucuggggagaagcuguaugaauguaaagagugcggagaggcuuucauuuguggcgccgaccucagagugcaccagaagaugcauaucggggaaaagccguacgagugcaaagaauguggaaaggccuuucggguccgcggccaacugacccugcaccagcggauucacacgggggagaaacccuaugugugcaaggaauguggaaaggcuuucagacaguacgcccaucucaccagacaccaaaaacugaacuccgcugaucgccuuuaugagugcaaggagugcggcaaagccuuucuguguggcagcgggcuccgggugcaucacaagcugcauacaggagaaaaaccuuacgagugcaaggaauguggcaaagcguucagaguccgccagcagcuuacccugcaccagcggauccacacaggggagaagcccuaugagugcaaggaauguggaaaaaccuuuuccagaggcuaccaucucauucugcaccaucgcauccacacgggggagaagccuuacgaaugcaaagaguguuggaaggccuucucucgguauagccaacugaucucccaccagagcauucauaucggaguuaaacccuacgacugcaaggaauguggcaaggcuuucagacuccugucucagcuuacacagcaccaauccauucauaucggcgagaaaccguauaagugcaaagagugugggaaggccuuucgccugcggcagaaacucacccugcaccagagcauucauacaggagaaaagccuuucgagugcaaagaaugcagaaaggcuuuucgccuuaauucuagccugauccagcaccuccggauccacuccggcgagaagcccuacgaauguaaagagugcaagaaagccuucagacaacauucucaccugacccaucaccugaagauucauaacgugaaaaucuga

SEQ ID NO: 78099 - RNA, 1713 nt, Artificial Sequence
  derived and/or modified sequence opt5 from ZFP91__Homo_sapiens__NP_444251
augcccggcgagaccgaagaaccuagaccgcccgaacagcaagaccaggagggaggagaagccgcuaaggccgcgccugaggagccccagcagcggccucccgaagcuguggccgccgcuccugccggcacaacgagcucccgcguccugagagggggacgggaucgcggcagagcugccgcggccgcugccgcugccgcgguuucucggcgcagaaaagccgaguacccgcggcgcagacggagcucccccucugcucgcccucccgacgugccugggcaacagccccaggccgcuaagagcccguccccugugcaggggaaaaagucucccagacuccugugcaucgaaaaagucaccacagauaaggacccuaaggaggagaaagaagaggaagaugacagcgcccuuccccaagagguguccauugccgcuagccggcccucucgcggcuggagauccagccggaccucuguuuccagacaccgcgauacagaaaauacccggagcucuagauccaagacaggcagccugcagcucaucuguaaauccgagccuaauaccgaccagcuggauuaugacgugggggaggaacaucagucuccgggaggcauuagcuccgaggaagaggaagaggaggaagaggaaaugcuuaucagcgaggaagagauucccuucaaggaugacccucgcgaugagacguacaaaccccaccuggaacgggagaccccuaagcccagacgcaagucugggaaagucaaggaagagaaagagaagaaagaaaucaagguggagguugaaguggaggucaaagaagaggagaacgaaauccgggaggacgaggagccgccuagaaagcgcggacggagacgcaaggacgauaaaagcccccggcucccuaagagacggaaaaagcccccuauucaauaugugcgcugcgaaauggagggcugugggacagugcuggcgcaucccagauaccugcagcaccauaucaaauaucagcaccuccugaagaagaaauacgucugcccgcacccuuccuguggacggcuuuuuagacugcaaaagcagcuccugcgccaugccaaacaccauaccgaccagcgggauuauauuugcgaguacugugcuagagccuucaagucuagccacaaucuugccguucaccgcaugauccauacaggcgaaaaaccccugcagugcgagauuuguggcuuuaccugcagacaaaaggcuucccucaacuggcacaugaagaaacaugacgccgauucuuucuaccaguuuagcuguaauaucugcgggaagaaauucgaaaagaaagacuccgugguggcgcacaaggcuaagagccaucccgagguccugauugccgaagcccuggcugccaacgcuggagcccucaucacgucuacagauauccugggcaccaauccugagucccuuacacagccgagcgacgggcagggacugccccuccugccugagccccuuggcaacucuaccuccggggaaugccugcuccuggaggcggaaggaaugagcaaauccuauuguucuggcaccgagcgggugagccugauggccgauggcaagauuuuuguuggguccggaucuagcggcgggacagagggacucgugaugaacuccgacauccugggcgcuacgaccgaaguccuuauugaggauagcgacucugccgggccuuga

SEQ ID NO: 78100 - RNA, 3021 nt, Artificial Sequence
  derived and/or modified sequence opt5 from ZFPM1__Homo_sapiens__NP_722520
augagcagacggaagcaguccaacccccgccaaaucaaaagaucucugggcgacauggaggcccgggaagaggugcagcucgucggggcuagccacauggaacagaaggccaccgcgccugaggcuccgucucccccuuccgccgauguuaauagcccgccuccccugccuccgcccacauccccuggaggccccaaagaacuugaggggcaggagccugaaccccgcccgacggaggaggaaccuggaucucccuggagcggcccugacgagcuggaacccguggugcaagaugggcagagacggauucgcgccagacucucccuggcuaccggacuuagcuggggccccuuccauggcucuguccagacacgggccuccagcccucgccaggcugagccgucucccgcccugacccuccugcugguggacgaagcgugcuggcucagaacacugccucaagcccuuaccgaggcugaagccaacacagagauccaccggaaggaugacgcucuguggugucgcguuaccaaacccgugccugccgggggacuccuguccguccuucugacggcggagccccauagcaccccgggccacccugugaagaaggaacccgccgagccuacaugccccgcuccugcccaugaucuccagcugcugccccagcaggcugggauggccucuauucucgccaccgcuguuaucaauaaagacguguuuccguguaaggauugcggaauuugguacagauccgaacggaaccugcaagcgcaccuucuguauuacugugccagccgccagggcacaggguccccugcugccgccgcuaccgacgagaaacccaaggaaacguaucccaaugagagagucugcccuuucccgcagugucggaaaucuugccccagcgccuccagccucgagauccacaugagaucucauuccggagaacgcccuuuugugugucugaucugccuuagcgcguucacaaccaaggcuaacugugagcggcaccugaaggugcauacagauacccucucuggcgucugccacagcugcggcuuuauuuccaccacaagagacauccuguacucucaccugguuacgaaucauauggugugucaacccgggagcaaaggagaaauuuauuccccuggcgccgggcaccccgccaccaagcucccucccgauagccugggaucuuuccagcagcagcauacagcccuucaaggcccgcuggccuccgcugaccucgggcuggccccuacccccagcccuggacuugaccgcaaagcgcuggccgaggcuacaaacggcgaagcccgggcugagccccucgcccagaauggcgggucuuccgagccgccugcggcccccagaagcaucaagguggaagcugucgaggaaccugaggccgcucccauucugggacccggcgagccugggccgcaggcccccucccgcaccccuucuccccggagcccugcccccgcuagagugaaagcggaacuguccucuccuacgccgggaagcucccccguuccuggcgagcucgggcuggccggcgcucuuuuucugccccaguacguguucggaccugaugccgccccucccgcuagcgaaauccucgccaagaugucugagcugguccacucccgccugcaacagggcgcgggggcuggagccggcggggcccagacaggacuuuuucccggcgcucccaaaggggcuaccugcuucgaaugugagauuaccuuuagcaacgugaauaacuauuacguucauaagcggcucuacugcucuggcagacgcgcgcccgaggacgcuccugccgcccggagacccaaggcuccuccgggacccgcccgggcuccucccggccagccugccgaacccgaugcgccgcgcuccagcccugggcccggagccagagaggaaggcgcugggggagccgcuacaccugaggacggcgccgggggccggggaucugaaggcagccaaucccccgggagcucuguggaugacgccgaggaugacccuuccagaacccugugugaggcuugcaauauccgcuucagccggcacgaaacauauacgguccacaaaagauacuauugugcgucccgccaugaucccccgccuagacggcccgccgcucccccuggaccgcccggcccugccgcucccccugcccccucuccugccgcgccggugcgcaccagacggcgcagaaagcuguacgagcuccacgcugccggggcucccccucccccucccccgggacaugccccugcccccgaaagcccccggccuggcuccgggucuggcagcggacccggccuggcgccugcucgcuccccggggcccgccgccgacggaccuaucgaucuuucuaaaaagcccagacggccucugcccggcgcuccggccccugcucucgccgacuaucacgagugcacagcgugucgcgucagcuuucacucccuggaagccuaccuggcucauaaaaaguauagcugccccgccgcuccucccccuggggcccuuggacuccccgccgcugcguguccguacugcccucccaacggccccgugagaggcgaccugcuggagcacuuccggcucgcccaugggcugcuucugggagcuccucucgccggcccggggguugaggccagaacccccgcugaucgcggaccuucucccgccccugcgcccgcugccuccccucagcccggcagccgggggccgagagacggacugggcccugaaccccaggagccucccccgggcccuccucccucucccgccgcugcccccgaagcggugccuccgcccccugcucccccuuccuacagcgauaaggggguccagacacccucuaaaggaaccccugccccgcugcccaauggcaaccaccgcuauugccggcuuuguaacauuaaguucuccagccucuccacguuuaucgcccauaaaaaguacuauugcagcucucacgcugccgagcacgugaaauga

SEQ ID NO: 78101 - RNA, 3456 nt, Artificial Sequence
  derived and/or modified sequence opt5 from ZFPM2__Homo_sapiens__NP_036214
augagcagacggaagcaguccaaaccccgccaaaucaagagaccucuggaggacgccauugaagaugaggaagaggaaugcccgucugaggagaccgacaucauuagcaaaggcgauuucccccucgaagaguccuuuucuacagaguucgggccugaaaaccugagcugugaggaaguggaguacuuuugcaauaagggagacgaugaaggcauccaggagacggcugaauccgacggggauacccagucugagaaacccggacagccuggcgucgagacagacgauugggacgggcccggagaacuugagguuuuccaaaaggauggcgaacggaagauucagagccgccagcagcugccugugggcaccacaugggggccguuucccggaaaaauggaccucaacaauaacucccugaagaccaaagcccaagugccuaugguccuuacagcgggccccaaguggcugcucgaugugaccuggcaggggguugaggacaauaaaaacaauuguaucguguauagcaagggaggccagcuguggugcacgaccacaaaggcuaucucugaaggggaggagcugauugccuucgucguggacuuugauuccagacuccaggccgcuagccaaaugacccugacagaaggaauguacccugcccggcuucuggacucuauccagcuccugccccagcaagcugccauggcguccauucuuccgaccgccaucguuaacaaagauauuuucccuuguaagagcugcggcaucugguaucgcucugagagaaaucugcaggcucaccucauguacuauuguuccggccggcagcgcgaagccgcucccgugagcgaggaaaacgaggacuccgcccaucagauuucuagccugugcccuuuuccccaauguacgaaauccuucagcaaugcgagagcccuggagaugcaccucaacucucauuccggggucaagauggaagaguuucugcccccuggagcuagccuuaaaugcacaguguguucuuacaccgccgauagcgugaucaauuuccaccagcaucuguuuucccaccucacacaggcugccuuccggugcaaccacugccauuucggcuuucagacccaacgcgaacugcuucagcaccaggagcugcaugucccgucugggaagcuccccagagagagcgacauggaacacuccccuagcgccaccgaggauucucugcagcccgcuacagaccugcucacgcgguccgaacugccucaaagccagaaagcgaugcagaccaaggaugccucuuccgacacagagcuugauaagugugagaaaaagacccagcuguuccucacaaaucaacgccccgaaauccagccgaccacgaacaaacagagcuuuuccuauacaaagauuaaaucugagccuagcucccccagacuggcuucuagcccuguucaacccaacaucggaccuuccuuccccgugggcccguuucuuagccaguucucuuuuccucaggacauuaccauggugccccaggccuccgaaauccuggccaagaugagcgagcucguccaccggagacugcgccaugggucuuccagcuaucccccugugauuuacucuccgcugaugcccaagggagcuaccugcuucgaauguaauaucacauuuaacaaucucgacaacuaccugguucacaaaaagcauuacugcagcucccgguggcaacagauggccaaaagcccugaguuccccucuguguccgaaaagaugccugaggcgcuuagccccaauaccggccagacauccaucaaccugcucaauccugcugcccacucugccgaucccgagaacccgcugcugcagacgagcuguauuaauuccucuaccguccuugaccucaucggcccuaacgggaaaggacaugauaaggacuuuagcacacaaaccaagaaacuguccacaucuagcaauaacgaugacaagauuaauggcaaacccguggauguuaagaacccuuccgugccccuggucgacggggaaagcgauccgaauaaaaccacgugcgaggcuuguaacaucaccuucucuagacacgaaacauauauggugcacaagcaguacuauugcgccacccgccaugacccuccccucaagcgguccgcuagcaacaaagucccugccaugcagagaacaaugcgcacccggaagagacgcaaaauguacgagaugugucugcccgaacaggagcaacggcccccucuugugcagcagagauuucuggauguugcgaaucucaacaauccgugcacgucuacacaagagcccaccgaaggacugggcgaguguuaucacccucgcugcgacauuuuccccgggaucguguccaagcaucuggaaacaagccuuaccaucaacaaaugcgucccugugucuaagugugauaccacacacuccagcguuuccugccucgagauggacgugcccauugaccugagcaaaaagugucugucucagagcgagcggacgaccacauccccuaagagacuccuggauuaccacgaaugcaccgucuguaaaaucucuuucaauaagguggagaacuaccuugcccauaaacagaauuuuugcccggugacagcucaccagcggaacgaccugggccaacucgauggaaagguuuuccccaauccugaaagcgagcgcaacucccccgacgucucuuaugaaagaagcauuaucaaaugugagaagaauggcaaccugaagcagccuucccccaaugggaaccuguuuucuagccaucuugccacccuccagggacugaaaguguucuccgaggcugcccagcugauugcgacgaaggaagagaaucggcaccucuuucugccgcaaugccuuuacccuggcgccaucaaaaaggcuaaaggggccgaucagcugagccccuauuacggaauuaagcccucugacuauaucuccggcagccucgugauccauaacacagauauugaacagucuagaaacgcugagaaugaauccccuaaggggcaggccagcuccaacggcugugccgcucugaaaaaggacucucugccccuucucccuaaaaaucgcggaauggucaucgugaacggcgggcugaagcaagaugagcggccggcggccaauccccagcaggagaacauuagccagaauccucaacacgaagacgaucacaaaucccccagcuggaucucugagaacccucuggcugccaaugaaaacguuucccccggcauuccgagcgccgaggaacagcucucuagcaucgcuaagggagugaauggguccucucaggccccuaccagcggaaaguacugcagacugugugacauccaauucaacaaucuuuccaacuuuauuacccauaaaaaguucuauugcucuagccacgcggcugagcaugucaaauga

SEQ ID NO: 78102 - RNA, 213 nt, Artificial Sequence
  derived and/or modified sequence opt5 from ZFR2__Homo_sapiens__NP_001139112
auggccaccagccaguacuucgacuuugcucaaggcgggggaccccaguauuccccugagguggaaacaacgccgcccgcccuggcgucuggccucccuugcgcucugcccuggaccgucggguguagcggauccgaugccguuacagcccuuugcccuucucugagaggccucgcuuguaucugcagcauucugugggaccccgccugguga

SEQ ID NO: 78103 - RNA, 3225 nt, Artificial Sequence
  derived and/or modified sequence opt5 from ZFR__Homo_sapiens__NP_057191
augauccccauuugcccuguggucagcuucaccuacguuccguccagacugggcgaggacgccaagauggcuacagggaacuauuuuggauucacgcacucuggcgccgcggcugccgccgcugccgcucaguacagccaacagcccgccuccgggguggcguauucucauccuaccacaguggccagcuacaccguccaccaggcucccguggccgcucauacaguuaccgccgcguaugccccugcugccgcuacaguggccgucgcccggcccgcuccuguggcgguugccgcugccgccaccgcugccgcguacggaggcuauccgacggcucacaccgccacagauuacggguacacccagcgccaacaggaagcucccccucccccucccccggcuacaacccagaauuaucaggacuccuacucuuaugugagaagcacggccccugcugucgccuacgauuccaaacaauauuaccagcagcccacagcgaccgccgcugccguggcugccgcggcccagccucaacccagcguggcugagacauauuaccagaccgcccccaaggcuggauacucucagggcgccacccaauauacacaggcccagcagacgcggcaagucaccgcuaucaaaccugcgacaccgucccccgccaccacaaccuuuagcauuuacccuguuucuuccacggugcagcccguggcugccgccgcuacagucgugccuagcuauacccagucugccaccuacuccacaaccgcgguuacauauagcggcacguccuacucuggguaugaagcugccguguacagcgccgcuuccagcuacuaucagcaacagcagcagcaacagaagcaggccgcggcugccgccgcugccgcugccgcgaccgccgcuuggacaggaaccacauucaccaaaaaggcccccuuucagaacaagcaacucaaaccgaagcagccucccaaaccuccccagauccauuacugugacgucugcaagauuucuugugcuggcccucaaacguauaaagagcaccuggaagggcagaagcacaagaaaaaggaggccgcccuuaaagccucccagaauaccagcucuagcaacuccucuacacgcggaacccagaaucaacugagaugcgagcucugugaugugagcugcacaggcgcggacgccuacgcugcccauauccgcggggccaagcaccagaaaguugugaagcugcauaccaaacuuggaaagcccaucccguccacggaaccuaacgucgugagccaggcuacaucuuccaccgccgucagcgcgucuaagcccacagcuucccccagcuccauugccgccaauaacuguaccgugaauaccucuagcguugcuacauccucuaugaaaggccugacgaccacaggcaacagcucccucaauagcaccucuaacacaaagguguccgccgucccuaccaauauggcggcuaaaaagacgagcacaccgaaaaucaacuucguugggggaaauaagcugcagucuaccggcaacaaggccgaggauauuaaagggaccgaaugcgugaaguccacacccgugaccagcgccguccaaaucccugaggugaaacaggacacagugucugagcccguuacgccugcuagccuggccgcucuccaguccgauguccagcccgugggacacgacuauguggaagagguccggaacgaugaaggcaaggugauuagauuucacuguaaacugugcgaguguagcuucaaugacccuaacgccaaggaaaugcaucuuaaggggcggcgccacagacugcaauacaaaaagaaaguuaaucccgaucuccagguggaggucaagccgucuauccgggcgcgcaaaauucaggaggaaaagaugagaaagcaaaugcagaaagaggaauauuggcggcgcagagaggaagaggagcgguggagaauggaaaugcgccgguacgaggaagacauguacuggagacgcauggaggaggagcagcaucacugggacgaucggagacgcaugccugacggaggcuauccccauggcccucccgggccgcugggacuucugggcgugcggccugggaugcccccucagccccaaggacccgccccucucagacgcccggauuccagcgacgaucgguacguuaugaccaagcacgcuacaaucuaucccaccgaggaggaacugcaggccgugcagaaaaucgucuccauuacagaaagagcucugaagcucgugucugacagccuguccgagcacgagaaaaacaagaauaaagaaggcgaugacaagaaggaagggggcaaagaucgcgcccuuaagggaguucugcgggugggcguccucgccaaagggcugcuucugagaggagaccggaacgugaaucucgugcugcugugcucugaaaagccuagcaaaacccuccugucccgcaucgcugagaaccuucccaagcagcuggcggucauuucuccugaaaaguacgauaucaaaugcgccguuagcgaggcugccauuauccucaauuccuguguggagcccaagaugcaagugacgaucacccugacaagcccuauuaucagagaagagaacaugcgggaaggcgacgucaccucugggauggugaaagacccgcccgauguucuugacagacagaagugccuggaugcccucgcugcccugcgccaugcgaaaugguuucaggcucgggccaauggacugcaguccugugugauuaucauuagaauccuccgcgaccugugccaaagagucccuacauggagcgauuuccccucuugggccauggagcuucugguggaaaaggcuaucuccagcgccucuuccccucagagccccggcgacgcgcuccggcgcguuuuugaguguauuuccagcgggaucauucugaagggcucuccgggacugcuugauccuugcgagaaagaccccuucgauacccucgccacaaugaccgaccagcagagagaagauaucacgagcuccgcucaauuugcccugcggcugcucgcuuuccgccagauucacaaggugcugggcauggacccccuuccucagaugucucaaagauucaacauccauaauaaccggaaacgcagacgggauagcgacggggucgacggauuugaggccgaaggcaagaaagauaagaaggacuaugauaauuucuga

SEQ ID NO: 78104 - RNA, 1731 nt, Artificial Sequence
  derived and/or modified sequence opt5 from ZFX__Homo_sapiens__NP_001171557
augaccauggacacagagagcgaaaucgaucccugcaagguggacggcacguguccugaggucauuaaaguuuacaucuucaaggccgauccgggggaagacgaucugggaggcaccguggacauuguggaguccgaacccgagaacgaucacggggucgagcuccuggaccaaaauucuagcaucagagugccucgggagaaaaugguuuauaugacagugaacgauucccagcccgaagacgaagaucuuaaugucgcugagauugccgacgagguguacauggaaguuaucgugggagaggaagaugcggcugccgccgcugccgcugccgcgguccaugagcagcagauggacgacaacgaaaucaagaccuuuaugccuauugccugggcugccgcuuauggcaauaacucugaugggaucgagaaucgcaacggaacagccagcgcgcugcuccacauugacgaguccgccggccugggcagacuugcuaaacagaagcccaagaaacggcgcagaccugauucucggcaauaccagaccgccaucauuaucgggccggacggacauccccugacaguguauccuugcaugauuuguggcaagaaauucaagagccgcggguuucucaaaagacacaugaagaaucaucccgaacaccuggcuaagaaaaaguaccggugcaccgauugugacuauacgaccaacaaaaagaucucccugcacaaucaucucgagagccacaaacugacaucuaaggccgaaaaagccaucgagugcgaugaauguggaaagcauuucucccacgcuggcgcgcuuuuuacccacaagauggugcauaaagagaagggggccaacaaaaugcacaagugcaaauucugugaguacgaaacagcugagcagggacugcucaaucgccaucugcuugccguccacagcaagaacuuuccucauauuugcguugaauguggcaagggcuucagacaccccucugagcugaaaaagcacaugcggauccauaccggggaaaaaccguaccagugccaauauugcgaguaccgcuccgccgacagcucuaaucucaagacgcacgugaaaacaaagcauuccaaggagaugccuuuuaaaugugauauuugccugcugaccuucagcgacacaaaggaagugcagcagcacgcucucauccaccaggaguccaaaacccaucaaugucugcacugcgaucauaagucuagcaacuccagcgaccuuaaaagacacauuaucucuguccauaccaaggacuauccccacaagugugauaugugcgacaaaggauuucaccggccuuccgaacugaagaaacauguggccgcgcacaagggcaaaaagaugcaucagugucgccacugcgauuucaaaaucgcugaccccuuuguucucagcagacauauucugucugugcacacaaaggaucuucccuuccgguguaagagaugccgcaaaggguuccggcagcaaagcgagcugaagaaacacaugaagacgcauuccggaagaaaagucuaccagugugaguauugcgaauacucuaccacagacgccagcggcuuuaagcgccacgugaucuccauucauaccaaggauuauccucaccggugcgaguacuguaaaaagggguucagacgcccgagcgagaaaaaccagcacaucaugcggcaucacaaggaaguuggacuccccuga

SEQ ID NO: 78105 - RNA, 2175 nt, Artificial Sequence
  derived and/or modified sequence opt5 from ZFY__Homo_sapiens__NP_001138747
auggacggcgaucagaucguggucgagauucaagaagccguuuucgugagcaacaucguggacuccgauauuaccguccacaauuuugugcccgacgauccugacucuguugugauccaggaugucguggaggacguugugauugaagaggauguccagugcagcgacauccuggaagaggcugauguguccgagaacgugaucauuccggaacagguccucgacucugauguuacagaggaagugagccugccccauuguacggugccugacgacguccuugccuccgauaucaccucuacaagcauguccaugcccgagcacgugcugaccagcgagucuaugcauguuugcgacauugggcacguggaacauaugguccacgauuccgugguugaggcggaaaucauuacagacccucucaccagcgauaucgugucugaggaaguccugguggcugacugugcccccgaggccgucauugaugcuuccggaaucagcguggaccaacaggauaaugacaaggccucuugcgaggauuaccuuaugaucucccuggacgacgcuggcaaaauugaacacgaugggagcacaggaguuaccaucgacgccgaguccgaaauggauccuuguaagguggacucuacgugcccggaggucauuaaaguguauaucuucaaggcggaucccggcgaagacgaucucgggggaaccguugacauuguggagagcgagccugaaaacgaucauggcgucgagcugcuggaccaaaauuccagcaucagagugccccgggagaaaaugguguacaugacaguuaacgauucucagcaggaagacgaagaucucuccaauaacagcgacggcaucgagaaucgcaacgggaccgccucugcucugcuucacauugacgagagcgccggacugggcagacucgcuaagcagaagccuaaaaagaaacggcgccccgauuccagacaguaucagacagccaucauuaucgggccggacggacauccucugaccgucuaccccuguaugauuugcggcaagaaauuuaagucucggggguuccuuaagcgccacaugaaaaaucacccugaacaucuggcgaagaaaaaguaucacuguacggauugcgacuacacaaccaacaaaaagaucagccuccauaaucaccuggagucccauaaacugacaagcaaggccgaaaaggcuaucgagugugaugagugcggaaaacacuuuucucacgccggcgcucucuucacccauaagauggugcacaaagaaaagggcgccaacaaaaugcauaagugcaaguuuugugaguaugaaaccgccgagcaagggcugcuuaauagacaucugcucgcugugcacuccaaaaacuucccccacauuugcgucgaauguggaaagggcuuucggcaccccagcgagcugcgcaaacauaugagaauccacacaggggagaagccuuaccagugccaguacugugaauaucggucugcggacuccagcaaccuuaaaacgcauauuaagaccaagcacuccaaagagaugccguucaagugcgauaucugucugcucacauuuucugacaccaaagaagugcaacagcacacacugguucaucaggagagcaagacccaccagugccugcauugugaucacaaauccucuaauagcuccgaccucaagcgccaugugauuagcguccacacgaaggauuacccccacaaaugcgaaaugugugagaagggauuccauagaccuucugagcugaaaaagcacguggccguucauaaaggcaagaaaaugcaccaaugccggcacugcgacuuuaagaucgcugaucccuucgugcuuucccgccauauucugagcguccacacaaaggaccucccuuucagauguaaacggugcagaaagggguuucgccagcagaacgaacugaaaaagcauaugaaaacccacucuggacggaagguguaucagugugaguacugcgaauauuccaccacagacgccagcggcuucaagagacauguuaucucuauccacaccaaagauuacccccaccgcugugaguauugcaagaaaggcuuucggagaccgagcgaaaagaaucaacauauuaugcgccaccauaaagagguggggcuuccuuga

SEQ ID NO: 78106 - RNA, 1416 nt, Artificial Sequence
  derived and/or modified sequence opt5 from ZFYVE19__Homo_sapiens__NP_001070736
augaacuacgacagccagcaacccccucugccgccccucccuuaugccggcugcagacgggcuuccggguuccccgcccugggacgcggcgggaccgugccugucggaguuuggggcggggcgggacagggcagagagggccggucuuggggagaagggccccgcggcccugggcuuggaagacgggaucugagcuccgcugacccggccgugcucggcgccacaauggagucucgcuguuacgggugcgcugugaaguuuacgcuguucaaaaaggaauauggauguaaaaauugcggcagagccuuuuguagcggcugccuuuccuucucugcugccgucccccggaccgggaacacacagcagaagguguguaaacaaugccacgagguucugacccgcggaagcuccgcgaaugccagcaaguggucuccuccccagaacuacaagaaaagaguggcugcccucgaagcuaagcagaaaccuuccacaagccagucucaaggccugacccggcaggaucagaugaucgccgagcgccuggcgagacuccggcaggagaauaagcccaaacuggucccgucccaagccgaaauugaggcucgccuugccgcucugaaggacgaaagacaggggagcaucccuucuacacaggagauggaggcccggcucgccgcucugcaaggaagagugcuucccucccagaccccucagcccgcgcaucacacgcccgauacccgcacacaggcccaacagacccaggaccugcucacacagcuggcugccgaaguugccauugaugagagcuggaagggcgggggaccugcugccucccugcaaaacgaccucaaucagggcggcccggggucuaccaacagcaaacggcaggcgaauuggucccuggaagaggaaaagagcagacuucuggcugaggccgcccucgagcugcgcgaagagaacacgcggcaggaaagaauccuugcucuggccaaacgccucgcuaugcugcggggacaagaucccgagagagugacacugcaggacuaucgccucccugauucugacgaugacgaagacgaggagaccgccauucagcggguccugcagcaacuuacagaagaggcgucccuggaugaagccagcggcuuuaauauccccgcugagcaggccucuagaccuuggacccagccccgcggggcugaaccggaggcccaagacguggauccucggcccgaggcggaagaggaggaacucccuugguguugcaucuguaacgaggacgccacccugagaugcgcuggaugcgauggcgaccuuuucugugcccggugcuuucgcgaagggcaugaugcuuucgagcugaaggaacaccagacaagcgccuacuccccucccagagccggccaggagcauuga

SEQ ID NO: 78107 - RNA, 759 nt, Artificial Sequence
  derived and/or modified sequence opt5 from ZFYVE21__Homo_sapiens__NP_001185882
augagcuccgaggugucugccagacgggacgcuaagaaacugguccgcagccccuccggccucagaaugguuccugaacaccgggccuucgggucuccguuuggacuggaggaaccccagugggugccugauaaggagugccgcagauguaugcaaugcgacgcgaaauucgauuuucuuacccggaagcaucacugucgcagaugcggcaaauguuucugcgaccgguguugcagccagaaggugccccugcgcagaauguguuuugucgauccugugcggcagugcgcugaaugugcccucguuucccugaaggaggccgaguucuacgacaaacagcuuaaggugcugcucucuggggcuacauuucuggucacguucggaaacagcgaaaaacccgagaccaugacaugccgccuguccaauaaccaaagauaucucuuucuggauggcgacagccauuacgaaaucgagauugugcacaucucuaccguucagauucuuacagagggguucccuccgggagaaaaggauauccaugccuauaccucccugcggggcagccagcccgcuucugagggcgggaaugcccgcgcgacaggaauguuucuccaguacaccgugccuggcacggaaggggucacccaacugaaacuuacagugguggaggacgucaccguuggaagacggcaggccguggcuuggcugguggccaugcacaaggcugccaagcuccuguaugaauccagagaucaguga

SEQ ID NO: 78108 - RNA, 7620 nt, Artificial Sequence
  derived and/or modified sequence opt5 from ZFYVE26__Homo_sapiens__NP_056161
augaaccaccccuucggcaaggaggaagcugcuagccagaagcagcuguuuggguucuuuugcgagugucucagacggggagaaugggagcuggcucaggcgugcgugccucagcuucaggaaggccaaggggacaucccgaagagagucgaggauauucugcaggcucucguugugugucccaaucugcuuagaugcggacaggacaucaacccucagcggguggccugggucuggcugcucgugcuggagaaauggcuggcccgcgaaaagaaacuccugcccguuguguucagacggaaacuugaguuucugcuccuguccgaagaucuucaaggcgacauuccugagaauauccuggaggaacucuacgagacccugacacagggggcugucggacacgugcccgauggcaacccucgcagagaaucuuggacgccgcggcugagcuccgaggccguuucugugcucugggaccugcuucgccagagcccccagccugcucaagcccugcucgaacugcuucuggaggaggaugacggcaccgggcucugucacuggccccugcagaaugcgcuggucgaucucauuagaaaggcccugcgggcccuucagggaccugacuccgugcccccgggcguggucgaugccaucuauggggcucugcgcacccucagaugcccugccgaaccccugggaguugagcuucaucugcucugugaagaacugcuggaagcgugccggaccgagggcucuccucuccgcgaggaaagacugcuuagcugucugcuccacaaagccucccgggggcugcugagccuuuacggacauacauaugcugagaaggugaccgaaaaaccgcccagagccacagcuucuggcaagguguccccugaccaccucgauccggagcgcgccaugcuggcccuguucagcaaccccaauccugcugaagcguggaaagucgccuacuuuuauugccucucuaacaauaagcacuuccuggagcaaauccuugugaccgcucugacgcuccugaaggaggaagacuuucccaaccugggcugucuucucgaccgggaguucagaccucuguccugccugcucguucugcuuggguggacccauugccagagccuggaaucugccaaacgccuccugcagacacugcaccggacccagggacccggcugugaugagcuucucagagacgccugcgaugggcugugggcucaucuggaggugcucgaaugguguauucaacaguccagcaauccgaucccuaagcgcgaccugcuuuaccaucugcacggaggcgauucccauucuguccucuauacacugcaccaucugaccaaccuucccgcccuccgggaggaagacgugcugaaacugcuccagaagguuccugcgaaagauccccagcaagagccugacgcuguggaugcccccgucccggaacaccugagccagugccagaaucuuacgcuguaccagggguuuugugccaugaaguacgcuauuuaugcccucugcgugaacucccaucaacacagccagugucaggacugcaaagauucucuguccgaggaccuggcuagcgccacagagccugcgaaugacucucuuagcucccccggagccgcuaaccuguucucuaccuaccucgccagaugucagcaauaucugugcagcauccccgauucccucugucuggaacuucuggagaacauuuuuagccuccugcugaucacaucugcugaccuucacccugaaccgcaucugcccgaggauuacgccgaagacgaugacauugagggcaaguccccuagcggccuccgcucucccuccgagagcccucagcacaucgcgcaucccgaacggaaguccgagagagggucucugggagucccuaaaacccucgccuauaccaugcccagccacgugaaggcugaaccgaaagauuccuacccuggcccccaccgccauucuuuccuggaccuuaagcacuucacaagcgggaucuccggauuucuggccgaugaguucgcuauuggcgccuuucuccggcugcugcaggaacaacuugacgagaucagcucuagauccccucccgagaaaccgaagcaggaaagccagucuugcuccgggagccgggauggccugcagucucgccuccauagacugagcaagguuguguccgaggcccaauggcggcacaaagucgugacgagcaaucauagaucugaggaacagccuucccgccgguaucagcccgcuaccagacacccuagccuccgcagaggacggcgcacaagacggucccaggcggacggccgcgauagagggucuaaccccagccuggaguccaccucuagcgaacuuuccacaucuaccagcgagggaucccugagcgccaugucuggccggaaugaacugcacucccgccuccauccccacccucaaagcucucugauuccgaugauguucucucccccugagagccuucuggcuagcugcauccucagagggaacuuugccgaagcccaucagguucuguucacguuuaaucucaaguccagccccuccagcggagagcugauguucauggagcgguaccaggaagugauucaggagcuugcucaagucgaacacaaaaucgagaaccaaaauucugacgccggcagcuccacaauccgcagaaccgggucuggccggagcacccugcaggcgauuggauccgcugccgccgcuggcaugguguuuuacucuaucagcgacgugacagauaagcugcucaacaccuccggggacccuauucccaugcugcaagaagauuucuggaucucuacagcccuuguugagccuacggcgccgcugagagagguccucgaagaccugagcccucccgcuauggccgccuuugaucucgcuuguucccagugccagcuguggaaaaccuguaagcagcuucuggagacagccgaacgccggcugaauagcucucucgagagacgcggacggagaauugaccaugugcugcuuaacgcugauggcauccgcggguuccccgugguccugcaacagaucuccaagagccucaauuaucugcucaugucugccucccagaccaaaagcgaauccguggaggagaagggaggcgggccuccccggugcucuauuacagaacugcuucagauguguuggccgagccuguccgaggacugcguugcgagccacaccacgcugucucaacagcucgaucaggugcugcagucccuuagagaagcccuggagcucccugagccccgcacacccccucugagcucucuggucgaacaagcugcccagaaagcucccgaggccgaagcccacccugugcagauccagacacaacuccuucagaagaaccugggcaaacagaccccgagcggaucccggcaaauggacuaccugggcacauuuuucucuuauuguagcacccucgcugcgguucugcuucagucccugucuagcgagcccgaucauguggaagucaagguggggaauccuuucguucuccugcagcaguccagcucucaacuggugucccaccuccuuuuugagagacaggugcccccugagcggcuggccgcucugcucgcccaggaaaaccugagccuuuccgugccccaggugauugucucuugcuguugcgagccgcuggcccucuguagcucccgccaaucucagcagacgagcucccugcugacaagacucggaacccuugcucagcugcaugccagccacugccuggacgaucucccucugucuacacccuccagcccucggaccaccgaaaaucccacacuugagcgcaagccuuacucuucccccagagacagcucucugccggcgcucacgagcuccgcucuggccuuccugaaaucucggagcaagcuccuugccaccguugcuugccugggcgccuccccuagacugaaagugagcaagcccucccucucuuggaaagaacugcgcgggcggagagaggugccccuugcggcugagcaagucgcccgcgaaugugagcggcugcucgaacaguuuccucuguucgaggccuuucugcucgcugccugggaaccgcuuagaggaagccugcagcaaggccagucccuggcugugaaccucugcgggugggccucucugagcacaguucuucugggccuccacucccccaucgcgcuggacgugcugucugaggccuucgaggaaagccucgucgcucgcgauuggucccgggcccuucagcugaccgagguguauggaagagacguugaugaccugagcucuauuaaggaugcugugcucuccugugccgucgccugcgacaaagaaggcuggcaguaccuguuuccugugaaggaugcuagccuucgcucuagacuggcgcuccaauucguugaccgguggccccuggaguccugucuggagauccucgccuauugcauuagcgauacagcugugcaggaagggcuuaagugugagcugcagcgcaaacuggccgaacuccaggucuaccaaaagauccugggacuucagucuccucccguguggugcgacuggcagacccugagauccuguugcguggaggauccuagcacggucaugaacaugauccucgaagcccaggaguacgagcugugugaagaguggggcugccuguauccgauuccccgggaacaucucaucucccuucaccaaaaacaucugcugcaccuccuggagcgcagagaccaugacaaggcccuucagcugcuccggcgcauuccugaucccacaaugugccuggaaguuaccgagcagagccuggaccagcacaccucucucgccacaagccacuuucuugcgaauuaccugaccacacauuucuaugggcaacugacggcugugcgccaccgggagauccaggcccucuacgugggauccaaaauucugcuuacccugccugaacagcauagagccucuuauagccaccucuccucuaacccccuguuuaugcuggagcaacuccugaugaauaugaaggucgauugggcuacaguggccguucagacccuucagcagcugcucgugggccaagaaaucggcuucacaauggacgaggucgauagccugcuuucccgcuacgcggaaaaggcccuggacuuuccguauccucagcgggagaaaagaucugauagcgugauccaccuccaggagauuguucaucaggcugccgaccccgaaacccugccccgguccccuagcgcugaguucucucccgccgcuccuccggggaucuccagcauucacucucccucccugcgcgaaagauccuucccucccacgcaaccuucccaggaguuugugcccccggccaccccucccgcgcggcaucagugggucccugaugagacagaaucuaucuguauggugugcugucgcgagcacuucaccauguuuaacagacggcaucacugccgcagauguggacggcucgucugcagcuccuguagcacaaagaaaauggugguugaaggcugccgcgagaaucccgccagagugugugaccagugcuacucuuacuguaacaaggaugucccugaggaacccuccgagaaaccggaagcucuggacagcucuaagaaugagagcccucccuauuccuucgugguucgggugcccaaggccgaugaagucgaguggauucuugaccugaaagaagaggagaacgaacucgugagaucugaguuuuacuaugaacaagcuccuagcgccucccugugcaucgccauccuuaaucugcaccgcgacucuauugcuugcgggcaucagcucaucgagcacuguugccggcugagcaagggacugaccaacccggaaguggaugcgggccuccugacagacauuaugaaacagcuucuguucuccgccaagaugauguuuguuaaagcugggcaaagccaggaucucgcccugugugacucuuacaucuccaaggucgaugugcuuaauauucugguggccgcugccuauagacauguccccagccucgaccagauccugcagccugcggccgugacccgccugcggaaccaacuccuggaggcugaguacuaucagcuuggaguugaaguguccacgaagacaggccuggauaccaccggcgccuggcacgcuugggggauggccugccucaaagcgggaaaucugacagccgcuagagagaaguucucucgcugucuuaaacccccuuuugaccugaaccagcucaaucacggcagccggcugguccaggaugugguugaauaccuggaguccaccgugagacccuucgucucucuccaagacgaugacuacuuugccacgcugcgcgagcuugaagcuacacugcggacccagagccucucccuggccgugaucccugaggggaagauuaugaacaacacauauuaccaggaaugccuuuucuaucugcauaauuacagcaccaaccucgcuaucauuucuuucuauguuagacacuccugucugcgcgaggcccugcuccaucugcuuaauaaagaaagcccucccgagguguuuaucgagggaauuuuccagcccucuuacaaguccggcaaacugcacacacucgaaaaccugcuugagagcaucgaucccacccuggaaucuugggggaaguaucucauugcggccugccaacaucugcagaagaaaaauuacuaccacauccuguaugagcuccagcaauuuaugaaggaccagguccgggcugccaugacguguaucagauucuuuucccacaaagcuaagagcuacaccgaacugggagagaaacuuucuuggcugcucaaggccaaggaccaucugaaaauuuaucuucaggagacaagccgcuccagcggcagaaagaaaaccacauucuuucggaagaaaaugaccgccgcggaugugucccgccacaugaacacgcugcagcuccaaauggaagugacaagauuccugcaucggugcgagucugcuggcaccagccagaucacaacccugccucuucccacccuguuugggaauaaccacaugaagauggacgucgccuguaagguuaugcucggaggcaaaaauguggaagauggguucggaauugcuuuuagagugcugcaggacuuccagcucgaugccgccaugacauacugccgggcugcccgccaacuggucgagaaggaaaaauauuccgagauccagcagcuucugaagugcgugucugagagcggcauggcggccaaauccgacggggauacgauucugcucaacugucuggaggcuuuuaagagaaucccgccucaggagcuugaaggacugauccaagccauucauaaugacgauaacaagguucgggcuuaccucaucugcuguaaacugcgcucugccuaucucauugcggugaagcaggagcacagcagagccaccgcucugguccagcagguccaacaggccgcuaaauccagcggcgacgccguugugcaggauaucugcgcucaauggcugcuuacaucucacccccggggcgcccaugggcccggaucccgcaaguga

SEQ ID NO: 78109 - RNA, 1251 nt, Artificial Sequence
  derived and/or modified sequence opt5 from ZFYVE27__Homo_sapiens__NP_001002261
augcagaccagcgagagagaaggcuccgggcccgagcugucuccuagcgugaugccggaagcuccccucgaguccccucccuucccuacaaagucucccgcuuuugaccuguucaaccuuguccugagcuacaaacggcucgaaaucuaucuggagccucuuaaggaugccggagacggcguucgcuaccugcucagauggcaaaugccgcugugcucccugcucacgugucuggggcuuaaugugcuguuucucacccugaacgagggagcgugguauucugugggcgcucuuaugauuagcguccccgcccugcucggguaccugcaggaagugugccgggcccgccugccugauuccgagcucaugagacggaaauaucacagcguucgccaggaagaccugcagagaggacggcuuucucgccccgaggcuguggccgaggucaaguccuuccugauccaacucgaagccuuucugagcagacuuuguugcacaugugaggccgcguaccgggugcugcauugggaaaauccuguugugucuucccaguucuauggcgcccuccugggcaccgucugcaugcuguaccuccugccccuuuguugggugcugacacuccugaacagcacccuuuuucuggggaauguggaguucuuucgcgucguuucugaauacagagcuucccuccagcagcggaugaacccgaaacaagaggagcacgccuucgaaagcccucccccucccgaugugggaggcaaggacgggcugauggauuccacacccgcucugaccccuacggagucucucagcucccaggaccugaccccgggaagcguggaagaggccgaagaggcggagcccgaugaagaguuuaaggacgccauugaagagacacaucuugucgugcuggaagaugacgagggcgcuccuugccccgccgaggaugaacucgcucugcaggacaauggguuccugucuaaaaacgagguucuucgcuccaaggugagcagacucaccgaacggcugagaaaacgcuauccuacaaauaacuuuggaaauuguaccggcugcucugccacguucagcguccugaagaaacggagauccuguucuaacugcggcaauagcuucugcucccgcuguugcagcuuuaaggugcccaagucuuccaugggggccacagcuccggaggcgcagcgggagaccguuuucgugugugccagcugcaaccaaacacucucuaaauga

SEQ ID NO: 78110 - RNA, 2574 nt, Artificial Sequence
  derived and/or modified sequence opt5 from ZFYVE28__Homo_sapiens__NP_001166127
augaugaacagauuccggaaguggcuguacaaacccaagcgcagcgacccucagcuccuggccagauuuuauuacgcugaugaggaacuuaaucaaguggccgcggagcuggacucccucgauggccggaaagacccgcagcgcugcacccugcuugucucucaguucagaagcugucaggauaacguucugaauaucauuaaccaaaucauggacgaaugcauuccccaggaucgggcuccucgcgacuuuugugugaaguuccccgaggaaaucagacacgauaaucucgccgggcagcugugguuuggagccgagugccuggcugccggcuccauuaucaugaaccgggagcucgaaucuauggcuaugcgcccucuggccaaagagcuuacaagaagccuggaagacgugcgcggggcgcuccgggaucaggcccugagagaccuuaauacguauaccgagaagaugcgggaggcucugcgccauuucgauguccucuuugccgaguucgaacuguccuacgugucugcuaugguucccgucaagagcccuagagaauauuacgugcaacaggaggugaucguucuguuuugugaaacaguggaguccggacucgucguguaugccgacggcccgcugaaccuugaccggaaaguggaggauaugagcgaacuguucagacccuuucacacccuccugcgcaagauucgggaccuucugcagacacucaccgaggaggaacugcauacacuggaaagaaaucucugcaucucucaggaugucgaguucccuauucgcgcggacguucaagggcccgccgcucuggccccugcucuuuccgcuccccugccgccugagggaccccucagcgccaaagcuaaggauccugacgcggaacuggccuguucuaugcaguacgaugaccaggagcuugaacaacugucccggauggugcacagagcuggcgaugagaugagcucucuccuguccccucccaucgccugccagagccccgcccaucgcccgggcgcugaagggucccccggaggcgaggccucuccugggcggcccagacugcgcagcggauccgacgaggaggaacggguguuuuucauggaugacgucgaaggcaccgcggaggcucucgccagaccugagagccccgccgggccguucggaugggcuggcucuacgugggccgacccucaggaaaaaggccaagggggacccggcggggcugccggaauuucccugccugcgagcgagaaggaagaggaucuuucuaacaauaaccuggaagccgagggcaccgacggggcuagccucgccggaacauccucuuguagcugccuggauucccgccugcaccuugacggcugggaggugggcgcugaugacgccgaaaccgcggagaugaucgcccaccggacagggggaaugaagcucagcgcuaccguuauuuuuaaucccaaaucuccuacgucccuggauagcgccguggcuacacaggaagccgccucugagcccgucgcugaaggcauggacgggggaccgcauaagcuguccaccggcgcgacaaacugucuccugcacagcugcgugugcuguggguccugcggcgauucuagagaggacguuguggagcggcuucgcgaaaaauguagcccuggaggcgucaucggggccuccuacgcugccggacuggccaaggcuucugauagagcccccgagcggcaggaagaggcgcccccuccgagcgaagacgcuuccaauggcagagagcccaaagccccuaccagcgauaagugccucccccauaccucugggucccagguggacacagccagcggacugcagggcgaggcuggggucgccggccaacaggaaccugaggcgcgcgaacugcacgcuggaucucccuccgcccacgaggccccucaggcucuuagcggcucuagcuccagcacggccgggucuuguuccagcgacaaaaugggacccgaggcugccccggcggccacccaugcugccccucaggcuacacgggaaaagaucagaucccgcuuccacggcucucaugaucucauucacagacuguuugugugcaucagcgggguugccgaccaacugcagaccaacuaugccuccgaucuccggucuauucugaagacacuuuucgaggugauggcuaccaaacccgaaacggacgauaaggagaaacugcgcaaggucacacagacccucagaagcgcggcccuggaagacugugcucugugccaggagacccuuuccucuagcgagcucgccgccaaaacacgggauggagacuuugaagauccucccgagugggugccggacgaagccuguggcuucugcaccgccuguaaggcgccuuuuacaguuauccgcagaaagcaucacugccgguccugcgggaaaauuuucuguagccgcuguucuucccacagcgcuccccugccuagauacggccaagugaagcccguccgggugugcacgcauugcuauauguuucacgugacccccuucuacucugauaaagccggacuguga

SEQ ID NO: 78111 - RNA, 4278 nt, Artificial Sequence
  derived and/or modified sequence opt5 from ZFYVE9__Homo_sapiens__XP_011540739
auggagaacuacuuccaggccgaggcuuauaaucuggacaaggugcucgaugaauuugaacaaaacgaggacgaaaccgucagcuccacacugcuugauacgaaauggaauaagauccuggacccgccuucucacagacucagcuucaacccgacccuggccuccguuaaugagucugcggugagcaacgagucccagccccagcuuaaaguguuuucucuggcucauagcgccccucucacaaccgaagaggaagaucacugcgccaauggccaggacuguaaccugaaucccgagauugcuacaauguggaucgaugagaacgccgucgcugaagaccaacugauuaagcggaauuacuccugggaugaccagugcagcgccguggagguuggggaaaagaaguguggaaaccucgcgugccugccugaugagaagaaugugcuugucguggccguuaugcauaacugugacaaacgcacccugcagaaugaucuccaggacugcaacaacuauaauucucaaucccugauggacgcuuucagcuguucucuugauaacgaaaauagacagacagaccaguuuuccuucagcaucaacgagucuaccgagaaggauaugaacuccgaaaaacagauggacccccugaaucggccuaagacggagggccgcagcgugaaucaccucugcccgaccuccucugauagccuggccuccgucuguagccccucucaacugaaagacgauggguccauuggaagagacccuagcaugucugcuaucacaagccucaccguggauuccgugaucucuagccagggcacagacgggugccccgccgucaagaagcaggaaaacuacauuccugaugaggaccugaccggaaaaaucuccagcccccggacggaccuuggcucucccaauuccuuuagccauaugucugaaggcauucugaugaagaaagagccugcggaggaauccacaaccgaggaaagccuccgcuccgggcugccccuucugcucaagccugauaugcccaacggaucuggcagaaauaacgacugugagcggugcagcgauugccugguucccaaugaagugcgcgccgacgagaacgagggguaugaacacgaggaaacacugggaaccaccgaguuccucaauaugacagagcacuuuuccgaaucucaagauaugacgaacuggaaacugaccaagcucaacgagaugaaugacagccaggugaacgaagagaaagaaaaguuccugcagaucucccagccugaggauacaaauggcgacagcgggggacaaugugucggccucgcugaugccggccuggaccuuaaggggaccugcauuucugaguccgaagagugugauuuuagcacagugaucgacaccccggcugccaacuaccugucuaauggaugcgauuccuauggcaugcaggaccccgggguuagcuucgugccuaaaacgcuccccucuaaggaagacagcgucacagaggaaaaagagauugaggaauccaagagcgaguguuacucuaacaucuacgaacagagaggaaaugaggccaccgaaggcuccgggcugcugcucaacagcaccggagaucugaugaaaaagaauuaucuucauaacuuuugcucccaggugccuucuguucugggccaaagcucccccaagguggucgcuucucucccgagcaucuccgugccuuucggcggggcgcggcccaaacagccuucuaaucugaagcugcagauucccaaaccucuuagcgaccaccuccagaacgauuuccccgccaauuccggaaacaauacaaagaacaaaaacgacauccugggcaaggcuaagcugggggagaauagcgccaccaacgucuguucuccgucccucggaaauauuagcaacguggauacaaauggcgagcaucuggaaucuuacgaggccgaaaucuccacgcgcccuugccuugcucuggcccccgacagccccgauaacgaccucagagcggggcaauuuggcauuucugcucggaaaccuuucaccacacugggagagguugccccgguguggguccccgauucccaggccccuaauuguaugaagugcgaggcucgcuuuaccuucacaaaaagacggcaccacuguagagccugcggcaagguguuuugcgcuagcuguugcucccugaaauguaaacuucucuauauggaccgcaaggaagcccggguuugcgugaucugucauagcguccugaugaacgcgcaggccugggagaauaugaugucugcuagcucccagucucccaacccuaauaaccccgccgaauacugcagcaccaucccuccccugcaacaggcucaggccuccggggcgcucucuagcccgccucccacggugauggugccuguuggaguccugaaacaccccggcgccgagguggcucaaccgagagaacagcgccgggugugguucgccgaugggauucuuccuaauggagaggucgcugacgccgccaagcugaccaugaacggcacauccucugcugggacccucgcggugagccaugaucccguuaaaccugugacaaccagcccccugcccgccgagacggacaucugucuguuuagcggcucuauuacacaggucggauccccugugggcagcgcuaugaaucuuaucccggaagacgggcuucccccuauucugaucucuaccggaguuaagggcgauuaugccguggaggaaaaacccucccagaucagcgucaugcaacagcuggaggacgggggaccugauccccucguguucguucugaacgccaaccuucuguccauggugaagauugucaauuacgugaacagaaaaugcugguguuuuacaaccaagggcaugcacgcuguggggcagucugaaaucgucauucuccugcagugccugccugacgagaagugucuuccgaaagauaucuucaaucauuuuguucaacucuaucgcgacgcccuggcgggcaacguggugagcaaucugggacacuccuucuuuagccagucuuuccucggcuccaaggagcacgggggauuccuguacgucaccagcacauaccagucucuucaggaucuggugcuccccacgccucccuaucuguuuggcauucugauccaaaaaugggaaaccccuugggcuaagguuuuccccauucggcuuaugcugagacucggggccgaguaccgccuguauccgugcccucucuuuagcgugcgguucagaaaaccccuguuuggagaaacaggccauaccaucaugaaccuucuggccgacuuccgcaauuaccaguauacacuccccgucgugcaggggcugguuguggauauggagguccggaagaccuccaucaagauuccuucuaacagauacaaugaaaugaugaaagcuaugaacaagagcaaugagcacgugcuggccggcggagcgugcuuuaacgagaaagcugacucccaucuuguuugugugcaaaaugaugacggcaacuaucagacgcaggccaucucuauucacaaucagccccggaaggucacaggggccagcuucuuuguguucuccggagcucugaaauccucuuccggcuaccucgccaagagcuccaucguggaagacggggucaugguucaaauuaccgcugagaacauggauucucugcgccaggcccucagagaaaugaaggacuuuaccaucacaugcggaaaagcggaugccgaggagccucaggaacacauccauauucaguggguggacgaugacaagaaugugagcaaaggcgucguguccccgaucgauggcaagucuauggagaccauuacaaacguuaaaaucuuccacgggagcgaauacaaggcuaacggaaaggugauucgguggacggaggucuuuuuccuggaaaaugacgaucaacauaacugucuuuccgaccccgccgaucacagcagacugaccgagcauguggcuaaagccuucugccucgcccuguguccucaccugaaacuucugaaggaggacggcaugacaaagcucgggcugcgcguuacccucgauucugaccaggugggauaucaggcuggcuccaaugggcagccccugccuagccaauacaugaacgaccuugauucugcgcugguccccgugauccacggaggcgccugccagcuguccgaaggcccggucgugauggagcucaucuuuuauauucuggaaaauaucguuuga

SEQ ID NO: 78112 - RNA, 627 nt, Artificial Sequence
  derived and/or modified sequence opt5 from ZG16B__Homo_sapiens__NP_660295
augggcgcccagggggcucaagagagcaucaaggccauguggagagugcccggaaccacacggcgcccugucacgggcgaauccccggggaugcacagacccgaggcgaugcugcuccugcuuacccuggcucuccugggaggcccuacaugggccgggaaaauguacggacccggcggcgggaaguauuucucuaccacagaagacuacgaucaugagauuaccggacuucggguuagcgugggccugcuccuggugaaauccguccaggugaagcugggggacucuugggauguuaaacucggagcccugggcgggaacacacaggaagugacccuucagccuggagaguauaucacgaaggucuuuguggcuuuccaagccuuucugcgcggcaugguuauguacaccagcaaggacagauauuucuacuuuggcaaacucgaugggcagauuuccucugcuuaucccagccaggagggacaggugcuggucggcaucuacgggcaauaccagcuucugggaauuaaguccaucggcuucgaauggaauuauccucucgaggaaccgacaaccgagcccccugugaaccugacauacagcgccaauucucccguggggcgguga

SEQ ID NO: 78113 - RNA, 816 nt, Artificial Sequence
  derived and/or modified sequence opt5 from ZGLP1__Homo_sapiens__NP_001096637
augaccgagccccaggugggcugcgucgccuguccuagaguucacaaggaaccggcucaaguggggacacccuggccugccaaaccccggagccauccucgcaagagagaccccacggcgcugcucccucggucccuguggccggcuugccaggagucugugaccgcccuuuguuuccugcaggaaacagucgagcgccucggacagagccccgcccaagauaccccugugcugggccccugcugggacccuauggcucuugggacacagggaagacugcuccuggaucgggacuccaaagauacccagacacgcaucucucagaagggcagacggcugcaacccccggggaccccuagcgcucccccucagcgcagaccccggaaacagcucaaccccugucgcggaacggaaagaguugacccuggcuuugagggcgugacccugaaguuccagauuaagccggauuccucucuucaaaucauucccacauacagccugccuugcuccagccggucucaggagucccccgccgacgccgucgggggaccugcggcccaccccggcgggaccgaagcucauagcgccggaucugaggcucucgaaccgcgcagaugugccuccugccggacacagagaaccccucuguggcgcgaugcggaggacggcacgccccuuuguaaugccugcgggauccgguauaaaaaguacggaacaagauguagcucuugcuggcuggugccucgcaaaaacguucaacccaagcggcucugcggcagauguggcgugucccuggauccuauucaggagggguga

SEQ ID NO: 78114 - RNA, 1536 nt, Artificial Sequence
  derived and/or modified sequence opt5 from ZGPAT__Homo_sapiens__NP_001076582
auggacgaggaaagccuggaguccgcccuccagaccuacagagcucaacugcaacagguggaacuugcccugggcgcggggcucgauucuagcgagcaggcugaccugcggcagcuucagggagaucugaaggaacucaucgagcugacagaggccucccuggucucuguucgcaaaagcucccuccuggccgcucuugacgaagagagacccggccggcaggaagaugccgaguaucaggcuuuccgcgaggccauuacggaagcgguggaggccccugcugccgcuagagggucuggaagcgaaaccgugccgaaggccgaggcgggccccgaauccgccgcugggggacaagaggaggaagagggcgaagacgaggaggaacugagcggcacaaaagucucugccccuuacuauuccagcugggggacccucgaguaccacaacgcuauggugguuggaacagaagaggccgaagauggcucugccggggugcggguccuguaucuuuaccccacccauaagucccugaaaccuugccccuuuuuccucgagggaaagugucgcuuuaaggaaaauugcagauucagccacggccaggugguuucucuggacgagcugcggccuuuucaggauccggaccucuccagccugcaggcuggguccgcgugucuugccaaacaucaagauggacuguggcacgcugcccgcaucacagacguggauaacggcuauuacaccgucaaguucgacucucuccugcuuagagaggccgugguggaaggcgacgggauucugcccccucuccggacggaggcuaccgaaagcgauuccgacagcgauggaacaggcgacucuuccuacgcccgcgucguugggagcgaugcgguggacucuggaaccugcagcuccgcuuuugccggcugggaggugcauacaagagggaucggaucucggcugcugaccaaaaugggcuaugaguucggcaaggggcucggacgccacgccgaaggcagagucgagcccauucacgcugugguucugccucgggggaaaagccuugaucaguguguggaaacgcugcagaagcaaacaagagucggaaaggccggcaccaauaaacccccgcgcugccgggggagaggcgcucgcccuggaggccggcccgccccuagaaacguguuugacuuccucaaugagaagcugcaggggcaggcgcccggagcccuugaagcuggcgccgcucccgccgggcgccgguccaaagauauguaccaugcgagcaagucugccaaaagagcucugucccuccgccuguuucagacagaggagaagaucgaacggacccaaagagacauccgcagcauucaggaggcccuggcucggaacgccggaagacacucuguugccuccgcucagcuccaggaaaaacuggcgggcgcccaacggcagcuugggcagcugcgcgcucaggaggccggccuccaacaggaacagagaaaggccgauacccauaagaaaaugacagaguucuga

SEQ ID NO: 78115 - RNA, 2622 nt, Artificial Sequence
  derived and/or modified sequence opt5 from ZHX1__Homo_sapiens__NP_009153
auggccagcagacggaaguccaccacacccugcauggugcuggcuucugagcaggacccugaucucgaacugaucagcgaccuugaugagggcccgcccguccugacgccuguugaaaacacccgcgccgaguccauuucuagcgacgaagaggugcacgaguccguggauucugacaaucaacagaacaaaaaggucgaagggggauacgaguguaaauauugcacauuccagacccccgaucucaauauguuuacauuccauguggacagcgaacacccuaacguugugcuuaauuccagcuacgucuguguggagugcaacuuucugaccaagagauaugaugcgcugucugagcauaaucucaaauaccaccccggcgaagagaacuucaagcugacaaugguuaagcggaauaaccagaccaucuuugaacaaacgauuaaugaccugaccuucgauggguccuuugugaaagaggaaaacgcugagcaggccgagagcacagaagucucuuccagcggaaucucuauuuccaagaccccuaucaugaaaaugaugaagaauaaaguggagaacaagcgcaucgccgugcaucacaauagcgucgaagacguuccggaggaaaaggagaacgagauuaaacccgauagagaagagaucguggaaaacccuuccucuagcgcuuccgagagcaauacaucuaccuccauugugaaccggauccaccccagcacggccucuacagucgugaccccugcugccguucuccccggccuggcccaggugauuacagcggucagcgcucagcaaaauuccaaccuuaucccgaaggugcugauuccuguuaauucuauccccaccuauaacgccgcucucgacaauaacccucugcuucugaauaccuacaacaaauuccccuaucccacaaugagcgaaaucacggugcucuccgcccaggcgaaguacaccgaggagcagauuaaaaucugguuuagcgcccagcgccugaagcauggggucucuuggacaccugaagagguggaagaggcuagacggaaacaauucaauggaaccguccacacagugccgcagaccauuacgguuauccccacacauauuuccaccggcagcaacggccugccuucuauccuccagaccugucaaaucguggggcagcccggacugguccuuacacagguggccggcaccaauacacugccuguuacggcucccauugcccucaccguggccggggucccgucccagaacaauauccaaaagagccaggugccugcugcgcagcccacagccgagaccaagccugcuacagccgccgugcccaccucccagucuguuaaacacgaaacggcucuggucaacccugacagcuuuggcauucgcgccaagaaaaccaaggagcaacuugcggaacugaaaguguccuaccucaagaaccaguucccccacgauucugagaucauuagacugaugaagaucacaggacugaccaaaggggaaaucaagaaaugguuuagcgacacacgguauaaucagcgcaacuccaagagcaaucagugccuccaucugaacaaugauucuuccaccacgauuaucauugacagcucugaugagacaaccgaguccccgacagugggaaccgcucaaccuaaacagagcuggaaccccuuccccgacuucaccccucagaaguuuaaggagaaaacagccgagcagcuuagaguccugcaagccucuuuccucaauagcuccgugcugacggaugaagaacuuaaccggcugcgcgcucagaccaagcucacaagacgggaaaucgacgccugguuuaccgagaaaaagaaaagcaaggcucugaaggaggagaaaauggagauugaugaaucuaaugccggcuccagcaaggaggaagcgggcgagacauccccggccgacgagucuggggcucccaaaagcggauccaccggcaagaucuguaaaaagacgccugaacagcugcacaugcucaaaucugccuucguuagaacacaauggcccagcccugaggaauacgauaagcuggcuaaggaguccgggcuugcccgcaccgacauugugucuugguuuggagacacccgguaugcguggaaaaacggcaaucugaagugguacuauuacuaucagagcgccaacuccagcucuaugaaugggcucuccagccugagaaaacgcggacggggcagacccaagggccgcgggcggggaagaccucgcggccggcccagagggucuaaacgcaucaacaauugggaucggggaccgucccugaucaaguucaagacaggcaccgcuauucuuaaagacuacuaccucaagcauaaauuucugaacgagcaggaucuggacgaacucgucaacaagagccacaugggguaugaacaggugagagaaugguucgccgagcggcaacgcagaucugaacugggcaucgagcuuuuugaggaaaaugaggaagaggaugaaguuauugacgaucaggaggaggacgaagaggaaacagaugacuccgauacgugggagccuccccggcaugugaaaagaaagcugagcaaguccgacgauuga

SEQ ID NO: 78116 - RNA, 2514 nt, Artificial Sequence
  derived and/or modified sequence opt5 from ZHX2__Homo_sapiens__XP_011515234
auggccagcaagagaaaauccaccacacccugcauggugcggacgucucaggucguugagcaagacgugccugaagagguggaucgcgcuaaggaaaaaggcaucgggaccccgcagcccgacgucgccaaggauagcugggcggcugagcuggaaaacuccucuaaagagaaugaggugauugaaguuaagagcaugggagagucccagucuaagaaacuccagggcggguacgaauguaaguauugcccuuacagcacacaaaaccugaaugaguucaccgagcacguggacaugcagcaucccaacgucauccuuaauccucuguaugugugugccgaaugcaacuuuacaaccaaaaaguacgauucccucagcgaccacaauucuaaauuccaucccggagaggccaacuuuaagcugaaacuuauuaagagaaauaaccagacaguucuggaacaguccaucgagaccacgaaucacguggucagcauuaccacaucuggcccugggaccggagauuccgacagcggcaucucuguguccaagacaccgaucaugaaacccggcaagccuaaagcugaugccaagaaagugcccaagaagccugaagagauuacccccgagaaccaugucgaagggacggcucggcucguuacagacaccgccgagauccugagccgccugggaggcguggaacuccugcaagauacacuugggcacgugaugccguccguccagcugccucccaauauuaaccucgugccuaaaguucccgugccccugaauaccaccaaguauaacucugcgcuugacacaaacgccacgaugaucaauagcuucaacaaauuuccuuacccgacccaggcugagcuguccuggcucacagccgcuagcaagcaccccgaggagcauauuagaaucugguucgccacccagcggcugaaacacggaauuucuugguccccugaggaagucgaggaagcgcgcaagaagauguuuaauggcacaauccaaagcgugcccccuaccaucacgguucugcccgcccagcucgcuccgacaaaagugacccagccuauucugcaaaccgcccuucccugucagauccuggggcagacaucucucguccugacccaggugacaagcggauccacgaccgucucuugcagcccuauuacacuugcuguggccggcguuaccaaccauggccaaaagagaccccuggugacaccucaggccgcucccgagccgaaacggccucacaucgcgcagguccccgaacccccuccgaagguggccaaucccccucucacccccgcuuccgaucgcaaaaagacgaaggagcagauugcccaccugaaagccagcuuccugcaaucucaguuuccugacgacgcugagguuuauagacucaucgaagugaccgggcuggcccgguccgagaucaagaaaugguucagcgaucaucgcuacagaugucagcggggaauuguccacaucacaucugaaucccuugcgaaggaccagcuggcuauugccgccagccgccauggcagaaccuaccacgcuuaucccgauuuugccccucaaaaauucaaggagaagacacagggacaggugaaaauccucgaggacuccuuucugaagucuagcuuccccacccaggcugaacuugaucggcugagaguggagacgaaacucucccgccgggaaauugacucuugguucagcgagagacgcaagcugcgggauuccauggaacaagccguucuggacagcauggggucuggcaaaaaggggcaggaugucggagcgccgaacggcgcccucuccagacuggaccagcuuagcggcgcucaacugacaucuucccucccuagccccucuccugccaucgcuaaaagccaggaacaggugcaucugcugcgcuccaccuuugcccggacacaguggcccaccccgcaagaguacgaucagcuugcggccaagaccgggcucgugagaacagaaaucguccgcugguucaaggagaaucggugccugcugaaaacgggaaccgugaaguggauggaacaguaucagcaccaaccuauggcugacgaccacggcuacgaugccguugcuagaaaagccacaaagcccauggccgagagcccuaaaaacgggggagacguggucccccaguauuacaaggaucccaagaaacucugugaagaggaccuggagaaacuugugacccgcguuaaggugggcucugaaccugcuaaggauugccugccggcgaaacccuccgaggccacaagcgaccgguccgaagggucuagcagagauggccagggauccgacgagaaugaagagucuagcgucguggauuauguugaggugaccgucggcgaagaggacgcuauuuccgaucggucugacagcuggucccaggccgccgcugaaggggugagcgagcucgccgagucugauuccgacugugugccugcggaagcuggacaagccuga

SEQ ID NO: 78117 - RNA, 1344 nt, Artificial Sequence
  derived and/or modified sequence opt5 from ZIC1__Homo_sapiens__NP_003403
augcugcucgacgccggcccccaguacccugcuaucggggugaccacauucggagccagcagacaccauuccgcgggcgaugucgcugagcgggacguugggcugggaauuaacccguuugccgauggcaugggggccuucaagcugaaucccucuagccacgaacuggcuuccgccggacaaacggcuuuuaccucucaggccccuggcuaugcggccgcugccgcucucggccaucaccaucaccccgggcacgugggaagcuacuccucugccgcguucaacagcacacgcgacuuucuguucagaaaucggggcuuuggggaugccgcugccgcugccuccgcccagcauagccuuuucgcugcgucugccggaggcuuugggggaccucacggccauaccgacgcugccggccaccuucucuuccccgggcugcacgagcaggccgcuggacaugccuccccuaacguggucaauggccaaaugcgccugggguuuagcggagauauguauccgagacccgaacaguacggccaggugacaucuccucgguccgagcacuaugcggcuccccagcuccauggguacggaccuaugaacguuaauauggccgcccaccauggcgcuggcgccuucuuucgcuauaugagacaacccaucaaacaggaacugauuugcaaguggaucgagccggagcagcuugcuaacccuaaaaagagcuguaauaaaaccuucucuacaaugcacgaacuggugacccacgucacgguggagcauguugggggacccgaacaguccaaccacauuugcuucugggaggaguguccucgggaaggcaagcccuuuaaggccaaauacaagcucgugaaucauauccgcguccacaccggggagaaacccuucccuugcccguuucccggauguggcaagguguucgcgagaagcgaaaaccugaaaauccacaagcggacacauaccggggagaagccuuuuaaaugcgaguucgaaggcugugaccgcagauuugccaauuccucugaucggaagaaacacaugcaugugcacacaagcgacaagcccuaccuuugcaaaaugugugauaaguccuauacccauccuagcucucugcgcaaacacaugaagguccacgaguccagcucucaaggaagccagcccuccccggcugccucuagcggcuacgaauccagcacgccucccacaauuguuucuccuuccaccgacaaccccacaaccagcucucucuccccuagcuccucugcugugcaucacaccgccgggcauagcgcgcuguccucuaauuucaacgagugguauguguga

SEQ ID NO: 78118 - RNA, 1599 nt, Artificial Sequence
  derived and/or modified sequence opt5 from ZIC2__Homo_sapiens__NP_009060
augcugcucgacgccggcccccaguucccugcuaucggggugggcagcuuugccagacaccaucaccauuccgcggcugccgccgcugccgcugccgcggagaugcaagaucgggaacugucucuugccgcugcccagaacggauucgucgacagcgcugccgcgcacaugggggccuuuaagcugaauccgggagcucaugagcucucccccggccagucuagcgccuucaccucccaggggccuggagcuuaccccggcucugccgccgcugcggccgcugccgccgcucugggcccucacgccgcgcacguugggagcuauuccggacccccuuuuaacagcacacgcgauuuccuuuuuagaucucggggcuucggggacuccgcuccgggaggcgggcaacauggacuguuuggccccggcgccgggggacuccaccaugcccacagcgaugcucagggccaucugcuguucccugggcuccccgaacagcacggaccucacggcucucagaaugugcugaacgggcaaaugcgccuuggacugcccggcgagguguuuggcagauccgaacaguaccggcaggucgccagcccgcgcacggacccuuauucugcugcccagcuccauaaucaauacgggcccaugaacaugaauaugggaaugaacauggcggccgcugccgcucaccaucaccaccaucaccaucaccacccuggcgccuucuuuagauauaugcggcagcagugcauuaaacaagagcugaucuguaaguggauugaucccgagcagcuuuccaaucccaaaaagagcugcaacaaaaccuucuccacaaugcaugaacuggugacccacguuucuguggagcaugucgggggaccugaacagagcaaucacguguguuucugggaggagugcccgcgcgaaggcaagcccuuuaaggcgaaauacaagcucguuaaccauaucagagugcacacaggggagaaaccuuuccccuguccuuuucccggcugcggaaaggucuucgcccgguccgaaaaucugaaaauucacaagcgcacccauacaggcgagaagccguuucagugugaguucgaagggugcgacagacgguuugcuaacagcucugaucgcaaaaagcacaugcaugugcacaccuccgacaaaccuuaucuguguaagaugugcgauaaaagcuacacgcaucccucuagccucagaaagcacaugaaagugcacgaguccucuccucaaggaagcgaauccagccccgccgcuucuuccggcuacgagagcucuaccccucccgggcuggucuccccgagcgccgaaccucaguccucuagcaaucuuucccccgccgcugcggccgcugccgccgcugccgcggcugccgccgcugccguuucugcggugcaucggggaggcgggagcggcuccggaggcgcugggggaggcagcgggggaggcucuggguccggcggaggcgggggaggcgccgggggaggcgggggcggaagcucuggcgggggauccggcacagccgggggacacagcggccugucuagcaacuucaacgagugguauguguga

SEQ ID NO: 78119 - RNA, 1404 nt, Artificial Sequence
  derived and/or modified sequence opt5 from ZIC3__Homo_sapiens__NP_003404
augaccaugcugcucgacggcgggccccaguucccuggacugggcguggggagcuuuggagccccgagacaccaugagaugcccaaccgggaaccugcuggcauggggcuuaaucccuucggagauuccacacacgccgcggcugccgccgcugccgcugccgcguuuaagcugucuccugccgcugcccaugaccucagcuccggccaaucuagcgcuuucacgccccagggcuccggguacgccaacgcgcugggacaccaucaccaccaucaccaucaccaccaucacaccucucaggucccuagcuauggcggggccgcuuccgccgcuuuuaauagcacacgcgaguuccuuuuuagacagcggucuuccggacugagcgaagccgccucuggcgggggacaacauggccucuucgcuggcuccgcgagcucucugcacgccccggcugggauccccgagccucccuccuaccugcucuuuccuggacugcaugaacagggcgccgggcaccccagcccgaccggacacguugauaacaaucaggugcaucuuggccugcgcggggaacucuucggcagagccgacccuuaucggcccguggcuuccccucgcacagaucccuacgccgcgggagcucaguuucccaacuauucuccuaugaauaugaacaugggcgucaauguggccgcccaccaugggccgggagcuuucuuuagauacaugcggcaacccauuaaacaggagcugagcugcaaguggaucgacgaggcccagcuuucccgcccuaaaaagagcugugauagaaccuucucuacaaugcacgagcugguuacccacgugacgauggaacaugucggcgggcccgagcagaacaaucacgugugcuauugggaggaauguccucgggagggaaaauccuucaaggcuaaguacaaacucguuaaccauauucgcgugcacaccggcgaaaagcccuuuccgugcccuuuccccggguguggcaaaaucuuugccagaagcgagaaucugaagauucauaaacggacacacaccggagaaaagccuuucaagugcgaguuugagggcugugaccgcagauucgcgaacucuagcgaucggaaaaagcacaugcauguccacacauccgacaaacccuacaucugcaaggugugugauaaaucuuauacccauccuagcucccugagaaagcacaugaaagugcaugaaagccaagggucugacuccagccccgccgcuucuuccggauacgagagcuccacgccgccugccaucgcuucugccaauagcaaggauacaaccaagacacccuccgcgguccagaccucuaccagccacaaccccggccucccuccgaacuuuaaugaaugguauguuuga

SEQ ID NO: 78120 - RNA, 1155 nt, Artificial Sequence
  derived and/or modified sequence opt5 from ZIC4__Homo_sapiens__NP_001161850
augcccccuuucugcagaaacgccaagcugggccuccugagcuuucuuaucugugcugggcggucccugcucccgcugggcaaaaaugccuucuggcuugagcgcauugaaaacaauaacacccugugggagaaggcgcagucucagaaaaugagauacaagacaagccucgugaugcggaaacgccugagacuguaucggaauacgcucaaggaauccucuagcuccucuggacaccaugggccccaacugaccgcugccagcuccccuagcgucuuucccggacuucacgaggaaccuccccaggccucuccuucccgcccgcugaacggccuccugagacuugggcugcccggagacauguacgcucggccugagcccuucccucccggcccggccgcucgcagcgaugcccucgcggccgcugccgcucugcauggcuaugggggaaugaaucugacaguuaaccucgccgcgccucacggccccggggccuuuuucagauacaugcggcagccuaucaagcaagagcugauuugcaaauggcuugcugccgacggaaccgcuacacccucucuguguuccaagaccuuuagcacaaugcaugaacucgugacccacgugacggucgagcacgugggcgggcccgaacaggccaaucauaucugcuucugggaggaguguccucgccagggaaaaccguuuaaggccaaauauaagcugguuaaccacauuagagugcauaccggcgaaaagcccuucccuugccccuuuccuggcugugggaaagucuucgcucggucugagaaucuuaagauccacaaacgcacacacaccggagaaaagcccuuuagaugcgaguucgaaggcugugagcggagauucgcgaacuccagcgaucgcaaaaagcauucccacgugcauacaucugacaaaccguauaccugcaagguucgggggugugauaagugcuacacgcacccuagcucccugagaaaacauaugaaggugcacggacgcucucccccucccagcuccggcuacgacagcgccacaccuucugcucucgucagccccuccucugauugcgggcacaaaagccagguggccuccagcgccgcuguggccgcgcggaccgcugaccugucugaguga

SEQ ID NO: 78121 - RNA, 1992 nt, Artificial Sequence
  derived and/or modified sequence opt5 from ZIC5__Homo_sapiens__NP_149123
auguuccugaaggccggcagagggaacaaagugcccccuguccggguuuacggaccggacugcguggugcucauggagcccccucugagcaagcgcaaucccccugcucuuagacuggccgaucucgcgaccgcucagguccaaccccugcagaacaugacaggcuuuccugcccuugccgggccgcccgcucacucccagcugcgggccgcuguggcccaucuccgccugagagaccugggagcggauccuggcguugccacgacaccccucgggccugaacacauggcucaggccucuacccugggacuuagcccgccgucccaggcuuucccugcccaucccgaggcgccugccgcugccgcucgggccgccgcucugguggcgcaccccggcgccggcucuuaucccugugggggaggcagcuccggggcucaaccuucugccccgcccccucccgccccuccccucccgccuacccccagcccucccccucccccgccucccccucccccgcccgcucuguccggauacacaaccacaaauagcggcgggggagggucuuccggcaaaggccauagccgcgacuuuguccuuagacgggaucugucugccaccgcgccugcugccgccaugcacggagcuccccucggcggggaacagcgcuccggaacgggcagcccucagcaccccgccccucccccgcauucugcugggauguucaucuccgccagcggaaccuaugcgggcccugacggcuccgggggacccgcccuguuuccugcucugcacgauacacccggcgcccccgggggacauccucacccccucaacggccaaaugagacuggggcuugcugccgcggccgcugccgcugccgccgagcuguacggccgggcugaaccucccuucgcgccccgcucuggagacgcccacuauggcgcuguggccgccgcugccgcggcugcccuccauggguacggagccguuaaucugaaccuuaaucuggcugccgcggcugccgccgcugccgcuggcccugggccgcaccuccagcaucacgcgcccccucccgccccucccccuccgcccgccccugcucagcauccccaccagcaccauccucaucugcccggagccgcuggcgccuuucugagauauaugcggcaaccgauuaagcaggagcucaucugcaaauggauugauccugacgagcuggccgggcuuccucccccucccccuccgcccccucccccucccccgccucccccugcuggcggagcgaagcccuguagcaagaccuucggcacaaugcacgaacuggugaaccacgucaccguggagcacgucgggggaccugaacaguccagccaugugugcuuuugggaggauuguccccgcgagggcaaaccguucaaggccaaauacaagcucaucaaucacauuagaguucauacgggggaaaaaccuuuucccugccccuucccuggauguggcaagguguuugcucggucugagaaccugaagauccacaaaagaacacauaccggggaaaagccguucaaaugcgaguucgacggcugugaucgcaaguuugccaauuccagcgaccggaaaaagcacucucacgugcauacaagcgacaaacccuacuauugcaagaucagaggaugugauaaguccuacacccacccuucuagccuucgcaaacauaugaagauucacugcaaauccccuccgcccagccccggcccccugggguauucuuccgucggaacccccgugggcgccccucucagccccguucuggacccugcucggucucauuccagcacacugucuccccaagugacgaaccucaaugaaugguacgucugccaggccuccggggcgccgagccaucugcacaccccuuccucuaacggaacaaccagcgagacagaggaugaagagaucuauggcaaucccgaagugguuagaaccauucacuga

SEQ ID NO: 78122 - RNA, 1464 nt, Artificial Sequence
  derived and/or modified sequence opt5 from ZIK1__Homo_sapiens__NP_001010879
auggccgcugccgcgcugagagcucccacccaggugacagucagcccugagacgcacauggaccucaccaagggcugcguuacauucgaagauaucgccauuuacuuuucccaagacgagugggggcugcuugaugaagcccagcggcugcucuaucuggaggugaugcuugaaaacuucgcucugguggccucucucggauguggccaugggaccgaggacgaggaaacaccgagcgaucagaaugucuccgugggaguuucucagagcaaagcuggcuccucuacccaaaagacacagagcugcgagaugugugugcccguccugaaagacauccugcaccucgccgaucugccugggcagaagcccuaccuugugggagaaugcaccaaccaucaccagcaucaaaaacaccacuccgcgaagaagucccugaaacgcgacauggauagagccucuuauguuaaguguugccucuuuuguaugucccugaaaccuuuccggaagugggaggugggcaaagaccuucccgcuaugcugcgccuccugagaagccuggucuuuccuggcgggaagaagccgggaacgauuaccgagugcggcgaagauauccggucucagaaaucccauuacaagagcggggaguguggaaaagccucucgccacaagcauacacccguguaucacccuagaguguacaccggcaaaaagcucuaugaaugcuccaaaugugggaaggcuuuccggggaaaguacagccugguccagcaccagcgcguucauacaggcgagagacccugggaaugcaaugagugcggcaaauuuuucucccaaaccucucaccuuaacgaccaucggcgcauucacacgggggagagaccuuacgaauguagcgagugcggaaagcuguuucggcagaauagcagccucguggaucaucagaaaauccacacaggcgcccgccccuaugaauguucucaaugcgggaaguccuucagccagaaagcgacccuggugaagcaccagagaguccauacaggagagcggccguacaaguguggcgaaugcgggaacucuuuuagccaguccgccauccuuaaucaacacagacgcauucauaccggagcuaaaccuuaugaguguggccagugcggcaagucuuucagccagaaagccacccugaucaagcaccagcgggugcacacaggggagagacccuacaaauguggagacugcggcaaguccuuuagccaaucuuccauucucauccagcaucgccggauucacacgggggcuagaccuuaugaauguggacagugcggcaagagcuucucucagaaauccgggcugauccaacaucagguugugcacaccggcgagcgccccuacgaaugcaacaaguguggaaauagcuucucccagugcucuagccugauucaucaccagaaaugucacaacacauga

SEQ ID NO: 78123 - RNA, 1584 nt, Artificial Sequence
  derived and/or modified sequence opt5 from ZIM2__Homo_sapiens__NP_001139799
auguaccagcccgaggacgauaacaauagcgacgugaccuccgaugacgauaugacaagaaaccggcgcgaaucuagcccuccgcacuccguccauucuuucagcggcgacagagauugggaccggcgcgggagaucccgggauauggagccccgcgacagauggucucacacgcggaauccucgcagcagaaugcccccucgggaucugucccuccccguuguggccaagaccagcuuugaaauggaccgcgaggaugacagagacucucgggcuuaugaaucccgcagccaagaugccgagucuuaccagaacguggucgaccuggcggaggauagaaaaccucauaauacaauccaggacaacauggaaaauuaucggaaacuucugucccucggauuccuggcucaggauagcgugccggccgagaagagaaacaccgaaaugcuugacaaucugcccucugccggcucccaauuuccugauuucaagcaccucgggacauuucugguuuucgaggagcuggugaccuuugaagacguccucguggauuucagccccgaggaacuguccucucuuagcgcugcccagcgcaaccuguaccgggagguuaugcucgaaaauuauagaaaccuggugucccuuggacaucaguuuagcaaaccugacauuaucucucgccuggaggaggaagaguccuacgcuauggaaacagauagccggcacaccgucauuugccagggcgagucucacgacgacccccucgaaccgcaucaagggaaucaggagaagcugcugacgccuaucaccaugaacgaucccaagacacucaccccugagagaagcuauggauccgacgaguucgaacgcucuagcaaucuguccaaacagagcaaggauccccuuggcaaagacccccaggaaggcacagccccugggauuuguaccucuccgcaauccgcgagccaggagaacaagcacaaccggugcgaauuuuguaaaagaacguucucuacacagguggcccugcgccggcaugagagaauccacaccggaaagaagcccuacgagugcaaacaaugugcugaagccuuuuaccucaugccucaccugaaucgccaucagaagacacacuccggccggaaaaccagcgggugcaacgagggaagaaagcccuccgugcagugugcuaaucuuugcgaacggguccgcauccauucucaggaggauuauuucgaguguuuccaaugcggcaaagccuuucugcagaacguucaccuccugcagcaucugaaggcgcacgaagccgcuagagugcucccucccgggcugagccacuccaaaaccuaccuuauucgguaucagagaaagcaugacuacgugggagagcgcgccugucaaugcugcgauuguggccgggucuucucuagaaauagcuaucugauccagcacuaccgcacacauacgcaggaaagaccguaucagugccaacucuguggcaagugcuuugggcggccuuccuaccugacccagcacuaccagcuucacagccaggagaaaacaguggaaugugaccauugcuga

SEQ ID NO: 78124 - RNA, 1584 nt, Artificial Sequence
  derived and/or modified sequence opt5 from ZKSCAN1__Homo_sapiens__NP_001273983
auguggggccaggacagcacccugcaagauacacccccuccggaccccgagaucuucagacagcgguuucgcagauucugcuaccagaacacguuugggccucgggaagcccucucccgccugaaggagcuuugucaccaguggcugagacccgaaauuaauaccaaagagcaaauccucgaacugcuugugcuggagcaguuccucucuauucugccuaaggagcugcaggucuggcuccaggaauaucggcccgauagcggagaggaagcuguuacacugcuugaggaccuggagcucgaucuguccggccaacaggugccuggacaggugcaugggccggaaaugcuugcccgcggcauggucccccuggacccugugcaggagucuagcuccuuugaucuccaccaugaagcgacccaaucucacuucaaacauagcuccagaaagccccggcugcugcagagccgcgcucucccugccgcccacauccccgcuccgccucacgaggggucucccagagaccaggccauggcuuccgcccuguuuacagcggauagccaagccaugguuaaaauugaagacauggcugugucucuuauccuggaggaguggggaugccagaaccucgcccggcgcaaucuguccagagauaaccggcaggaaaauuacggcagcgcuuucccucagggcggggagaaccgcaaugaaaacgaggaaucuaccuccaaggccgagacaagcgaggacuccgcgucuagaggagaaaccacgggccggagccaaaaggaguuuggggagaaaagagaucaggaaggaaagaccggcgaacgccagcagaaaaaucccgaggagaagacacggaaagaaaagagagacuccgggcccgccaucggaaaggacaaaaagaccauuacaggcgagcgcggcccucgggaaaaagggaagggacuuggccgcagcuucucucuguccagcaacuuuaccacgccggaggagguccccacagggaccaaaucucauagaugugaugaaugcggaaaguguuucacacggagcuccucucucaucagacacaaaauuauccauaccggcgagaagccuuaugaaugcagcgagugugggaaggcuuuuucccugaauagcaaccuggugcuccaccaacgcauucacaccggagaaaaaccccaugagugcaaugaguguggcaaggccuucucucacuccagcaaccugauccuucaucagcggauucacucuggcgaaaaaccuuacgagugcaaugaaugugggaaggcuuucucccagagcuccgaccugacaaaacaucagagaauccacacgggagagaagcccuaugaaugcucugagugcggcaaggccuuuaaccgcaacagcuaccucauccugcaccggcggauucauaccagagagaaaccguauaaguguacaaaaugcgggaaggccuucacccgcuccucuacacuuacccugcaccauagaauccacgcucgggaaagagcgagcgaguacuccccugccagccucgaugcuuuuggagccuuccugaaaucuuguguuuga

SEQ ID NO: 78125 - RNA, 1173 nt, Artificial Sequence
  derived and/or modified sequence opt5 from ZKSCAN3__Homo_sapiens__NP_001229824
auggcccugcucacccccgcuccuggcagccaguccucucaauuccagcugaugaaggcccuucugaaacacgagagcguggggucccagccgcuccaggacagaguccugcaaguucccgugcuugcgcauggaggcugcugucgggaagauaagguggucgcuucucgccugacaccugagagccaggggcuccugaaaguggaagacguugcccugacgcucacccccgaguggacacagcaggauuccucucaaggaaaccugugcagagacgaaaagcaggagaaucacggcagccuugugucccugggggaugagaaacagaccaagagccgggaccucccucccgccgaggaacugccugaaaaggagcauggaaaaaucucuugucaccuucgcgaggauauugcucagaucccgacaugcgccgaagcuggcgagcaagaaggcagacugcagcggaagcagaaaaacgccaccgggggacgcagacauauuugucacgagugcggcaaguccuuugcgcaaagcucugggcucuccaaacaccggcgcauccauacaggagaaaagcccuacgagugugaggaaugcggcaaggccuucauugggagcucugcucuggucauccaccagagagugcauaccggagagaaaccuuaugaaugugaggaaugcggcaaggccuuuucccacagcuccgaccugaucaaacaccagcggacgcauaccggcgagaagcccuacgagugugaugacugcgggaaaacauucucucagagcugcucccuccuggaacaccaucgcauucacaccggagagaagccuuaucaauguagcaugugcggcaaggcuuuuagacggucuucccaucuucugcgccaccagagaauccacacaggggauaagaauguucaggaacccgagcagggagaagccuggaaaagccggauggagucucaacucgagaacguggaaaccccgaugagcuacaaauguaaugagugcgaaagauccuucacgcagaacacaggccugauugagcaucagaagauccacaccggggagaaaccuuaucaguguaaugcgugcggaaagggcuuuacacgcauuucuuaccuuguccaacaucagcggagccacgugggcaaaaacauccugucccaguga

SEQ ID NO: 78126 - RNA, 831 nt, Artificial Sequence
  derived and/or modified sequence opt5 from ZKSCAN7__Homo_sapiens__NP_001275520
augaccacagccggcagagggaaccugggacucaucccccggagcacggcuuuccagaagcaagagggccgccugaccgugaaacaggaaccugccaaucagacaugggggcagggauccucucuucaaaagaacuacccgcccgucugcgagauuuuuagacugcacuuccggcagcucuguuaucaugaaaugagcggcccucaggaggcgcugucccgccuuagagaacugugccggugguggcucaugcccgagguucacaccaaagagcagauccuggaacugcucgugcuggagcaauuucuuucuauucugccuggggaacuccgcacaugggugcagcugcaucaccccgagagcggagaggaagcugucgccgugguugaggacuuccagagacaucuuuccggcucugaagaggugagcgccccugcucagaagcaagaaaugcacuuugaggagaccacagcccugggcaccacgaaagaauccccgcccaccagcccucucucugggggauccgcucccggcgcccaccuggagccucccuacgauccggggacacaucaucugccuagcggagacuucgcgcaguguaccucucccgucccuacacucccccaggugggcaauuccggggaucaagccggagcuaccguucugcggauggugcgcccccaggacacggucgccuaugaagaucuuagcguggacuacacacagaagaaguggaaaucucugacccucucccagagagcucugcaauggaacaugaugccugagaaucaccacagcauggccucccuuggcuggucuacaauggcguga

SEQ ID NO: 78127 - RNA, 867 nt, Artificial Sequence
  derived and/or modified sequence opt5 from ZMAT3__Homo_sapiens__XP_005247763
augauccugcuccagcacgccgugcugcccccuccgaagcaacccagcccuucucccccuauguccgucgcuaccagaagcacaggcacgcuucagcugcccccucagaaaccguucgggcaggaggccucccucccccuggcgggagaagaggaacuuucuaagggcggggagcaagacugcgcucuggaagaacucuguaaaccucuguacugcaagcuguguaacguuacccucaauagcgcccagcaggcccaggcucauuaucaaggcaaaaaccacggaaagaagcugcggaauuacuaugccgcuaacuccugucccccucccgcccgcaugucuaaugugguggagccggcggccacaccugucgugcccguuccuccccagauggggagcuuuaaacccggaggcagagugauucuugcuaccgaaaacgauuacugcaagcugugcgacgccuccuucagcucuccugcugucgcccaggcgcauuaucagggcaaaaaucacgccaagcggcuccgccuggcugaggcccaauccaacagcuuuucugaauccagcgagcuugggcagagacgggcucgcaaagagggaaaugaguucaagaugaugccgaacagacggaauauguacacagugcagaacaauucuggccccuauuuuaacccucgcuccagacaacggaucccccgcgaucuggccauguguguuaccccuagcgggcaguucuacugcuccauguguaaugugggagccggcgaggaaauggaguuuagacagcaucucgaaucuaagcagcacaaaagcaaggucuccgagcaacgguaccgcaacgagauggaaaaccugggguauguguga

SEQ ID NO: 78128 - RNA, 462 nt, Artificial Sequence
  derived and/or modified sequence opt5 from ZMAT4__Homo_sapiens__NP_001129203
augaaaagcuccgacaucgaucaggaccuguucaccgauucuuacugcaaaguguguagcgcccaacucauuuccgagucucagagagucgcucacuaugaaagccggaagcaugccuccaaaguucgccuguacuauaugcuucaccccagagacggcgggugcccugcgaagcggcugcgcucugagaacggaagcgaugcugacaugguggauaaaaauaaguguugcacacucuguaacauguccuuuacgagcgccguggucgccgacucucauuaccagggcaagauccacgcuaaaagacugaaacuucugcucggggaaaagaccccgcugaagacaaccggacugcggcgcaauuauagaugcacaauuuguuccgugagccucaacucuaucgagcaguaccaugcccaccugaagggcuccaagcaccaaaccaaucuuaagaacaaauga

SEQ ID NO: 78129 - RNA, 3204 nt, Artificial Sequence
  derived and/or modified sequence opt5 from ZMIZ1__Homo_sapiens__NP_065071
augaacagcauggacagacacauccagcaaaccaaugaucggcugcagugcauuaagcagcaucuccagaaccccgccaauuuccacaacgcugccacagagcugcuugacugguguggcgauccucgcgcguuucaaagaccguucgaacagucccugauggggugccucacgguggucucucggguugcugcccagcagggauuugaccuggaucuuggcuaccgccugcucgccgugugugcugccaauagagacaaauucacccccaagagcgcugcccugcuguccucuuggugcgaggaacucgggcggcugcuucugcuccgccaucagaaaagcagacaauccgauccucccggaaagcugccuaugcagcccccucuuucuagcauguccagcaugaaaccgacacugucucacuccgacggcagcuuucccuaugauucugugccuuggcagcaaaacaccaaucagcccccugggucccucagcgucgugacaaccguuuggggagugacaaacaccucucagucccaaguccugggcaaucccauggcgaacgccaauaacccgaugaauccuggcgggaaccccauggcuagcggaaugacgaccuccaauccuggccugaacucuccccaguucgccgggcagcagcaacaguuuagcgcuaaggccggacccgcgcagccuuacauccagcaauccauguauggccggccgaacuaccccgggagcggaggcuucggcgccucuuauccugggggacccaaugcuccugccggcauggggauucccccgcauacacgcccucccgcugacuuuacccagccugccgccgcugcggccgcugccgccguggcugccgcggcugccacagccaccgcuacggccacagcuaccguugccgcgcuccaggagacacagaacaaggauaucaaucaauacggacccaugggcccuacccaggccuauaacucccaguucaugaaucagcccgggccgagaggaccugcuagcaugggcggcucuaugaaccccgccagcauggcugccgggaugacccccuccggaaugucuggcccuccgauggggaugaaucaaccccggccucccggaauuagcccuuuuggcacacacgggcagcgcaugccccagcaaacguacccuggccccagaccgcagucccugccuauccagaacaucaaacggcccuacccuggagaacccaauuauggcaaccagcaauacgggccgaauagccaguucccuacccagcccggacaguauccugcgcccaaucccccucgcccgcuuacaucucccaacuacccuggccaaagaaugcccucccagccuagcucugggcaguaucccccuccgaccgugaacaugggacaguacuauaagcccgagcaauuuaauggccagaacaacacauucuccgggagcuccuacucuaauuacagccagggcaacgucaaucggccucccagaccugugcccguggccaacuauccgcacuccccuguccccggaaaucccaccccucccaugacgccuggcucuagcauuccgcccuaccuguccccuagccaagacguuaaacccccuuuucccccggauaucaagccuaacaugucugcucugcccccucccccugccaaucauaacgacgagcuccgccuuacauuccccgugcgggacggggugguccuggaaccguucagacucgagcacaaucuggcuguguccaaccauguuuuucaucugcgcccuaccgugcaccagacccucauguggcggagcgaucuggaacuucaguucaaauguuaucaccacgaggacagacagaugaauacaaacuggcccgccucuguccaaguguccguuaaugccacaccccugaccauugagcgcggagauaacaagacgagccauaagccucuccaccugaaacaugugugccagccgggccggaauaccauccagauuacagucaccgcuuguugcuguucucaccuuuuugugcugcagcucguccacagacccagcgugcgcuccguucugcaagggcugcucaagaaacggcugcuuccugcggaacauugcaucacaaagauuaaaagaaacuucagcucuguggccgcuuccagcggaaacaccacgcugaauggcgaggacggggucgaacagaccgccaucaaggugucccucaaaugucccaucacauuucgccggauucagcugccugccagaggccacgauugcaagcauguucagugcuucgaccuggagucuuaccuucaacucaacugugaacggggaaccuggcgcugccccguguguaauaagacagcucugcuggagggccucgaggucgaucaguauaugugggggauccugaacgccauucagcacagcgaauuugaggaagugaccaucgacccuacgugcuccuggagaccggugcccauuaaaucugaucuucacaucaaggacgauccugacggaauccccagcaaacgguucaagacaauguccccuucucagaugauuaugcccaauguuauggagaugaucgcggcucugggcccggggccuagccccuacccccucccucccccuccgggaggcaccaacuccaaugacuauagcucucaagggaacaauuaccagggccauggaaacuuugauuucccccacggcaauccugggggaacauccaugaacgacuuuaugcaugggcccccucagcugagccaucccccggauaugccuaauaacauggccgcccuggaaaaaccccuuucucacccuaugcaagagaccaugccccacgcuggcuccagcgaccagccucaccccucuauucagcagggacuccaugucccgcacccuuccagccaauccggcccuccccugcaucacagcggcgcgcccccgcccccucccucucagccucccagacagccuccccaggccgcuccgagcucccauccucacucugaucugaccuucaaucccagcuccgcccucgaggggcaagccggagcucagggcgccucugacaugccugaacccagccuggaucuucugccggagcucacaaacccugacgaacugcuguccuaccuugauccucccgaccuccccucuaacagcaaugaugaccugcugucccucuucgagaacaauuga

SEQ ID NO: 78130 - RNA, 4200 nt, Artificial Sequence
  derived and/or modified sequence opt5 from ZMYM2__Homo_sapiens__XP_011533519
augugcauccugcucagcgccguggucaccuggauucccucccuggaccuucugguuuucuuuggcauggauacaucuagcgucgggggacucgagcugacggaccagaccccugugcuucugggcuccacagcuauggccaccucucucacaaacguggggaauagcuucuccggaccggcgaacccccuggugucuagaagcaauaaguuucaaaacuccagcguugaagaugacgaugacguggucuucaucgagccugugcagcccccucccccuucuguuccgguggucgcugaucagcggaccauuacauuuaccuccagcaaaaaugaagaacugcagggcaacgacucuaagaucacgcccuccagcaaagaacucgccucucaaaagggguccgugagcgagaccauugugaucgaugacgaggaagauauggagacaaaucagggacaggaaaagaacuccucuaauuucaucgagcgcagaccucccgagaccaagaaccggacaaaugacgucgauuuuagcaccuccagcuucucucgcuccaagguuaacgccggcaugggcaauagcgggauuacgacagaaccugacucugagauccagauugcuaacgugaccacacuggaaaccggagugagcuccgucaaugacggccaacuugagaacaccgaugggagagacaugaaccugaugaucacacacgugacgucucuccagaauaccaaccugggagauguuagcaauggccuucaguccagcaacuuuggggugaauauucagacauacacccccucucugacaucccaaaccaaaacgggagucggcccguucaacccuggccggaugaauguggccggggacguuuuucagaacggagaaagcgcuacacaucacaaucccgauucuuggaucucccagagcgccuccuucccucgcaaccaaaagcagcccggcguggacucucucagccccgucgcgucccugccuaaacagauuuuucagccgucugugcaacagcagcccaccaagccugucaaagugaccugugccaauugcaagaagccccugcagaaagggcaaacagcuuaucagagaaagggaagcgcccaucucuucuguuccaccacaugccugagcucuuucucccacaaaccugcucccaagaaacuuuguguuaugugcaagaaagauaucacgaccaugaagggcacaaucguggcccaggucgacagcucugaguccuuucaggaguucuguagcaccucuugccugagccucuacgaagauaagcaaaacccgacaaaaggggcgcugaauaagucccgguguaccauuugcggaaaacuuacggagauccgccaugaagugagcuuuaagaacaugacccacaaacuguguucugaccacugcuucaauagauaucggauggccaacggccucauuaugaacugcugugagcagugcggcgaauaccugccuuccaagggggcuggaaauaacguucuggugaucgauggccagcagaagcgcuuuuguugccaaagcugugucuccgaguauaaacagguggggucucaucccagcuuccucaaggaggugagagaccacaugcaggacuccuuucugaugcaaccugaaaaauacggaaaacuuacaaccugcacaggcugucggacccagugccgcuucuuugauaugacgcaguguauugggcccaauggcuauauggagccuuacugcucuacagccuguaugaacagccauaaaaccaaguacgcuaagucccagucucugggaaucaucugccacuucugcaaaagaaauagccucccccaauaucaggccacaaugccggacggcaagcuguacaacuuuuguaauuccagcugcguugccaaauuccaggcucuuucuaugcaguccagcccuaacgggcaauuugucgcgcccucugauauucagcugaaguguaauuauugcaaaaacuccuucuguagcaagcccgaaauccucgagugggaaaauaaggugcaccaguucugcucuaaaaccuguuccgacgauuacaagaaacugcauugcauugugaccuauugugaguacugccaggaggaaaagacacugcacgagacggucaacuuuagcggagugaaacggccuuucuguuccgaaggcugcaagcuccuguauaaacaagacuuugccagacgccuugggcugcggugcguuaccuguaauuacugcagccagcucuguaagaagggagcuacaaaagagcuggauggcguggucagagacuucugcucugaggauuguugcaagaaauuucaggacugguacuauaaggccgcccgcugugauugcuguaaaagccaagggacccugaaggaacgggugcaguggagaggcgagaugaagcauuucugcgaccagcacugucuucuccgcuuuuacugccagcaaaacgaaccgaauaugacaacccagaaaggacccgagaaccugcauuaugaucagggcugccagacgucccggacaaagaugaccgggucugcuccucccccuagccccaccccuaacaaagaaaugaagaauaaagccguucuguguaagccccucacaaugaccaaggcgacauacugcaaaccgcacaugcaaacgaaguccugucagaccgacgacacauggagaaccgaguaugugccuguccccaucccugugcccguuuacauuccggugccuaugcacauguauucucagaacauccccgucccuacaaccgugcccgugcccgucccuguuccgguguuccugcccgcuccucuugauagcuccgagaaaauccccgccgccauugaggagcugaagucuaaagugagcuccgacgcucucgauacggaacugcugaccaugacagacaugaugagcgaggaugaaggaaagaccgagacaaccaauaucaacucugucauuaucgagacagacauuaucggcuccgaucuucucaagaauagcgacccugaaacccagucuuccaugcccgaugugccuuacgagccggaccuggauauugaaaucgacuuuccccgcgccgcugaggaacuggauauggagaacgaguuccuccugccucccguuuuuggggaagaguacgaggaacaaccucggcccagaagcaaaaagaaaggagccaagcgcaaagcgguguccggcuaucagucucaugacgacagcuccgauaauagcgagugcucuuucccguuuaaguacacguauggggucaacgccuggaaacacugggugaagacacggcagcuugacgaagaucugcucguucuggacgagcugaaguccagcaaaucugugaaacuuaaggaagaucuccugagccauaccaccgcugagcugaauuacggccucgcccacuucgucaacgaaaucagacggccuaauggagagaacuaugcucccgacuccauuuacuaucugugucuuggcauccaggaguaccugugcgggucuaaucgcaaggauaacauuuucaucgaccccggauaccaaacauuugaacaggagcucaauaaaauucugagaagcuggcagccuuccauccugcccgauggcucuaucuucagccggguggaagaggacuaucuuuggagaauuaagcaacucgggucccacagcccuguugcccugcugaacacccucuuuuacuucaacacgaaguauuuuggacugaaaacaguggaacagcaucuucgccugucuuucggcaccgucuuucggcacuggaagaaaaauccgcucacaauggagaacaaggcgugucugagauaccagguguccagccugugcgggaccgauaaugaggacaaaaucacaaccggcaagcgcaagcaugaagacgaugagcccguguucgaacagauugagaacacggccaauccuuccagaugucccgucaaaauguuugaaugcuaucuuucuaagagcccucaaaaccugaaucagcggauggacguuuucuaccuccagcccgaguguuccucuagcaccgauuccccggugugguauacaagcaccucucuggaccgcaacacacucgagaauaugcuggugagaguccuucuggugaaagauaucuacgacaaggauaacuacgaacucgacgaggauaccgacuga

SEQ ID NO: 78131 - RNA, 4077 nt, Artificial Sequence
  derived and/or modified sequence opt5 from ZMYM3__Homo_sapiens__NP_001164633
auggaccccagcgauuucccuuccccguuugacccccugacccucccugagaagccccuggccggcgaucuuccuguggacauggaguucggggaagaucugcucgaaucucagacagcucccacgagaggaugggccccuccgggccccagcccuuccucuggggcgcuggaccuucuggauacccccgcuggacucgagaaagacccuggcguccuggauggggccacagaacugcucggacugggcggccuucuguacaaggcccccagcccgccugagguugaccacgggcccgagggaacccucgcuugggaugccggcgaccaaacacuggaaccugggcccggaggccagacccccgagguggugccuccggaucccggggcuggagccaacuccugcucuccugaaggccuucuggagccccucgcgccugacagccccaucacacugcaguccccgcauauugaggaagaggaaaccacgagcaucgccaccgcucggcgcggcucuccugggcaggaggaggaacugccccaaggacagccucagucccccaaugccccucccagcccgucugucggcgagacacucggggacggaauuaacuccagccagaccaaaccuggcgggucuuccccucccgcucaccccagccugccgggagauggccuuacagccaaggcguccgaaaaacccccugagagaaagcggucugaacgcgugagacgggccgagcccccuaagcccgaaguuguggacagcaccgaguccaucccugucagcgaugaggacucugaugcuaugguggacgaucccaaugacgaagauuuuguuccguuccgcccuagacggagcccccgcaugucccugagaucuagcgugucccaacgggccggccgcucugcugucgggacgaaaaugacaugugcccauugcagaaccccucuccagaagggacagacagccuaucagcggaaaggccugccccaacuguuuuguagcuccagcugccuuaccaccuucucuaagaaaccguccgggaagaagacauguacguuuugcaaaaaggagauuuggaacaccaaagacagcgugguggcucagacaggaucuggcggguccuuccacgaauuuuguaccagcgucugccucucccuguacgaggcgcagcaacagcgcccuaucccccagucuggcgauccugccgacgcuacaagauguagcaucugccagaagaccggagaaguucugcaugagguguccaauggcucugugguccaccggcucuguagcgacuccugcuucagcaaauuuagagccaacaaggggcugaaaacgaauugcugugaucaaugcggagccuauauuuacacaaagaccggcucucccgggcccgagcuucuguuccacgaaggacagcagaagcgcuuuuguaacaccacaugccucggcgcuuauaaaaagaaaaauacccggguguacccuuguguuuggugcaagacacuguguaaaaacuucgagaugcuuucccauguggacagaaaugggaagacgagccuguucugcucucucuguugcaccacauccuauaaggucaaacaggccggccugaccggaccgccccgcccuuguagcuuuugccggagaucucugagcgaucccugcuacuacaacaagguggaccgcacaguuuaucaauucuguuccccuagcugcuggaccaaauuucagcggacgucucccgaaggcgggauccaccucuccugucauuacugccacagccuguucuccggaaagccugaggugcuugauuggcaggaccaggucuuucaauucuguugcagagauuguugcgaggacuuuaaacgccugcggggcguggucucucagugugaacacugcagacaggagaagcuccugcaugaaaagcugcgcuucagcgggguggagaaauccuuuuguucugaaggaugcguucuucucuauaagcaggauuucaccaaaaagcugggccugugcuguauuacaugcaccuacuguagccaaacaugccagagaggggugaccgagcagcucgacggcuccacgugggauuuuuguucugaggacugcaaaagcaaguaucugcuuugguacuguaaggcggcucggugccacgccuguaaacggcaaggaaagcugcucgaaacaauccauuggcgcggccagauuagacacuucugcaaucagcagugucugcugcgguuuuauucccaacagaaccagccgaaucuugauacccagagcgggcccgagucucuccugaacucccaaagcccugaaucuaaaccccagacaccuucccagaccaaggucgagaacagcaauaccauccccgugaaaacaagaucugccccgacggcuccuacacccccucccccucccccgcccgccaccccucgcaagaacaaagcugccaugugcaagccccugaugcagaaucggggaguuuccugcaagguggaaaugaaaagcaagggcucccaaaccgaggaguggaaaccucaggucauugugcuccccaucccggugccuaucuucguucccgucccuaugcaucuguacugucagaaggugcccgugccuuucagcaugcccauuccggucccugugcccauguuucuucccacaacccuggaaucuacggacaaaaucguugagacaauugaggaacucaaggugaagaucccuagcaacccgcuggaagcggacauucuggccauggcugagaugaucgccgaggcugaggaacuugauaaagccuccucugaccucugcgaucuggucagcaaucaauccgcggaagggcugcucgaggacugugaucuguucggacccgccagagacgaugugcuugcuauggccguuaagauggcuaacgugcuggacgagccuggccaggaucucgaagccgacuuucccaaaaauccucuggauaucaaccccucugucgacuuccuguuugauugcgggcuugugggcccugaggacguuagcaccgaacaggaccucccgcgcaccaugagaaagggacagaaacggcuggugcuguccgagucuuguagccgcgauuccaugagcucucaacccuccugcacaggccucaauuacagcuauggggucaacgccuggaaguguugggugcagucuaaguacgcuaauggagaaaccuccaaaggcgacgagcugagauucgggccuaagcccaugcggauuaaagaggauauccuugcgugcagcgccgcugaacugaacuauggacucgcccaguuugugcgcgagauuacaagaccuaauggcgaacgguacgagcccgacuccaucuauuaccugugucugggcauucagcaauaucuucuggaaaacaaucgcauggucaacaucuucacggaucucuacuaccugaccuuuguucaggagcucaacaagucucugagcacauggcagccgacccuucugccuaauaacacaguguucuccagaguggaggaggaacaccucugggaaugcaaacagcugggggucuauagccccuuugugcugcuuaauacccugauguucuuuaacacgaaguucuucggacuccaaaccgccgaggaacacaugcagcugucuuuuacaaauguugugcggcagucccgcaaguguaccacacccagaggcaccacaaaagucgugagcauccgguacuaugcuccuguuagacagcgcaaggggcgggacaccggacccggcaaaagaaagcgcgaggaugaggccccuauucucgaacaacgggagaacagaaugaauccgcugcgcugccccgugaaauucuacgaauuuuaucuuucuaagugcccugagagccugcggacgagaaacgacgucuucuaccuccagcccgagcgcuccuguaucgcggaaucuccucugugguauagcgugauucccauggaucgguccaugcuggagucuaugcuuaauagaauccuggcuguucgggaaauuuacgaggaacucgggcgcccgggagaggaggaccuggauuga

SEQ ID NO: 78132 - RNA, 4551 nt, Artificial Sequence
  derived and/or modified sequence opt5 from ZMYM4__Homo_sapiens__XP_011540726
auggacaccgagaugagcgaagauaucgaccacaaccugacacccacgcucgauuccaugucuuacggcaugccuaaucagaccgggagcgagaacucccugcuugacgaagaugacuauuuccucaauucuggagaucuggccggcauuccgguggucgggagcgacaacgaggaugaacaagacuuuuccucuaaggauaaucugguuagcuccauccauacagacgauagccuugagguggagagacgggugacccagcacgaaucugacaacgagaaugaaauucagauccagaacaaacugaagaaagacuuccccaagcaauuugaucaggucuccguguucaaaagcauucgcaaggacuuuucucucguuagagaaaauuccaaggagacauucagcggaaaagaaaagaaccgggaucugaccuacgagcgcgagaaaagacuggacaagccucauaaagaucucgacucucggcugaaguccagcuuuuucgauaaggcugccaaucagguggaggaaacacuucacacccaucugccccagacgccugagaccaacuuucgcgacuccucuuaucccuucgcgaauaaagagagcaucggcuccgaacucgggaacagcuuugcuucuaauaucagaauuaaggaggaaccucuggaugacgaguacgauaaagccauggccccgcaacagggacuucuggacaagaucaaagacgaacccgauaacgcucaggaguauucccacggccagcaacagaagacacaggagggcgaacucaaaauuagcgccgucuucucugugagcggguccccucuggcuccccaacugaccacaggauuucagccuucucucgccagcuccggcaugaacaagaugcugcccagcguuccggcgaccgccgugcgggucucuugcuccggguguaagaaaauccuucagaagggacagacggcuuaccaacgcaaaggcagcacacagcuguucugcucuacccucugucugacaggguauaccgugccucccgccagaccucccccuccccuuaccaagaaaacaugcuccagcuguuccaaggacauucugaauccgaaggaugugaucucugcucaguucgagaacacgaccacaagcaaagacuuuugcucccagucuugucucagcaccuacgaacugaagaaaaagcccauugucacaaucaauaccaacuccaucagcacgaaaugcucuaugugucaaaagaaugccguuauucggcacgaggugaacuaccagaaugugguccauaagcugugcuccgaugcguguuucagcaaauuucgcucugccaacaaucucacaaugaacugcugcgaaaauuguggaggcuauugcuacuccggcagcgggcagugucacaugcugcagaucgagggacaaucuaagaaauucugcagcuccagcuguauuaccgcuuauaagcagaaaucugccaagaucaccccuugcgcucuuuguaagucccugagaagcuccgccgagaugauugaaaacacaaauucucucggcaaaaccgagcuguuuugcagcgugaacugucuuuccgccuaccggguuaagauggugacaucugcugggguccaggugcagugcaauagcuguaaaacguccgcgaucccccaauaucaucuggccaugucugacggaagcauccgcaacuucugcuccuacagcugcguuguggcuuuucagaaccucuucaauaagccuaccggcaugaacucuuccgucgugccccugagccaggggcaagucauugugucuaucccgacaggauccaccguuagcgccggcggcgggucuacauccgccgugagcccuaccuccauuagcucuagcgcugccgcgggacugcagagacucgcugcccagucccagcacgucggcuuugcccggucugugguuaaacugaagugucaacacugcaauagacuuuucgcuacgaaacccgaacugcucgauuauaaggggaagauguuucaguucuguggcaaaaacugcagcgacgaguacaagaaaaucaauaacgugauggccaugugugaguacugcaagauugagaaaaucgucaaggaaaccgugcgcuuuuccggcgcugauaagucuuucuguagcgaagggugcaaacugcuguauaagcaugaccuugccaaacgguggggcaaucacuguaagaugugcuccuacugucuccagacaucuccuaaacuggugcagaacaaucugggaggcaagguugaggaguucugcugcgaagaguguaugagcaaguauaccguccucuuuuaccaaauggcgaaaugcgaugccuguaagagacaggggaaacuguccgaaagccuuaaguggcgcggagagaugaaacauuucugcaaccugcucuguauccugauguuuugcaaucagcagucugugugugaucccccuucccaaaacaaugcugccaacauuagcauggugcaggcugccucugcgggacccccgucccugcggaaggacagcacaccugucaucgccaaugugguuucccuugcuucugcccccgcugcccagcccaccgugaacagcaacuccguccuccaaggggccgugccuacgguuacagcuaagauuaucggagacgcgagcacccagacagacgcccugaaacugccgcccucucagccucccagacuccugaagaauaaagcccuucugugcaagccuauuacccagaccaaagcuacauccuguaagccccacacgcaaaacaaagaaugccagaccgaggauacaccuagccagccccagaucauuguggucccggugccuguucccguguucgucccuaucccccuccaucuguauacccaauacgccccggugccuuuuggcauccccgugccuaugcccguccccaugcugauuccuucuagcauggacuccgaagauaagguuacagagucuaucgaggacauuaaggaaaaacuuccgacccaccccuucgaggcugaucuccuggaaauggccgagaugaucgcggaagacgaggagaagaaaacgcugagccagggggaaucccagacaucugagcacgaacucuuucuggauaccaagauuuucgagaaagaccagggcagcaccuauuccggagaucuugagagcgaagcugugucuacaccucauuccugggaggaggaacugaaucacuacgcccucaagagcaacgccgugcaagaagcugacuccgagcugaagcaguuuucuaaaggcgagaccgaacaggaucuggaggccgacuuccccagcgauuccuuugacccucuuaauaaggggcagggaauccaagcgcgcucucggacaagacgccggcauagagacggcuucccccagccucgccggagagggcggaaaaagagcaucgucgcuguggaaccgcgcucccucauucagggagccuuucaaggcuguagcguuucugggaugacgcugaaauacauguauggcgugaacgccuggaagaauuggguccaguggaagaacgcuaaagaggaacagggagaucugaagugcggcgggguggagcaggccuccagcucucccagauccgacccucucggaagcacccaagaucacgcucugucucaggagagcuccgaacccggcugccggguuagaucuaucaaacuuaaggaggacauucugagcuguacauucgccgaacucucccuggggcugugccaguucauccaggaggugcgccggccuaauggagaaaaauacgaucccgacagcauucuuuaucugugucucggcauccaacaguaccuguuugagaacgggagaaucgauaauauuuucaccgagccguauucccgcuuuaugaucgaacucacaaagcugcuuaagauuugggagccuaccauccugcccaacggcuacauguucucuagaauugaagaggagcaccucugggaaugcaaacagcugggagcguauagccccaucguccugcuuaauacgcugcucuuuuucaacaccaaguacuuucagcugaaaaaugugacagagcaucucaagcuguccuucgcccacguuaugcggcgcaccagaacacuuaaauacucuaccaagaugacauaucugcgguuuuucccuccccuccaaaagcaggaaagcgagccugacaaacugaccgugggcaagcgcaaaagaaacgaagaugacgaggucccgguggggguggagauggcugaaaacacggauaauccccugcgguguccuguccgccuuuacgaguuuuaucuguccaagugcucugaaagcguuaaacagagaaacgacguguucuaccuccaacccgagcgguccugugugccuaauagccccaugugguauucuacauucccgaucgacccuggaacccuggauaccaugcucacacgcauucugauggucagagaagugcaugaggagcuugccaaggcuaaauccgaagacagcgauguugagcugucugacuga

SEQ ID NO: 78133 - RNA, 627 nt, Artificial Sequence
  derived and/or modified sequence opt5 from ZMYM5__Homo_sapiens__NP_001034738
auggagaagugcagcgugggcgggcuggaacucaccgagcagacacccgcccugcuuggaaacauggcuauggccacgucccugauggacaucggcgauucuuucgggcacccugcguguccgcucgucagcagaucccgcaauucucccguugaagacgaugacgaugacgaugacgugguguuuauugagagcauccaaccucccuccauuucugcuccugccaucgccgaucagcggaacuucauuuuugcuagcuccaaaaaugaaaagccccagggaaacuacagcgucaucccuccgucuuccagagaccuggccagccagaaaggcaauaucucugagaccauugugaucgaugacgaggaagauauugagacaaacgggggagcugaaaagaaauccagcugcuucaucgaguggggccuucccggcaccaagaauaagacaaacgaccuggacuuuucuaccuccagccucucccggucuaaaacaaagaccgggguucgcccuuucaaucccggaagaaugaacguggccggcgaucuguuucaaaauggggaguucgcgacgcaucacagcccugaaaugcaucugcagcggcgccucauguccuuuuuccaguga

SEQ ID NO: 78134 - RNA, 1323 nt, Artificial Sequence
  derived and/or modified sequence opt5 from ZMYND10__Homo_sapiens__NP_056980
augggcgaccuggagcuccugcuucccggggaagccgaggugcuggucagaggacuccggagcuucccucugcgcgaaaugggcuccgagggguggaaccagcaacacgaaaaucuugagaagcugaacaugcaggcuauccucgaugccaccguuucucagggagagccgauucaggaacugcuggugacacauggcaaagugcccacgcucgucgaggaacugaucgcgguggagauguggaagcaaaaaguuuuuccuguguucugcagagucgaggacuuuaagccccagaauaccuucccuauuuacauggugguucaccaugaagcuagcaucauuaaccuucuggagacaguguuuuuccacaaagaagucugugaguccgccgaagauaccgugcucgaccugguggauuauugccaucggaagcugacacugcucgucgcccagucuggguguggagggcccccugagggcgagggcagccaggacuccaauccgaugcaagaacugcagaagcaggcugagcugauggaauuugagaucgcccucaaagcucugucuguucuucgcuacaucaccgauugcguggacagccugucccucagcacacugucuagaaugcuuuccacccacaaccugcccugucuccugguggaacugcucgagcacagcccuuggucucggcgcgagggaggcaagcugcagcaauucgaaggguccagauggcauacggucgcccccagcgagcagcagaaacuuucuaagcuggauggacaaguguggauugcgcucuauaaucugcuucuguccccugaagcccaggcucgguacugccucaccagcuuugccaaaggccgccugcugaagcucagagcuuuccugacagacacccuucuggaucagcuccccaaccuggcccaccuucaguccuuucuugcgcaucucacacugaccgagacgcaaccgccuaagaaagaccugguucucgaacagauccccgagauuugggagcggcuggaacgcgagaauagagggaaguggcaggccaucgcuaaacaccagcuucaacacguguucucuccuagcgaacaggaucugcggcuccaggcccgcagaugggcugagacauaucggcuggacguccuggaggccguggcccccgaaagaccccgcugugcuuacugcuccgcggaggccagcaagcgguguucuagaugccagaacgaaugguauuguugccgcgagugccaaguuaaacauugggaaaagcacggaaaaaccugugugcuugcugcccagggcgaccgggccaaguga

SEQ ID NO: 78135 - RNA, 1554 nt, Artificial Sequence
  derived and/or modified sequence opt5 from ZMYND11__Homo_sapiens__NP_001189394
auggccagacugaccaagcggcgccaggcugacacaaaagccauccaacaccucugggcggcuauugagaucauuagaaaccagaagcagaucgccaauauugaucggaucacgaaauacaugagccgcgugcauggcaugcaccccaaggaaaccacaagacagcugucccuugccgucaaagacgggcugaucguugagacccucacagugggaugcaagggcucuaaggcugggauugaacaagagggauauuggcugccuggcgaugaaaucagcauuaaaaagaaaaacaccaauaagcaggagauggggacauaccuucgguucaucgugucccgcaugaaagagagaaaggucaacgaaggaaaguaucggucuuacgaggaauuuaaagccgacgcucagcugcuccugcauaauaccgugauuuucuauggcgccgauagcgagcaggcggacaucgcccgcaugcuguacaaggauacgugucacgagcucgacgaacugcaacuuugcaaaaacuguuuuuaucuguccaaugcuagaccggauaacugguucugcuaccccuguauuccuaaucaugagcucguuugggccaagaugaaaggcuuuggguucuggcccgcuaaggugaugcagaaagaagacaaccaggucgaugugcgguuuuucggacaccaccaucagcgcgccuggaucccuucugagaauauccaagacauuaccguuaacauccacagacugcaugugaagcggagcaugggcuggaagaaagcgugcgaugaacuugagcugcaccagcgcuuucucagagaggggcgguucuggaaguccaaaaaugaagacagaggagaggaagaggccgaaagcucuauuuccagcacaucuaacgagcagcugaaggucacccaagagccccgcgcuaaaaagggccggagaaaucaguccguggaaccuaagaaagaggaaccggagcccgaaacagaggccguguccucuucccaggagaucccuaccaugccccagccuauugaaaaggucagcguuuccacgcaaacaaagaagcugucugcuagcagcccccgcaugcuccaccggagcacccagacaaccaacgacggggugugucagucuaugugccaugauaaauacaccaagaucuuuaacgacuucaaggauagaaugaaauccgaccacaagcgcgagacagaacggguggucagagaggcccuggagaaacuucgcagcgaaauggaggaagagaagcggcaggccgugaauaaagcuguugcgaacaugcaaggagaaauggauagaaaguguaaacaggugaaagagaagugcaaagaggaauuugucgaggaaaucaagaaacuggccacgcagcauaagcagcucauuucucaaaccaaaaagaagcagugguguuauaauugcgaggaagaggcuauguaccacugcuguuggaacacaagcuauugcuccaucaaaugucagcaggagcauuggcacgccgaacacaagcggaccugccgcagaaaacgguga

SEQ ID NO: 78136 - RNA, 465 nt, Artificial Sequence
  derived and/or modified sequence opt5 from ZMYND8__Homo_sapiens__NP_001268698
augcacccccagagccuggccgaggaagagaucaagaccgaacaagagguggucgaaggcauggacauuuccacaagaucuaaagauccugggagcgcugagcggacggcccagaagcgcaaauucccgucucccccucauuccagcaacggacacucuccccaggacaccuccacaagcccuaucaagaaaaagaagaaacccggccuccuuaauuccaacaauaaggagcagagcgaacugagacaugggccuuuuuacuauaugaaacaaccgcugaccacagaucccguugacguggugccucaggauggacggaacgacuucuacugcugggucugucaccgcgagggccaggugcucugcugugaacugugccccagaguuuaucaugcgaagugucuucggcugaccucugagccugagggggauugguuuugccccgaaugugagguguccagcuga

SEQ ID NO: 78137 - RNA, 3336 nt, Artificial Sequence
  derived and/or modified sequence opt5 from ZNF106__Homo_sapiens__NP_001271236
auggugagagagcggaagugcauccugugucacauugucuacagcuccaaaaaggaaauggacgagcauaugcgcucuaugcuccaccauagagaacuggagaaccuuaaaggccgguucgggaucgaaaugguuccccuggugcagaaugagcaagaggcccucgaucuggacggagaaccugaucuuagcucccuggagggcuuucagugggaaggggugucuauuagcuccucuccgggacucgcucgcaagagaagccuguccgagagcucugucaucauggaccgggcccccuccguguauagcuucuuuucugaggaaggcaccgggaaagagaacgaaccucagcagaugguuucccccagcaauucucugcgcgcgggacaaucccagaaggcuacaaugcaccucaagcaggaggugacgccuagagccgccagccugcggaccggcgaacgcgcugagaacgucgccacacagagacggcauuccgcucaacuuucuagcgaucacauuaucccccugaugcaccucgccaaagaccugaauagccaggagcgcagcaucccuccgucugaaaaccaaaauucccaggagagcaacggcgaagggaauugccuuucuagcuccgcgucuagcgcccuggcuauuuccagccucgccgaugcugccaccgacucuuccuguacaagcggagcggagcagaacgauggccagucuaucagaaagaaacggcgcgccaccggggacggauccagccccgaacugccuucccuggagagaaagaauaaacggagaaagauuaagggcaaaaaggagcgcucucagguggaucaacuccugaacaucagccuucgggaagaggaacuguccaaaucucuccagugcauggacaauaaccugcuucaggcuagagccgcucugcagacagccuacguugaggugcaacgccuccugaugcugaagcagcagauuaccauggaaaugagcgcccuccggacgcauagaauccagauucugcaagggcuucaggagaccuaugagcccuccgaacacccugaucagguccccuguagccugacacgcgagcggagaaauucucgcucccagaccagcaucgacgcugcgcuccugccgacaccuuucuuuccccuuuuccuggaaccucccucuucccaugugagccccucuccuaccggagccagccuccaaaucacgacauccccgaccuuucagacacacggcagcgugcccgcuccugacucuuccguccagauuaaacaggagcccaugagcccugagcaagaugaaaacguuaacgccgugcccccguccucugccugcaaugugagcaaggagcugcuggaagcuaaccgggagaucuccgacucuuguccugucuaccccgugauuaccgccagacucagccugccugaauccaccgagucuuuccacgagcccagccaggaacuuaaauuuuccguugagcagcgcaauacacggaacagagaaaauagcccuucuucccaaagcgcgggccugucuuccaucaacaaggagggggaggaacccacgaagggaaauagcggcucugaggcuugcaccuccagcuuccuccggcuguccuuugccagcgaaacaccgcuggagaaagaaccucauucucccgccgaucagcccgagcagcaggcugaaagcacccuuacauccgccgagacccgcgggucuaagaaaaagaaaaagcucagaaagaaaaagagccugcgggcugcccacgugccugagaacuccgacacggaacaagauguccugacagugaaaccgguuagaaaggugaaagcgggaaagcucauuaagggcgggaaagucaccaccucuacaugggaggacagccgcaccggacgggaacaggaguccgugagagaugagcccgacucugauagcucccuggaaguccuugagaucccuaauccccagcuggaagugguugccaucgacagcucugaguccggcgaagagaagccugauagccccucuaaaaaggacauuuggaacuccacagagcagaauccucucgaaacgagccgcuccggcugugacgaggugucuagcaccuccgaaaucgggacaagauauaaagauggcauucccgucagcguggcugagacccaaacaguuaucucuuccauuaagggaagcaagaacucuagcgaaaucuccucugagccgggggacgaugacgagccuaccgaaggauccuucgagggccaucaggccgcugugaaugccauccagauuuuugggaaccugcuguacacgugcuccgcggauaaaaccguccggguguauaaucuugugucucgcaaguguaucggcguuuucgaaggacacacaagcaaagucaacugccuccuggugacccagacauccggcaagaacgccgcucuguacaccgggagcucugaccauacgauuagaugcuacaaugugaaaucccgggagugugucgaacaacuccagcuggaggaucgcgugcuuugccugcacagcagauggcggauccucuaugccggacuggcuaacggcacaguugugaccuucaauauuaagaacaauaaacgccuggagaucuuugaaugucacgggcccagagccgucuccugccuugccacagcucaggagggagcgcggaagcuccuggugguuggcucuuacgacuguaccauuagcgugcgcgaugccagaaacgggcugcuccugcggacccuugaaggccauuccaagacaauccugugcaugaaagucgugaaugaccucguuuucucuggaagcuccgaucaaagcgugcacgcucauaacauccacacgggcgagcuggucagaauuuauaaggggcacaaucaugccgugaccguggucaacauccugggaaaaguuauggugacagccugucuugacaaguuugugcgcgucuacgagcuccagucucacgaucggcuccagguguauggcgggcauaaagacaugauuaugugcaugaccauccacaaguccaugauuuacacaggauguuaugacggcagcauccaggcuguuagacugaaucugaugcaaaacuaccgcugcugguggcauggguguucucugaucuucggcguggucgaucaccuuaagcagcaucugcucaccgaccacacgaauccuaacuuucagacacugaaaugccgguggaagaauugcgaugccuucuuuaccgcgagaaaaggauccaagcaggacgcugccggccacauugaacgccaugccgaggaugacagcaaaaucgauucuuga

SEQ ID NO: 78138 - RNA, 2352 nt, Artificial Sequence
  derived and/or modified sequence opt5 from ZNF107__Homo_sapiens__NP_001013768
augguggccaagcccccugucaugagcuuccacuuugcucaggaccuguggccggagcaaaacaucaaagauuccuuccagaagguuacccucagacgguacggcaaaugcgaauaugagaaucugcagcuucgcaagggguguaaacauguggacgaaugcacaggacacaagggcgggcauaacacggugaaucagugucugaccgccacacccucuaagauuuuucaaugcaacaaauacgucaagguguucgauaaauuuagcaauuccaacagauauaagcggcgccacaccggaaauaaacauuucaaguguaaggagugcucuaagagcuuuuguguucucucccagcugacacagcacagacggauccacacccgcgugaacucuuacaaaugcgaagaguguggcaaagcguucaauugguuuagcacacuuaccaagcauaaacggauucacacgggggagaagccuuauaaaugcgaagaguguggaaaggcuuucaaccaguccagccaacugaccagacauaagaucauucacacagaagagaaacccaauaagugcgaggaaugcggcaaagccuuuaagcaggccucucaccucaccauccauaaaaucauucacacaggcgagaagccuuacaaguaugaagagugugggaaagucuucucccagagcucucaucugaccacgcagaagauccugcacacaggagaaaaccucuacaaaugcaaggaguguggcaaggcuuuuaaucuguucuccaaccuuaccaaucauaaacgcauucacgccggggagaagcccuacaaaugcaaggaauguggcagagcuuucaacaucagcucuaaccugaauaaacaagagaagauucacacaggagggaaacucaacaagugcgaagagugugacaaggccuuuaaucggucccugaaacuuaccgcgcauaagaaaauccugauggaagagaagccuuauaaaugcgaggaauguggaaagguguucaaccaguuuagcacccucacacgccacaaaauuauccauacgggcgagaagccguacaagugcaaagaauguggcaaggccuucaaucaguccucuaaccugaccgagcacaaaaagauccacacagcugaaaaaucuuauaagugcgaggagugcgggaaggccuuuaaucaacauuccaaccugauuaaucacagaaaaaucuacagcggagaaaagcccuauaaaugugaggaaugcggcaaggcuuucaaccggucuuccacccucacacgccauaaaaagauucacaccggggagaagccuuacaaaugugaggaaugcgauagagccuuuagccagucuagcaaucugacggagcauaagaaaauccacacaggagaaaagcccuauaaaugugaggaaugcggcaaggcguucaaccgguuuuccacccuuaccaagcacaaacgcauucauacaggggagaagccuuacaaaugugaggaaugcggaaaggccuucaaucagucuuaccagcugaccagacacaaaaucguucauacaaaggagaaacucaacaagugugaagaguuuggcaaggcuuucaaacaaagcucccaccggacgauccauaagauuauccacaccggcgaaaaacccuauaagugcgaggagcacgggaaaguguuuaaucagagcucuaaccugacaacccagaagauuauccauacaggagaaaaccuuuacaaguucgaggaacacggcaaagccuucaaucuguuuuccaacauuaccaaucauaagaucaucuauacgggggagaaaccgcacaagugugaagagugcggaaaggcuuacaacagauucagcaaucucaccauucacaaacgcauccauacaggcgagaagccuuaucagugcgccgaaugugggaaagccuuuaacugcagcuccacccugaaucggcacaagauuauccauacaggcgagaaacccuacaaguguaaagaaugcggaaaggcuuucaaccugagcuccacccucacggcgcacaagaaaauucauacaggcgagaagccuuauaaaugugaggaaugcgggaaggccuuuaaucaaucuagcaaccugaccacacacaaaaagauccacaccuccgagaagcccuacaaaugugaagagugcggaaagucuuucaaucaguuuagcucccuuaacauucauaaaaucauccacaccggcgaaaagcccuacaaauguggggacuauggcagagcuuucaaucugagcucuaaccucacaacgcauaagaaaauucacaccggagagaagccuuacaagugcgaguaugggaaaacauga

SEQ ID NO: 78139 - RNA, 1722 nt, Artificial Sequence
  derived and/or modified sequence opt5 from ZNF10__Homo_sapiens__NP_056209
auggacgccaagagccugaccgcuugguccagaacacucgugacguucaaagaugucuuuguugacuucacccgggaggaauggaagcugcuugauacagcccagcaaaucguguaccgcaacgugaugcuggagaauuauaaaaaccucgucucucugggcuaccagcuuaccaagcccgacgugauucugagacucgaaaaaggggaggaaccuuggcugguugagcgggagauccaccaggaaacacauccggauagcgagaccgcguuugaaauuaaguccucugugagcucccgcucuaucuucaaggacaaacagagcugcgauauuaagauggagggaauggcuagaaaugaccugugguaucucucccuggaggaagucuggaaaugucgggaucaacuugacaaguaccaggagaaccccgaacgccaccugagacagguggccuuuacacagaaaaagguucucacccaagagcgggugagcgaaucuggcaaguaugggggaaauugccugcuuccugcccagcugguccuccgcgaguacuuccauaaaagagauucccacaccaagagccugaaacaugaccuggugcucaacggccaccaggauucuugugcuuccaauagcaacgagugcgggcagacguuuugucaaaauauccaccugauccaguucgcccggacacauaccggagacaagucuuauaaaugccccgacaacgauaauucccuuacacacggcagcucccugggcauuucuaaggggauccaucgcgaaaaaccuuacgaguguaaggaaugcggaaaguuuuucagcuggagauccaaccucacccggcaccagcugauucacacgggcgagaaacccuacgaauguaaggagugcgggaaauccuuuucucgcuccagccaucuuaucggacaccaaaagacacauaccggcgaggaaccuuaugaguguaaagaaugcgggaagucuuucagcugguuuucccaccuggugacacaucagagaacccacaccggagacaagcucuacacaugcaaucaguguggcaaaucuuucguccacagcucccggcugauuagacaucagcgcacgcacaccggcgagaagccguaugaaugccccgagugugggaaaucuuuccggcaaagcacacaucugauccuccaccagagaacccacguucgcgugcggccuuacgagugcaacgaauguggaaaguccuauagccagagaucucaucuggugguccaccaucgcauucacacaggccuuaaacccuuugagugcaaggauugugggaagugcuucucccggagcucccaucuguacucucaccagagaacccacacgggagaaaaaccuuaugagugucaugacugcggcaagagcuuuucccaaucuagcgcucucaucgugcaccagcgcauccauacaggggagaaacccuacgaauguugccagugcggaaaggccuucauucggaaaaaugaucugaucaagcaccagcgcauucauguuggcgaggaaaccuacaaguguaaccaaugcggcaucauuuuuagccagaacagcccguucaucgugcaccagaucgcgcacaccggggagcaguuucuuacauguaaucaaugcggaaccgcccuggucaacacaucuaaucucauuggcuaucagacgaaccauaucagagaaaaugcuuacuga

SEQ ID NO: 78140 - RNA, 2742 nt, Artificial Sequence
  derived and/or modified sequence opt5 from ZNF112__Homo_sapiens__NP_001076804
augaccaaguuccaggagauggugacauuuaaagacgucgccguuguguucacggaagaggaacugggccuccuggauagcgugcaaagaaaacuuuaccgggacgucaugcuggagaacuuucgcaaucuccugcuuguggcucaccagcccuucaagccugaucugaucucccagcucgaaagagaggagaagcugcugaugguugaaaccgagacaccgcgggacgggugcucuggacgcaaaaaccagcaaaagauggaaagcauucaggaggugaccgucuccuauuuuucucccaaggagcucagcuccagacagacauggcagcaaucugccggcgggcugauccggugucaggauuuccuuaaaguguuucagggaaagaauagccagcugcaagaacagggcaacucccucgggcagguuugggcgggcauuccugugcaaaucagcgaggacaaaaauuacauuuucacccauaucggaaacggcucuaauuauaucaagucccagggguaccccagcuggcgcgcucaccauucuuggagaaaaauguaucugaaggaaucccacaacuaccagugccggugucagcaaauuagcaugaagaaucauuuuugcaaaugugauucugucuccuggcuuagccaccacaacgacaagcuggaggugcaucgcaaagaaaauuauuccugccacgauuguggagaggacaucaugaaggugucucuccugaaccaggagagcauucagacagaagagaaaccuuaccccugcaccggcuacagaaaggccuucuccaaugauuccucuuccgaaguccaucagcaauuucaccuggaggggaaaccuuauacguacagcucuuguggaaagggcugcaacuauagcucccuccugcacauccaucagaauauugaacgggaggacgauaucgagaacucucaccuuaagagcuaccagcgcguucauaccgaagagaaaccguguaagugcggggaauauggagagaacuucaaucacugcagcccccugaacacauacgaacucauucauaccggcgagaugagcuauagacacaauaucuacgagaaagccuuuucucacucccuggaccuuaacagcaucuuccgggugcauacacgcgacgaaccucacgaguacgaagagaaugagaacguguucaaucagucuuccugucugcaaguccaucagaagauucacaccgaagagaaacucuauacggauaucgaauacggcaagagcuuuauuugcuccucuaaccuggacauccagcacagagugcauauggaggaaaauagcuauaacuccgaggagugugggaauggauucucucuggcuagccacuuucaggaucuccaaauuguucauacaaaggaacagcccuacaaacgguaugugugcuccaacagcuucucucacaaucuguaccuucagggccauccuaagauccacaucggggagaaacccagaaaggaacacggaaacggcuuuaauugguccagcaaacugaaggaccaucaacgcguccacaccgggcagaagccguauaaauguaacauuugcggaaagggcuucaaccaucggucugugcucaauguucaccagagagugcauacaggcgagaaaccuuacaagugugaagagugcgauaaaggguuuucccgcagcucuuaccugcaggcccaccaacggguccacaccggagagaagcccuauaagugugaagagugcggcaaaggguucagcagaaacuccuaccuucagggacaucagcgcgugcacaccggcgaaaagccuuauaaaugugaggaaugcgggaagggcuuuagccggucuucccaucugcagggacaccaaagaguccacacaggcgagaaacccuucaagugcgaggaaugugggaaaggauuuagcugguccuucaaucuccagauccaucagcgcgugcacacgggcgagaagcccuacaagugcgaagagugugggaaaggauuuucuaaggcuagcacccugcuggcccaucagcggguucacacaggcgagaaaccuuaucaaugcgacgaaugugggaaguccuucucucagagaagcuaccuccagucccaucaaucugugcacagcggcgagcgcccguauauuugcgaagucuguggaaaaggcuucucccagcgggcguaccugcaggggcaccagagagugcauacccggguuaagcccuacaagugcgagauguguggaaaaggcuuuagccaaucuucccgccuugaagcccacagacgggugcauacagggggaaagccuuauaaaugcgaggucuguaccaagggcuucagcgagucuuccagacugcaggcucaccagcgcgugcacguggaagggcggcccuacaaaugcgagcagugcggcaagggauuuagcggcuauucuucccuccaagcccaucacagaguucauacgggggaaaagccuuacaaaugugaggucugcggaaagggcuucagccagcgcuccaaccugcaggcucaccagagagugcauacaggggaaaaacccuauaagugugaugccugcggaaaaggcuuucgguggagcucugggcugcuuauccaccaacgcgugcacagcuccgacaaguucuacaagucugaggauuauggcaaagacuacccgagcuccgagaaucuccauagaaacgaagauucuguccuguuuuga

SEQ ID NO: 78141 - RNA, 1299 nt, Artificial Sequence
  derived and/or modified sequence opt5 from ZNF121__Homo_sapiens__XP_011526569
auguacuucgugaccgagcacggcgccaucgggcugggcagcuuuagaaacggaaagcucaaacccaagugccagcaucugaauaacauuuucuuuuggcuuaauaaaacauccaacgggauccaaauggcugaaauucacaauggaggcgagcugugugacuucauggaaaacggggagaucuuuucugaacauagcugccucaaugcccacaugggaacggagaacaccggcgauacauaugacugugaugaguacggcgaaaauuucccuaugcugcauaacuccgcgccggcuggggagacccuuucuguccugaaucagugccggaaggccuuuagccugcccccuaacguucaccagcgcacauggauuggagacaaauccuucgaauauucugauugugaggaggccuuuguggaccagagccaccuccaagcuaauagaaucacccauaacggcgaaacacuguacgagcagaagcagugcgggcgggccuucaccuauuccacgagccacgcugugucugucaagaugcauaccguggaaaaacccuacgaguguaaggaaugcggaaaauuuuuccgcuauuccagcuaccucaauucucacaugagaacacacaccggcgagaagccuuacgaguguaaagaaugcgggaaguguuuuacaguuuccagccaucugguggagcacguccggauccauaccggagaaaagcccuaucagugcaaagagugcggccgcgccuucgcgggcagaucugggcuuacgaagcacgugcggauucauacaggagaaaaaccuuacgaguguaacgagugcggcaaggccuauaaccgcuucuaccugcucaccgaacacuuuaaaacacacaccgaggaaaagccguucgaguguaaaguuugcgggaaguccuuuagaagcuccucuugucugaagaaucauuuccggauccacaccggaauuaaacccuauaagugcaaagaauguggcaaggcuuuuacagugagcuccagccuucauaaccacgucaaaauccacacgggggagaagccuuacgagugcaaggauuguggaaaagccuucgcuaccucuucccaacugauugaacauauccgcacacacaccggcgagaagcccuauauuugcaaagaauguggcaagacauuuagagccagcucucaucuccagaaacacgugcggauccauaccggggagaagccuuacaucugcaaugagugcggaaaggcguacaaccgcuucuaucugcugacgaaacaccucaagacacacuga

SEQ ID NO: 78142 - RNA, 1872 nt, Artificial Sequence
  derived and/or modified sequence opt5 from ZNF131__Homo_sapiens__NP_001284477
auggaggccgaagagaccauggaaugccugcaggaguuccccgaacaccauaagaugauccucgacagacugaacgagcaacgggagcaggaucgcuuuacagacauuacgcuuaucguggauggccaccauuucaaagcucacaaggccguccuggcggcuuguagcaaauuuuucuacaaguuuuuccaggaauuuacccaggagccucucguugaaauugaggggguguccaaaauggccuucagacaucugaucgaguuuacauauaccgccaagcugaugauucaaggagaagaggaagcuaaugacguguggaaggccgcugaguuccugcagaugcucgaagccaucaaagcgcuggagguccggaacaaggaaaauucugccccgcuggaagagaacacaaccggcaaaaaugaagcuaagaaacgcaagaucgccgagacaagcaacgugauuaccgaaucccuccccucugcugagagcgagccuguugaaaucgagguggaaauugccgaggggacgaucgaagucgaggaugagggaauugaaacccuggaggaaguggcguccgccaagcagucuguuaaauacauccagagcacaggcuccagcgacgauucugcucuugcccugcucgcugacauuaccuccaaguauagacaaggggaucggaaaggacagaucaaggaggacggcugccccagcgauccuacaucuaaacagguggagggcaucgaaauugucgagcugcagcuuucccacgugaaggaccuguuucacugugaaaaaugcaaucgcagcuucaagcucuuuuaccauuucaaggagcacaugaaaucucauuccaccgagagcuucaagugugagaucugcaacaaaagauaucugcgggaguccgccuggaagcaacaccugaauuguuaccaccucgaagaagggggagugucuaaaaagcagcgcacgggcaagaaaauucaugucugccaguauugugagaagcaauuugaucacuucgggcauuuuaaagagcaccugagaaagcauacaggagaaaaacccuucgagugcccuaacugucacgagcgguuugcccgcaauagcacccuuaagugccaccugacagcuugccagaccggcguuggggcgaagaaaggaagaaagaaacucuacgaaugucaggugugcaacuccguguucaauagcugggaccaguuuaaggaccaucuggucauccacaccggcgauaaaccgaaccauuguacacuuugcgaccugugguucaugcaaggcaaugagcuccggcgccaccugucugaugcccacaacauuuccgaaagacuggugacggaggaaguucucagcguggagacccggguccagacagagcccgugaccucuaugacaaucaucgaacagguugggaaggugcauguccugccucuucuucaggugcaagucgacagcgcucaggugaccguugaacaggugcaccccgaucuccugcaggacucccaaguccaugauucucacaugagcgagcuuccugaacaggugcagguuuccuaccuggaggugggacgcauucagacggaggagggcacagaaguccauguggaggaacuccacguggagagaguuaaccaaaugcccgucgaggugcagaccgaacugcuggaggccgaccucgaucacgugaccccggaaaucaugaaucaggaggaacgggagagcucucaagccgacgcugccgaggcggcuagagaagaucaugaggacgccgaagaccuggagacaaagccuaccgucgauuccgaagccgagaaagcugagaacgaagaccgcacagcccuucccgugcuggaguga

SEQ ID NO: 78143 - RNA, 2121 nt, Artificial Sequence
  derived and/or modified sequence opt5 from ZNF132__Homo_sapiens__NP_003424
auggcccugcccagcccucaggugcucaugggccugccggcccuucugauggggcccgcucaacacaccuccuggccuugcggaucugcgguccccacacucaagagcaugguuacguucgaggacguggcuguguacuuuucccaggaagagugggaacugcuugaugccgcccagagacaucuguaucacucugucaugcucgagaaccuggaacuggugaccagccucggcuccuggcaugggguugagggagagggcgcucacccuaaacagaaugugucugucgaagugcugcaaguucggauccccaacgccgacccuagcacaaagaaagcuaauuccugugauaugugcgggccguuccuuaaggacauucugcaucucgccgagcaccagggaacccagagcgaagagaaacccuacacauguggcgcgugcggccgcgauuuuuggcugaacgccaaucuucaccagcaucaaaaggagcacucugggggaaagccuuucagaugguauaaagaccgggaugcucugaugaaguccagcaaagugcaucucucugaaaaccccuuuaccugucgcgagggcgggaaggucauccugggauccugcgaccugcuccagcugcaggccguggauagcggccagaaaccuuacucuaaucuugggcaacugcccgaaguguguacaacccagaaacucuucgagugcuccaacuguggaaaggcuuuucugaaaagcuccacgcuuccgaaucaccugagaacccacucugaagagauuccuuucacaugccccaccggcggcaacuuucucgaggaaaagagcauccuggggaauaaaaaguuccauacaggagagauuccucacgucuguaaagaaugcggcaaggccuuuucccauagcucuaaacugcggaagcaccagaaguuccauaccgagguuaaauauuacgaaugcaucgcgugugggaagacguuuaaccacaaacucacauucgugcaccaucaacgcauccacuccggagagagacccuaugagugcgacgaauguggcaaggccuucagcaaucggucucaucugauucgccacgagaaagugcacaccggggaaagacccuuugagugccuuaaguguggacgggcuuucagccaguccucuaacuuucugcgccaucagaagguccacacacaggugagaccuuacgaaugcagccaauguggcaaauccuucagccggucuuccgcccucauccagcauuggcgcguucacaccggcgagagaccguacgagugcagcgaaugugggcgggcuuuuaauaacaacucuaaucuggcccagcaucagaaggugcacaccggagagagacccuucgaaugcuccgaguguggccgcgauuuuagccaauccucucaccuucugcggcaucagaaaguccacacaggggagagaccuuucgaaugcugcgacuguggaaaggccuuuagcaacuccucuacgcucauucagcaucagaaagugcacaccggccaacgccccuaugagugcagcgaaugucggaaguccuucagcagaucuuccagccugauccagcauuggcgcauucacacaggggagaagccuuacgaaugcucugaguguggcaaggcuuuugcgcacuccagcacccugaucgagcauuggcggguucacacaaaggaaagacccuaugagugcaaugaauguggaaaauucuuuucucagaacagcauucucaucaagcaucagaaagugcacaccggcgagaagccguacaagugcuccgaaugugggaaauucuucagccgcaagucuucccugaucugccacuggcggguccauacgggagagagaccuuaugaguguagcgaaugcggccgcgccuuuuccucuaauagccaccuugugcggcaucaaagaguccacacacaggagcggcccuacgaaugcauucagugugggaaggcuuucuccgagcgcucuacccuggugagacaucaaaaaguucacacccgggaaagaacauaugagugcagccaguguggaaaacucuuuucccaccugugcaaccuggcccagcauaagaaaauccacaccuga

SEQ ID NO: 78144 - RNA, 2016 nt, Artificial Sequence
  derived and/or modified sequence opt5 from ZNF133__Homo_sapiens__NP_001269925
auggcccacauggcuuucagagacguggccgucgauuuuacccaggacgaguggcggcugcucagccccgcgcaacgcacacuguacagagaaguuaugcuugagaacuauuccaaucuggugucucucggcaucagcuucuccaagccugaacugauuacgcagcuugagcaggggaaagaaaccuggcgggaggagaagaaaugcucuccggcuacaugucccgaucaucaggaauacggaaacaauugcgaccugcaaaaggaggccgauccugaacccgagcucuaucuggacccuuuuugucccccuggcuucagcucccagaaauuuccgaugcagcacgugcugugcaaccaucccccuuggaucuucaccugucucugcgccgaggggaauauucagcccggagauccuggccccggggaccaagaaaagcagcagcaggcuucugagggacgcccguggagcgaucaagccgaaggcccugagggcgaaggggcuaugccccuguuuggaagaacaaagaaacggacccuuggcgccuucucccgcccuccccagagacagcccgucagcucucggaacgggcugcgcggaguggagcucgaggcguccccugcccaaacaggcaauccggaagagaccgacaagcugcuuaaaagaaucgaaguucugggguuuggaacggugaacuguggcgagugcggccucagcuucucuaagaugaccaaucugcugucccaccagcggauucauagcggggaaaaacccuacgucuguggagugugcgagaagggcuuuucucucaagaaaucccuggcucgccaccagaaggcccacagcggggagaaaccuaucguuuguagagaaugcggacggggcuucaaccgcaaguccacacuuaucauucaugagagaacccacucuggggaaaaacccuauaugugcagcgaguguggacggggcuuuucccagaaaagcaaucugaucauucaucaaagaacacacucuggcgaaaaaccuuacgugugccgcgagugugggaagggauucucccaaaagagcgcugucgugcggcaccagagaacccaucucgaggaaaagacgaucgugugcucugauuguggccugggguucagcgaccgcuccaaccuuauuucucaccagcggacacauagcggagagaagcccuaugccugcaaagaauguggcagaugcuuucgccagcggaccacacuggucaaucaccagagaacccauuccaaggagaaaccguacguuuguggggugugcggccacagcuucucucagaacuccacccucaucagccaccgccggacacauacgggagagaagccuuacguguguggcgucugcgggagaggauuuucucugaagucccaccugaaucgccaucagaacauucacagcggcgaaaaacccaucgugugcaaggauugugggcggggauucucccaacagucuaaccucaucagacaccagcggacccauagcggcgagaaaccuaugguuugcggggaauguggccgcggauuuucccagaagucuaaucugguggcgcaccaaagaacacauagcggcgagcggcccuaugucugcagagaaugugggcgcggauucucccaccaggccggccuuauucggcauaaaagaaagcacagccgcgagaagccuuacaugugcagacagugugggcugggauuuggcaacaaaucugcucucaucacccacaagcgggcccauuccgaggaaaaacccugcgugugucgcgagugcgggcaaggcuuccugcaaaagagccaccuuacacugcaucagaugacccacacgggagaaaaaccguauguuuguaagacaugcggcagaggguuuucucucaagucccaucugagccggcaccgcaaaaccaccucugugcaccauagacugccuguccagcccgaccccgagccuugcgcuggacagccgagcgacucccucuacagccuguga

SEQ ID NO: 78145 - RNA, 1425 nt, Artificial Sequence
  derived and/or modified sequence opt5 from ZNF141__Homo_sapiens__NP_003432
auggagcugcucaccuucagagacguggccaucgaauuuagccccgaggaauggaagugccuggauccugaccagcaaaaccuuuaccgggaugucaugcuggagaauuaucgcaaccucguuucccugggcguggcuauuucuaauccggaccuugugacaugucuggaacagagaaaagagcccuacaacgucaagauccacaaaauuguggcccggccucccgcgaugugcagccauuucacgcaggaucacuggccuguucaggggaucgaggacuccuuucauaagcucauucugcgcagauaugaaaaauguggacacgauaaucugcaacuccggaagggcugcaagucucugaacgaguguaaacuucagaaagggggauacaaugaguucaacgaaugccugagcaccacacaguccaagauccuccaguguaaggcuucugugaaagucgugagcaaguuuuccaauagcaacaagcgcaaaaccagacauacaggcgagaagcacuucaaagaaugcgggaagucuuuucaaaaauucucccaccugacccagcauaagguuauccacgccggagagaaacccuauacaugugaagagugcggcaaggccuuuaaguggagccuuauuuucaaugaacauaaacggauccacaccggcgagaagccuuuuacgugugaggaaugcgggucuauuuucaccacauccagccacuuugcuaaacauaagaucauucacaccggagagaaaccguacaagugcgaagaguguggcaaggccuucaaccgcuucacaacccugacgaaacauaagagaauccacgcuggggaaaaacccauuacaugcgaggagugucggaagaucuuuaccucuuccagcaauuucgccaaacauaagcgcauccacacaggagaaaagccuuauaaaugcgaggaauguggcaaggcguuuaacagauccaccacccucacaaaacacaagcggauucauacgggggagaaacccuauaccugcgaagaguguggaaaggccuuccgccagucuagcaagcugaaugagcacaaaaaggugcauacaggcgaaagaccuuacaaaugcgacgaguguggcaaggcuuuugggcgguccagaguccugaacgaacacaaaaagauccacaccggagagaaacccuacaagugcgaggaauguggcaaggccuuccgccggagcacagauagaucucagcauaaaaagauucacuccgcugacaaaccguacaagugcaaagagugcgauaaggccuuuaagcaauucagccuccugucucagcauaaaaagauccacaccguggacaaaccuuauaaguguaaagauugcgacaaggcguuuaagcgcuucagccaucuuaacaaacacaagaaaauucacacguga

SEQ ID NO: 78146 - RNA, 1914 nt, Artificial Sequence
  derived and/or modified sequence opt5 from ZNF143__Homo_sapiens__NP_001269585
augcugcucgcccagaucaacagagacagccaaggcaugaccgaguuccccgggggaggcauggaagcucagcacgugacacugugccuuacggaggccgucaccguugcggauggggacaaucuggaaaacauggagggagugucccuccaggcugugacacuggccgauggcucuaccgccuacauucagcauaauagcaaggacgcuaaacuuaucgaugggcaagucauucagcuggaagacggauccgccgcuuaugugcagcacguuccuaucccgaagucucgggauagccuccgccuggaggacggccaggccgugcaacuggaggauggcacaaccgcguuuauucaucacacauccaaagacucuuacgaucagagcgcccuccaggcuguccagcuggaagacgggaccacggccuauauccaucacgcugugcaaguuccccaguccgauaccauccuugccauucaggcggacggaacaguggccggccugcacaccggggacgcuacaaucgauccugacaccauuagcgcccucgagcaauacgcugccaaggucucuaucgauggauccgaaagcguggccggcacggggaugauuggagagaacgagcaggaaaagaagaugcagaucgugcugcagggccaugcuacaagagucaccgcgaagucucaacaguccggcgagaaagccuuccggugugaauaugacgggugcggaaaacuuuacacaaccgcucaccaucugaaaguucacgagcgcagccacaccggcgauagacccuaucagugugaacaugccgggugcggaaaggccuuugcuacaggcuacgggcucaaaucucacgugcggacgcauaccggagagaagccuuaccgcuguuccgaggacaauugcacaaagagcuucaaaaccuccggcgaucugcagaagcacauuagaacacauaccggcgaacggcccuuuaaauguccuuucgaggggugcggacgcucuuuuacgacaagcaacaucagaaaggugcacguccggacccacaccggcgaacgcccguauuacuguacagagcccgggugcggcagagccuucgcguccgcuaccaauuauaaaaaccaugugcggauccacacaggagaaaagccuuacguuuguacggugcccgggugcgacaaacgcuuuaccgaguauagcucucuguacaagcaucacgucgugcacacacauuccaagccuuauaauugcaaccacuguggcaaaaccuacaagcaaauuagcacacucgccaugcauaaaagaaccgcccacaaugauacggagcccaucgaagaggaacaggaggcuuucuuugaaccgccucccggacagggcgaggacguucugaaggggucucagauuaccuacgugacaggagucgagggcgaugacguggucagcacccaaguggccacaguuacccaguccgggcuuucucaacaggugacgcugaucagccaggacggaacacagcaugucaacauuucccaggcugauaugcaagccaucggcaauaccaucacaauggugacccaggacgggaccccuauuacaguucccgcgcacgaugccgugaucagcucugcuggcacgcacuccgucgccauggugaccgcugaaggaacagagggcgaacagguggccauuguugcgcaggaccucgccgcuuuccauaccgccagcucugagauggggcaccaacagcauucccaccaucuggucacaaccgagacgcggccccuuacacugguggcuaccagcaacggaacccagaucgccgugcagcucggcgaacaaccuucccuggaggaagccauuagaaucgcuucucgcauccagcagggggagacaccgggacuggaugacuga

SEQ ID NO: 78147 - RNA, 879 nt, Artificial Sequence
  derived and/or modified sequence opt5 from ZNF146__Homo_sapiens__XP_005259271
augagccaccugucccaacaaagaaucuacucuggcgagaaccccuucgccugcaaggugugugggaaagucuuuagccauaaguccaaucucaccgaacacgagcauuuccacacacgggaaaaaccuuuugagugcaacgaauguggaaaggcuuucucucagaaacaguauguuauuaagcaucagaauacgcacaccggcgagaagcuguuugagugcaacgaaugugggaaauccuucagccaaaaggagaaucuucugacacaccagaaaauccauaccggagaaaagccguuugagugcaaagacuguggcaaggccuucauucagaagucuaaccucauccgccaccagagaacacauaccggggagaaacccuuugugugcaaggaauguggaaaaacauucagcggcaaguccaaucugaccgagcacgagaaaauucacaucggcgaaaagccuuuuaaaugcagcgaaugugggacggcguucggacaaaagaaguaccuuaucaaacaucagaacauucacaccggcgagaagcccuaugagugcaaugaaugcgggaaggcuuuuucucagcggacaucccugaucgugcauguccgcauucacagcggagauaaaccuuacgaguguaacgugugcggcaaagccuucucucaguccagcucucucaccguucaugugagaucccacacaggggaaaagcccuauggauguaaugagugcggcaaggccuucagccaauuuuccacccuggcucugcaccuccggauccauacgggcaaaaagccuuaccaguguucugaaugcgggaaagccuucagccagaagucccaccauauucgccaccagaaaauccacacacauuga

SEQ ID NO: 78148 - RNA, 2385 nt, Artificial Sequence
  derived and/or modified sequence opt5 from ZNF148__Homo_sapiens__NP_068799
augaacaucgacgauaagcuggagggccucuuccugaaaugcgggggaauugacgaaaugcagagcuccagaaccaugguggucaugggcgggguuucuggacaaagcacaguguccggcgagcuucaggauucugugcugcaggaccggagcaugccccaccaggaaauccucgccgcugaugagguccugcaagaauccgagaugcgccagcaggacaugauuucucaugaugagcuuauggugcacgaagagacgguuaagaaugacgaagaacagauggagacccaugaaagacugccucaagggcuccaguacgcccugaacgugccgaucagcgucaaacaggagauuacauuuaccgauguguccgaacagcugaugcgggacaagaaacaaauccgcgagcccguugaucuccagaagaagaaaaagagaaaacagcggagcccugcgaagauccugacaauuaaugaagacggaucucuuggccugaaaacccccaagucccacgugugugagcauugcaacgcugccuuccgcacaaauuaucaccuccaaagacacgucuuuauccauaccggcgagaagccuuuccaguguagccagugcgauaugcgguuuauucagaaauaccugcuucaacgccacgaaaagauccauacgggggagaaacccuucagaugugacgaaugcggaaugcgguuuauucagaaguaucacauggagcgccacaaaagaacccauucuggcgaaaagccuuaccagugugaguauugccugcaguacuucucccggacagaccgcgugcucaaacacaagagaaugugucaugagaaccacgauaagaaacugaaucggugcgccaucaaagggggacugcucaccagcgaagaggacucuggcuuuuccacaagcccgaaagauaacucccugcccaagaaaaagagacaaaagaccgaaaagaagucuagcgggauggacaaagaguccgcucuugauaagagcgaccugaaaaaggauaagaaugacuaucucccucuguacucuuccagcacgaaagugaaggaugaauacauggucgccgaguaugcuguugagaugccccauucuagcgugggaggcucccaccuugaagacgccucuggcgagauucacccucccaaacuggugcucaagaaaaucaacagcaagcgcucccugaagcagccgcuggaacagaaucagacaaucagcccucucucuaccuacgaggaguccaaagucagcaaguaugcguucgaacugguggauaaacaagcccuucuggacucugaggggaacgcugacauugaucagguugacaaucuccaggaaggacccuccaagccugugcauagcuccacaaacuacgaugacgccaugcaguuucugaaaaagaaacgguaucuucaagcugccucuaauaacagcagagaguacgcgcugaacgucggcaccaucgccucccagcccucugugacccaggcugccguugcuagcgugauugaugaauccacaacggccagcauccucgagucucaagcccugaaugucgagauuaaguccaaccacgacaagaaugugauccccgaugaaguccugcagacccuccuggaccauuauagccacaaagcuaacgggcagcacgagaucucuuucuccguggcggauacagaaguuaccagcucuauuagcaucaauuccagcgaggugccugaagucacaccgucugagaacgugggauccagcucccaggccucuagcuccgacaaggcuaauaugcuucaagaguacucuaaauuucugcagcaggcccucgaucgcaccagccagaacgacgccuaccuuaauucccccucucugaacuucguuacggauaaucaaacacugccuaaccagcccgcuuucagcuccauugacaaacagguguaugccaccaugccuaucaauagcuuucggucuggcaugaacagcccccucagaaccacaccggacaagucccauuucgggcugauugucggagauucucagcacuccuuuccuuucagcggcgacgaaaccaaucaugcgucugcuacauccacgcaagauuuucuggaccaggugaccagccagaagaaggccgaggcccaacccgugcaccaggcuuaccagauguccagcuucgaacagccuuuucgcgcccccuaucauggcucucgggcugggaucgccacacaauucagcaccgcgaacggacagguuaaccucagaggcccugggacauccgccgaguuuucugaguucccccuggucaaugugaacgauaaucgcgcuggaaugaccagcuccccggacgccacgaccggccagacauuuggguga

SEQ ID NO: 78149 - RNA, 1314 nt, Artificial Sequence
  derived and/or modified sequence opt5 from ZNF154__Homo_sapiens__NP_001078853
auggccgcugccacccugagaacacccacgcagggcaccgugacauucgaggacgucgcgguucacuuuagcugggaagagugggggcuccuggaugaagcucaacggugccuuuaccgcgacgugaugcuggagaaccucgcccugcuuaccucccuggaugugcaucaccagaagcagcaucucggagaaaaacacuucagaucuaaugucggccgggcccuguuugugaagacauguaccuuccauguuagcggggagccuuccacaugccgcgaggugggaaaagacuuucuggcuaagcucggcuuccugcaccagcaagccgcucacaccggggaacagucuaacagcaaauccgauggaggcgccaucucucauagaggcaagacgcacuauaauuguggggagcauaccaaggcguuuagcggaaaacacacacuuguccagcagcaacggacccugacaaccgaacgcugcuacauuuguuccgagugcggcaagagcuucucuaaauccuauagccucaacgaccacuggagacugcauacgggggagaagccguacgaaugucgggagugcggaaaaucuuuucgccaguccagcucucuuauccagcacagacgggugcauacagccguucgcccccacgaaugugaugagugcggcaagcuguucuccaauaagagcaaccucauuaaacauagacgggugcacaccggggaacgcccuuaugaguguuccgagugcggaaagucuuuuagccagagauccgcucugcugcaacaccggggcguccauacaggcgaaagacccuacgagugcagcgaaugugggaaauucuuuaccuaucacucuucccucaucaagcaucagaaagugcacagcggaucucgcccuuacgagugcagcgaauguggcaaguccuucucucagaauagcucccugauugagcaccaucgggugcacaccggggagagacccuacaaaugcagcgaauguggaaagucuuucucccaacgcagcgcccuucugcagcaucggggcguccacacaggggagagaccuuaugaaugcucugaguguggaaaguuuuucccguacuccagcucccuccgcaaacaucagcggguucacacgggcucuagacccuaugaaugcagcgaguguggcaaguccuuuacccagaacucugggcugaucaaacaccgccgggugcauacaggagagaagccuuacgaaugcaccgaguguggcaagagcuucucccacaauagcucucuuaucaaacaucaacgcauucacuccagauga

SEQ ID NO: 78150 - RNA, 2349 nt, Artificial Sequence
  derived and/or modified sequence opt5 from ZNF160__Homo_sapiens__XP_005259436
augcuggagaacuacuggaaucucgugagccugggccuuugccacuucgacaugaacaucauuuccaugcuggaagaggggaaggaacccuggaccgucaaaucuuguguuaagaucgccagaaaaccucggacaccggagugcgugaagggaguggucacggauauucccccuaaauguaccaucaaggaccuccugcccaaggaaaaauccuccacagaggcuguguuucauaccguugugcuugagcgccacgaaucuccugauauugaggacuucagcuuuaaggaaccccagaaaaauguccaugauuucgagugccaauggagagacgauacaggcaacuauaagggggugcugauggcccagaaagagggaaagcgggaccagcgcgauagacgggacaucgaaaauaagcucaugaacaaucagcugggcguuuccuuucacucucaucugccugagcuccaacuguuccagggggaaggaaaaauguacgaguguaaccagguggaaaagagcaccaauaacggcuccagcgucucuccgcuucagcaaauccccuccagcgugcagacacaccgcucuaaaaaguaucacgagcugaaucauuuuucccuccugacccagagacggaaagcgaacagcugcggcaagccuuacaaauguaaugagugcgggaaggcuuucacgcagaacucuaaucuuaccucccaccgccggauucauagcggagaaaagcccuauaaauguuccgagugcggcaagacauuuaccgugagaucuaaccugacaauccaccaagucauucacaccggggaaaaaccuuacaagugucaugagugcggaaaaguuuuccgccacaacagcuaucucgccacgcauagacggauccacacaggcgaaaagcccuacaagugcaaugagugugggaaagccuuucgcggacauuccaaccugaccacacaccagcugauucacaccggcgagaagccguucaaaugcaaugaauguggcaagcucuuuacccagaacagccaucugaucucucacuggcggauucauacaggggagaaaccuuacaagugcaaugaauguggaaaggcuuucuccgugagaagcucucuugccauccaccaaacgauccacaccggcgagaaacccuauaagugcaacgaaugugggaaaguguucagauacaauagcuaucugggacgccaucggagaguccacacaggcgagaagccuuacaaaugcaacgagugugggaaggcuuuuuccaugcauucuaaucucgccacccaccaggugauucauacaggaaccaagcccuucaaaugcaacgaauguagcaagguuuuuacgcagaauagccagcuggcgaaccaccgccggauccacacaggcgagaaacccuauaagugcaaugaaugcggcaaagccuucagcgugagaucuucccuuaccacccaucaagcuauucacagcggggagaagccuuacaaauguaucgagugcggaaagucuuuuacacagaagucccaucugcgcagccaccggggcauucauuccggggaaaaaccguauaaguguaacgagugcggaaaagucuucgcccagaccucucagcucgcuagacacuggcgcgugcacacaggcgaaaagcccuacaaauguaaugauugcgggcgggccuuuagcgacagauccucucugacguuccaucaagcgauccacaccggcgagaagccuuacaagugucaugaaugcggaaaaguuuuucgccacaacagcuaucuggccacacaccggagaauccauaccggcgagaagcccuacaaauguaacgagugcgggaaggcuuucuccaugcacagcaaucucacaacccauaaagugauucacacgggagaaaagccuuauaaguguaaccagugcggcaaagucuuuacccaaaauucucaucuggccaaccaccagcggacacacaccggggagaagcccuaccgcugcaaugaauguggaaaagccuucuccgugagaagcucucuuacaacccaucaggcuauccacacgggcaagaaaccguauaagugcaacgagugugggaaggucuuuacacagaaugcccaucuggcuaaccaccggcgcauucacaccggcgaaaaaccuuacagaugcacagaguguggaaaggcguuccgggugagauccagccucaccacccauauggccauccacacaggcgagaaacgcuauaagugcaaugaaugugggaaaguuuucagacagucuagcaaccuggcuucccaucaccggaugcauacgggagagaagcccuacaaauga

SEQ ID NO: 78151 - RNA, 1815 nt, Artificial Sequence
  derived and/or modified sequence opt5 from ZNF169__Homo_sapiens__NP_003439
augagccccggccugcucaccacaagaaaggaggcccugauggcuuuccgggacguggccgucgcguuuacgcagaaagaauggaaacuucuguccucugcucaacgcacccucuacagagagguuaugcuggaaaacuauagccaccuugugucccuggggaucgccuucucuaagccuaagcucauugagcagcuggaacagggagaugagccguggcgggaggaaaaugagcaucugcucgaccugugccccgccgaaccucgcacagaguuucagcccagcuucccucaccuuguggcuuuuuccucuagccaacugcucagacaguacgcccuguccggccaucccacccagaucuucccuuccucuuccgcugggggagauuuucagcuugaggccccgcgguguagcucugaaaaaggcgaguccggggaaacagagggacccgacagcucucugcgcaagagaccuucccggauuagccgcaccuucuuuagcccccaccaaggcgauccugucgaauggguggagggcaacagagaagggggaacagaccuccggcuggcgcagcgcaugucucugggcgggagcgauaccaugcucaagggagccgacacguccgaaagcggcgcuguuaucagagggaauuaucggcugggacuuucuaaaaaguccagccuguucucucaucagaaacaccacgugugccccgaguguggccgcggcuuuugccagagaagcgaucucauuaagcaucaacggacccacacaggggaaaaaccguaccuguguccugagugcggaagacgcuucucccagaaggccucucuuagcauccaucagcggaagcacuccggcgaaaaacccuaugucuguagagagugcgggcgccacuuucgguacaccagcucucugacaaaccauaagagaauccacuccggagagcgcccuuucgugugucaagaaugcggccggggguucagacagaaaauugcucuccugcugcaucagcgcacccaccucgaggaaaagcccuuuguuugucccgagugcggacggggcuucugccagaaagccagccugcuucaacaucagucuucccacacgggcgaaagaccuuuucugugucucgagugcgggcgcagcuuccggcagcagucccugcuucugucucaccaagugacacauagcggagagaagccguaugucugugcggaaugcggccacuccuuuagacagaaagugacccucauccggcaucagcgcacacacaccggggagaagcccuaccuguguccucagugcggaagaggcuucucucaaaaggugacccugauugggcaccagcggacacauacgggcgaaaaacccuaccucuguccugacugcggaagaggcuuugggcagaaggucacccugauccgccaccagcggacacauaccggagagaaacccuaucuuuguccgaagugcggcagagccuucggguuuaaaagccugcucacacgccaccaaagaacccauuccgaggaggagcuguacguugaucggguguguggacagggccuggggcaaaagagccaccuuauuucugaccagcgcacgcacuccggcgaaaagccuugcaucugcgaugaguguggaagaggcuucggguuuaaaagcgcucucauucggcaucagcgcacacacucuggagaaaagcccuaugugugcagagaguguggccggggguucucccagaaaagccaucugcaccgccauagacggaccaagucuggacaccagcugcucccucaagaggucuuuuga

SEQ ID NO: 78152 - RNA, 2136 nt, Artificial Sequence
  derived and/or modified sequence opt5 from ZNF175__Homo_sapiens__NP_009078
augcccgccgacgugaaccugagccagaagccucaaguccucggcccggagaaacaggauggguccugcgaagcuagcguuagcuucgaggacgugaccguggauuuuuccagagaagaguggcagcagcuggaccccgcccaacggugucuuuaccgcgaugucaugcuggaacucuauucucaccuguucgcggugggauaccauaucccuaaucccgagguuauuuuuagaaugcuuaaggagaaagaaccucggguggaggaagcugaggucagccaccagcgcugccaggagagagaauuuggccuggagaucccccagaaggaaauuuccaaaaaggccucuuuucaaaaggacauggugggggaguucacacgggauggaagcugguguuccauccucgaggaacugcgccuggacgccgauagaacgaaaaaggacgagcagaaccagauucagccuaugagccauucugcuuucuucaauaaaaagacccucaacacagaauccaauugcgaguauaaagauccgggcaagaugauccggacccgcccccaccuggccagcucucaaaagcagccucagaaauguugccuuuuuacagaaucccugaagcucaaccuggagguuaaugggcaaaacgaaagcaaugacaccgagcagcuugaugacguggucggaucuggccagcuguucucccauagcuccucugacgcuuguagcaaaaacauccacacaggcgagaccuuuugcaaggggaaucaguguagaaaagugugcggacacaagcaaucccucaaacagcaucagauucacacgcagaagaagcccgauggcuguagcgaaugcgggggaucuuucacccaaaaaucccaucuguuugcccagcagcggauccacagcgugggcaaccugcacgagugcgggaaguguggaaaagcguucaugccucagcucaagcugucugucuaccuuacagaccauaccggcgauauucccugcaucuguaaagaaugcggcaagguuuucauucaacgcagcgagcugcucacacaccagaagacccauacgcggaaaaagccguauaaaugucacgacugcgggaaggccuuuuuccagaugcugucccuuuuuagacaucagcgcacacacucuagagaaaaacuguacgaguguagcgagugcggaaagggcuucucccaaaauagcacccucaucauucaccagaagauccauacaggggaacggcaguaugcuuguucugagugcggaaaagccuuuacccaaaaguccacccugagccugcaccagagaauccauucuggccagaaauccuacguguguauugaaugcgggcaggcuuucauccaaaaggcccaccucauugugcaccagcgcagccauacaggagagaaaccuuaccagugccacaacuguggcaaguccuuuaucucuaagagccagcuggauauucaucaccggauccauacgggcgagaaacccuaugaaugcuccgacugugggaagaccuucacacaaaaaucucaccuuaauauccaccagaagauucauaccggagagagacaccaugucugcagcgaauguggcaaagcguuuaaccagaaguccauccugagcaugcaccagcgcauucauacaggggagaaaccuuacaagugcucugaauguggaaaggccuucaccuccaaaagccaauuuaaggagcaccagcggauccacacgggcgagaaacccuaugugugcacagaaugugggaaggcuuucaacggcagaucuaauuuucauaaacaccagauuacccauacccgcgagcggcccuucguuugcuacaaguguggaaaggccuucgugcaaaaauccgaacucaucacacaccagagaacccacaugggcgagaagccuuaugaaugccuggauugcgggaaaucuuuuucuaagaaaccgcagcuuaagguccaucagcgcauccacacaggagagcggcccuacguguguagcgagugcggcaaggcuuucaacaauagauccaacuuuaauaaacaucaaacgacccacacacgcgacaagagcuauaaauguucuuacuccguuaagggguucaccaaacaguga

SEQ ID NO: 78153 - RNA, 1446 nt, Artificial Sequence
  derived and/or modified sequence opt5 from ZNF177__Homo_sapiens__NP_001166122
auggccgcuggcuggcugaccacauggagccagaacuccgugacguuccaagaggucgccguugacuuuucucaggaagagugggcgcuccuggaucccgcucagaagaaucuuuacaaagacgugaugcuggaaaacuucagaaaucucgccagcgugggguaucagcugugccggcacucccuuaucucuaaggucgaucaagagcagcugaaaaccgacgaacgcgggauucuccagggcgauugugccgacugggagacacagcugaagccuaaagauaccaucgcuaugcaaaacauuccgggaggaaagacaagcaauggcaucaacaccgccgagaaucagcccggggaacauucccuggagugcaaccacuguggaaaguuucggaaaaauacaagauucauuugcacccgcuacuguaagggcgaaaaaugcuauaaguacaucaaauauucuaagguguuuaaccauccuagcacgcucagaucccacguuagcauccauauuggcgagaagacccuggaguucacagacugucggaaggcuuuuaaucaggaaucuucccuucgcaaacaccugagaacccccacagggcagaaauuccaagaguacgaacagugcgauaugagcuuuucucuccacuccagcuguucugugcgggagcagaucccuaccggagaaaagggcgacgagugcuccgauuaugggaaaauuagcccccuguccguccauacgaagacaggaucuguggaggaaggccuugaguguaacgaacacgagaaaaccuucacagacccucugagccuccaaaauugcguucgcacccauuccggggaaaugccguacgagugcagcgauuguggaaaggccuuuaucuuccagucuucccugaagaaacacaugagaagccacaccggcgagaagcccuacgaaugcgaccauuguggcaaaucuuuuagccaguccucucaccugaacgugcauaagcggacacacacgggggagaaaccuuaugacugcaaggaauguggaaaggcguucaccguccccagcucccuccagaaacaugugcgcacacacaccggcgagaagccuuacgaaugcagcgauugugggaaagccuucauugaccaaucuucccugaagaaacacacaagaagccauaccggagagaagcccuaugagugcaaucaguguggcaagucuuuuuccacggggagcuaccuuaucgugcacaaacggacacauaccggagaaaagaccuaugagugcaaagaauguggcaaggcuuuccgcaacuccucuugccugagaguccacguucggacacacaccggcgagaaaccguacaagugcauucagugugagaaggccuuuagcacauccacgaaccucaucaugcauaaaagaauccacaaugggcagaagcugcaugaauga

SEQ ID NO: 78154 - RNA, 1863 nt, Artificial Sequence
  derived and/or modified sequence opt5 from ZNF182__Homo_sapiens__NP_001007089
auggccaagccccagggccuggugaccuucgaggacgucgcuguugauuuuacacaagaagaguggcaguaccucaacccuccgcagagaacgcuguaucgggacgugaugcuugaaaccuacagcaaucugguguucgucgggcagcaagugacaaaacccaaccucauccugaagcuggagguugaagagugcccugccgagggaaaaauucccuuuuggaauuucccugaagugugucaggucgaugagcagaucgaacgccagcaccaagacgaucaggacaagugccugcucaugcaagugggcuuuuccgauaaaaagaccauuaucacaaagucugcgagagacugucaugaguucgggaacauucugcaccugagcaccaaucucguugcuuccauccagcggcccgauaaacaugagucuuuuggaaacaauaugguggacaaccuggaucuuuucagccgcuccucugccgaaaauaaguaugacaacggcugcgccaaacuguuuuuccacacagaguacgaaaagaccaauccugggaugaaaccguauggauacaaggaguguggcaagggccucagacggaaaaaggggcugagccuucaucagcgcaucaaaaacggagaaaagcccuuugagugcacggcuuguagaaaaaccuucuccaagaaaagccaccugauuguccacuggcggacacauaccggcgagaagccuuuugggugcacagaauguggaaaggccuucucucagaaaucccagcucaucauucaccuucgcacccauacgggcgagagacccuucgaaugcccugagugugggaaggcuuuucgggagaaaagcacagugaucauucacuaucgcacccacacaggagagaagcccuacgagugcaaugaaugcggcaaagccuucacccaaaagucuaaccugaucgugcaucagaagacccacacaggcgagaaaacguacgaauguaccaagugcggggaguccuuuauucagaaacucgaucugaucauccaucacagcacacauaccggaaagaaaccgcacgaauguaaugagugcaagaagacauucucugacaaauccacccuuauuauccaccagagaacgcauacaggcgagaagccucacaaauguaccgaaugcggaaagagcuuuaacgagaaauccacccugauuguccaucaacggacacacaccggggaaaagcccuaugagugugacguuugcggcaagacauucacgcagaaaucuaaccucggggugcaccagcgcacccauagcggagagaagccuuuugaauguaaugagugcgaaaaagcguucucccagaaaagcuaccugaugcuucaccaaagaggccauacaggcgagaaacccuaugaauguaacgagugcgagaaggccuuuucucagaaauccuaccugaucauucaccagcggacccauacagaagagaagcccuauaagugcaaugaaugugggaaggcuuucagagaaaagagcaaacucaucauccaccagcgcauucacaccggagaaaagccuuacgagugcccgguguguuggaaagccuuuucucaaaagagccagcugaucauucaucagcggacgcacaccggcgagaagcccuaugcuugcacagaaugugggaaagccuucagagagaaguccaccuuuacaguccaucagcgcacccacacgggagaaaaaccuuacaagugcacagaguguggcaaagcguucacccaaaagucuaaccugaucgugcaucagcggacacacgccgggaagaaagcucacggcagaggacauacccgcaagagcaaauucauggcccacuga

SEQ ID NO: 78155 - RNA, 2256 nt, Artificial Sequence
  derived and/or modified sequence opt5 from ZNF184__Homo_sapiens__NP_009080
auggaggaccugagcucccccgauucuacccuccugcagggcgggcacaaccuucugagcuccgccucuuuccaagaagcugugacauuuaaggacgucaucguugauuucacgcaggaggaauggaaacagcucgacccuggacagagagaucuguuucgggacgugacccuugagaauuacacacaucuggugagcauuggccuccaagucuccaagccggaugugaucucucagcuggaacaggggaccgagcccuggauuauggagccuagcauccccguuggaacaugcgccgacugggaaacccgccuggagaacuccgugagcgcgccugaacccgauauuucugaggaggaacucuccccugaggucaucguggaaaaacacaagagagacgauagcuggucuuccaaucugcuugagagcugggaauaugagggcucucuggagcggcagcaagcuaaccagcagacacucccgaaagaaaucaagguuaccgagaagacgauucccuccugggaaaaagggccugugaauaacgaguucggaaagagcgucaauguguccucuaaccuggugacccaggaacccagcccugaggagacauccaccaaacgcagcaucaagcaaaauucuaaccccgucaaaaaggaaaaguccuguaaaugcaaugaguguggcaaggccuuuagcuacugcucugcccuuauuagacaucagcggacacacaccggcgaaaaaccguauaaguguaacgagugcgaaaaggcuuucagccgcuccgagaaucugaucaaccaucagagaauccacacgggggacaaaccuuacaaaugugaucaaugcggaaagggcuuuauugaggggcccucucucacacagcaccagcggauucauaccggagaaaagccuuauaaaugugacgagugcggcaaggccuucagccagcgcacacaccugguucaacaucagagaauccacaccggggaaaaacccuacaccuguaaugagugcggaaaggcuuuuucccagcggggccacuucauggagcaucagaaaauccacacaggcgaaaagcccuuuaagugcgacgagugugauaaaacguucacccgcagcacacaucugacccaacaccagaagauucauacaggggagaaaaccuauaagugcaacgaauguggaaaagccuuuaacggcccuucuacguucaucagacaccacaugauucauacaggggaaaagccguacgagugcaaugaguguggaaaggcguucucccagcacagcaaccucacccagcaucagaaaacccacacaggcgaaaagcccuacgacugcgccgagugugggaaaucuuuuuccuauuggagcucccuggcucaacaccuuaagauccauaccggagaaaaaccuuacaagugcaaugaguguggcaaggccuucucuuauugcagcucccugacacagcaccggcgcauucauacgagagaaaaacccuuugaguguucugagugcggcaaggcuuucagcuaccucuccaaccugaaucagcaccagaaaacccauacacaagaaaaggccuaugagugcaaagaaugugggaaggcguuuauccggucuagcucccuugccaaacacgagagaauccacaccggagaaaagccuuaccagugccaugaguguggcaagacauucagcuaugggucuucccugauucaacaccgcaaaauccauaccggagagcggcccuacaagugcaacgaauguggcagagcuuuuaaucagaacauucaccucacgcagcauaaacgcauccacaccggggccaagccguacgagugcgcugaauguggcaaagccuuccggcacugcagcucucuggcccagcaucaaaagacacacaccgaggagaagccuuaucaguguaauaaaugcgaaaagacauuuagccaguccagccaucugacccagcaccaacgcauucacacgggagagaaacccuacaaguguaacgaaugcgauaaggcuuucucuagauccacacaucucaccgagcaccagaauacacauaccggcgaaaaaccuuauaacugcaaugagugucggaagaccuuuagccaguccacauaccugauccagcaccaaagaauccauucuggggagaaacccuucggaugcaacgacuguggcaagagcuuucgcuaucgguccgcgcuuaauaaacaccagagacugcacccugggauuuga

SEQ ID NO: 78156 - RNA, 984 nt, Artificial Sequence
  derived and/or modified sequence opt5 from ZNF185__Homo_sapiens__NP_001171586
auggccgcuagagacgagcugggccucgggggagauagccuggaagccaugcccgugccugcggcucggggccgcccgagaaucaccaacgggcccgaggaacuugccgccccuucccccgcugcccuggcugacuacgagggaaaggaugucgccacacggguuggcgaagcguggcaggagcgcccuggggcccccagaggaggccaaggcgacccugcugugccggcccagcagcccgcugauccuucuacgcccgagcggcagagcuccccuucugggagcgaacaacucgugcgcagagaguccugcggaucuagcguccugaccgacuucgaaggcaaagauguggccacaaagguuggggaggcguggcaggaccggcccggagccccgcgcggcgggcagggagauccugcugugcccacccagcaaccugccgaccccuccacacccgagcagcagaauagcccuucuggcuccgaacaguuugucagacgggagagcuguaccucucgcgugagauccccgagcucuugcaugguuacagugaccgucacggcuaccuccgaacaaccccacauuuauaucccugcccccgccagcgagcuugauuccucuagcacaaccaaaggcauucuguucgugaaggaauacgugaacgcuuccgaggucagcucugggaaaccuguuuccgcgcgguauagcaaugugucuagcaucgaggacuccuuugccauggaaaagaagcccccguguggaucuacaccuuacagcgagcgcaccacgggcgggauuugcacauauuguaacagagaaauccgggauugccccaaaaucacccucgagcaucugggaauuuguugccacgaauacuguuucaagugcggcaucuguuccaaaccuaugggggaccugcucgaccagauuuuuauccauagagauacaauucacugcggaaagugcuaugagaaacuguucuga

SEQ ID NO: 78157 - RNA, 1839 nt, Artificial Sequence
  derived and/or modified sequence opt5 from ZNF189__Homo_sapiens__NP_001265160
auggccagccccuccccuccgcccgagucuaaggaagagugggacuaccuggauccugcucagagaagccucuauaaagacgugaugauggaaaacuacggcaaucuggucucccuugauguucugaaccgggacaaggaugaggaacccaccgugaaacaagagaucgaggaaauugaggaagagguggagccucagggggucaucgugacacgcauuaagucugaaaucgaccaggaucccaugggaagagagacguucgaacucguuggccggcuggacaaacagcgcgggauuuuucuuugggagaucccuagagaaagccugacccaagagcagcggauguuccgcgagaauacaaacaucauuagaaagcggccgaauagcgaagagaagugccacaaaugugaagagugcggaaagggcuuugugcgcaaagcccauuucauccagcaccagagaguccauaccggggaaaagcccuuucaauguaacgagugcggaaaaucuuucagccgguccagcuuugugauugagcaccagcgcauccauacaggcgaaagaccuuaugaguguaauuacugcggcaagaccuucucuguuuccagcacacucauucggcaccagcgcauccacaccggggaaagacccuaucaguguaaccaaugcaagcagucuuuuucccagcggagaagccuggugaaacaucaacgcauucacacgggagagaagccucauaaauguucugauugcggcaaggcguucuccuggaaaagccaccugaucgaacaccagcggacccauacaggggagaagcccuaccacuguaccaaaugcaagaaguccuuuucuagaaauagccuccuggucgagcaucagcgcauccacacaggagaacggccgcauaaaugcggcgagugugggaaggcuuucagacuuuccaccuaucugauucagcaccagaaaauccacacgggagaaaagccuuuucucugcauugaguguggcaagagcuucucucgcuccagcuuccugaucgagcaucaacggauucacacaggcgaaagacccuaccagugcaaagagugugggaagucuuuuagccagcuuugcaaccugacccgccaucaacggauccacacaggagacaaaccucacaagugugaagagugcggcaaagccuucuccagaucuagcgggcucauccagcaucagcgcauucacacccgggaaaagaccuaccccuauaaugagacaaaagaguccuuugaucccaacuguagccuggugauccagcaagaaguguacccuaaggagaagucuuauaaaugcgacgaauguggaaagacguucuccgucagcgcccaucugguucagcaccagcggauucauaccggcgagaaaccguaccucugcacagugugcgggaagucuuuuuccagaagcuccuuccugaucgaacaccagcgcauucacaccggagagagacccuaucuuugucggcaaugcggcaaaucuuuuagccagcuguguaaucucaucagacaucagggcgugcacacagggaacaagccucauaagugcgaugaguguggaaaggcuuucucccgcaauucuggccugauccaacaccagcggauucauaccggggaaaaacccuacaaaugcgagaagugugacaaauccuuuucccagcagagaagccuugucaaccaccaaaagauccacgccgaagugaaaacgcaggagacacaugaaugcgacgcuuguggagaggccuucaacugccgcauuucucugauccagcaccagaagcuccauaccgcguggaugcaauga

SEQ ID NO: 78158 - RNA, 804 nt, Artificial Sequence
  derived and/or modified sequence opt5 from ZNF197__Homo_sapiens__NP_001020026
augaccagagagaacguggcccacaaugcucugcggcaggaaggccucgucaaggggaaagacgauacauggaaguggggaacgagcuuccaaggcuccucuagcuccguuugggagaccucucaucugcacuuucgccagcuuagauaccaugaaacaagcgggccccaggaggcccugucccggcuccgcgaacugugcagacgguggcuucgcccugaggcgagaaccaaagcucagauccuggagcuccuggugcuggaacaauuccucucuauucugccgggagagauccggacaugggugcagcuucaccaucccggcagcggggaagaggccgucgcccugguggaggaacuccagaaggaccuggauggaccugcuauucagguucccgugcuugucaaagaccaagauacccugcagaaggugguuuccgccccuggcacaacccugcccccugugcucccgggcagccacaucgcugccgagauuuguccccacccucccacggaccuggucgcguuuaaccuccaggauccucagcaugacucucccgccccggaggcuuccgcccugagccaagaagaaaauccucgcaaccagcuuauggcucugaugcuccugaccgcccagccccaagagcuugugauguucgaggaagugucugucugcuuuacauccgaggaaugggcgugucuggggccuauccagagagcccucuauugggauguuaugcuggagaauuacggaaacgugaccagccugggcuaucggaaguaccgcagacagcggaauaaauga

SEQ ID NO: 78159 - RNA, 1947 nt, Artificial Sequence
  derived and/or modified sequence opt5 from ZNF202__Homo_sapiens__NP_001288709
auggccaccgcuguggagcccgaagaccaggaucugugggaggaagagggcauccucauggucaagcuggaagacgauuucacaugcagaccugagagcguucuucaacgggacgauccggugcuggagacgucccaccagaacuuucgcagauuccgguaccaggaagccgcgucuccccgcgaggcucucauuagacugcgggaacuuugucaucaguggcugcgcccugagagacggaccaaagagcaaauccucgaacugcuggugcucgagcaguuucugacaguccuucccggggaacugcagagcugggugcgcggacagagaccugaguccggcgaagaggccguuacccucguggaggggcugcaaaagcagccccggcgcccuagacggugggucacagugcacguucauggacaggaagugcuuucugaggaaaccguccaccugggcguggagccggaaagccccaaugagcuccaggacccugugcaauccucuacacccgagcagagcccugaagagaccacgcagucccccgaucugggggccccggcugaacaacgcccucaucaggaggaagaacugcagacccuccaggagagcgaaguccccguuccugaggaccccgaucugcccgccgaaagaucuuccggagacagcgagaugguggcccuucugacagcucucucucaaggccuggugaccuucaaagaugucgcggugugcuuuucccaggaccaguggagcgaucuugacccuacacagaaggaguucuauggcgaauacguucuggaggaagacugugggauuguggucucucucuccuuuccgaucccccggccugaugagauuagccaagugagagaagaggagcccuggguuccugacauccaggaaccccaggagacccaggaaccggagauccuguccuucacguauacaggagaucgcucuaaagacgaagaggagugccuggaacaagaggaucucagccuggaagacauucaccggccugugcuuggcgagcccgaaauccaccagaccccugauugggagauugucuuugaggacaaccccgggagacugaaugaacgccgguucggaacaaacaucucccaggugaauagcuuugucaaccucagagagaccaccccugugcauccccugcuuggccgccaccaugauuguucuguuugcgggaaguccuucacauguaauagccaccuggugcggcaccucagaacgcauaccggagaaaagccguacaaaugcauggaguguggcaagucuuauacacgcagcucccaccuggcccggcaucagaaaguccacaagaugaacgcuccuuacaaauauccccugaauagaaagaaccucgaggaaaccucucccgugacacaagccgagcgcaccccuagcguugaaaagccguaccggugcgacgauuguggcaaacauuuuagauggacguccgaccuggugcggcaccagcgcacacacaccggggagaagcccuucuucugcaccauuugcggaaagagcuuuucucagaaauccguccuuacaacccaucaaagaauccaccugggcgggaaaccuuaccucuguggagaaugcggcgaggacuucagcgagcaucggagauaucuggcucaccgcaagacacacgccgcggaggagcuguaccuuuguucugaaugcgggcgguguuuuacgcauuccgccgcuuucgccaaacaccucagaggacaugcuagcgugcgccccugcagauguaaugagugcggcaaguccuuuucucggcgcgaucaccuggugagacaucagcggacccacacaggcgaaaagccuuucaccugucccacaugcgggaaauccuuuagccgcggauaucaccugauuagacaucagcggacccacucugagaagacgagcuga

SEQ ID NO: 78160 - RNA, 1665 nt, Artificial Sequence
  derived and/or modified sequence opt5 from ZNF205__Homo_sapiens__XP_005255615
augagcgccgacggcgggggaauccaggauacccaagacaaggagacacccccugaagugccggauagaggccacccccaucaggagaugccuuccaaacugggggaagcuguccccucuggagacacgcaggagagccuccacauuaagauggaaccugaggagccccauuccgaaggcgccucucaggaggauggggcgcaaggagcuuggggcugggccccucugagccacggcuccaaagaaaaggcccuuuuccugcccgggggagcucuccccucuccucggauccccguucugagccgcgagggcagaacccgggaccgccagauggccgcugcccuucugacagcguggucccagaugccugugaccuuugaggauguggcccucuaccugagcagagaagagugggggcggcuggaccauacacagcaaaacuucuaucgcgauguccuccagaaaaagaauggacugucucuuggcuuucccuucuccagaccguuuugggcuccucaggcccacgggaagggagaagcuagcggcagcucccggcaggccggcgacgagaaagaauggcgcggggcgugcaccggagccguggagguuggccaaagagugcagacaagcucugucgcugcccuggggaacgugaagcccuuccggacccgcgcuggaagaguucaguggggcgugccucaaugugcccaggaggccgcuugcgggcgguccagcggacccgcgaaagauuccggccagcccgccgaaccugaccgcacgccggaugcugccccgccugaccccucuccuaccgagccccaggaauacagagucccggagaagccuaaugaagaggagaaaggcgcccccgaaagcggggaggaaggacucgcuccugacuccgaggugggccggaagucuuauagaugugaacaaugcgggaagggauuuucuuggcacucccaucuggugacacaccgccggacccauacaggcgagaaacccuacgccuguaccgauugcgggaagagauucggccgcagcucucaccuuauucagcaccagaucauucauacgggagagaaaccuuauacaugucccgcgugcagaaagagcuuuucccaccauucuacccugauccagcaccaacggauccauacaggcgaaaaaccguacgucugugaccgcugcgcuaagcgguucaccagacgcagcgaucucguuacccaccaggggacacacacgggagccaaaccucauaagugucccauuugcgccaagugcuuuacccaguccagcgcucuggugacacaccagcggacccauacaggcgugaaacccuauccuuguccggagugcgggaaguguuucucucaaagauccaaccugaucgcccacaaucgcacccacacgggagaaaaacccuaccauugccucgacuguggcaagagcuuuucucacuccagccaucugacagcucaccagcggacccauagagggguccggccuuacgccugcccccuuuguggcaaauccuucucucgcagaagcaaccugcaccggcacgagaagauucauaccacaggaccuaaggcgcucgccaugcugaugcuuggcgcugccgcugccggggcgcuggccacacccccucccgcuccgaccuga

SEQ ID NO: 78161 - RNA, 1599 nt, Artificial Sequence
  derived and/or modified sequence opt5 from ZNF20__Homo_sapiens__NP_066966
augauguuccaggacagcguggccuuugaggaugucgcuguuuccuucacccaagaagagugggcccugcucgaccccucucagaagaaccuguacagagaugugaugcaggaaacauuuaaaaaucuuacgagcgugggcaagaccuggaaaguccagaacaucgaggacgaauauaagaauccucggcgcaaccugucccucaugagagagaaacugugcgagucuaaggaaagccaccauuguggggaguccuucaaucaaauugcggaugacaugcuuaaccggaagacacugccgggaaucacccccugcgaaucuagcguguguggcgagguugggacaggacacuccagccucaauacccauauucgcgcugauacaggccacaaaucuuccgaguaccaggaauauggggagaacccuuacagaaauaaggaaugcaaaaaggccuuuagcuaucuggacucuuuccagucccaugauaaagccuguaccaaggagaagcccuacgacggaaaagaaugcacggagaccuuuaucagccacucuuguauucagcggcaccgcgugaugcauuccggcgauggcccuuauaagugcaaauucugugggaaggcuuuuuacuuccugaaccucugccugauccacgagagaauccauacaggagucaaacccuacaaguguaaacaaugcggcaaggccuuuacccggagcacaacccuuccugugcacgaacgcacgcacacagggguuaaugcugacgagugcaaggaauguggaaacgccuucuccuuuccgucugagauuagacggcauaaacgcagccacaccggcgaaaagcccuaugagugcaaacagugugggaagguguucaucuccuucagcucuauucaguaccauaaaaugacacacaccggagagaagccuuaugaaugcaagcaguguggcaaagcguuuagaugcggcucccaucugcaaaagcacgggcggacccacacaggagagaaacccuacgaaugucgccagugcggcaaggccuucagauguacgagcgaucuccagcggcaugagaaaacccacacagaagacaagccuuaugggugcaagcaauguggaaaaggcuuuagaugcgcuucucagcugcagauccaugagcgcacccacagcggggagaagccccacgaaugcaaagaguguggaaaggucuucaaauacuuuuccucucuucggauucaugaaagaacacacaccggcgagaagccgcaugagugcaagcaguguggcaaagccuuccgcuauuuuagcucccugcacauccaugaacggacgcacacaggggacaagccuuacgagugcaaaguguguggaaaggcuuuuaccugcucuagcuccauuagauaccacgaacgcacccauacaggcgagaaacccuaugaauguaagcacugcgggaaagccuucaucagcaauuacauccgguaucaugagagaacccacacaggagagaagccuuaccaauguaagcagugcggcaaagcguucauucgcgccucuuccugucgggaacaugagagaacgcacaccaucaaccgcuga

SEQ ID NO: 78162 - RNA, 1488 nt, Artificial Sequence
  derived and/or modified sequence opt5 from ZNF212__Homo_sapiens__NP_036388
auggccgagagcgcucccgccagacaccggcgcaagagacgguccaccccucugacaucuagcacgcucccgucccaggcgaccgaaaaaucuagcuacuuccaaacaaccgagaucucccuguggacaguggucgcugccauucaggccguugaaaagaaaauggagucucaggcugcccgccuucagagccuggaaggcagaaccgggacagcugagaagaaacucgccgacugcgagaagauggcgguggaauuuggaaaccaacuggagggcaagugggccgugcuugggacccugcuccaggaauauggacugcugcagcggcgccucgagaaugucgagaaccugcuuagaaaucggaacuucuggauccugcgccuucccccuggcuccaaaggggaagcucccaaggugagcagaucucuggagaaugauggaguuuguuuuacggaacaggagugggaaaaccuugaggacuggcaaaaagagcuguaccggaaugugauggaauccaacuaugagacccucgucagccugaaggugcugggccagacagaaggcgaggccgaacucgggaccgagaugcugggagaucuugaggaagagggcccugggggagcucaucccgccggcgggguuaugauuaaacaggaacugcaguacacacaagagggaccugcggaccucccgggcgaguucucuugcaucgccgaggagcaggcuuuucugucccccgaacagaccgagcuuuggggcgggcaaggaagcucugugcugcucgaaacgggcccuggggauuccacacuggaggagcccgucggaagccgcgugccuuccucuagcagaaccgugggcugucccaagcagaagucccaccggcagguccagcuggaccaagaaugcgggcagggacucaaacugaagaaagauacaagccgcccguaugaguguucugaaugcgagauuaccuucagauacaagcagcagcuugccacccaucugcggucccacagcggcuggggcucuuguacaccugaagaacccgaggaaagccucagaccucgcccccggcugaaaccccaaacgaagaaagcuaagcuccaucagugcgacguuugucugagauccuuuucuugcaaggugagccucgugacccaccagcgcugucaucugcaggaggggccuuccgccggacaacacguccaggaacgguucagcccgaauagccugguggcccuccccggccacaucccuuggagaaaaucccgcagcucucugaucugcggguauugcggaaaguccuuuagccaucccuccgaucuuguucggcaccagcgcauucacacaggcgagagaccuuacucuuguaccgaaugcgagaaaucuuucgugcagaagcaacaucugcuccagcaccagaaaauccaucaacgggagagagggggccuggcucuggaacccggacgcccgaacggccuucucuga

SEQ ID NO: 78163 - RNA, 1821 nt, Artificial Sequence
  derived and/or modified sequence opt5 from ZNF214__Homo_sapiens__XP_006718371
auggccgugaccuucgaggacgucacaaucauuuuuacgugggaagaguggaaguuccuggauagcucccagaaaagacucuaccgggaaguuaugugggagaacuauaccaaugugaugucuguggaaaacuggaaugagagcuacaagucccaagaggaaaaauuucgcuaucuggaguacgaaaacuucucuuauuggcagggcugguggaaugcuggggcccagauguacgagaaccagaauuauggagagacaguccaaggcaccgacagcaaggaucuuacacagcaggacagaucccagugccaagaauggcugauccucucuacccaggugcccggguacggaaacuacgagcugacauuugaaagcaaaucccuucggaaucugaaguauaagaacuucaugccuuggcagagccucgagaccaaaacgacccaggauuacggccgcgaaauuuauaugucugggucccacggauuucaaggcggcagauaccggcuggggaucagccgcaagaaucugucuauggagaaagagcagaagcucauuguucagcauuccuauaucccgguggaagaggcgcugccccaauacgucggagugaucugucaggaagaccuucugagagauagcauggaggaaaaauauugcggcuguaacaagugcaaggggauuuacuacuggaauagccgguguguuuuccacaaacgcaaccagccuggagagaaucucugccaguguuccaucugcaaggcuuguuuuagccaaagauccgaccuguaucggcauccccgcaaccacauuggcaaaaagcuguacgggugcgaugagguggacggaaacuuccaucagucuagcggcguccacuuucaccagagagugcauaucggcgaagugccuuauuccuguaaugccugcgggaaaucuuucucucagauuuccagccugcacaaccaucaacggguccacacagaggaaaaguuuuacaaaaucgagugcgauaaggaccucucucgcaauagccugcugcacauucaucagagacuccacaucggagaaaagcccuucaaauguaaccagugcggcaaguccuucaaucggucuagcguucugcaugugcaccagagagugcauaccggggagaaaccuuauaagugugaugagugcggaaaaggcuuuucccaaagcucuaaccuucgcauccaccagcugguccacacaggggaaaaguccuacaagugugaggacugcggaaaaggcuucacccagcggagcaaucuccagauucaucaaagagugcacacgggcgaaaagccguauaaaugugacgauugcgggaaggacuuuucucauuccagcgaucugcgcauccaccagcggguucacacaggagagaaacccuacaccuguccugagugcggcaagggguucuccaagucuagcaaacuucauacacaccagagagugcauaccggagaaaagcccuacaaaugugaggaaugcggcaagggguuuucccaacgcucucaccuucucauucaucagcggguccacaccggcgagaaaccuuauaagugccacgacuguggaaagggcuucagccauuccagcaaccugcacauccaucagagagugcacacaggggaaaaacccuaccagugcgccaaguguggaaaaggcuuuucucauuccagcgcucugcgcauucaccaacggguucacgccggggagaagccguauaaaugcagagaguacuauaagggauucgaucauaauucucaccuccauaacaaucaccgccggggcaaccuguga

SEQ ID NO: 78164 - RNA, 1554 nt, Artificial Sequence
  derived and/or modified sequence opt5 from ZNF215__Homo_sapiens__NP_037382
augcagccccugagcaagcucauggccaucuccaaaccuagaaaccugucucuucgggagcaacgcgaagugcugagagcugacaugagcuggcagcaggagaccaauccggucguugaaacacacgauuccgaggccucucggcagaaguuccgccauuuucaauaccucaaagugagcggcccccacgaagcgcugucccagcuuugggagcugugccuccaguggcugagaccugagauucauacgaagaaacagaucauugaacugcucgugcuggagcaauuccuugcuauccugcccgaagagguccggaccugggugaaccuccagcacccuaauaacucuaaggacaugguuacacugauugaggaugugaucgaaaugcuugaggacgaagauaugcccuguaaggacagcgcccugcagaugggguccaucaaagagaagaugaaagccggaagccgcaccggcaagccucaggaaccggucacauuuaaagaugugguuguggaguucucuaaggaggaaugggggcaacucgacuccgcugucaagaaucuguauagaaacgugaugcuggagaauuuucggaaccucaauagccugcgcaaagcccaucuucugucuaagcccuucgaaucccucaaacuggagagcaagaaaaagagauggauuauggaaaaagagaucccucggaagaccauuuuugauaugaagucuaucuccggagaggaaagcucccacggcgugauuaugacacgccuuaccgagucugggcaccccagcuccgacgcuuggaaaggagaaaacuggcuguacagaaaucagaagaaaugggauaucaaccucccucaggaggccuucauucccgaaacgaucuauaccgaggaggaagacuuugagugcagcgaaaauaagaaaucuuucgauaucaacuccgucagcucuauuugugcgauccaaguuggcauuccgagccggaagggcuccccuaagugcgacaaauuuaagacauacuucaaauuuaaucuggacucuguggggaagcagcauagcgaguaugaguacggaaacgaucugucccucagcaccgacauccgccaccagaaaucucauacaaccaugaacuccuaugaauguuaccagugcggcaaggccuucuguagaucuagcucccugauucggcaccaaaucauccacacgggggagaagcccuacaaaugcagcgaauguggaagauucuuuaaucgccggacaaaccuuaccaagcaucagaaacugcacgcugaggccaaggcuugcacauccaauaaauguggcaaggccuucucuaagagcgaagauuccaacaauccuacccuccauuuugggaacaauuucuaucagugcgugaacugcggaaaaucuuuuaauagaagcuccagccugauucgccaccagaugauccauaccggcgagaagcccuucaaauguaaggagugcucuaaagcguuuaaccgguccagcaaucuugucaagcaccaaaaacugcacacaagagacaagucuuga

SEQ ID NO: 78165 - RNA, 3147 nt, Artificial Sequence
  derived and/or modified sequence opt5 from ZNF217__Homo_sapiens__NP_006517
augcagagcaaggugaccggcaacaugcccacacaaucccugcucauguacauggacgggccugaggucaucggaucuagccugggcuccccgauggaaauggaggaugcccuuucuaugaaagggacggcuguugugcccuucagagccacccaggaaaagaaugugauucagaucgagggauauaugccucuggacugcauguuuuguagccagacauucacccacuccgaagaucucaacaaacauguccugaugcaacaccggcccacacuuugcgagccugcggugcugcgcguugaggcugaauaccucucuccccuggacaagagccaggugagaaccgagccuccgaaagaaaagaauuguaaggagaacgaguuuuccugcgaagucuguggccagacauuccggguggccuuugauguugagauucauaugcgcacccacaaagacagcuucacguaugggugcaauauguguggaagacgguuuaaggaacccugguuccugaaaaaccauaugcgcacccacaauggcaagucuggcgccagauccaaacuccagcaagggcuggagagcucuccugcuacaaucaacgaagugguccaggugcacgccgcugaguccauuagcucucccuacaagaucugcaugguguguggauuucuuuucccuaauaaggagucccugaucgaacaucggaaaguccacaccaagaaaacagccuuuggcaccagcuccgcgcagacggauucuccccagggaggaaugccgagcucccgcgaggacuuccuccaacuguuuaaccuuagaccuaagagccaucccgaaacaggcaaaaagccuguucggugcauuccccagcuggaucccuucaccacauuccaggccuggcaacucgcuaccaaagggaagguggccaucugucaggaggugaaggaaucuggacaggagggcuccaccgacaaugaugacagcucuagcgagaaagaacugggcgagacaaacaagggguccugcgcuggacugucucaggaaaaagagaagugcaaacacagccacggcgaagccccuuccgucgaugcggacccgaagcuccccagcucuaaggagaaaccuacgcauuguuccgagugcgggaaggccuuucgcaccuaucaccaacuggugcuucauagcagaguucacaaaaaggaccggcgcgcuggagccgaaucucccacaauguccguggauggcagacagccugggaccuguagccccgaccuggcugccccgcucgaugagaauggagccgucgaccggggcgaaggcggguccgaggauggaucugaggacggccugccugaagggauucaucuugauaaaaacgacgauggaggcaagaucaagcaccugacaagcuccagagagugcucuuacugugggaaauucuuucgcagcaauuauuaccucaacauucaucugcggacccacacgggcgaaaagcccuacaaaugcgaguucugugaauaugcugcggcccagaagacaucccugagauaccaccucgagcgccaucacaaagagaagcagaccgacguggcugccgaaguuaagaacgaugggaaaaaucaagacaccgaggacgcccugcuuacagcugauagcgcccagaccaagaaccugaaacgguuuuucgacggcgcgaaggaugugacagggucuccucccgcuaaacagcucaaggaaaugccuuccgucuuucagaaugugcugggaagcgccguccuuucucccgcccacaaagacacgcaagauuuccauaagaacgcugccgacgauuccgcugacaaggugaauaaaaacccgaccccugccuaucuggaucuccugaagaaaagaagcgcgguugagacacaggccaauaaccugaucugccgcaccaaggcugacgugacaccgcccccugauggcucuaccacgcacaaucucgaagucagcccgaaagagaagcagaccgagacagccgcugacugucgguacagacccuccguggauugccaugaaaagccucugaaccuuagcguuggggcccugcacaauugucccgcgauuucucucuccaaaagccugaucccuuccauuaccugccccuuuugcacauucaagaccuuuuauccugaggugcugaugaugcaucagcgccuugaacacaaauacaaccccgacguccacaagaauugucggaacaaaucucuccugagaagccgccggacgggaugcccgccugcccugcucggcaaggacgugcccccucuguccucuuucuguaagcccaaacccaagagcgcuuuuccugcccaauccaaaucucuucccagcgcuaaggggaaacaguccccucccggccccggaaaggccccucugacaagcggcaucgauucuuccacccucgccccgagcaaucugaagucucauagaccccagcaaaacguggggguucagggagcugcgacacggcagcagcaauccgagauguucccuaaaaccagcgucucucccgccccugacaagaccaaacgccccgaaacaaagcugaaaccucuuccgguggcucccucccagccuacgcucggcagcuccaacaucaaugggagcauugauuaucccgccaagaacgacucuccuugggcucccccgggaagagauuacuucugcaaucggagcgccuccaacaccgccgcggaguuuggcgagccucugcccaaaagacugaagucuagcguggucgcucucgacguggaucagcccggggccaauuaccgccggggcuaugaccugccuaaguaccacaugguuagaggaaucacaucccuucugccccaggauuguguguauccuucucaagcccucccgcccaaaccucgcuuccugagcuccucugaagucgacagccccaacgugcugaccguucagaagccuuacggcggguccggaccccuuuauacaugcgugccggcuggcagcccugccucuuccagcacccucgaggggaaaagacccgucucuuaccagcaucuguccaauagcauggcgcagaagcggaacuaugaaaauuuuauuggaaacgcucacuaccgcccuaaugauaaaaagacguga

SEQ ID NO: 78166 - RNA, 2124 nt, Artificial Sequence
  derived and/or modified sequence opt5 from ZNF224__Homo_sapiens__XP_005259278
augaccacauucaaggaggccaugacguuuaaagacguggcugucguuuucaccgaagaggaacugggccuccuggaucuugcccagagaaagcuguaccgggacgugaugcucgagaacuuucgcaaucugcuuagcguggggcaccaagcguuccauagagauacauuucacuuccugcgggaagagaaaaucuggaugaugaagaccgcuauucagcgcgagggaaacuccggcgacaaaauccagacagaaauggagaccgucucugaagccgggacacaucaggaguggagcuuucaacagauuugggagaagaucgccuccgaucucaccagaucucaggaccugaugauuaauagcucccaguucucuaaggaaggagauuuucccugccaaacggaggcuggccugagcgugauccacacccggcagaaauccagccaggggaacggauauaagccuucuuucuccgacguuagccauuuugauuuccaccagcaacuccacucuggcgaaaaaucccauacaugugacgagugcggcaagaauuuuuguuacaucagcgcccugcgcauucaccagagagugcauaugggggaaaaaugcuauaagugugaugucugcggaaaggaguucucucaguccagccaccuucaaacccaccagcgggugcauacaggcgagaaaccguucaaguguguugaaugcgggaaaggauuuucccgcagaucugcucugaacgugcaccauaagcuccacaccggcgagaaacccuacaauugugaagagugcgggaaggccuucauccaugacagccagcugcaggaacaccaacggauucacacgggagagaaaccuuuuaagugugauaucugcggcaaguccuucugcggccgcagcagacuuaaccggcauucuaugguccacacagcggagaaacccuuucgcugugauaccugcgacaaguccuucagacagcggagcgcccugaauagccauagaaugauucacacaggggaaaaaccuuauaagugugaggaaugcggaaaaggcuuuaucugucgccgggaccucuacacccaccauauggugcacaccggggagaagcccuauaacugcaaggaauguggaaaaucuuucagaugggcuuccugccugcugaagcaucagcgcgugcacucuggcgagaaaccuuuuaagugugaggaaugcgggaaaggauucuacacaaauagccaguguuacucccaucaacggagccacucuggcgagaagccguauaagugcgucgaaugcggcaaaggguacaagagacgccucgaccuggauuuucaccagcggguucauacgggagagaaacuuuauaacuguaaggagugcggcaaauccuucagcagagcccccugucugcucaagcacgaacgccugcauucuggggagaagccuuuucagugcgaagaguguggaaaacgguucacccaaaauucccaccuucauagccaccagagagugcacacaggcgaaaagcccuacaaaugcgagaagugugggaaaggcuauaacuccaaguucaaucuggacaugcaucagaaagugcacaccggagagcgcccuuacaacugcaaggaauguggcaagucuuuugggugggcuagcugccuccugaaacaucagcggcugcacuccggagagaagcccuucaaaugugaagagugcggcaagagauuuacacagaacucucaacuccacagccaucagcggguccacaccggggaaaaaccguauaagugcgaugaguguggaaagggcuucuccuggagcucuacgcgccugacacaucagagacggcacuccagagagaccccucuuaaaugcgaacaacaugggaagaauauugugcagaacagcuuuucuaaaguucaggagaaggugcacuccgucgaaaaacccuacaagugugaggacugcggcaagggauacaaucgccggcugaaccucgauaugcaccagagagugcauaugggcgagaaaaccuggaagugucgcgaaugcgacauguguuucagccaagccucuagccugagacuucaccagaauguucaugugggggagaaaccuuga

SEQ ID NO: 78167 - RNA, 675 nt, Artificial Sequence
  derived and/or modified sequence opt5 from ZNF22__Homo_sapiens__NP_008894
augagacuggccaagcccaaagcuggcaucagccgguccucuagccaggggaaggccuacgagaacaaacgcaagaccggaagacaacggcagaaauggggcaugacaauucgcuucgacuccucuuuuagcagacuccggcgcucccuggaugacaagccuuauaagugcacggaaugugagaaaucuuucagccaguccagcacccuuuuucagcaccaaaagauccauacagggaaaaagucucacaaaugcgcggauuguggaaaguccuucuuucagagcucuaaucugauucagcauagacggauccacaccggcgaaaagccguacaaaugcgacgaguguggggaauccuucaagcagagcucuaaccucauucaacaucagcgcauccacacaggagagaaacccuaucagugcgaugaguguggcagaugcuuuucccagagcucccaccugauccaacaucagcggacccacacaggcgaaaagccuuaccaguguucugagugcgggaaauguuucagccaauccagccaucuucgccagcacaugaaggugcacaaagaagagaagcccagaaagacccggggcaaaaauauucgcgucaagacgcaucugccuucuuggaaagcuggaaccgggagaaaguccguugccggacuccgguga

SEQ ID NO: 78168 - RNA, 1425 nt, Artificial Sequence
  derived and/or modified sequence opt5 from ZNF230__Homo_sapiens__XP_011525595
augaccacauucaaggaggccgugacguuuaaagacgucgcuguuuucuuuaccgaagaggaacugggccuccuggaucccgcccagagaaagcuguaccaagacgugaugcuggagaacuucacaaaucuccugagcguggggcaccagccuuuucauccguuccacuuucuucgggaagagaaauucuggaugauggagaccgcgacacagcgcgaaggaaacuccggcgggaagaccaucgcugaggccggaccccaugaagauugcccuugucagcaaauuugggagcagacagccucugaccugacccagagccaggauuccaucauuaauaacucucacuuuuucgagcaaggcgacguccccagccagguggaagcugggcucuccaucauucauacgggacagaaaccuucucagaauggcaagugcaagcagagcuuuuccgauguugccaucuucgaucccccucaacaguuucacagcggcgagaaaucucacaccuguaacgaaugcgggaaguccuucuguuauaucagcgcucugcggauucaucaaagagugcaccuucgcgagaaacucucuaagugcgacaugagaggaaaagaguucucccagagcucuugucugcagacacgggaacgcguccauaccggcgagaagccguuuaagugcgaacagugugggaaaggauucagaugccgggccauccuucaagugcacuguaagcugcacacaggcgagaaacccuacauuugcgaaaagugcgggcgcgcguuuauccaugacuuccagcuccagaaacaccagauuauccauaccggagagaagccuuuuaaaugugaaauuugcggcaaguccuucugucugagaagcucccuuaaucggcacugcaugguucauacggccgagaagcuguauaaaucugaggaauguggcaagggguuuacagauagccucgaccugcacaaacaccaaaucauccauaccggacagaagcccuacaacugcaaagaguguggcaaguccuuccgcuggagcucuuaucugcucauucaccagagaauccauuccggggaaaagccuuaccggugcgaggaauguggaaaaggcuauauuagcaagucugggcugaaucuucaccagcgcgugcacacaggagagagacccuacaacugcaaagaguguggcaagagcuuuucccgggcuucuagcauccugaaucauaaaaagcuccacugcagaaagaaaccguucaagugcgaagauuguggcaaacgccugguccaucgguccuuuugcaaggaccaacagggggaccacaacggagagaauagcucuaaaugugaagauugcggcaagagauacaagcgccggcuuaaccuggacauuauccucucccuguuccugaaugauauguga

SEQ ID NO: 78169 - RNA, 5538 nt, Artificial Sequence
  derived and/or modified sequence opt5 from ZNF236__Homo_sapiens__NP_031371
augggccugugcgggcuccuggaaagauguuggcuucaccaugaccccgauggagugcugacccucaacgcugaaaauaccaacuacgcuuaucaggucccuaauuuccacaaaugcgagaucugucugcuuagcuuuccgaaagaaucccaguuccagcggcauaugagagaccacgagagaaacgauaaaccccaucggugcgaccaguguccucagacguuuaauguugaguucaaccugacccuccacaaaugcacacacucuggcgaggaucccaccuguccugugugcaauaagaaauuuagccgcguggccucccugaaggcgcauauuaugcugcacgagaaggaagagaaccucaucuguucugaaugcggggacgaguucacacugcagagccagcuugcuguccauauggaggaacacagacaggagcuggccggaacccggcagcacgccuguaaggcuugcaagaaagaauuugagacauccucugaacucaaggagcauaugaaaacccacuacaagauucgcgugagcuccacgagaagcuauaaucggaacaucgaucgcucuggcuucaccuacuccugcccccauugugggaagacauuucaaaaaccuagccagcugaccagacacauucggauccauacaggagagcgcccguucaagugcucugaauguggcaaagccuuuaaucagaagggcgcccuucagacccacaugaucaaacacacgggggagaagccccaugccugcgcguucuguccugccgcuuuuucccaaaaaggaaaccugcagagccacguucagagagugcauucugaagucaagaauggccccacauauaacugcaccgaguguuccugcguguucaagagccucgggucccugaauacacacauuucuaaaaugcacaugggaggcccucaaaacagcaccuccagcaccgaaacagcccauguucugacggcuacccucuuccagacacugccccuucagcagaccgaggcccaagcgacaucugccuccagccagccgucuagccaggcuguguccgacgucauccagcaacugcucgagcugucugaaccugcccccguggagagcgggcaguccccucagcccggacagcaacuuagcauuaccgugggcaucaaccaggauauucugcagcaggcucucgaaaauucuggccuguccagcauccccgccgccgcucacccuaacgacucuugucaugcgaagacguccgccccgcacgcucaaaaucccgaugucagcuccguuucuaacgagcagacagacccuaccgaugccgaacaggagaaagagcaagaaagccccgagaagcuggacaaaaaggaaaagaaaaugauuaagaaaaaguccccuuuucuccccgggucuauccgggaggagaauggagugcgcuggcaugugugcccguacugugccaaagaguucagaaagccuagcgaccugguccggcacauccgcauucacacccaugagaagcccuuuaaaugcccucagugcuuccgcgcuuuugccgugaaguccacacuuaccgcgcacaucaaaacacauacgggcauuaaggcuuucaaaugucaguauugcaugaaaucuuuuagcaccuccgggagccugaagguucacauccggcuccauacaggagugagacccuucgccuguccucacugcgauaaaaaguuucgcaccucuggccaccggaaaacacauauugccucccacuucaagcauaccgaacugagaaaaaugcgccaccagcggaagcccgcuaaagucagaguggggaagacgaacaucccgguuccugacaucccccuucaagagcccauucugaucaccgaucucggacugauucagccuaucccgaagaaucaguuuuuccagagcuacuuuaacaauaacuucgugaaugaagccgaccgccccuacaaauguuucuauugccaccgggcuuacaagaaaucuugucaucugaagcaacacauuagaagccauacaggcgagaaaccuuuuaagugcucccaguguggccgcggguucgucagcgccggagugcucaaggcgcacauccggacccauacaggccugaaaucuuuuaagugccuuaucuguaacggggccuucaccacgggaggcucccugagacggcacauggggauucacaaugaucuccgccccuauaugugcccuuacugccagaaaacauuuaagaccagccugaacuguaaaaagcauaugaagacacacagauaugagcuggcucagcaacuucagcagcaucaacaggccgcuuccaucgacgauucuaccgucgaccagcagagcaugcaagccuccacccagaugcaaguggaaauugagucugaugaacucccccagacagcggagguuguggccgcuaauccugaagccaugcuggaccuggagccccaacacgucgugggcacggaggaagcuggacucggccagcagcuggccgaucagccgcuugaggccgacgaagacggguucguugcuccucaagauccccugcggggacacguggaccaguuugaggaacagagcccugcgcagcaauccuucgagcccgccggccucccgcagggguuuaccgucacagauaccuaccaucagcaaccucaguuucccccugugcagcagcugcaagacucuagcacacuggagucccaggcucuuagcaccucuuuucaccagcagucccuccugcaagcccccagcucugauggaaugaacgugacgacaagacugauccaggaauccagccaggaggaacucgaccugcaggcccaaggcucucaguuccuugaggauaacgaggaccagucccgccggagcuauagaugcgauuacuguaauaaaggguuuaagaaauccagccaucugaagcaacacguucgcucucauaccggcgaaaaacccuacaagugcaagcucuguggaagaggcuucgucagcuccggggugcugaaaucucacgagaagacccacacaggagugaaggcuuucagcugcuccgucuguaacgccucuuuuaccacaaauggcagccugacgcggcauauggcgacccacauguccaugaagccuuauaaaugcccguucugugaagagggguuucgcacaaccgugcauugcaagaaacacaugaagagacaccagacaguucccucugcugugagcgccaccggagaaacggagggcggggacauuuguauggaggaagaggaagaacauuccgaucggaacgccagccgcaagucuagaccugaagucaucaccuucacagaggaggaaaccgcucagcuugccaaaauucggccccaggaguccgcgacagugagcgaaaagguucucgugcaaucugcugccgagaaagaccgcaucuccgaacugagagauaagcaggccgagcugcaggacgagccuaaacacgcuaauugcugcaccuacugucccaagagcuuuaagaaaccuuccgaccucguccggcaugugcgcauccacacaggcgaaaagccguauaaaugcgaugaguguggaaagucuuucaccguuaaaagcacgcuggacugccaugugaagacacacaccggccagaaacuuuucuccugucacgucugcagcaacgccuucucuaccaaagggucccugaaggugcauaugagacuccacacaggagcuaaacccuuuaaguguccucauugcgaacugcgguucagaaccagcggccgccggaaaacgcacaugcaauuucauuacaagcccgauccuaagaaagccagaaagcccaugacacgcucuagcuccgaggggcugcagccggugaaucuucucaacucuagcuccaccgacccuaaugucuucauuaugaacaauucuguucugacaggacaguucgaucagaaccugcuccaacccggccugguggggcaggcgauccuucccgccagcguguccgcuggcggagaccugaccgucagccucacagauggcucucuggccacccuggaggggauucagcuucagcuggcugccaaucucgugggaccuaacguucaaaucuccggcauugacgccgcuagcaucaauaacaucacgcugcagauugaucccuccauccuccagcaaacccugcagcaggggaaccuucuggcgcagcaacucacaggagaaccuggccuggccccgcaaaauucuagccugcagaccuccgacucuacagugcccgcuagcgucgugauucagccuaucuccggccuuagccugcaacccaccguuacgucugccaaccucacaauugggccucuguccgagcaggauagcgugcucaccacaaauucuuccggaacccaggaccugacccaggucaugacaagccaaggccuugugucucccagcgggggaccgcacgaaaucacgcugaccaucaacaauuccucucucagccagguucuggcccaggcugccggcccuacagcgaccuccagcuccgggucuccccaagagauuacacugaccaucagcgaacuuaacacgacauccggaucucugccuagcaccacccccauguccccuucugcuauuagcacacagaaucucgugauguccagcucuggcgucggcggggaugccuccgugacccugacacucgccgacacgcagggaaugcugagcggcgggcuugacaccgugacacugaacaucaccucucagggacaacaguuucccgcucugcucacagauccgucccugagcggccaagggggagccggcucuccucaggucauucuuguuucccacacaccccagagcgcguccgcugccugugaggagaucgccuaucagguggcuggcgugagcgggaaucuggcccccggaaaccagccugaaaaagagggccgggcucaucagugccucgaaugugacagagccuucucuagcgcggccguccugaugcaccauuccaaggaggugcacgggcgcgaacggauccacggaugcccgguuugcagaaaggcuuuuaagcgcgccacgcaucucaaggagcacaugcaaacccaucaggcuggccccucucugagcucccagaaaccucggguguucaagugugauacaugcgagaaagccuuugccaagcccucucaacuugaaagacacagccggauucauaccggggagcgcccuuuccacuguacacugugcgaaaaggcuuuuaaucagaaguccgcgcugcagguccacaugaaaaagcauaccggagagagacccuacaagugugccuauugcgugaugggcuucacacagaaaucuaacaugaagcuccacaugaaacgggcucauagcuacgccggcgcccugcaagaauccgcugggcacccugagcaggacggagaggaacuuagccgcacgcugcaccucgaggaaguugugcaggaggccgcgggcgaguggcaggcucugacccaugucuuuuga

SEQ ID NO: 78170 - RNA, 1809 nt, Artificial Sequence
  derived and/or modified sequence opt5 from ZNF239__Homo_sapiens__XP_011538534
augggccacgcccugcucaaggacguggucauggagcuggaagggagcaaccuuugcuucugucuguuuguucccccucuccugagaggacuuucccuucucuuccagccgucuagcuccgaguggcggcccgugacccugaaucgcaaacugggcagacaacauccuucucuccccagcucccugccuucuagcuuucccacaggggauaagcugggaacguccuacauccagggcugccugugugggcuccaccggggaggcgugcgcagcccuggccugugcucucaggaagcugucagauccugugacgccgggcagcuucaaaaacugggacucggcgaucugaacgagaauagcguggaaaaccugcagcagaagacccuccaggaccugcuucaugagcugucuuccuggcucguucuggaggggauggcgagcacaauuaccggaucucaagauugcaucgugaaucaccggggcgaagucgacggggagccggaacuugauauuucccccugucagcaguggggagaggcuagcuccccuaucucucgcaacagagacagcgugaugacacugcaguccggcugcuucgagaauauugaaagcgagaccuaucucccccugaaaguuucuucccaaaucgauacacaggacagcucugugaaguuuuguaagaacgaaccucaggaucaucaagagagccggcgccuguucgucauggaagaguccaccgagagaaaagugaucaagggcgaaucuugcagcgagaaucuccaggugaaacuggucuccgacgggcaggaacuugccagcccccugcucaacggagaggccacgugucagaauggccaacugaaggaaucucuugauccgauugacugcaacugcaaagacauccacggguggaagucccagguugugagcuguucucagcagcgggcucacaccgaggagaagccuugcgaucauaauaacuguggaaaaauucugaauacaucccccgacggccacccuuacgaaaagauccauaccgccgagaaacaauaugaaugcagccagugugggaagaacuuuucccagucuagcgagcuccugcugcaccagcgcgaucacacagaagagaaacccuacaagugcgagcaauguggaaaaggcuucaccagauccucuagccuccugauucaucaggcugugcacacggacgaaaagcccuauaagugcgauaaauguggcaagggguuuacacgguccagcucucuucugauccaucacgccguccauaccggagagaaaccuuacaagugcgacaaauguggcaagggguucucccagagcucuaagcuccacauucaccagcgcgugcauacaggagaaaaaccguaugagugcgaggaaugcggcauguccuuuagccaaagaucuaaccugcacauccaucagcggguucacaccggggagagacccuacaaguguggcgaaugcggaaaaggcuucagccaguccagcaaucugcacauccaucgcuguauucacaccggggagaagccuuaccaaugcuaugaauguggaaaaggcuuuucucaguccagcgaucuucggauccaucucagagugcacacaggggagaagcccuaccauugcggaaaguguggcaaaggguucucccagucuagcaagcugcugauucaccagcgcguccacacgggcgagaaaccuuaugaaugcuccaaguguggaaaaggcuucucucaaagcuccaaccuccauauccaccagcgggugcauaagaaggaccccagauga

SEQ ID NO: 78171 - RNA, 1932 nt, Artificial Sequence
  derived and/or modified sequence opt5 from ZNF23__Homo_sapiens__NP_001291421
augcuggagaacuacggcaauguggccagccucggguucccccugcuuaagccugcugucaucucccagcuggaaggaggcucugagcucgggggaagcuccccgcuggccgcgggcaccgggcuucaaggacugcagacagacauucagacggauaacgaccucaccaaagaaauguaugagggcaaggaaaauguuucuuuugagcugcagagagauuucagccaagagacagacuuuuccgaggcuucucugcucgagaaacagcaggaagugcacagcgccggcaacaucaagaaagagaaguccaauaccauugaugggacagugaaggacgagaccagccccgucgaagagugcuucuuuucucaguccagcaacucuuaccaaugucauacaaucaccggagaacagccuuccggcugcacggggcugggaaaaagcauuucuuucgauaccaaacuugugaaacacgagaucaucaauuccgaagaacggcccuuuaagugugaggaacugguugagccuuuccgcugcgacagccagcucauucagcaucaagaaaacaauacagaggaaaaacccuaucaguguuccgagugcggcaaggccuuuucuaucaacgagaagcugauuuggcaccagagacuucauagcggggaaaaaccuuucaaguguguggagugcggaaaauccuuuagcuacucuucccacuauaucacccaccaaacaauucauagcggcgaaaagccguaccaguguaaaaugugcggcaaggcuuucucugucaaugggagccugucccggcaccagcgcauccauaccggagagaaacccuaucaguguaaggaaugcggcaacggguuuucuugcagcuccgccuacauuacgcaccaaagagugcacacaggagagaagccuuacgaguguaaugauugcggcaaggcuuucaacguuaaugccaagcucauccagcaucagcggauccacaccggggaaaaacccuaugaguguaacgaaugcggaaagggcuuccgcuguagcucucagcugagacaacaucaguccauucacacaggcgagaaaccuuaccagugcaaggagugugggaagggauuuaacaauaacaccaaacugauccagcaucaacggauucacaccggcgaaaagcccuaugagugcacagaaugugggaaagcguucagcgugaagggaaaacucauccagcaccagcgcauucauacgggcgagaagccguacgaaugcaaugagugugggaaggccuuuagaugcaacucucaguuccggcaacaucugcgcauccacaccggcgagaaaccuuaugaaugcaaugaguguggaaaggcuuuuuccgucaacggcaaacuuaugagacaccagcggauccacacaggggaaaagcccuucgagugcaaugaauguggacgcugcuuuaccagcaaaagaaaccugcucgaccaucaccggauucauacaggcgagaagccuuaccaguguaaggagugcgggaaagccuucuccaucaaugcuaagcugaccagacaccaacgcauucauacgggagaaaaacccuuuaaguguauggagugcgaaaaagccuucucuuguagcuccaacuauaucgugcaccagcggauucacacaggcgagaagcccuuucagugcaaagaaugugggaaggcguuccaugugaaugcccaccuuaucagacaucagcgcucucacaccggcgagaagccuuuucggugcgucgagugcggaaaaggcuucagcuucuccagcgauuacaucauucaucaaaccguucacacauggaagaaaccguacauguguucugugugcgggaaggcuuuuagauucuccuuucagcugagccagcaccagucugugcauuccgaaggaaaaagcuga

SEQ ID NO: 78172 - RNA, 1740 nt, Artificial Sequence
  derived and/or modified sequence opt5 from ZNF248__Homo_sapiens__XP_011517899
augaacaagagccaggagcaaguguccuucaaagacgucugcguugauuuuacccaggaagagugguaccugcucgaccccgcccagaagauccuguauagagaugugauucuugaaaauuacucuaaccuggugagcgucggcuauuguaucacaaaaccugaggugauuuucaagaucgaacagggggaggagccguggauucucgaaaaaggauuucccucccaaugccacccugagcggaaguggaagguugacgaugugcuggaaucuagccaggagaaugaggacgaucauuucugggaacuucuguuucacaacaauaaaacggucuccguggagaacggcgaccgcgggucuaagaccuucaaucucggaacagaucccguuagccugagaaacuacccuuauaaaaucugugacuccugcgaaaugaaucugaagaacaucagcggccucauuaucucuaaaaagaauuguucccggaagaaacccgaugaguuuaacgugugcgaaaagcugcuucuggacauucgccaugagaaaaucccuauuggggaaaagagcuacaaauaugaucagaagagaaaugcuaucaacuaccaccaggaccucucucaaccguccuucggacagagcuuugaguacucuaaaaauggccagggcuuccaugacgaggccgcguuuuucaccaacaagcggucccagauuggggaaacagucuguaaguauaacgagugcggacgcaccuuuaucgaaagccugaaacuuaauaucucccaaagaccccaccuggagauggagccuuacggcuguucuauuugcggaaagagcuucuguaugaaccuccgguucgggcaccagcgcgcucugacaaaagauaaucccuaugaauacaacgaguauggcgaaaucuuuugcgacaauuccgccuucauuauccaucagggggccuacaccagaaagauucugcgggaguauaaagugagcgauaagacgugggaaaagucugcucuccugaaacaccaaaucgugcauaugggaggcaaguccuacgacuacaacgagaauggcagcaacuuuucuaaaaagagccaccuuacccagcugcgcagagcccacacaggggagaaaaccuucgaaugcggagaguguggcaagacauuuugggaaaaguccaaucucacccagcaucagcggacgcacacaggggagaaaccuuaugagugcaccgaauguggaaaggcuuucugccaaaaaccccaucugacaaaccaccagcgcacccauaccggcgagaagccguacgaauguaaacagugcgggaagacauuuugugucaagucuaaucuuacggagcaccagagaacccacacaggagaaaaaccuuaugagugcaacgccuguggcaagagcuucugccaucgguccgcgcugaccguucaccaaagaacacauaccggcgagaaacccuuuaucuguaaugaaugcggaaagagcuucugcgugaaaucuaaccucauugugcaccagcgcacgcacacaggggagaagccuuacaaauguaaugaaugcggcaagaccuuuugugagaaguccgcccugaccaaacaucagcggacacacaccggggaaaagcccuaugagugcaacgcuuguggaaaaacauucagccagagaucuguccugacgaagcaucaacgcauccacacccgggugaaagcccucuccacaagcuga

SEQ ID NO: 78173 - RNA, 1107 nt, Artificial Sequence
  derived and/or modified sequence opt5 from ZNF24__Homo_sapiens__NP_008896
augagcgcccaguccguggaggaagacucuauccugauuauccccaccccugaugaggaagagaagauucucagagucaaacuggaagaggacccggauggcgaggaagggagcuccauccccuggaaccaccuuccugaccccgagauuuuccggcaacgcuuuagacaguucggauaccaggauucuccuggcccccgggaagcuguuagccagcugcgcgagcucugcagacuguggcuucggccugagacacauacgaaggaacaaauccuggagcucguggugcuggaacaguuugucgccauccugccgaaagagcuccagaccugggugcgcgaccaccaucccgaaaauggggaggaggcgguuacagugcuggaagaucuugaguccgaacuggacgauccuggacagcccgucucucucagacggcgcaagagagaggugcugguugaagacauggugagccaagaggaggcucagggccuuccuuccagcgaacuggaugccgucgagaaccagcucaaaugggccucuugggaacugcacucccugcggcauugugacgaugacgggcgcaccgagaauggagcucucgcccccaagcaggaacugccgagcgcucuugagucucacgaggugccuggcacacugaacaugggcgugccccaaauuuucaaguauggggaaaccugcuuuccuaaaggaagauucgagcggaagcgcaaucccucccggaaaaagcagcacaucugugacgaaugcggcaaacauuuuagccaggggucugcccucauucugcaccaaagaauccauuccggagagaagcccuacggcugugucgagugcgggaaggcguucagcagauccucuauucuuguucagcaccagcgcgugcacacaggagaaaaaccuuauaagugucuggagugcggcaaagccuuuagccagaacuccggccucaucaaucaucaacggauucacaccggggaaaagccguacgagugugugcagugcggaaaaagcuauucucaguccagcaaccuguucagacaucagcgccggcacaaugcugaaaagcugcucaacgucgugaaaguuuga

SEQ ID NO: 78174 - RNA, 1500 nt, Artificial Sequence
  derived and/or modified sequence opt5 from ZNF253__Homo_sapiens__NP_066385
augggcccccugcaguucagagacguggccaucgaguuuagccucgaagaguggcacugccuggauaccgcucaacggaaccuuuaccgcgacgucaugcuggaaaauuauagaaaccucguuuuccuggggauugugguguccaagcccgaucuugucacaugucuggagcagggcaaaaagccgcucacgauggaacggcaugagaugaucgccaaacccccugugaugucuagccacuuugcgcaggaccuguggcccgagaauauucagaacuccuuccaaaucggaaugcugcgcagauacgaagagugccggcaugauaaucuccagcugaagaaaggguguaagucuguuggagaacacaaggugcauaaaggcggguauaacggacuuaaucagugccugaccacaacccagaaggagauuuuucaaugugacaaauacggcaaggucuuccacaaauuuagcaacuccaauacauauaagacccgccacacaggcaucaaccucuucaagugcaucauuugugggaaggcuuuuaaaagaucuagcacccugacgacccauaaaaagauccacacaggagagaaaccuuaccggugcgaagaguguggcaaggccuucaaucaguccgccaaccuuaccacacauaaacgcauucacaccggggaaaagcccuauagaugcgaggaauguggaaaggcuuuuaaacagagcucuaaucugacgacacacaagaaaauccauaccggcgagaagccuuacaaaugcgaggaaugcgggaaggccuucaaccgguccacagaucucaccacccacaagauugugcauacaggagagaaaccguacaagugugaagagugcggcaaggcuuuuaaacaccccagccauguuacgacccacaaaaagauccacacacgcggcaagccuuauaauugugaagagugcgggaaaucuuucaagcauuguuccaaccugaccauucacaaaagaauccauacaggagagaagcccuacaaaugcgaagaguguggcaaggccuuccaccugagcucucaccucaccacgcauaagauccugcacacaggggaaaaaccuuaucggugccgcgaguguggaaaggcguuuaaccauuccaccacccuuuucagccacgagaaaauucauacaggcgaaaagcccuacaaaugcgacgagugugggaagaccuuuacauggccguccauccugucuaaacacaagagaacgcacaccggagaaaagccuuauaaaugcgaggaaugcggcaagagcuucacagccuccagcacccucacaacccauaaacggauucacacgggcgagaagcccuacaaaugugaggaaugcgggaaggcuuuuaauuggucuuccgaucugaacaagcauaaaaagauccacauugagagaaaaccuuauaucgugaagaaugucaccgaccuucugaacgugccuccccuccugaucagcauucgcuga

SEQ ID NO: 78175 - RNA, 1239 nt, Artificial Sequence
  derived and/or modified sequence opt5 from ZNF260__Homo_sapiens__NP_001012774
augaucggcaugcuggagagccuccagcacgaauccgaccugcuucaacaugaucagauucacaccggggagaagcccuacgaaugcaacgaguguagaaaaacauucucucugaagcagaaucucguggaacauaaaaagaugcacacgggagagaaaagccaugagugcaccgaauguggcaaggucugcucccggguuucuagccugacacuucaccugagaucccacaccgggaagaaagccuauaaguguaacaaaugcggaaaggcuuuuucucagaaagagaauuuccucagccaucaaaagcaccauacaggcgaaaagccuuacgagugugagaaaguguccauccagaugccgaccauuaucagacaccagaagaaccacacagggaccaaacccuaugccugcaaggaauguggaaaagcguuuaauggcaaggcuuaccugacggagcaugagaaaauucacaccggcgaaaagccuuucgaaugcaaccagugugggcgggccuuuagccaaaagcaguaucugaucaaacaucagaauauccacacaggaaagaaacccuucaagugcucugagugcggcaaagccuuuucccagaaggagaaccucauuauccaucaacgcauucacaccggggaaaagccuuacgaguguaaaggaugcggcaaggcuuucauccagaaaagcucucugauuagacaccagcggucccauacaggggaaaagcccuauaccuguaaagagugcggaaaggccuuuagcggcaagucuaaucuuacggaacacgagaaaauccauauuggcgagaagccuuacaaauguaacgaaugcgggacaaucuuccgccaaaagcaguaccugaucaaacaccacaauauucauaccggagagaagccguaugaauguaacaagugcggcaaggcuuuuuccagaaucacaagccucauugugcacguccggauccauaccggggacaaacccuacgaguguaaagugugcggaaaggccuucugucaguccucuagccugaccguucacaugcgcucccauacaggcgaaaaaccuuaugggugcaaugagugcggaaaggcguuuagccaguucucuacgcuugcccugcacaugcgcauucacaccggcgagaaacccuaccaauguuccgaaugcggcaaggcuuucagccagaagucucaucacauccggcaucagcgcauccacacacauuga

SEQ ID NO: 78176 - RNA, 2052 nt, Artificial Sequence
  derived and/or modified sequence opt5 from ZNF263__Homo_sapiens__NP_005732
auggccagcggccccgggucccaggagagagaaggacugcucaucgugaagcuggaggaagacugcgcuuggucucaagagcuuccuccgcccgauccuggccccagcccugaagccucccaccuccgguuccgcagauuucgguuccaggaggcggcugggccccgcgaggcccucucuagacugcaggaacuuugucauggauggcugcggccugagaugcgcaccaaagaacagauucucgagcugcugguccucgagcaauuucugacaauccuuccgcaggaaauucagagcagaguucaggagcugcaccccgaauccggcgaggaagccgugacgcucguggaggacaugcaacgggagcuggggcgccuuagacagcaggucaccaaccauggacggggcacagaagugcugcucgaggaaccucugccccuggagaccgcucgcgaaucuccuagcuucaagcucgagcccauggagacagaaagauccccgggcccucggcugcaggagcuucuggggcccagcccucaacgcgauccccaggccguuaaagaaagagcucucucugcccccuggcugucccuuuuuccuccggagggaaauauggaagacaaggagaugaccggcccccagcugccugagagccucgaagauguggcgauguacaucucucaagaggaaugggggcaccaggaccccuccaaacgggcccugagcagagauacaguccaggagucuuaugagaacguggacucccuggaaagccauauuccuucccaggagguucccggaacccaagugggccaagggggaaagcucugggauccgucuguccagagcugcaaggaaggccuguccccucgcggccccgcuccuggggaggaaaaauucgagaaucuugagggagugcccagcguguguucugaaaacauccacccucagguccugcuccccgaccaggcccggggcgagguuccgugguccccugaacuggggagaccccacgaucgcagccagggagacugggcucccccuccggagggcgggauggaacaggcccuugcgggagccucuagcggccgggagcugggcagacccaaggagcuccagccuaaaaagcugcaucugugcccccucugugggaaaaauuuuuccaacaauucuaaccugauccgccaccaacggauucaugcugccgaaagacuuugcaugggaguggauuguacggagaucuucggcgggaauccucgcuuucugagccuccaccgggcucaccugggagaagaggcccauaagugccuggaauguggcaagugcuucucccagaacacccaccuuacaagacaucagcgcacccacacaggggagaaacccuaccaguguaauauuugcggcaagugcuuuagcuguaacucuaaucuccaucggcaccaaagaacccacacgggagagaaaccuuauaagugccccgaauguggcgagaucuucgcccauuccagcaaccugcugcggcaccagcgcauucauacaggggaaagaccguacaaaugcccugaguguggaaagucuuuuucccggagcucccaccucgugauccacgagagaacccaugaacgcgagcggcuguaucccuucucugaaugcggcgaggcugucagcgacuccacaccuuuccuuaccaaucacggggcgcauaaagccgaaaagaagcuguuugagugucugaccugcggaaaaucuuucagacagggcaugcaccugacacgccaucaaagaacgcacaccggggagaagcccuacaaauguacacugugcggcgaaaacuuuagccaccgguccaaccuuauucgccaucagagaauccacaccggagagaagccguauacaugucaugaaugcggcgacagcuucucucacuccagcaaucggauccgccaucucagaacccacacgggggagcggccuuacaaaugcucugaauguggagaguccuuuagccgcucuagcagacugaugucccaccagcggacacauaccggcuga

SEQ ID NO: 78177 - RNA, 1884 nt, Artificial Sequence
  derived and/or modified sequence opt5 from ZNF264__Homo_sapiens__NP_003408
auggccgcugccgugcugaccgacagagcgcaggucagcguuacauucgaugacguggcugugacguuuaccaaggaggaauggggccaacucgaucuggcccagcggacacuuuaccaggaggucaugcuggaaaacugcgggcuccuggugucccuuggaugucccguuccuaaagccgagcugaucugccaccucgaacauggccaggagccguggacccgcaaggaggaccugucucaagauacaugucccggggacaaaggaaagccuaaaaccacagaacccaccacgugcgagccugcucugagcgaaggcauuucccuccaggggcaagugacccagggaaauucugucgauagccagcugggccaggccgaggaccaggauggccuuuccgagaugcaggaagggcacuucagacccggaaucgacccucaagagaagucuccgggcaagaugagccccgaaugugaugggcugggaacagcugacggcgugugcucccggauugggcaggagcagguuagcccuggagaucgcgugagaucucauaacuccugugaaagcggcaaagaccccaugauccaagaggaggaaaauaacuuuaagugcucugaguguggcaaagucuucaauaagaaacaccuccuggccgggcaugaaaagauucacuccggagugaagccuuaugagugcaccgaauguggcaaaacauuuaucaagagcacccaccuucugcagcaucacaugauccauacgggggagcggcccuacgagugcauggaaugcggaaaagcguucaaccgcaagucuuaucucacacagcaccagcggauucacuccggcgagaaaccguacaaguguaaugaaugcgggaaagccuuuacccauagaagcaacuucgugcugcacaaucgcagacauacaggagagaaguccuuugucuguaccgaaugcggccaaguuuuccggcaccgcccuggcuuucugagacauuauguggugcacucuggggagaaccccuacgagugucucgaaugcggaaaggucuucaaacaccggagcuaucugauguggcaucagcagacccacacaggcgagaagccuuacgaauguuccgagugcgggaaaguguuucuugagagcgcugcccugauccaucacuacguuauucacacgggagaaaagcccuucgagugucucgaaugcggcaaggcuuucaaucaucgcucuuaucugaaaagacaccagcggauccauaccggggagaagcccuuuguguguuccgaaugcggcaaagccuucacacacugcagcaccuuuauucuucauaagagagcgcacacaggagagaaaccuuucgaguguaaggaaugcggcaaagccuuuucuaaccgcaaggaccugauccggcacuucagcauucauaccggggagaagccguacgaaugugucgagugcggaaaggcuuuuacgagaauguccggccucacacgccacaaacggauccauucuggggaaaaacccuaugaguguguggagugcggaaagagcuucuguugguccaccaaucugaucagacacgccauuauccauaccggcgaaaaaccuuacaagugcagcgagugugggaaggcuuuuucucgcuccagcucucugacacaacaccagcggaugcacaccggcaaaaaccccauuuccguuacagaugugggaagaccuuucacgagcggccagaccuccgucacacuccgcgaacugcuucuggggaaggacuuucucaaugugaccacagaggccaacauccugcccgaagagaccucuagcuccgccucugaucagccguaucaacgggagacgccucaggucagcucccuuuga

SEQ ID NO: 78178 - RNA, 1650 nt, Artificial Sequence
  derived and/or modified sequence opt5 from ZNF266__Homo_sapiens__NP_006622
augcuggagaacuacaagaaucucgccaccgugggcuaucagcuguucaaacccagccuuaucuccuggcuggaacaagaggaaucuagaacaguccagagaggggacuuucaggcuagcgaguggaagguucagcucaaaacgaaggaacuggcccuucaacaggaugugcugggagagccuaccuccucuggcauucagaugaucgggagccacaacggaggcgagguguccgacgucaaacagugcggggaugugucuagcgaacauuccugucucaagacacacguucgcacccaaaauagcgagaacacauucgaaugcuaccuguauggaguggacuuucugacccuccauaagaaaacaucuaccggcgagcagagauccgucuucagccaguguggcaaggcguuuucucugaauccggaugugguuugccagcggacguguaccggggagaaggcuuucgacugcuccgauagcggaaaaucuuuuauuaaccacucccaucuucaaggccaucugcgcacacacaauggggaaagccuccacgaguggaaagaauguggaagaggcuucauccacuccaccgaccuggccgugcggauucagacacaucgcucugagaagcccuacaagugcaaagaaugugggaagggauuuagauauagcgccuaccuuaacauccacaugggcacccacacgggcgauaauccuuaugagugcaaagagugugggaaggcuuucacacgguccugccagcugacccaacaucgcaaaacacacaccggagaaaagcccuacaaaugcaaggacuguggcagagccuuuaccgucagcucuugccucucccagcauaugaagauccacgugggggagaaaccuuacgaauguaaggagugcggaauugcuuucacacggagcucucagcugacggaacaucugaaaacccacacagccaaggaucccuuugaguguaaaaucugcggcaagagcuuccgcaacuccucuugucucagcgaccacuuccggauucauaccgggaucaagccuuauaaaugcaaggauuguggaaaagcguuuacacagaauagcgaccugaccaagcacgcccggacgcauagcggcgagcgcccguacgaaugcaaagaguguggcaaggcuuucgccagaucuucccggcuuagcgaacacacaagaacccacaccggggagaagcccuuugaaugcgugaaaugcggaaaggcuuucgccauuucuuccaaccugagcggccaucuccgcauccacacaggggagaaaccuuuugagugucuggaaugcggaaaggcguucacccauuccucuagccuuaauaaccacaugcggacacauuccgccaaaaagcccuuuacguguauggagugcggcaaggcuuucaaauuuccuaccugugucaaucugcacaugcgcauucacacaggggaaaagcccuauaaaugcaagcaauguggcaaaucuuucagcuacuccaacagcuuucagcuccaugagagaacccacacaggagagaagccguaugaaugcaaagaguguggcaaggccuucucuuccuccucuuccuuucggaaccaugaaagacgccacgcugacgagcggcugagcgccuga

SEQ ID NO: 78179 - RNA, 2136 nt, Artificial Sequence
  derived and/or modified sequence opt5 from ZNF267__Homo_sapiens__NP_001252517
augcuggagaacuacagaaaucucgugagccugggccuugucguuuccaagcccgaccugaucaccuuccucgaacagcggaaagagccuuggaacgugaagucugaagagacaguggccauucaaccggaugucuuuagccacuauaauaaagaccugcuuacggaacauugcaccgaggcuuccuuccagaaggugaucucucgcagacacgggagcugugaucuggagaaccuccaucugcggaaacgcuggaagagagaagagugcgaaggacacaauggcuguuacgacgagaagacauuuaaauaugaucaguucgacgaguccucuguugaaagccuguuucaucagcaaauucucuccagcugcgccaagucuuacaacuucgaucaguaucggaaaguguuuacccacuccagccugcuuaaucagcaggaggaaaucgacauuugggggaagcaccauaucuacgauaaaacaucuguccuguuccgccaaguguccacccucaacagcuauagaaauguuuuuaucggagagaagaacuaccacuguaauaacucugaaaagacacugaaucaguccagcucccccaaaaaccaucaggagaauuacuuccuugagaagcaguauaaaugcaaggaauuugaggaaguguuccugcaaucuaugcacggccaggagaaacaggaacaaagcuacaaguguaacaaaugcgucgagguguguacccagucccucaagcacauucagcaucagacgauccacauucgggagaacagcuauucuuacaauaaguaugacaaagaucugucccaaagcucuaaccugcgcaagcagaucauucauaaugaagagaaaccuuacaagugcgaaaaauguggggacagccucaaccacucccugcaucuuacccagcaccagaucauucccacagaggaaaagccuuauaaguggaaagagugcggaaagguguuuaaucugaacugcucucucuaccugaccaaacaacagcagaucgauacaggcgagaaucuuuacaaguguaaagcgugcagcaaguccuucaccagaagcucuaaccugaucguccaccagcggauucauacgggcgaaaagcccuauaaauguaaggagugcgggaaggcuuuccgcuguuccagcuaccucacaaaacacaaaagaauccauaccggagaaaagccuuauaagugcaaagaguguggcaaggccuuuaaucggucuuccugccugacacaacaccagaccacccacacaggggagaaacuguacaaguguaaaguuugcagcaaguccuaugcccgcucuagcaaccucauuaugcaucagagagugcacacgggagaaaaaccguacaaguguaaggagugcggcaaaguguucucccggucuagcugccugacccagcauagaaagauccacacaggggaaaaucuuuauaaauguaaggucugcgcuaaacccuuuaccuguuucuccaaccugauugugcaugagcgcauccacacaggagaaaagccuuacaagugcaaagaguguggcaaggccuuucccuacagcucucaccucauccggcaucaccgcauucauaccggcgagaaaccuuauaagugcaaagccuguuccaagagcuucucugacuccagcgggcugacgguucacagacggacacauaccggagaaaagcccuauaccugcaaagaguguggcaaggcuuuuucuuacagcuccgacgugauccaacacagacgcauucacacagggcagcggccguacaaaugcgaagaguguggaaaggcguucaauuauagaagcuaccuuaccacacaucagcgcucucacacgggcgaacggccuuauaaaugcgaggagugcgggaaggccuuuaacuccagaagcuaccugaccacacaucgccggagacacaccggagaacggcccuacaagugugaugagugcggcaaggcuuucuccuaucgcucuuaccucacaacccacagacggagccauuccggcgaaagaccuuauaaaugugaggaaugcgggaaagccuuuaauucucgcagcuaccugaucgcucaccaacggucccauacgagagagaagcuguga

SEQ ID NO: 78180 - RNA, 2844 nt, Artificial Sequence
  derived and/or modified sequence opt5 from ZNF268__Homo_sapiens__NP_001159353
auggccaccagagugcggacagcuagcaucuggguucccccucugcaggagcgcaacuccucuugggaccgcauucggaagcuccaaggccaggaaagcauccuggggcagggaacgccgggccuucagccccugccugggacccccagacaaaaacagaaguccagacggauugagaaaguccucgaauggcuguucaucucucaggagcagccuaagauuacaaaaagcuggggaccccuuuccuuuauggauguguucguggacuuuaccugggaagaguggcaacugcucgauccugcccagaagugccuguaccgcucugucaugcuggagaauuauagcaaccucgugucccugggcuaccagcacacaaagccggacaucaucuucaaacuugaacagggggaggaacuguguaugguucaagcucaggugcccaaucagaccugcccuaacacagucuggaagauugaugaccucauggauuggcaucaagagaauaaagacaagcugggaagcaccgcuaaaucuuuugaguguacgaccuucggcaaacuuugccugcucuccacaaaguaucugagcagacagaaaccccacaaguguggcacccaugggaaaucucugaaguacaucgauuuuacauccgacuaugcccggaacaauccuaacggauuccaggugcacggcaagagcuuuuuccauucuaagcacgaacagaccguuauugggaucaaauacugcgaguccauugaaagcggaaagacggugaauaagaaaucccaacucaugugucagcagauguauaugggcgagaagcccuuugggugcucuuguugcgaaaaagccuucagcuccaagagcuaccugcuuguccaccagcaaacacaugcugaggagaaaccguacggauguaacgaaugcggcaaggauuuuucuuccaagagcuaucugaucgugcaccagcgcauucauaccggcgagaaacuccacgaaugcucugaguguagaaagacauucagcuuccacucccagcuggugauccaucagcggauccacaccggggaaaauccuuacgagugcugugagugcggaaaagucuuuucucgcaaggaccaacuuguuagccaucagaaaacccacuccggccagaagcccuauguguguaacgaaugcgggaaggccuucggacugaaaagccagcucauuauccaugagcggauucacacaggcgaaaagccuuacgaguguaaugaaugccaaaaagcguuuaacacgaagucuaaucugauggugcaccagagaacccauacaggggagaaacccuaugucuguuccgauugcggaaaggccuucaccuuuaagagccagcugaucgugcaccaaggcauucauacaggcguuaaacccuacggguguauccagugcggaaagggcuucucucucaaaucccagcugaucgugcaccagcgcagccacaccgggaugaagccuuaugucugcaacgaguguggaaaagcguuuagauccaagucuuaccuuauuauccauacgcggacacacaccggcgaaaaacugcaugagugcaacaauugugggaaggccuucagcuuuaagucccaacucauuauccaccagcgcauucauaccggcgaaaacccguacgagugccacgaguguggaaaggcuuucucuagaaaauaucagcugaucagccaccagcggacacaugccggcgaaaaacccuacgagugcaccgacugugggaaggcuuuuggacuuaaaucccaacugaucauucaccagagaacacauacgggcgaaaagccuuucgagugcagcgaaugucagaaggccuuuaauaccaaaucuaaccucaucgugcaccagcgcacacauaccggggagaagcccuauuccugcaaugaguguggaaaagcguucacauucaagagccaacugauuguucacaaaggcgugcacaccggggucaagccuuacggcugcucucagugcgccaagacguuuucccugaaaagccagcucaucgugcaucaacggucucacaccggagucaagcccuauggcuguagcgaaugcgggaaggcuuucagauccaaaagcuaccugauuauccauaugcgcacacacaccggagagaaaccgcacgaaugucgggagugcggcaagucuuuuuccuucaacagccagcuuauugugcaucagagaauccacacaggggaaaauccuuaugaguguuccgagugcggaaaggccuuuaaccgcaaagaccagcugaucucucaucaacggacccacgcuggcgaaaagcccuacggguguagcgagugcggcaaagccuucuccucuaagagcuaccucauuauccauaugagaacgcacuccggagaaaaaccuuaugaguguaaugaaugcggcaaggccuuuauuuggaaaucucugcugaucguucacgagcgcacacaugcuggggugaaccccuacaaguguagccagugcgagaaguccuucagcggaaaacuucggcuccugguccaccagagaaugcauacccgggaaaagccuuaugagugcucugaauguggcaaagcguuuauucgcaauucccagcugaucgugcaccaaagaacacacagcggggagaagcccuacggaugcaacgaguguggcaaaaccuucucucagaaguccauccucagcgcccaucagcggacccacacaggggaaaagccgugcaaauguacggagugcggcaaggcuuuuuguuggaaaucucagcugauuaugcaucaaagaacccacguugaugacaagcauuga

SEQ ID NO: 78181 - RNA, 1710 nt, Artificial Sequence
  derived and/or modified sequence opt5 from ZNF273__Homo_sapiens__NP_066971
augagcuccgcccccagaggcccuccgucuguggcuccccugccugccgggaucggacggagcaccgcgaagacacccggccucccugggucccuggagaugggaccccuuacguuccgcgacgucgcuauugaauuuucucuggaggaauggcagugccucgauaccagccaacagaaccuguacagaaauguuaugcuugacaacuaucggaaucugguguuccucggcaucgccguguccaaaccugaucugauuacaugucuggagcaggggaaggaaccgugcaacaugaaacgccacgccauggucgcuaagcccccugugguuuguucucauuuugcccaggaccucuggcccaaacaaggacugaaggauagcuuccagaaggugauccuuagacgguacggcaaauauggccacgagaaucugcagcuccgcaaggggugcaaauccgcugacgagcauaagguccacaaaagaggauacaacggccugaaucagugucuuaccacaacccaaagcaagauuuuucagugcgauaaguaugugaaaguucugcauaaguucucuaacuccaauauccacaaaaagcggcagacagggaaaaagccuuuuaaauguaaggaaugcggaaagagcuguugcauccucucucagcugacccaacacaaaaagacggccacccgcgugaacuucuacaaauguaagacaugcggcaaagcguuuaaucaguucuccaaccugaccaagcauaagauuauccaccccgaggucaauccguauaaaugcgaagagugugggaaggccuuuaaccagagccucacacugaccaaacauaagaaaauucacacggaggaaaagccuuacaagugcgaggacuguggaaaaguguucucuguguuuuccguccuuacaaagcacaaaaucauucauaccggcacaaagcccuacaauugcgaagaguguggcaaaggguucagcaucuucuccacccugaccaagcacaagauuauccauacaggagaaaaaccuuauaagugcaacgaguguggcaaggcuuuuaacuggucuagcacgcucaccaaacacaaaagaauccauacaggggagaagcccuacaaaugcgaagaguguggaaaggccuucaaucaauccagcacccugacacggcacaagauuguucacaccggcgaaaaacccuauaagugcgaggaaugugggaaggcuuuuaaacgcucuacgacacuuaccaaacauaagagaaucuacaccaaggagaaaccuuauaagugcgaggaaugcggaaaagccuucuccguguuuagcacacugaccaagcacaaaauuauccauacaggcgcgaagccguacaagugugaggaaugcggcucugccuuccgggcuuuuagcacgcucaccgagcacaaacgcgugcacacaggggaaaagcccuauaaauguaacgagugcggaaaggccuucaauugguccucuacccugacaaaacauaagcggauucacaccggcgagaagccuuacaaaugugaagagugcgggaaggcuuuuaacagaagcuccaaucugacgagacauaaaaagauccacaccggagaaaaacccuacaagccuaaacgcugugauagcgccuucgacaacacacccaauuuuucucggcauaagagaaaccacaugggcgagaaguccuga

SEQ ID NO: 78182 - RNA, 1866 nt, Artificial Sequence
  derived and/or modified sequence opt5 from ZNF274__Homo_sapiens__NP_057409
auggccagcagacugcccaccgcuugguccugcgagccugugacauucgaagacgucacgcucggcuuuaccccggaggaaugggggcugcuugaucugaagcagaaaucucucuaccgggagguuaugcuggaaaacuaucgcaaucuugugagcguggaguaccccgagcugcaacucgacccuaagcuggauccccugccugccgaauccccgcucaugaacaucgaggucguggaaguucugacacuuaaucaggagguggcgggaccuagaaacgcucagauucaggcccuguaugccgaggacggcucucucagcgcugaugccccguccgaacaaguccagcagcaggggaaacaccccggagacccugaggcugcccggcaacgcuucagacaguuucgguacaaggauaugaccggcccccgcgaagcgcuggaccagcuuagagagcugugucaucaguggcuccaaccuaaagcccggucuaaggaacagauccuggagcugcucgugcuggagcaguuccuuggggcucugcccguuaagcuccgcacauggguggaaagccaacacccggagaauugccaggaagucguggcccugguggagggagucaccuggauguccgaagaggagguucuuccugcuggccagcccgccgaaggcacaaccuguugccuggaggugacggcgcagcaagaagagaaacaggaagaugccgcuauuuguccugugaccguccuccccgaggagcccgugacauuucaggacguugccguggauuucagcagagaagagugggggcugcugggaccuacccagcggacagaauaucgcgacgucaugcucgagaccuuuggccaucuggugucuguugggugggagacgacacuugaaaacaaggagcuggcucccaauuccgauauccccgaagaggaaccugcccccagccucaaagugcaagagucuuccagagacugcgcccugagcucuacccuugaggacacacugcagggaggcguccaggaagugcaggauaccguccucaagcaaauggaguccgcucaggaaaaagaccugccucagaagaagcacuucgauaaccgggagagccaggcgaauagcggggcccuggacaccaaccaagugucucuccagaaaauugauaaucccgaaagccaggcuaacuccggagcccuggacacaaaucaaguucuucugcauaagaucccgccucgcaaaagacuccggaagagagauagccaggugaaaucuaugaagcacaacucccgcgucaaaauccaccagaaguccugugagcggcagaaggccaaagagggcaauggcugcagaaagacguuuucucgcagcaccaaacaaauuacauucauccggauucauaaggggucccagguguguagaugcucugaauguggaaaaaucuuucgcaacccccgguacuucagcguucacaagaagauucauaccggcgagagaccuuaugugugccaggacugcgggaaaggauuuguccaguccagcucucugacacaacaccagcgcgugcacuccggcgaacggcccuucgagugucaggaaugcgggagaaccuucaacgaucgcagcgcuaucucucagcaucugcggacgcacacaggagccaagccuuacaaaugucaagacugcggcaaggcguuuagacaguccagccaucuuauucggcaccagcgcacccauaccggcgagagacccuacgcuuguaauaaaugcgggaaggccuucacacaauccucucaccucaucggacaccagcggacccauaacagaacaaagcgcaaaaagaaacagccgacgagcuga

SEQ ID NO: 78183 - RNA, 1845 nt, Artificial Sequence
  derived and/or modified sequence opt5 from ZNF276__Homo_sapiens__NP_001106997
augaagagagaccggcugggccgcuuccucagccccggguccucuagacagugcggagccagcgauggcgggggaggcgugucccggacccgcgggagaccuucucugagcggaggcccgcgggucgacggcgcuacagcccgcagagcgugggggcccguuggauccuguggcgaugcuggggaggacggagccgaugaagccggcgcugggcgggcccuugcuaugggacacugccgccugugucauggcaaauuuucuagcagaucccuccggagcaucucugagcgcgccccuggcgcguccauggaaagacccagcgccgaggaacgggugcuggugcgcgacuuccaaagacuucugggggucgcugugcggcaggauccuacgcucucucccuuuguuugcaaguccugucacgcccaguucuaccagugccauagccugcugaaaucuuuucuccaaagagugaacgcuuccccugccggacgccggaagccgugugcgaaagucggcgcccagcccccuaccggggcugaggagggagccugccugguggaccuuauuacaagcagcccccagugucugcacggccucguugggugggugcauggacacgcugccucuugcggcgcccugccucaccuucagagaacccugagcuccgaauauuguggcgucauccaaguggugugggggugcgaucagggacaugacuacacaauggauaccuccucuuccugcaaggcuuuccuccuggacagcgcgcuggccgucaaguggcccugggauaaagagacagcuccgcgccucccucagcaccggggcuggaaucccggggacgccccucagaccucucaaggaagaggcacggggacccccguuggcgccgaaacaaagacccugcccagcacagacguggcucagccuccguccgauucugacgccgugggaccccgcagcggcuuuccuccccagccuucccuuccccugugucgggcgccggggcaacucggagagaaacagcugccuagcucuaccuccgaugacagagucaaggaugaguucagcgaccuuucugaaggcgaugugcuguccgaggacgaaaacgauaaaaagcagaaugcucagagcuccgacgagucuuuugaacccuauccugagcgcaagguuagcgggaaaaaguccgagucuaaagaagccaagaaaagcgaggaaccccggauuagaaagaaaccuggacccaagccgggcuggaagaaaaagcuccgcugcgagcgggaggaacugccuacgaucuacaaaugucccuaucaagggugcacagccguguacagaggcgcugauggaaugaagaaacauauuaaggagcaccacgaagagguccgggaacgccccuguccucauccgggcugcaacaagguguucaugaucgacagauaucugcagcggcacguuaaacucauccauaccgaggugagaaauuacauuugugacgaaugcgggcagacauuuaagcagcgcaaacaucugcuuguccaccaaaugcggcacuccggagccaagccccugcagugugaggugugcggcuuccaguguagacagcgcgcuagccucaaauaccacaugaccaagcauaaggccgagaccgaacuggauuuugcgugcgaccaaugcgggagacgguucgagaaagcccacaaccuuaauguccauaugucuauggugcacccucugacacagacgcaggauaaggcucucccccuggaagccgagccucccccuggacccccguccccuagcguuaccacagagggccaggcugugaaacccgaaccuaccuga

SEQ ID NO: 78184 - RNA, 1353 nt, Artificial Sequence
  derived and/or modified sequence opt5 from ZNF277__Homo_sapiens__NP_068834
auggccgcuagcaagacccagggcgccguggcgagaaugcaagaggaccgggauggguccugcucuacagucggaggcguuggguacggagacagcaaagauuguauccuggaaccccucucccugccugagucuccgggcgggacgaccacacuugaaggaagccccuccgugccuugcauuuucugugaggaacacuuucccguggcugagcaggacaagcugcucaaacauaugaucauugagcacaagaucgucauugccgaugugaaacugguugccgacuuccagcgcuauauccuuuacuggagaaagcgguuuaccgaacagccuaucacagauuucugcucugugauucgcaucaacagcaccgcucccuuugaggaacaagagaauuauuuccugcucugugacguccugccugaggaucggauucugagagaagaacuccagaagcagcgccugagagaaauccuugagcagcaacagcaggaacggaacgacacaaauuuucauggcgugugcauguucuguaacgaggaguuucugggcaaucgcuccguuauucucaaccacauggccagagaacaugcuuucaauaucgggcugccggauaacauugugaauugcaacgaguuucuuuguacccugcagaaaaagcucgacaaucugcaaugccuguacugugagaaaacguuccgggauaagaacacccucaaagaccacaugcgcaagaagcagcacagaaaaaucaaucccaagaaccgggaguaugaccgcuuuuacgucaucaauuaucuggaacuuggaaaaagcugggaggaggugcagcuggaagaugacagagagcuccuggaucaucaagaagacgauuggucugacugggaggaacacccugccuccgcggugugccuuuucugcgagaagcaggccgagacaauugaaaaacuguacguccauauggaggaugcucacgaguucgaccuccugaagaucaaaagcgaacugggccucaacuuuuaccagcagguuaagcuggugaacuucauucggagacaagugcaccagugucgcugcuaugggugucaugucaaguuuaaaucuaaggccgaucuucggacccacauggaggaaacaaaacauaccucccugcuccccgacagaaagacgugggaucagcuggaguacuauuucccuacauacgaaaaugacacccuucugugcacacucagcgacucugaguccgaucugaccgcucaggaacaaaacgagaaugugcccaucauuagcgaggacaccuccaaacuguaugcccucaagcagucuagcauccugaaccagcuucugcucuga

SEQ ID NO: 78185 - RNA, 1632 nt, Artificial Sequence
  derived and/or modified sequence opt5 from ZNF280B__Homo_sapiens__XP_011545198
auggagcagagcugcgaagaggaaaaggagcccgaaccucaaaagaacauccaggagaccaaacagguggacgaugaggacgccgaacugauuuucgucggcguugagcacgugaaugaagaugcugagcucaucuuugugggggucacauccaacucuaaaccggugguuagcaauauucugaacagagugacgcccggauccuggucucggcgcaagaaauacgaccaucuuagaaaggauaccgcccggaagcugcagccuaaaagccacgagacagucaccuccgaagcggugacaguucuccccgcuucucaacuggagagccgcuccaccgacagcccuaucauuaucgaaccccuuucuaagccugauuauagaaauuccagcccccaggugguccccaacaauucuuccgagcugccuagcccccucaucacauucaccgacucucugcaucacccuguguccacggcccugagcgugggcgggauuaacgaauccccgcgggucucuaaacagcucagcaccuuugagguuaauuccaucaacccgaagcgcgccaaacugagagauggaauuaucgagggcaauagcucugcuuccuucccuagcgacacauuucauaccaugaacacacagcaaucuacccccagcaauaacgugcacacgucccuuucucacgugcagaauggggccccuuuccccgcugccuuucccaaggauaacauucauuucaagccuaucaacacaaaucuggaccgggcgaacgaacucgccaaaaccgauauucugagccuuacaucccagaauaagaccuuugacccgaaaaaggagaaccccaucguccugcucagcgacuucuacuauggacagcacaaaggcgaaggccaaccugagcagaagacccauacaacguuuaaaugucugucuugcgugaagguucugaagaaugugaaauucaugaaccacgucaagcaccaucucgaauuugagaaacagcgcaaugauuccugggagaaccacaccacaugucaacauugccacagacaguuccccaccccuuuccagcugcagugucauaucgaaaaugugcacacagcucaagagcccagcaccguuugcaagauuugugaacuuucuuuugagacggaccaggugcugcuccagcacaugaaagaucaucacaagccgggggaaaugccuuacgucugccaggugugucauuaucgguccagcgucuucgccgacguggagacacacuuuagaaccugccacgagaacaccaagaaucugcuuugucccuucugccugaaaaucuuuaagacagcuaccccuuacaugugccauuaucgcggacacuggggcaaauccgcccaucaauguucuaagugccggcuccaguuccugacauuuaaagaaaagauggagcacaagacgcagugucaucagauguucaaaaagcccaaacaacuggaagggcucccucccgagaccaagguuacaauucaggugagccuggagccgcuucagccuggauccgucgauguggcgucuaucaccguuagcacauccgacagcgaacccucucugccccgcuccaaaagcaagauuucuaagaaaucccacuga

SEQ ID NO: 78186 - RNA, 2901 nt, Artificial Sequence
  derived and/or modified sequence opt5 from ZNF280D__Homo_sapiens__NP_001002843
auggccgagcuguucauggaaugcgaggaagaggaacucgagcccuggcagaagaaagugaaggaggucgaagacgaugacgaugacgagccuaucuuuguuggcgaaauuagcuccucuaaaccggcuaucagcaacauucugaauagagugaaccccuccucuuacagccgggggcuuaagaauggagcccugucccgcggcaucaccgcggcuuucaaaccuacaucucaacacuauacgaaccccaccagcaauccugugcccgccuccccuauuaacuuucauccggagagcagaucuuccgauagcucugucaucgugcagcccuucuccaagccuggguacaucacaaauagcucucggguuguguccaacaagagcuccgagcuccuguuugaccuuacccaggauacaggacugucucacuaucagggcgggcccacccucagcauggccggaauguccgaaagcucuuuccuguccaaacgcccuagcacaucugaggucaauaacgugaaucccaagaaaccgaagccuagcgaauccguuucuggcgcuaacagcuccgccgugcugcccagcgucaaaucuccuuccgugaccagcucucaagcuaugcucgccaagggcacgaauaccuccagcaaccaguccaagaaugggacacccuuucccagagcguguccuaaaugcaacauucauuucaaccugcuugacccgcugaagaaucacaugaaauacuguugccccgauaugaucaacaauuuucucggacuggccaagaccgaguucucuagcacagugaacaaaaauaccacgauugacuccgaaaagggcaaacuuaucaugcuggucaacgauuuuuauuacgggaagcaugagggagacguucaggaggaacagaagacacacaccacauucaaauguuuuucuugccucaagauucugaaaaauaacauccgguucaugaaucacaugaagcaucaccuggagcucgaaaaacaaagcuccgagagcugggaaaaccauaccaccugucagcacugcuaucgccaguucccuacacccuuucagcugcaaugucacauugagucuacgcauaccccucacgaguucuccacaaucugcaagaucugugaacuuagcuuugagaccgaacaugugcugcuccagcacaugaaggauaaucauaaacccggcgagaugccguacgugugccaggucugcaacuacagaucuuccagcuucucugacguggaaacacacuuucggaccagccacgagaauacgaagaaccugcuuuguccuuucugccugaaaguuauuaagaucgcuacacccuauaugcaucacuacaugaaacaucaaaagaaggggauucaccgcuguaccaaaugcagacuccaguuucugaccuguaaggagaaaauggaccacaagacacagcaucaccggaccuucaucaaaccuaagcagcuggaaggacugcccccuggcacaaaggugacgauucgcgccuccgucggcccccuccaaagcggggcuucuccgaccccuuccaucagcgccuccgcgucuacacuucagcugagcccucccagaaccaaaaauaucacagccaagaaccccgcuaaauccaacaccucuaagccgaauacggugaaaagcaacgccuccaagcccaauaccucuaaaccuaacggaagcaaguccaaguauaaacccaagauuagcaauaugcagaaaaagcagucuacacucgcuuccagcaacaaaaagucuaagguuaauaccgcccugcggaaccuucgcuacagacggggcauccauaaaugcauugaguguugcuccgaaaucaaggauuuugccaaucacuucccuacauaugugcauuguagcuuuugcagauacaacaccucuuguuccaaagcguaugucaaucacaugaugagcuuccacuccaaccgccccagcaagcgguuuugcauuuucaaaaagcauucugagaaucugagagggaucacgcucgugugccugaacugugacuuccugagcgaugucuccggacucgacaauauggcgacacaccugucucaacauaagacccacacaugccaggugguuaugcagaaagugagcgucuguaucccuaccuccgagcaucuuucugaacugaagaaagaggcccccgcuaaggaacaggagccggugagcaaagaaauugcccgcccuaacauggccgagcgggagaccgaaacauccaacucugagagcaagcaagauaaggcugccuccagcaaagaaaagaauggcugcaacgcuaauucuuuugagggguccagcacgaccaaaucugaagaguccaucacaguuagcgacaaggagaacgaaaccugucucgcugaucaggagacaggauccaaaaauauugugucuugcgacagcaacaucggcgccgauaaggucgagaaaaagaagcagauucagcacgugugucaagaaauggaacugaaaaugugccaguccagcgagaauaucauucugucugaccagaucaaggaucacaacuccagcgaggccagauucucuagcaaaaauaucaaggaccuucgccucgcuuccgacaacgugucuauugaucaauuucugcggaaaagacaugaacccgagagcguuuccucugacgucagcgaacagggcuccauccaccuggagccucucacccccagcgaggugcuggaauacgaggccacggaaauucuucagaaggggucuggagauccguccgcuaagacagacgagguggucagcgaucagaccgacgauaucccuggcgggaauaaccccuccaccacagaagccaccguggaccuggaggaugagaaagaacgcucuuga

SEQ ID NO: 78187 - RNA, 2688 nt, Artificial Sequence
  derived and/or modified sequence opt5 from ZNF281__Homo_sapiens__NP_001268222
augaagaucggcagcggguuccuguccggaggcgggggaaccggcucuagcgggggauccggcucuggcgggggaggcagcgggggaggcgggggaggcggcuccucugggagacgggccgagauggaacccacauuuccucagggaauggugauguucaaccaccgccucccgcccgucacgagcuuuaccagaccugcuggcuccgccgcgcccccuccccaaugcguucuguccucuuccacaagcgcugccccugccgcugagccgcccccucccccugcccccgacaugaccuucaaaaaggaaccggcugccucugcggccgcuuuuccuucccagcggacaagcuggggguuccuucagucucugguguccauuaaacaggagaagcccgccgauccugaagaacaacagagccaucaccaucaccaucaccaccauuacggaggccucuuugcuggggccgaggaacgcucccccggacugggcggcggggagggaggcucucacggggugauccaggaccuuagcauucugcaucagcacguccaacagcagcccgcgcagcaccauagagaugugcuccuguccucuagcucccggaccgacgaucaccauggaacagaggagccuaaacaagacaccaauguuaagaaggccaaacgcccgaagcccgagagccagggcaucaaagcuaagagaaaaccuucugccagcuccaagcccucucuggugggggauggcgaaggagcuauucucagcccuucccagaagccccacaucugugaccauugcagcgccgccuuccggucuuccuaucaucugcgcagacacguccuuauccacacgggcgagcggccguuucaauguagccagugcucuaugggguucauucagaaauaccugcuccagcgccacgaaaagauccauuccagagagaaaccuuuuggaugugaucaaugcagcaugaaguucauucagaaauaucacauggaacggcacaagcgcacccauuccggcgagaaacccuacaagugugacacaugccagcaguauuuuucuagaaccgaucggcugcuuaagcacagacgcacauguggggaggugaucguuaaaggagcuaccagcgcggaaccuggcuccucuaaccauacgaauauggggaaccuggccgugcucagccaaggcaauacauccagcucucggagaaagaccaaauccaagagcauugcuaucgagaacaaagaacagaagacaggaaagaccaaugagucucagauuuccaacaauaucaacaugcagagcuacucugucgaaaugcccaccgugagcuccagcggcgggaucauuggaacaggcaucgacgagcugcaaaaacgcgugccuaagcugauuuucaaaaaggggucucggaaaaauacggauaagaacuaucucaauuucgucagcccccugccggacaucguuggacaaaagagccuuuccggcaaaccuucugggagccugggcauuguguccaacaauucuguggagaccaucggacuccugcagagcacauccggcaagcaggggcaaaucucuagcaacuacgacgaugccaugcaguuuuccaaaaagagacgcuaccuucccaccgccagcucuaacuccgcuuucagcauuaaugucggacacauggugucucagcaauccguuauccagagcgccggcgugucuguccuggacaacgaagcgccccucucccugauugauagcuccgcucugaaugccgagaucaaaagcugccaugacaagucugggauuccugaugaagugcuccagagcauccuggaccaguauuccaacaagucugagagccaaaaagaagauccguuuaauaucgccgagccccggguugaccuucacacauccggagagcacucugaacuggugcaggaggaaaaccucagcccuggcacccagacgcccuccaaugauaaggcuucuaugcugcaggaguacagcaaauaucuucaacaggccuucgagaaguccacaaacgcuagcuuuacccuggggcauggcuuccaguuugucucucucuccagcccucugcacaaucauacccuguuccccgaaaaacagauuuacacaaccucuccucucgaguguggauuuggccaauccgugacaagcguccugcccuccucucuuccgaagccucccuucgggaugcuguuuggaagccagccuggccucuaucuguccgcccuggacgcgacgcaccagcaacuuacccccagccaggaacucgaugaccugaucgacucucagaaaaaccuggagacauccagcgccuuccagucuagcucccaaaagcucaccucucagaaggaacagaaaaaucuggagagcuccacaggguuucagauuccgucucaagagcuugcuagccagaucgauccucagaaggacauugaacccagaaccacguaccagaucgagaacuucgcccaggcuuucggaucccaguuuaaaagcggcucucgcgugccuaugaccuucauuacaaauuccaacggcgaaguugaucaucgggugagaaccagcgucuccgacuuuucuggguauacaaauaugaugagcgauguguccgagcccugcucuacccgcguuaagacgcccacaagccaguccuaccgguga

SEQ ID NO: 78188 - RNA, 1392 nt, Artificial Sequence
  derived and/or modified sequence opt5 from ZNF282__Homo_sapiens__NP_001290410
augcaguucgugagcaccagaccccaaccucagcagcugggcauccaggggcucggacuggacuccggcucuuggagcugggcccaagcccuuccgcccgaggaagucugccaccaggagccugcucugcgcggggaaauggcggagggaaugcccccuaugcaggcucaggaaugggauauggacgcccggagacccaugccuuuucaauucccgcccuuuccugaucgggcccccguuuucccugaccgcaugaugagagagccccagcucccgacagcugagauuucccuguggacggugguggccgcuauccaggccgucgaacggaagguggaugcgcaggccucucaacuucugaaccucgagggccgcaccgggacagcugaaaagaaacuggccgacugugagaaaaccgcuguugaguuuggaaaucauauggaaagcaagugggccgugcugggcacacuccugcaggaguacggccuucugcagagacggcucgaaaaccuggagaaucuucugcgcaacagaaauuucuggguccuccggcugccucccggguccaaaggagaagcgccuaaggugcccguuaccuuuguggauauugccgucuauuucucugaggacgaguggaagaaccuggaugaauggcaaaaagagcucuacaauaaccuggugaaggaaaauuauaaaacacuuaugagccuggacgcugagggcuccgugcccaagccugaugccccgguccaggcugaaccccgcgaggagccuugcguuugggaacagagacaccccgaggaacgggagaucccuauggaccccgaagccggggccgagccgcucgugccugcucaggaugcgagcucucaagugaaacgcgaggacacccugugugucagaggacagcggggccuugaagagagagccauucccacggaauccaucaccgacagcccuaucucugcucaggaucugcucucccgcauuaagcaggaggagcaucaaugcgugugggaccagcaggaucuggccgaccgggauauccccacagacccuaacagcgaaucucugauuuccgcccacgauauccucagcuggauuaagcaggaggaacaacccuacccgugggggccuagagacuccauggauggagagcugggccuugacucuggccccagcgauucccugcucaugguuaaaaaucccccuccggcucccccucagccccagccucagccccaaccuccccagccgcagcugcaaagccagccucagccccagucucuuccucccaucgccguggcggaaaacccugggggaccgcccucccgcggccugcucgacgacggguuucaaccucaucagggagcugcccugcgggucagauga

SEQ ID NO: 78189 - RNA, 1569 nt, Artificial Sequence
  derived and/or modified sequence opt5 from ZNF286B__Homo_sapiens__NP_001138517
auggagaccgaccuggccgaaaugcccgagaagggcgugcucagcucccaggauucuccucacuuccaagagaaaagcacagaggaaggggaggucgcugcccugagacuuacggcgcggucccaggcugccgccgcugccgcugccccgggaucucgcagccugagaggcguucaugugcccccuccccuccacccugcgcccgcccgggaggaaaucaagucuaccugcucccugaaggcuuguuuuagccuuucccugacacucaccuacuaucgcacagccuuccugcugagcaccgagaacgaagggaaucuccauuuucagugcccuucugacguggagacaagaccgcaguccaaagauagcaccucuguccaagacuucuccaaagcugagagcuguaagguggccauuaucgaucggcugacgcgcaacucuguuuacgacuccaaucuugaagcggcccuggagugcgaaaacuggcucgagaagcagcagggaaaucaggaaagacaucugcgggagauguuuacccacaugaacagccuuuccgaggaaacagaucacgagcacgacguguauuggaaaucuuucaaucaaaagagcguccugauuaccgaagaucgcgugcccaaaggcuccuacgcuuuucauacacucgaaaagagccugaaacagaagucuaaccugaugaagaaacagagaaccuauaaggagaaaaagccucacaaauguaaugacugcggggaacucuucacgugucauuccguucacauccagcaccaacgggugcauacaggagagaagcccuauaccugcaacgaauguggcaagagcuuuucucaccgcgccaaucugacaaaacaucagagaacccacacccggauucuuuucgagugccgcgaauguaagaaaacauuuacggagagcuccucucuggcuacccaucagagaauccacgucggcgaacggccuuacgagugcaacgagugcgggaagggauucaauagaagcacacaccucgugcaacaucagcugauccacaccggcgugcgccccuacgaauguaacgagugcgauaaagccuuuauucauuccagcgcccuuaucaagcaccagcggacacacaccggggaaaaaccguacaagugucaggagugcggaaaggcuuucucucauuguuccagccugacgaaacaccaaagaguccauacaggcgagaagccuuaugaaugcucugagugugggaaaaccuucucccagagcacccaccucguucagcaucagcgcauucacacaggagaaaagcccuacgagugcuccgaauguggcaaaaccuuuucucaaagcuccaauuucgcgaagcaccagcggauccauauuggcaagaaaccuuauaagugcucugagugugggaaagccuuuauccacagcuccgcucugauucagcaucagagaacacacacgggagagaagcccuuccgcugcaacgaaugcggcaagagcuuuaaauguucuuccagccugauccggcaucaaagagugcacaccgaggaacagcccuga

SEQ ID NO: 78190 - RNA, 1428 nt, Artificial Sequence
  derived and/or modified sequence opt5 from ZNF296__Homo_sapiens__NP_660331
augagcagacggaaggccggcuccgcuccccgcagaguggagccugccccggcggcuaaccccgacgaugaaauggagaugcaggaccuggucaucgaacucaaaccugagcccgaugcccaaccucagcaggcuccccggcuggggccuuucucuccgaaggaaguuagcuccgccggacgcuuuggcggggagccccaccacucuccuggacccaugccugccggcgcugcccuucuggcgcucgggcccagaaauccguggacccuguggacaccucuuacgcccaacuacccugaccggcagcccuggaccgauaaacaccccgaccugcucacaugcggacgcugucugcaaaccuucccucuggaggccauuacagcuuuuauggaucauaagaaacucggcugccagcuguucagaggcccgagccgggggcagggauccgaacgcgaggaacuuaaggcccugucuugucucagaugcggcaagcaguuuaccguggcuuggaaacugcuucggcacgcccaaugggaccaugggcugagcaucuaucagacagaguccgaggcgcccgaagccccucuccugggacuggcugagguggccgcugccgucagcgccgugguuggccccgcugcggaagccaagucuccucgcgcuuccgggagcggacucaccagacggucucccacguguccggugugcaaaaagacccuguccagcuucucuaaucuuaaaguccacaugcgcucccacacaggcgagagaccuuacgccugugaucagugccccuaugccugugcucagagcuccaagcugaaccggcauaagaaaacccacagacaagugccuccccagucuccucucauggccgacacaagccaggaacaagcguccgcugcucccccggagccugccguucaugccgccgcucccaccagcacgcugcccugcucuggcggggagggagccggcgcggccgcuacagccggggugcaggaaccuggagcuccgggcuccggggcccaggcgggacccggcggcgauaccuggggagccauuacaaccgagcagcgcaccgacccugcuaauagccaaaaggccucucccaaaaagaugccuaaaagcgggggcaagucccgggggcccggaggcucuugugaauuuugcgggaaacacuucacaaacagcuccaaucuuacgguccacagacgcagccauaccggcgagcggccuuacacaugcgaauuuuguaacuaugcuugcgcccagucuuccaagcugaauagacaccgccggaugcauggaaugacccccggcagcacaagauucgaguguccgcacugccaugugccuuuugggcuccgcgccacccuggauaagcaucugcggcagaaacaccccgaggcugcgggagaagccuga

SEQ ID NO: 78191 - RNA, 1152 nt, Artificial Sequence
  derived and/or modified sequence opt5 from ZNF2__Homo_sapiens__NP_001017396
augcuggagaacuacaauagcaucgugucccucggccugcccgucccucagccggacguuauuuuccaacuuaagagaggggauaaacccuggaugguggaccugcacggaucugaggaacgggaauggccugagagcgugucccucgauugggaaaccaagcccgagauccaugacgccucugauaaaaagagcgagggcucccugcgcgaaugccuugggagacagucuccucugugucccaaauuugagguccacacaccuaacggacggaugggcacggaaaagcagagcccguccggggagacccgcaagaaaagccucucuagagacaagggacugcggcgcagauccgcucugagccgggagauucucacaaaagaacgccaucaggagugcucugauuguggcaagaccuucuuugaccacuccagccugacaagacaucaacggacccacacaggcgaaaaacccuaugauugccgcgagugugggaaggccuucucucacagauccagccuuucccggcaucugaugucucacaccggagaaagcccuuacgagugcuccguguguagcaaggcguuuuucgacagaucuucccucacgguucaucagcgcauccacaccggcgagaaacccuuucagugcaaugaaugugggaaggcuuucuuugaucggagcucucugacaagacaccagcgcauucauaccggagagagcccuuaugaaugccaccaauguggcaaagccuucucccagaagucuauccuuacacggcaucagcugauccacaccgggagaaaacccuacgagugcaacgaaugcggaaaggccuuuuauggcgugagcucccucaaucgccaucagaaagcucacgccggcgacccgcgguaccaauguaacgagugcgggaaggcuuucuuugauagaagcucucugacgcagcaccagaagauucauacaggagacaaaccuuaugaguguuccgaaugcggcaaggccuucagccaacgcugucggcugaccagacaccagcgcguccauacaggggagaaacccuucgaaugcaccguguguggaaagguguuuucuuccaaaagcuccguuauccagcaccagcggagauacgcgaagcaaggcauugacuga

SEQ ID NO: 78192 - RNA, 1863 nt, Artificial Sequence
  derived and/or modified sequence opt5 from ZNF300__Homo_sapiens__NP_001166302
auggugcccgccgagaccagcuccucuggccugcucgaagaacagaagaugaugaaaagccaagggcuggucuccuucaaggacguugcuguggauuuuacacaggaagaguggcagcagcuugacccuucucaaagaacgcuguaccgggaugugaugcucgaaaacuauagccaccuggucuccaugggauacccggugucuaaacccgacguuaucagcaaacuugagcagggcgaggaaccuuggauuaucaaaggggauauuuccaauuggaucuaucccgacgaguaccaggccgauggacgccaggacagaaagagcaaccugcauaauucucaauccugcauucucggcaccgugagcuuccaccauaagauccugaaaggggucacacgggauggaucucuguguuccauccucaaggugugccagggcgacggccagcugcagcgcuuucuugaaaaccaagauaaacuguucagacagguuaccuuugugaauagcaagacagucaccgaggcgucugggcacaaauauaacccucucggaaagauuuuccaggaguguaucgaaacagacauuuccauccaacgguuucauaaguacgaugcuuucaaaaagaaucugaaacccaacauugaccuuccuagcugcuauaaguccaauucucgcaaaaagccggaccagagcuuuggcgggggaaaauccagcucucaguccgagcccaacagcaaucuggaaaagauccacaacggcgugauuccuuucgaugacaaucagugugggaacguguuuagaaauacccaaucucucauccaguaccagaacgucgagacgaaggagaaaagcugcguuugugugaccugcggaaaggccuucgccaaaaagucccagcugaucgugcaccaacggauucauacaggcaaaaagcccuacgauuguggcgcuugcgggaaggccuuuucugagaaauuccaccuggucgugcaucagcgcacccacacaggagagaagccuuaugacuguagcgaaugcggcaaagccuucucccagaaaagcucucucaucauucaccagagaguucauaccggggagaaacccuacgaaugcuccgaguguggaaaggcuuuuagccaaaagucuccgcugaucauucaccagcggauccauacgggcgaaaaaccuuaugagugccgcgagugugggaaggcguucucccagaaaagccagcuuaucauucaccauagagcccacacaggagaaaagcccuacgagugcaccgaauguggcaaggcuuuuugcgagaagucccaccugaucauucauaagcggauccacacaggcgaaaaaccuuauaagugugcccaaugcgaggaggcuuucucucgcaaaaccgaacucauuacccaucagcuggugcacacaggggagaagcccuacgaauguacggagugcggaaaaaccuuuagcagaaagucccagcuuaucauccaccaacggacacauaccggcgagaaacccuauaaguguucugaaugcgggaaggccuucugccagaaaagccaccugauuggacaucagagaauccacacaggcgagaagccuuacauuuguaccgaaugcgggaaagcguuuucccaaaagagccaucucccgggccaccagcgcauccacacgggagagaaacccuacauuugugccgaaugcggcaaggcuuucucucagaaguccgaucugguccugcaucagcggauccacacaggggagagaccuuaucagugugccauuugcggaaaggcuuuuauccaaaagagccagcucaccgugcaucagcgcauccacaccguugugaaaucuuga

SEQ ID NO: 78193 - RNA, 2001 nt, Artificial Sequence
  derived and/or modified sequence opt5 from ZNF311__Homo_sapiens__NP_001010877
augcaggaggugguccugcucgacgaaagcuccggacccccuucucaacugcuuuggaccagacaggauacacagcugccgcaggagagcgcccuccugcccgcuccuuaccccgccuucacgaaggacgggucccaaggaaaccuuccucaggcggauaucacccugaugucucaggcucaggaaagcguuacauuugaggacguggccgugaauuucaccaaccgggaauggcaaugccucacauaugcccagcgccaccuguacaaagaugucaugcuggagaauuauggcaacauggugucccucggguuucccuucccuaagccgccccugauuucucaucuugagagagaaguugacccuugugugcaggauccccaggaccgggagagccuguccugcagcuacccugucucugcugauaaaauguggcccgaaaaugagaaggccuccagccaacaggagaucuuugaaaacggagaggcuuauuggaugaaauucaauucucuccugaagguggacucccgcgauccgaagguuagagaaguguguguccaggacgugaaacuugagaaccaaugggaaaccagcauucgggagaagcugcgcgaggaaaaagagggcucugaagaggugacaugcaagaaagggaagaaucagaagguccucuccaaaaaccugaauccuaacagcaagcacucccaguguaauaaaguucugaucgcccagaagcuccaugaaugcgcgagauguggcaaaaacuuuucuuggcacagcgaucugauucuucaugagcaaauccacuccggcgagaagccccacgugugcaaugaauguggcaaagccuucaagacccggaaccagcugagcaugcaucgcaucauucacacgggggagaagccuuuuaacugcacccaguguggaaaagccuucaauucuagauccgcucucugccggcauaagaaaacacacagcggcgaaaagccccacgagugccgcgacugugggaaggcuuuuaaaaccagaaaccggcugugcaugcaucagcuuauccacacaggagaaaagcccuacaaauguaauugcuguggcaaggccuuccaauuuaaacauucucugaccauucacgggcgcauccauacgggagagaagccuuaugagugcgaagaguguggcaaagcguucagcggcuccucugaccucacaaagcacauuagaauccacaccggggaacggccguacgagugcagcaaguguggcagagccuucucccgcagcucugaucuguccaaacauaagcggauucacacaagagagaaacauuacggaugcccccagugugggaaggacuuuagcaucaaagcugaacugaccaagcaccgccggauccacaccgaggaaaagagauaucgcugcgaggaaugcggaaaagccuuccggcauaacuguaagagacgcgcucacgagcgggagcauacaggcgaaaaaccuuaccagugcagagauugugggaagacguuucaggacaaacacugccucaccauucaucaacgcauccacacaggagagaagcccuauaaaugucuggaaugcggcaaggccuucucuggcaaguccaaucuuaccaaccaccggcggauucauacaggggagaaaccucacaagugugaagugugcggaauggccuuucaucacagcuccguccugagacagcauaaacgcauccacaccggcgagaagcccuacacguguucugagugcgggaccagcuucagacagggauccgcucucauuggccacaaacgggugcauacaggggaaaagccguaugagugugaagagugcggcaaggcguuuagaguuucuagcaaucugaccggacacaaaaagcgcaaacaucaggugugguccacacacgaacuugauggcagccggaagucucuguccccugucaccgugagccaaacaucuguuguguccauccucacgagcgccuga

SEQ ID NO: 78194 - RNA, 6840 nt, Artificial Sequence
  derived and/or modified sequence opt5 from ZNF318__Homo_sapiens__NP_055160
auguaccgguccuccgcccggucuuccguguccucucaccgccccaaggacgauggcgggggaggcccucgcagcgggcgguccucuggaagcuccagcggccccgcucgccggucuucucccccucccccucccagcgggagcuccagccgcaccccugcccgcagaccgcggucucccuccggacaucgcggcagacgggcgagcccuucucccccucgcggcagacgggucagccccagcccgccucgcgcuagacgggggucccccagcccucccagaggacgccggcuguuucccccuggcccggccggguucagaggaucuucccgcggcgagagccgggccgacuaugcuagagaugggcgcggagaccaccccggcgauucuggcagccggagacgcuccccugggcucugcucugacagccuggaaaaaucccuucggaucacaguuggaaacgaucauuucugcgugagcacgcccgagagacgccggcugucugacagacucggcuccccuguggauaaucuggaagacauggaucgggacgaucuuaccgacgacagcgucuuuacaagaucuucccagugcagcagagggcuggagcgguacauuucccaagaagagggaccccucucuccguuccugggccagcuggaugaggacuauagaaccaaggaaacauuucuccaccgcagcgauuacuccccucauaucucuugucacgacgagcugcuucgggggaccgaaagaaaccgcgagaaacugaagggauauagcauuagauccgaggaacggagccgcgaggccaaaagaccccgguacgaugacacagugaagaucaauucuaugggcggcgaucacccuuccuucaccagcgggacgcgcaacuauagacagcggcgcagaucucccuccccucgguuucucgaccccgaguuccgcgagcuggaucuugcuagacggaagagagaagaggaggaagaacgcagccggucucugagccaggaacucguuggaguggacggcgggggaaccggcugcuccauuccggggcugagcggcguccugacagccucugagccuggauacucccuccauagacccgaagaggugagcguuaugcccaaaaaguccauccugaaaaagcgcaucgagguggauauuauggaaccuucuaugcaacuugagagcuuuuccucuagcaccuccucuagccaggaccacccgcuguacuccggccaucccagccucccucugucuggggcgaucgccgcuuucgccuccgaaauugagaauaaaggaacaauggucgaaaccgcucuuaaggagccccagggcaaccuguaucagugggggccucuccccggaaucccuaaggacaauagcccccugcgggagaaauuuggcucuuuccugugucacaaggauaaccucgaccugaaagccgaagggccggagagacacacggauuuucuucugccucaugaacgcgcgucccaagacggcagcggauucucucggauucucuccaugcuggccgauagcacauccacccaggagaagagacgccggagcuuccccgacaucgaggaugaagagaaauuucuuuacggcgacgaagaggaagaucugaaggcugagucugugccuaaaccccucgggagcuccgagucugaagugaugagacagaaggccagcucccugccgucuagcgcuccugccgucaagcuggagucccucgaagagacaaaucccgaauaugccaaaauucacgaccugcuuaagaccaucggacuggauaucggcguugcugagauuucucagcucgcggcccggacccaagagcgccugcaugggaaaaagccuagccugagauccagcgcugaccggagaucuuccguggauagauacuucagcgccgaccacuguucuuccguggaccaucgguuuagcgccgauagauguuccucugucgaccacugcuucagcgcugaucgccgguccagcgacccccacagacuugaaucucgcgaggcccaucacuccaacacacauagccccgaagugucucacccucacccgcccagcccuguugaucccuaucuccugacgaaaaauuccccucccuuucugaagucugaccauccugugggacacaucagcggcccggaggucgugggguccggcuuccagucuagcguugcggugcgguguaugcuccccuccgcuccuagcgcccccauuagacugccucauaccgccgcucuuucucaguuucacaugccccgcgccucccaauucgcugccgcgcggaucccgccuaacuaccagggacccgccauucccccugcuagcuuugaugccuauagacauuacauggcuuacgccgcgucccgcuggcccauguauccuacaucucagccgagcaaucaccccgucccugaaccccacagaaucaugccuaucaccaagcaggccacacggucccgccccaaccugagagugauuccgaccgucacgccugacaaacccaagcaaaaagagucucuccggggcagcaucccugcugcccaggugcccguucagguguccauuccuagccugauccgcuacaaucccgagaagauuucugaugagaaaaacagagcuucccagaagcaaaaggucaucgaggaacgggagaaacugaagaacgacagagaggcccgccagaaaaagauguauuaccuucggacagaacucgagagacugcauaaacagcagggggaaaugcugcgcaagaagcggagagagaaagauggacacaaggacccgcuccugguggaaguuagccggcuucaagauaauaucaugaaagacauugccgagcugcgccaggaggcugaagaggcggaaaagaaacagucugagcucgacaagguggcccagauccugggcauuaacaucuucgauaaaucccaaaagagccugucugacagcagagaaccuaccgagaagcccgggaaagcugagaaguccaaaucucccgaaaaggucagcuccuuuagcaauuccucuagcaacaaagaguccaaggugaauaacgaaaaguuccggaccaaaucuccuaagccggccgagagcccccaguccgccacaaaacagcuugaucaaccuaccgcugccuaugaauacuaugacgcgggaaaucauuggugcaaggauuguaacacaauuugcggcacgauguuugacuucuucacccacaugcauaauaaaaagcacacacagacccucgaucccuacaaccgcccuugggcuucuaagacacagagcgaggccaaacaggacgccaucaagagaaccgauaaaauuacggugcccgcuaagggguccgaguuucugguuccuaucagcggcuucuacugccaacugugugaagaguuucucggagacccgaucucuggcgaacagcacgucaaagggcaucagcacaaugagaaguauaagaaauacguggaugagaacccccuguaugaagaacggcgcaaucuugacagacaggccggacuggcggugguccucgaaaccgagcggcgcagacaauccgaacugaagcggaaacugagcgagaagccuaaagaggaaaagaaagagaagaaggcuaaagccgugaaggaaguuaaagaggacgauaaggugucugaaaaacuugaggaccagcucuccgagggcagaaacagccccgaaaaggccgagaauaagcgcaacacagggauuaaacugcagcugaaggaagaggucaaaaaggaaucuccuaccuccagcuccuucggaaaauuuagcuggaagaagcccgagaaagaggaagagaagucuagccucgugacaccguccaucucuaaagaagagauucuggagagcuccaaggauaaagaagacggcaagaccgaggcuggcaaggccaaaccuaucaagauuaaacuuucugggaagacgguuguggcucauacaagccccuggaugcccgucgugaccacauccacccagaccaaaauccggccuaaccugcccaucccuucuacaguucucagaaagagcugcuccgccacgaugagcaagccggcgccccugaauaccuuccugucuauuaaauccagcggaacaaccgccaagccucuucccguggucaaagaaucuuccgcugaucugcuccugccucccgacaucauuagcaaggccuuuggcggggaggaagugauccucaaaggauccccggaggagaaggugguccuggcugaaaaaucugagccuagccaccuucccgaacaaauucugccucccccucccccgccuccgcccccuccgcccccucccccucccguuaucccucaccccgccgccccguccgcugcgcaggccaacgcuauccucgccccugugaaguccaaucccguggucucucagacacuguccccuggcuucguggggcccaacauucugaauccgguucuuccuguggccaucauggcuagcgcccaacccgcggcuauucccucugaugagaccgccccuggagucagcgaauccgaccgcgaucagacgcuguuuucugugcucguucggcccccuccgccccugagcuccguguucucugagcaggccaagaaacucgagaagagaaacagcugucuggcuacagccaaugcgaaagaccuuuacgauaucuuuuauuccagcggcggcaagggggcuccugaaaccaaaggagcccccgagaccaagcugucuggcgggccucucgccaacggagaaaauuccaaccugagccgcacaaaguccucugacaccagcuccacaucuccccugaauagcuccgcuagccaggaggaacuucaucaagaugagggccuggucgccgcuccuauugugucuaacuccgagaaaccgaucgccaagacgcucguugcgcuggggaaauggagcguggucgaacacgugggacccaagucuaccggcuccacauacggcuuccuccagccucugacccggcuuugccagagcagacccuaugagacaaucaccccuaaaacggacacccuggccauuuggacaucuuccagcuuucagucugacaccagccgcgauaucucccccgaaaagagcgagcuggaccucggggagccgggaccucccggcguggaacccccuccccaacugcuugauauucaguguaaggagucccagaaacuggucgaaauccaucuccgggagucuguuaaucaggacaaggaaagccaagagcugagaaaauccgaggauugccgcgaaucugagauugaaacaaacaccgagcucaaggaacgggugaaagagcugagcgaggggaucguggacgaaggagucuccacaucuauuggcccucacagcaucgaugacuccaaucuuaaccaugggaacagauacaugugggagggagaagugaagcagccgaaucugcugaugaucgauaaggaggcugaacagagcaacaaacucaugaccggcucugagacgcccuccaagguugugauuaaacugagcccucaggccuguucuuucacaaaggcuaaacuugacuccuuccugagcgaggcccgcucucuccugaauccccaagauaccccugucaagaucuccgcccccgaacuccugcuucacagcccggcuagaucugcgaugugccugaccggcuccccucaggagcagggggugagcguugugagcgaagagggacuggagaacuccgcccccgaaucugcuagccggacaucccgcuacagaucucucaaacugaagcgggagagaagcaaggacuuucaagucaaaaagauuuaugaacuugccgugugggaugagaauaaaaagcggccugaaaccugggagucccccgagaaaccgaagacggaagcccuggagcuccaggacguccacccugaacugacagugaccaucgagucuaaggcucucgaagacuucgaggccacagaucugaaaguugaggaacuuaccgcgcugggcaaccugggggacaugcccguggauuuuuguacaacccgcgucagccccgcucauagauccccuacggugcucugccagaagguuugugaggaaaauagcgugucucccauuggaugcaacuccagcgacccugccgauuucgagccgauccccucuuuuuccggcuucccucuggacagccccaaaacccuuguccuggauuuugaaacagagggggagagaaauuccccuaacccccgcucugugagaaucccuagcccgaauauucucaagaccggacugacagaaaacguggaccggggccugggcgggcucgagggaacccaccaggcccuugaucugcuggcuggcgggaugaugcccgaagagguuaaagaguccucucaacucgacaagcaggaaagccugggacuugagcugaagacgaucaauuccgccggccucgggccuagccccugccugccugaucuggucgacuucgugacacgcaccucuggagugcagaaagacaagcucuguagcccccuuagcgaaccgggcgauccuucuaaaugcagcucccuggagcugggcccccuccagcuggaaauuucuaacgcgagcacaaccgaggucgccauccuucaaguggacgaugacuccggggauccccugaaucucguuaaggcuccugugagcagaucucccccucgggagcaggucauugaagacaacauggugccgcagggaaugcccgagcaggaaaccacaguuggcgccauccaagaucauacggaguccagcgugcacaacuga

SEQ ID NO: 78195 - RNA, 1530 nt, Artificial Sequence
  derived and/or modified sequence opt5 from ZNF320__Homo_sapiens__NP_997216
auggcccugagccagggccuccugaccuucagagacguggcuaucgaguuuucccaagaagaguggaagugccuugaucccgcccagcggacacuguaccgcgacgucaugcucgaaaacuauagaaaucugguuucucuugauauuagcuccaaauguaugaugaacacgcugucuagcaccgggcagggaaauacagaggugauccacaccggcacacuccagcggcaagcguccuaccauauuggggcuuucugcucucaggaaaucgagaaggacauucacgauuuuguguuccaguggcaggaggacgaaaccaacgaucaugaggccccuaugacagaaaucaaaaagcugaccagcuccacggaccgcuaugaucaaagacacgccggaaauaaaccgaucaagggccagcuggagagccgguuucaucuccaccuucgcagacaccggcgcauucauaccggggagaagcccuacaaaugugaagagugcgaaaaggucuucucuuguaaaucccaccuugagauccauagaauuauccacacaggagaaaagccuuauaaaugcaaggugugugacaaggcuuuuaaacacgauagccaucuggccaagcacacccggauucaucgcggcgacaaacacuacacaugcaacgaguguggcaagguuuucgaucagaaagcuacccucgccugccaucacagaucucacacgggggagaagcccuauaaauguaaugaaugcggaaagacauuuucccagaccagccaucugguguaccaccaucggcuucacacaggcgagaagccuuacaaaugcaacgaaugugggaagaccuucgcgcgcaauucuguccuggugauccacaaagccguucauaccgcugagaagcccuauaaaugcaacgaauguggaaagguguuuaagcaaagagccacacucgcuggccaccggagaguccauacgggggagaaaccuuaccgcugcgaggaaugugacaagguguucucccggaaaagccaccuggagagacaucgccggauucacaccggagaaaagccguauaaaugcaaggugugugacaaggccuuuagauccgauucucgccuggcggagcaccagcggguccauacaggcgaaagacccuauaccugcaaugaguguggcaaaguuuucagcacaaaggccuaccucgcuugccaccagaaacugcauaccggggagaagcuguacgaaugugaggaaugcgacaaaguguauauccgcaagucccaccuggagcggcauagacgcauccacacgggagagaagccucacaaaugcggcgauugugggaaggccuucaacagccccucucaucucauucggcaccaaagaauccauacaggacagaaauccuacaagugccaccaguguggcaaaguguuuagccugcggucucuucuggcugaacaccagaagauuccuuucggggacaauugcuuuaaauguaacgaguacagcaagcccuccucuaucaauuga

SEQ ID NO: 78196 - RNA, 1209 nt, Artificial Sequence
  derived and/or modified sequence opt5 from ZNF322__Homo_sapiens__NP_001229728
auguacaccagcgaggaaaagugcaaccagagaacacaaaaacggaagaucuauaauguguguccccgcaaaggcaagaaaauuuucauccacaugcaugagauuauccagauugacgggcacaucuaccagugccuggaauguaagcagaacuuuugcgagaaucucgcccugaucaugugugaaagaacgcauaccggagagaagccuuauaaaugcgauaugugugagaagacauucguccaauccucugaccuuaccagccaccagcggauucauaacuacgaaaaaccguauaagugcuccaaaugugagaagucuuuuuggcaccaccuggcucucagcggccaucagcgcacacacgccgggaagaaauucuauaccugcgauaucuguggaaagaauuuuggccaguccucugaccugcuuguucaucaaagaagccacacaggggaaaaacccuaccugugcuccgagugcgauaaguguuucagccggucuaccaaccucauucgccacagacggacgcauaccggagagaaaccuuuuaagugccuggaaugugagaaagcguucuccggcaagagcgaccugaucucucaccagcgcacacauaccggcgaaagacccuacaagugcaauaaaugugagaaguccuaccggcaccgcagcgcuuuuauugugcauaaaagagugcacacaggggaaaagccuuauaaaugcggagccugugagaagugcuucggccagaagucugaucucaucguccaccagcgggugcauaccggggagaaacccuacaagugucuggaaugcaugcgcuccuuuacgagaagcgccaaccuuauucggcaccaagcuacacauacccacacauucaaaugucuggaguaugaaaaguccuuuaauugcucuagcgaccucaucguucaccagagaauccauauggaggaaaaaccucaccagugguccgccugcgagagcggauuccugcuuggcauggauuucguggcucaacagaagaugcgcacccagaccgaggaacugcauuacaaguauacagucugugacaaaucuuuucaccaguccagcgcccuccugcaacaucagacggugcacauuggggagaagccguucguuugcaacgugucugaaaaaggacuggagcucagcccuccccacgcguccgaagccucucagaugagcuga

SEQ ID NO: 78197 - RNA, 822 nt, Artificial Sequence
  derived and/or modified sequence opt5 from ZNF32__Homo_sapiens__NP_001005368
auguucggcuuucccaccgccacacugcucgacugccacgggagauacgcucagaacguggccuucuuuaaugucaugacggaggcgcaucacaaguaugaucauagcgaagcuaccggauccucuagcugggacauccaaaacuccuuccggcgcgagaaacuggaacagaagucuccugauagcaaaacacuucaggaggacuccccgggcguuagacagcggguguacgaaugucaagagugcgggaagucuuuucgccagaaaggaagccugacccuccacgagcggauucauacaggccagaagcccuucgaauguacccacugcgggaaguccuuuagagccaaaggaaaucuggugacacaccagcgcauccauaccggcgagaagccuuaucaauguaaagaaugcggcaagagcuucucucagagagggucccuugccguccacgagcggcugcauacgggacagaaacccuacgagugugcuauuugccagcgcagcuuuagaaaccaaucuaaucucgccgugcaccggcgcguucacuccggcgaaaagccuuauagaugugaucagugcgggaaggcuuucagccagaaaggaucucugaucgugcauauucggguccacaccggccugaagcccuacgccuguacacaaugccgcaaauccuuucauaccagagggaacugcauccuccacggaaagauccauacaggcgagaccccuuaucuguguggccagugcgggaaauccuucacgcagcggggaagccuugcggugcaccagagaucuuguagccaacgccugacacucuga

SEQ ID NO: 78198 - RNA, 783 nt, Artificial Sequence
  derived and/or modified sequence opt5 from ZNF330__Homo_sapiens__NP_001278931
augccccaguggaacgugaccagcgucagaggcaagacaaaaugcaugaugaaguccucugacuguguuaucaaacacgccgggguguacagcacgggacuggcuauggugggcgccauuugcgauuucugugaggcgugggucugccaugggcggaagugucucuccacccacgcuugcgccuguccucugacagacgccgaaugcguggagugugaacgcggaguuugggaucauggcgggagaaucuuuucuugcagcuucugucacaauuuucuuugcgaggacgaucaauucgaacaucaggcuuccugccaggugcuggaggccgagaccuuuaaaugugucucuugcaaccggcucggacagcacagcugucugcgcugcaaggcuuguuucugcgacgaucacacaagauccaagguguuuaaacaagaaaagggcaaacagccgcccuguccuaagugcggccaugagacccaggaaacaaaagaccuuagcaugucuacccggucccugaaguucgggcgccagacgggaggcgaggagggggauggagccagcggcuaugacgcguacuggaagaaucucucuuccgauaaauauggggacaccagcuaccacgaugaagaggaagacgaguaugaagccgaggacgaugaggaagaggaagacgagggaagaaaggauucugacacagaauccagcgaucuguuuaccaaccugaaucucggccggacauacgcuuccggcuaugcccauuacgaggagcaagaaaacuga

SEQ ID NO: 78199 - RNA, 1392 nt, Artificial Sequence
  derived and/or modified sequence opt5 from ZNF331__Homo_sapiens__NP_061025
auggcccagggccuggugaccuucgcugacgucgccaucgauuuuagccaagaggaaugggcgugccucaacuccgcucagagagaccuguacugggauguuaugcuugagaauuauucuaaccuggugagccucgaccuggaauccgccuacgagaauaagucucuucccacagagaaaaacauucacgaaauccgggccagcaagcgcaauuccgauagacggucuaaaagccuggggcgcaacuggauuugugagggaacgcucgaaagaccucagcggucccgcggcagauaugugaaucagaugaucauuaacuacgucaagcggccggcuacccgcgaggggacacccccuagaacccaucaacggcaccauaaagaaaauagcuucgagugcaaggacuguggaaaggccuuuucucgcggcuaucagcugucccagcaccagaaaauccauacaggggagaagcccuacgaaugcaaagaguguaagaaggcuuucagauggggaaaccaacugacccagcaccagaaaauccacacaggcgaaaagccuuaugagugcaaagauuguggcaaggccuuucggugggggagcucucucgugauucauaaacgcauccacaccggagaaaagcccuacgagugcaaagacuguggcaaggcguucagaagaggggaugagcugacgcagcaucaaagauuucacaccggagaaaaagacuacgagugcaaggauuguggcaagacauucucccgcguuuauaaacuuauucagcacaagcggauccauagcggggaaaaaccuuacgagugcaaggacugcggaaaagccuuuauuugugggucuucccugauccagcacaagcggauucauaccggcgaaaagccguaugagugccaagaguguggcaaggcuuucacacgcgugaauuaccucacccagcaccagaaaauccauacgggagaaaaaccccacgagugcaaggaauguggcaaagccuuucggugggggagcucccuggucaagcacgagagaauccauacaggagaaaagccuuauaaaugcaccgaguguggcaaggcuuucaacugcggguaccaccuuacacagcaugagcgcauucacaccggagaaacccccuauaaauguaaggagugcggcaaagccuuuaucuacggcucuagccuggugaagcacgaacggauucauacagggguuaagccuuacggauguacggagugcggcaaauccuucagccacgggcaucaacucacccagcaccagaagacacauucuggagcgaaauccuaugagugcaaggaauguggcaaagccugcaaucaccugaaccaccugagagagcaucagcgcauccacaauagcuga

SEQ ID NO: 78200 - RNA, 2112 nt, Artificial Sequence
  derived and/or modified sequence opt5 from ZNF334__Homo_sapiens__XP_011527196
augugcguguuccugcaccuccugagcuacaucaaggacaccuccuuuauucccggcccugauugugagcuucauccgagagggauggccgcuacaggacccugcucugaagccccuguccagggcugugacgcgggggagcugcagcagcucggacugugcggcguuagcgaugugcagcgguccuggucuaaauucuguaacuuuccccuuacgggguaucacgugagcaagccugacgucaucuucaaacuggaacagggagaggaacccuggauuguggaggaguuuuccaaucaaaacuacccugauaucgacgaugcucucgaaaagaauaaagagauucaggacaagcaucugacccagacaguuuucuuuucuaacaagacccugaucacagaacgcgagaauguguucggcaaaacccucaaccugggcaugaauagcgucccguccagaaagaugcccuauaaaugcaacccugggggaaauagccuuaagacaaacucugaggugaucguugccaaaaaguccaaggaaaaucggaaaauucccgauggcuacagcggguuuggaaagcacgagaaaucucaucugggcaugaagaaauaucgcuacaacccuaugagaaaggccuccaaucagaacgaaaaucucauccugcaccaaaacauucagauccuuaaacagcccuucgacuauaacaagugugggaagaccuuuuucaaacgggcuauucugaucacgcagaagggacgccaaaccgagagaaaaccgaaugaaugcaacgagugucggaagacauuuagcaaacgcucuacccucauugugcaccagagaauccauacaggcgagaagccuuacgucugcuccgauugucggaagaccuuccgcgugaaaacgagccugacaagacaccggcgcauccauaccggcgaaagacccuacgagugcuccgaaugccggaagacauucauugacaaaucugcccugaucgugcaccagaagauucacgggggagagaaaagcuaugaauguaaugagugcggcaagaccuuuuucagaaaguccgcucucgccgagcauuuucgcagccacaccggggaaaaaccuuacgaguguaaggaaugcggaaacgcguucucuaaaaaguccuaucuggucguucaucaacggacacacagaggcgagaaacccaaugaauguaaggagugcgggaagacguuuuucugucagagcgcccuuaccgcucaucagcgcauccacacaggagagaaacccuacgaaugcucugagugugaaaagaccuuuuucugccagagcgcccugaacgugcaccggagaucccauacaggcgagaaaccuuaugaguguucucaaugcggcaaguuucucugcaccaaaagcgcucugauugcccaccagaucacgcaucgcgggaagaaauccuacgaauguaaugagugcggaaaguucuuuugucacaagagcacacuuaccauccaccagcggacccauacaggcgaaaaacacgggguguucaacaagugcggaagaauuucuaucgucaaauccaauuguagccagugcaagcgcaugaacaccaaagagaaucuguaugaauguucugagcauggccacgcgguguccaagaacagccaucucauuguucaccaacggacaaucugggagagaccguacgaaugcaaugagugugggcgcacguacugccggaaguccgcccugacccaccaucagagaacacacaccggccagcggcccuaugaauguaacgagugcggaaaaacauuuugccagaaguucucuuucguggaacaucaacgcacccacacgggcgagaaaccuuacgaguguaaugaaugcggaaagagcuuuugucauaaauccgcuuucagaguccaccggcgcauucacaccggggagaagcccuaugaaugcaaccaguguggcaagacauacagacggcuguggacccucacagagcaucagaaaauccacaccggggaaaagccuuaugagugcaacaaaugugagaagacguuuagacauaaaucuaauuuccugcuucaccaaaagagccacaaggaauga

SEQ ID NO: 78201 - RNA, 4029 nt, Artificial Sequence
  derived and/or modified sequence opt5 from ZNF335__Homo_sapiens__NP_071378
auggaggaaaacgagguggaaagcuccucugacgccgcucccggcccugggagaccggaggaacccagcgaguccggacugggcgucgggaccucugaggccguuagcgcggauuccucugacgcugccgccgcuccuggacaggccgaagcugaugacagcggcguggggcaauccagcgaucggggaucucgcucccaggaggaagugagcgagucuuccagcucugccgacccccucccuaauuccuaccugcccgauagcuccucugucagccacggcccuguggcgggcguuacagggggaccgcccgcccuugugcauuccagcgcucugccugaccccaacaugcucgucucugauugcacggccuccagcucugaccugggcagcgcuaucgauaagauuaucgaguccaccauugggccugaccuuauccagaauuguauuacagugaccucugccgaagauggaggcgcggagacaaccagauaucugauccuccaggggcccgacgacggagccccgaugacaagcccuauguccagcucuacccuggcucacucccuggccgcuaucgaagcccucgccgauggccccacgagcaccucuacaugccuggaggcucaaggcgggccuuccagccccguucagcuucccccugcguccggagccgaagaaccggaccugcagucucucgaggcuaugauggaaguggucguggugcagcaauucaaauguaagaugugccaguaccggagcuccaccaaagccacacugcuucgccauaugagagagcggcacuuucgccccgucgccgcugccgcggcugccgccggcaagaaagggagacugcggaaguggucuaccagcacgaagucccaggaagaggaaggaccugaggaggaagaugacgaugacauuguugaugcuggcgccaucgacgaucucgaggaagacagcgauuauaaccccgcugaggacgaaccucgcgggagacagcugcggcugcaacgccccacaccgucuaccccuagaccccggcgcagaccuggacggcccagaaaacucccucgccuggagauuuccgaccuucccgauggcguggagggcgaaccgcuggugagcucucaguccgggcagagcccucccgagccccaagacccugaagccccgucuagcuccggacccggccaucucgucgcgauggggaaggugagccggacaccuguugaggccggagugucucaguccgaugcugagaaugccgcucccagcuguccugacgaacacgauacccugcccagacgccggggcagaccuucccgccgguuccuugggaaaaaguacagaaaauauuacuauaagucucccaagccgcugcuccgcccuuuucugugccggaucuguggcagcagauuccugucccacgaggaccuccgcuuucaugucaacucucacgaagccggagauccccagcuguucaaaugccuucaguguagcuaccgguccagacgguggucuagccugaaggagcauauguuuaaucacgugggcuccaaaccuuacaagugcgacgaauguagcuauaccucuguuuaccgcaaagaugugauuagacacgcggccguccauucccgggacagaaagaaacgccccgauccgacaccuaagcucagcucuuuccccugcccugugugcgggcgggucuaucccaugcaaaagagacugacgcagcacaugaaaacccauuccacagagaagccccacaugugugacaaaugcggaaagagcuuuaaaaagcgcuacaccuucaagaugcaucuucugacacacauccaggcuguggccaacagacgguuuaaaugugaguucugcgaauuuguuugugaggauaagaaagcucuccugaaucaccagcugucucauguguccgacaagccuuucaaaugcagcuucuguccguaucgcaccuuuagagaagacuuccuccugucccacgucgccgugaagcauacgggcgccaagcccuuugcuugcgaguacugucacuucagcacacggcacaaaaagaaccuucgccugcauguuagaugccggcacgcgucuagcuuugaagagugggggcgcagacauccugaggaacccccuucccggcgcagacccuucuuuucucuccaacagauugaggaacugaaacagcagcacagcgccgcuccuggaccgcccccuuccucucccggcccucccgagaucccgccugaagccaccaccuuccaaagcuccgaggcccccucucugcuuuguagcgauacacucgggggcgcuaccaucauuuaucagcagggagccgaggaauccacagcgauggcuacgcagaccgcccuggaccugcuccugaauaugagcgcccaacgggagcuuggcgggacagcucugcaggucgccgucgugaagucugaagauguggaggcgggacucgcuucccccggcgggcagccuagccccgagggagccaccccucaaguugucacacugcauguggccgaaccgggcgggggcgcugccgcugagucucagcugggacccccugaccuuccccagaucacccucgccccuggccccuuugggggaacgggcuacuccgugauuaccgcgccgccuauggaagaggggacaagcgcccccggaaccccuuacuccgaggagcccgcuggcgaggccgcucaggccgucgugguuucugauacacugaaagaagccgggacccacuauaucauggcuacggacggcacacaacugcaccauauugagcucaccgcggauggaagcaucuccuucccuagccccgacgcccuggcuucuggcgccaaguggccgcuucugcagugcgggggacucccuagagauggccccgaacccccuuccccggccaagacacacugcgugggggacagccagucuagcgcuuccucucccccugccaccagcaaagcgcugggacuggcugugcccccuucucccccuuccgccgccaccgcugccagcaagaaauuuuccuguaagaucugcgcggaggcuuucccgggccgcgccgaaauggagagccauaaacgggcccacgcuggccccggggccuuuaaguguccugauugccccuucucugcuagacaguggccugaggugcgcgcccauauggcgcaacacuccagccuucggccccaccaguguucccagugcucuuucgccagcaaaaacaagaaggaccucagacgccauaugcugacacacacgaaagaaaagccguuugcuugucaucugugcggacagcgguucaauagaaacggccaccucaaauuucacauucaacgccugcauuccccugaugggcggaagucuggaacccccacagccagagcucccacccagacaccuacccagacgaucauucuuaauagcgacgacgagacacuggccacccuccacaccgcccugcaauccagccauggcguucuggggcccgaacggcuucagcaggcucucucucaggagcacaucauuguggcgcaagaacagacagucaccaaccaggaggaggccgcuuacauccaggaaaucacaacggccgauggacaaaccgugcagcaucugguuacauccgacaaccaggugcaguauauuaucagccaagauggcguccagcaucugcucccucaggaguacgugguggucccggaaggccaccacauucagguucaagaggggcagaucacccacauucaguaugagcaaggagcccccuuccugcaggaaucucagauccaguacgugccugugucccccggccaacagcuugucacacaggcucagcuggaggccgcggcucauagcgccgugaccgccguugcugacgccgcgauggcccaagcucaggggcucuuuggaacggaugaaaccgugccugagcacauucagcagcugcaacaccagggcaucgaauaugacgucaucacacuggccgaugacuga

SEQ ID NO: 78202 - RNA, 1800 nt, Artificial Sequence
  derived and/or modified sequence opt5 from ZNF343__Homo_sapiens__NP_001269424
augaugcugcccuacccuagcgcccucggcgaccaguauugggaggaaauccugcuuccgaagaacggggagaauguggaaaccaugaaaaagcugacacaaaaccacaaagcuaagggacuccccuccaaugauacggacugcccucagaaaaaggagggcaaggcccagauugucguucccgugaccuucagagaugugacagucaucuuuaccgaagcggaguggaaacggcugucuccugagcagcgcaaccuuuacaaggaagugaugcuggagaauuauagaaaccuccugagccuggcugaacccaaaccugagauuuacacauguuccucuugccuccuggccuucagcugucaacaguuucuuucccagcauguucugcagaucuuccucgggcugugcgccgagaaucacuuucauccgggaaacucuagccccggccacuggaagcaacaggggcagcaguauucccaugugagcuguugguucgaaaaugcugagggacaagaacggggcggcgggucuaaaccuugguccgcccgcaccgaggaaagagagacaagccgggcuuuucccucuccucuucagcgccaguccgccagccccagaaagggaaacauggucguggagaccgaaccgucuuccgcgcaacggccuaaucccguucagcuggacaagggccucaaagagcuggaaacgcugcgcuucggggccauuaacugcagagaguacgaaccugaucacaaucucgagagcaacuuuaucaccaauccccggacacugcuuggaaagaaacccuauaucuguuccgacugcggccgcucuuucaaggauagaagcacccugauucggcaccaucgcauccacuccauggagaaaccuuacguguguagcgaaugcgggagaggauuuucucagaaguccaaccucagccggcaucagagaacacacucugaggaaaaaccguaccugugucgcgagugcggccagagcuuccgguccaagucuauucuuaacagacaccaauggacccauagcgaagagaagcccuaugucugcuccgaguguggccgcggguuuagcgaaaaaucuuccuucauccggcaccagagaacgcauagcggagagaagccuuacgugugccuggaauguggccgcucuuucugcgacaaauccacacuccggaagcaccagcgcauucauagcggggagaaacccuauguguguagagagugcggacggggcuuuucccaaaauucugaucugaucaagcaccagagaacccaccuggacgaaaagccuuacgucugucgcgagugcgggcggggauucugugauaaaagcacacucauuauccaugaaagaacccacuccggcgagaagcccuauguuugcggcgaaugugggcggggauuuucucgcaaaagccugcuucuggugcaucagagaacccacuccggcgagaagcacuacgugugccgggagugcagacgcggguucagccagaaaucuaaccucauccggcaucaaagaacacacuccaaugaaaagccguauauuugucgcgagugcggaagaggcuuuugugacaagagcacgcugaucguccaugaacggacccacucuggggagaaaccuuacgugugcuccgaauguggccgcggauucagcagaaagucucuucugcucguucaucagcggacacacagcggcgagaaacacuacgugugccgcgagugugggagaggauuuucccauaagagcaaccugauucggcaccagcgcacccauuga

SEQ ID NO: 78203 - RNA, 1599 nt, Artificial Sequence
  derived and/or modified sequence opt5 from ZNF350__Homo_sapiens__NP_067645
augauccaggcccaagagagcauuacccuggaagacguggcugucgauuucacaugggaggaauggcagcuccugggcgccgcgcagaaggaccuuuacagagauguuaugcuggagaacuauuccaaucucguggcugugggguaccaggccucuaaacccgacgcccuguuuaaacuugaacaaggagagcagcuguggacgaucgaggauggcauucacagcggggcuugcuccgacaucuggaaagucgaucaugugcucgaacggcugcagucugagagccugguuaaccgcagaaagccuugucacgaacaugacgccuucgagaauauugugcacugcuccaaaucucaguuucuccugggacaaaaccaugauaucuucgaccuucggggcaagagccugaaguccaaucucacccuggucaaccagagcaaaggguaugagaucaagaacucuguggaauuuacaggaaacggcgauuccuuccuucacgcuaaucacgagcgccugcauaccgccauuaaauuuccggcgagccagaagcucaucucuacaaaaucccaguucauuagccccaagcaccaaaagaccagaaaacuggaaaagcaucacguuuguucugagugcggcaaagccuuuaucaagaaauccuggcugacagaccaccaggugaugcauaccggggaaaagccucaccgguguagccucugcgagaaggcuuucucccgcaaguuuaugcugacggagcaucagagaacccacacaggagaaaagcccuacgaguguccugaaugcggcaaagccuuccuuaagaaaucucggcugaacauucaucaaaagacccacacaggggagaaacccuauaucuguagcgaaugcggaaagggcuuuauucagaaggggaaucucaucguccaccagcgcauccauaccggagagaaaccuuacauuuguaacgagugcggcaagggcuucauccagaaaacgugccugauugcucaccaaagauuccauacagggaagaccccguuuguguguuccgaaugcggaaaaagcuguucucagaaguccggccuuaucaagcaccagcggauucacacaggggagaaacccuucgaaugcagcgaguguggaaaggccuuuucuaccaaacagaagcugaucgugcaucaacgcacccacacaggcgaaagaccuuaugggugcaaugaguguggaaaagcguucgccuacaugagcugccucgucaagcauaagcggauccacacgcgcgagaaacaggaagcugccaagguugagaaucccccugcugaaagacauuccucucugcacaccagcgaugugaugcaggagaaaaauuccgccaacggcgccacaacccaggugcccagcgucgcuccgcaaacaucucugaacauuuccggccuccuggcgaaucggaacgugguucuuguggggcagccugucgugagaugugccgcuagcggagacaaucgcggcuuugcccaggaccggaaccugguuaaugccgugaacgucgugguccccucugugaucaauuacguucucuucuaugugaccgagaacccuuga

SEQ ID NO: 78204 - RNA, 1818 nt, Artificial Sequence
  derived and/or modified sequence opt5 from ZNF354A__Homo_sapiens__NP_005640
auggccgcuggccagagagaggcccggccccaagugagccugaccuucgaagacgucgcgguucucuuuacacgcgaugaguggagaaagcuggcuccuucccagcggaaccuuuaccgcgacgugaugcuggaaaauuauagaaaccucgugucucuggggcuuccguucacgaaacccaaggucaucagccugcuccagcagggagaggauccuugggaaguggagaaagacggcuccgggguuucuagccugggauccaagucuagccacaaaaccacaaaguccacccaaacacaggauagcucuuuucagggccugauucucaagcgguccaaucgcaacgugcccugggaccugaaacuugagaagccuuacaucuaugaagggagacuggagaaaaagcaggauaaaaagggcagcuuccaaauugucucugccacccauaagaaaauccccacaauugaacggucccacaagaauaccgagcucagccagaacuuuucuccuaaauccgugcugauccgccagcagauccuuccgagagagaagacgcccccuaaaugcgaaauucaaggaaauagccugaagcagaacucccagcuccugaaucaacccaaaaucaccgccgacaagcgguacaaguguucucugugcgagaaaacauucauuaacaccagcucccuccgcaagcaugagaaaaaucacagcggcgaaaagcuguuuaaauguaaggaaugcucuaaggcuuucucccagagcucugcccuuauccagcaucagauuacacacaccggggagaaaccuuauaucuguaaggagugcggaaaggcuuuuacgcugagcacaucccucuacaaacaccugagaacccauacaguugaaaaaucuuaucgguguaaggagugcggcaagagcuucucccgcagaagcgggcuuuuuauucaccagaaaauccaugccgaagagaaccccuguaaguacaauccgggacggaaagcgucuuccugcagcaccucucuguccggcugucaaagaauccacagccgcaagaaauccuaccucugcaacgaaugcgggaauaccuucaagucuagcuccucucugcgguaucaccagcgcauucauacaggagagaagccuuuuaaauguagcgagugcggcagagccuucucccagagcgcuucucugauccaacacgaacggauucauacgggcgagaagcccuacagauguaacgaaugcgggaaaggauucaccuccaucagccgccucaaccggcacagaauuauccauacaggcgagaaguuuuauaauuguaacgaaugcgggaaagcccugucuucccacagcacccuuaucauucacgagcgcauccauacaggagagaagccuuguaaaugcaagguguguggcaaggcuuuccggcagucuagcgcccugauucagcaccagagaaugcauaccggggaacgccccuacaaaugcaaugaguguggaaagacguuucggugcaacuccagccucucuaaucaccaaagaauccacacaggcgaaaaacccuaucggugcgaggaguguggcauuuccuucgggcagagcuccgcgcugauccagcaucgcagaauccacaccggagaaaagccuuuuaaaugcaacaccuguggcaagacauuccggcagucuagcuccagaauugcccaucaacgcauccacaccggggagaagccguacgaaugcaauacauguggaaaacuuuuuaaccaucggucuagccugacgaaucacuauaagauucacaucgaggaagaucccuga

SEQ ID NO: 78205 - RNA, 1584 nt, Artificial Sequence
  derived and/or modified sequence opt5 from ZNF35__Homo_sapiens__NP_003411
augaccgccgagcugagagaagcuauggcccucgcgcccuggggcccugugaaggucaaaaaggaggaagaggaagaggagaacuucccggggcaggcuagcucccaacagguucacucugaaaauaucaaagugugggcccccgugcagggacugcagacaggccuugacgggagcgaggaagaggagaagggacaaaacauuuccugggauauggccgucgugcugaaagcuacgcaggaagccccugcugccucuacccucggcagcuacucccugcccgggacacuugcgaagucugagauccuggaaacccauggaacaaugaauuuucucggcgccgagaccaagaaccugcagcugcucguuccuaaaacagaaauuugcgaggaggcugaaaagccccugaucauuagcgagcggauccagaaagccgacccucaaggcccggaacuuggggaggcuugugaaaagggaaauaugcugaaacgccagagaaucaagcgggagaagaaagauuuccgccaggugauugucaacgacugccaccuccccgaguccuuuaaggaagaggaaaaucagaaauguaagaaaagcggcgggaaguauucucugaacuccggagccgugaaaaauccuaagacccaacuuggccagaagcccuucacgugcagcguuugugggaaaggauuuucucaguccgcgaaccuggugguccaucaaagaauccacaccggcgagaagccuuucgaaugccaugaguguggcaaagccuuuauucagagcgcuaaucucguggugcaccagcggauccacacagggcagaagcccuacgucugcucuaaauguggaaaggccuucacccaauccagcaaccugacaguucaucagaagauucacucccuggagaaaaccuuuaagugcaaugaaugugagaaggcuuucucuuauagcucccagcucgcccgccaucagaaagugcacaucacggaaaaaugcuacgagugcaacgaguguggcaagacauuuaccagaagcucuaaucugauugugcaccaacggauccauacaggggaaaagccguucgccugcaacgauuguggaaaggcuuuuacccaguccgcgaaccuuaucguccaccagcgcagccauaccggcgagaaaccuuaugaaugcaaagagugugggaaggccuucucuugcuucagccaccugauugugcaucagagaauccacacagcugaaaaacccuacgacuguuccgagugcggaaaggccuuuucucaacucagcugucugauuguucaccagcggauccauuccggcgaucuuccuuaugugugcaaugaguguggcaaggccuucacgugcagcucuuaccugcucauucaccagcgcauccauaacggggaaaaacccuauaccugcaaugaguguggaaaggcuuuuagacagcgguccagccugacaguccaccaacgcacccacacaggcgaaaaacccuacgagugcgaaaaguguggggccgcguucaucucuaacucccaucugaugagacaccaucggacccaccucguggaguga

SEQ ID NO: 78206 - RNA, 1224 nt, Artificial Sequence
  derived and/or modified sequence opt5 from ZNF365__Homo_sapiens__NP_055766
augcagcaaaaggccuucgaggaaagcagauaccccuggcaggaguccuuugaaaacguggcugucugccugccucuccgguguccgcgcugcggcgaccacaccagauuccggucucugagcucccuucgcgcccaucuggaguuuucucacagcuaugaagagagaacacuccugacgaaauguucccuuuuccccucucugaaggauaccgaccucguuacaagcuccgagcugcugaaaccugggaagcuccagagcucuggaaauguggugaaacagaagcccuccuacgucaaccuguauagcaucucucaugaacacuccaaggaucggaaaccuuuugaggugguugcggaacgccccgugagcuacguccaaaccuauacagcuauggaccuucaugccgauucucuggacggcaccagauccgggccuggacucccgacaagcgauaccaaggccuccuucgaggcucacgugcgggagaaauuuaaucgcaugguugaagccguggacagaacgauugagaagcggaucgauaaacugaccaaggaacuugcucagaagacagccgagcugcucgaaguccgcgcggccuucgugcagcugacccagaaaaagcaagaggugcagagacgggagcgcgcucugaacagacaggucgacguugccguggaaaugauugcugugcuccggcagagacugacagagucugaagaggaacuucugcgcaaagaggaggaagucgugaccuuuaaucacuuccucgaggccgcggccgaaaaggagguucaaggcaaagcucggcugcaggauuuuaucgaaaaccuucugcagagaguggagcucgccgagaagcaacuggaauacuaucagagccagcaggcuuccggguucguccgcgaccugagcggacaugugcucacggauauuucuuccaaucggaaacccaagugccugagcagaggccacccucauucuguuuguaaccaccccgaccuuaaggcccacuuucauccuaaaggccgcaaucaccugaagaaagccaaggacgaucgggcuagcaugcaacccgcgaaagccauccaugagcaggcugaauccucuagagaccucugccgcccgccuaagaagggggagcugcuuggauucggccggaaagggaacaucagacccaagauggccaaaaagaaaccuacagccauugugaauaucauuuga

SEQ ID NO: 78207 - RNA, 2235 nt, Artificial Sequence
  derived and/or modified sequence opt5 from ZNF366__Homo_sapiens__NP_689838
augcagaaggagaugaaaaugaucaaggacgaagaugugcacuucgaccuggccgucaaaaagacccccagcuuuccucauugccuccaaccgguugcuuccagaggcaaagcgccccagcggcacccuuuccccgaggcccugcgcgggccuuuuucucaguucagauacgaacccccuccgggagaucuugacggcuuucccgggguguucgagggagcuggcagccggaagcgcaaguccaugccuacaaaaaugcccuauaaccauccugccgaagaggugacgcuggcccuccacucugaggaaaauaagaaccaugggcugcccaaucuuccgcugcucuuuccucagcccccuagacccaaauacgauagccaaaugauugaccuguguaacgucggauuccaguuuuaucggucccuggagcacuucggcggcaagcccgugaaacaggaaccuaucaagccgucugcuguuuggccccagccuacccccacaccuuuucuccccaccccguacccuuauuaccccaaggugcacccugggcugauguuccccuuuuucgucccuagcuccagccccuucccguuuucucgccauacauuccuuccuaaacaaccucccgagccccugcucccgagaaaggccgagccccaggaauccgaggaaaccaaacagaagguggagcggguugaugugaauguccagauugacgauagcuauuacguggacgugggaggcucucaaaaacgcuggcagugcccuacaugugaaaaguccuacaccagcaaauauaaccuggucacgcacauccuugggcauucuggaauuaagccccacgcuugcacccacuguggcaagcuguuuaaacagcucucccaucugcacacacauaugcugacccaccaagggacaagaccucauaagugccagguuugucacaaagccuucacccagacgagccaccucaagcggcauaugaugcagcacuccgaggugaaaccccauaauugccgcguguguggaagaggcuuugcguacccuucugagcugaaggcccacgaagcuaagcacgccagcggccgggagaacaucugcgucgaaugugggcuugauuuccccacacuggcucaacucaaacgccaucugaccacacacagaggaccgauccaguauaauugcuccgagugcgacaagaccuuucaguacccuagccagcuucaaaaccauaugaugaaacacaaggauauucggcccuauaucuguucugaaugcggcauggaguucgugcagccucaucaccugaaacagcacucccucacccauaaggggguuaaggagcacaaauguggaauuugcggcagagaauuuacacugcuggccaauaugaagcgccaugugcucauccacacgaacauucgggcguaccagugucaucugugcuauaagagcuucguccaaaaacagacccuuaaagcccacaugaucgugcacucugacguuaagcccuuuaaguguaaacugugcgggaaggaguucaauagaaugcauaaccucaugggacacaugcaucugcacagcgacuccaaaccguuuaagugucuuuacugcccuucuaaauucacacugaagggcaaucucacccgccacaugaaagugaagcauggcgucauggaacgggggcugcacagccagggacugggcagagggcgcauugcucucgcccagacagcuggagugcugcggucccuugagcaagaggaacccuucgaucugagccagaagagacgcgccaaagucccuguguuucagucugacggcgaguccgcccaagggagccauugucacgaagaggaagaggaggauaacugcuacgaaguugagcccuauucucccggccucgcuccucagucccagcagcugugcaccccggaagaccugagcacgaaguccgagcaugcgcccgaagugcuugaggaggccuguaaagaagagaaggaagaugcuucuaaaggagagugggaaaagcggagcaagggcgaccucggggccgagggaggccaagagagagauugcgccgggcgcgacgaaugucugucccugcgggcuuuccagucuacaagacggggaccuagcuuuuccgauuaccucuauuucaaacaccgcgacgagagccugaaggaacuucuggagagaaaaauggaaaagcaggccguccuccugggcaucuga

SEQ ID NO: 78208 - RNA, 1053 nt, Artificial Sequence
  derived and/or modified sequence opt5 from ZNF367__Homo_sapiens__NP_710162
augaucagaggcuucgaggcccccauggcugaaaacccuccgcccccucccccucccgugaucuuuugccacgacagcccuaagcggguccugguuuccgugauucgcaccacaccgauuaaacccacgugugggggaggcggggagccugaacccccucccccgcucaucccuaccucucccggauucagcgauuuuaugguguacccuuggagauggggcgagaaugcccauaacgucacacugucccccggggcggcuggagccgccgcuucugccgcccuucccgcugcggccgcugccgaacacagcggccugcggggccgcggggcuccuccgcccgccgcguccgccucugcugccgcuagcggaggcgaggacgaggaagaggccuccagcccugauucugggcaucucaaggacggaauuagacggggccgccccagagccgauaccgugcgggaccugaucaaugaaggggagcacuccagcucucgcaucagaugcaacauuuguaaucggguuuucccucgcgagaaaucccuucaggcucauaagagaacacacaccggagaacggcccuaucugugcgauuacccggacuguggcaaagcguuugugcaaagcggccagcucaagacacaccagcgccugcauaccggggagaagccuuucgucugcucugaaaacggaugucuguccagauuuacgcacgccaaucggcauugccccaaacacccuuaugcuagacucaagcgcgaggaacccaccgauacacugagcaaacaccaggccgccgacaacaaggcugccgcggaguggcuugcucgguacugggagaugagagaacaacgcaccccuacacugaaaggcaagcucgugcagaaggccgaucaggagcagcaagacccccuggaauaucuucaguccgaugaggaagacgacgagaaaagaggggcccagcggcgccugcaggagcaacgggaaagacuccauggagcucuggcccugaucgagcucgcuaaucugaccggcgccccgcuucgccaguga

SEQ ID NO: 78209 - RNA, 1650 nt, Artificial Sequence
  derived and/or modified sequence opt5 from ZNF382__Homo_sapiens__NP_001243767
augagccagggcuccgugucuuucaaggacgucaccguugauuuuacacaagaggaauggcagcagcuggaccccgcccagaaagcucucuacagagaugugaugcuggagaacuauugccacuucgugagcgucggguuucauauggccaagccugacaugauccggaaacuugaacaaggagaggaacuguggacgcagcgcauuuucccguccuacucuuaucucgaggaggauggcaagaccgaagacgugcugguuaaauuuaaggaguaccaggauagacacagccggccccuuaucuucauuaaucauaagaaacugaucaaggaacgcuccaacauuuaugggaaaacauuuacccucggaaagaauagaaucucuaaaacaauccugugugaguacaagccugacggcaaggugcugaaaaacauuagcgagcucgucauccggaauauuucccccaucaaggaaaaauucggggauagcaccggaugggagaagucucugcuuaacacaaaacacgaaaagauucauccugcggugaaucugcacaaacagaccgagcgcguucucuccggcaagcaagaacugauccagcaccagaaggugcaggcucccgagcaaccuuuugaccauaacgagugcgaaaagagcuuccuuaugaaaggcaugcuguuuacgcacaccagagcccaucggggagagcgcacauucgaauauaauaaagauggaauugccuuuaucgagaagucuucccucagcguccacccgucuaaccugauggagaaaaagcccuccgcuuacaauaaguacggcaaauuccuguguagaaagccuguguucaucaugccccagcggccucagaccgaagagaaacccuuucacugcccguauugugggaacaauuuccgcagaaagagcuaccucauugaacaucaacggauccacacaggagagaaaccuuaugugugcaaccaguguggcaaggccuuucgccagaagaccgcucugacgcuucaugagaaaacacacauugaagggaagcccuucaucugcauugacuguggaaaauccuuuagacagaaggccacccugacacggcaucacaaaacccacaccggcgaaaaggcguacgagugcccucaauguggcucugccuucagaaagaaaagcuaucucaucgaucaucagcgcacacacacgggggagaagcccuaccagugcaaugaaugcggaaaggcuuuuauccagaaaaccacacugaccguccaucaacggacacacaccggcgagaaacccuauauuuguaacgaaugcgggaaguccuucugucagaaaacgacacuuacccugcaccagagaauccauaccggagagaagccuuacauuugcaacgaguguggcaagagcuuucgccagaaagccauccucacaguucaccaucggauucacaccggggaaaagucuaauggaugcccgcaauguggcaaggcuuucuccagaaaaagcaaccugauccgccaucagaaaacacacacgggcgagaagcccuacgaaugcaagcagugugggaaauuuuucucuugcaagagcaaucugaucgugcaccagaaaacccauaagguggagacaaccgggauucaauga

SEQ ID NO: 78210 - RNA, 1428 nt, Artificial Sequence
  derived and/or modified sequence opt5 from ZNF383__Homo_sapiens__XP_011524892
auggccgagggcagcgugauguucuccgacgucucuaucgauuuuagccaggaagagugggacugccuggaucccguucaaagagaccucuaccgggaugugaugcuggaaaacuaugggaaucuuguguccaugggacuguacaccccuaagccgcaggucauuucucuccuggagcagggcaaagaacccuggaugguggggcgcgagcuuacaagaggacuguguagcgaccucgaguccaugugcgaaacgaagcugcugucucucaaaaaggagguuuaugaaaucgagcugugucagcgggagauuaugggccuuaccaaacacgggcuggaauacagcuccuucggagaugugcucgaguaucgcagccaucuggcuaagcaacuuggcuacccuaacggccacuuuucucaggaaaucuucacacccgaguauaugccuaccuuuauucagcagacauuccugacccuccaucaaaucaucaauaacgaagacagacccuacgagugcaagaaaugugggaaggccuuuucccagaauagccaguucauucagcaccaacggauccauauuggagagaaaucuuacgaaugcaaggaguguggcaaauuuuucuccugcgggagccacgucacacgccaccugaagauccauaccggagaaaagccuuuugaguguaaagaaugcggcaaggcguucucuuguuccagcuaucugucccagcaccagagaauccauacggggaaaaagccguacgagugcaaagagugcggaaaggcuuuuucuuauuguagcaaccucauugaucaccaacggauucacaccggcgaaaaacccuacgagugcaagguguguggcaaggccuucacaaaauccagccagcuguuccagcaugcccgcauccacaccggggaaaagccuuaugagugcaaagaauguggaaaggcuuuuacacagucuuccaaacuuguucaacaucagagaauccacaccggcgagaagcccuacgagugcaaggaaugugggaaagccuucagcucuggaagcgcucugacgaaucaucagcggauucacacaggcgagaagccuuaugacugcaaagaaugugggaaggccuuuacccaguccucucaacuccgccagcaccagagaauccaugcgggagagaaacccuucgagugccuggaauguggcaaggccuuuacacagaacagccaacuuuuccagcaccagcggauucauaccgaugagaagccguacgaaugcaaugagugcggcaaggcuuuuaacaaauguuccaaucugacccgccaccucagaauccacacaggggaaaaaccuuacaacugcaaggaguguggaaaagccuucagcucuggcuccgaccugauucggcaucaggggauccacacgaauaaguga

SEQ ID NO: 78211 - RNA, 1386 nt, Artificial Sequence
  derived and/or modified sequence opt5 from ZNF384__Homo_sapiens__NP_001035009
auggaggaaagccacuucaacuccaaucccuacuuuuggccuucuaucccgaccgugagcggccagauugagaacacaauguucaucaauaagaugaaagaccaacugcuccccgaaaaggggugcggacuggccccuccccauuauccuacgcuucugaccguccccgcuuccguuucucucccuagcggcauuuccauggauacagagucuaaaagcgaccagcugaccccgcacucccaggccagcgugacacagaacaucaccgugguccccgugccuucuacagggcuuaugaccgcggcucugcaaguugugcccgaucucuccaagaaagucgccagcacgcugaccgaagagggaggcgggggaggcggcgggggaggcucuguggccccuaagcccccgagagggcggaagaaaaagcgcaugcuggaguccggacucccugaaaugaaugaccccuacguucugagcccugaggaugacgaugaccaucagaaagauggcaagacauauagaugucggaugugcucucuuaccuuuuacuccaaaagcgaaaugcagauucacuccaagucucauacagagaccaagccccacaaauguccccacugcagcaagacguucgcuaacuccagcuaucuggcccagcauauccgcauccacucuggggcuaaaccuuacuccuguaauuuuugcgaaaagagcuucagacaacucucucaucugcagcagcacacacggauucacaccggagaccgcccguauaaaugugcccaucccggcugcgagaaggcguuuacacagcuuagcaaccugcaaucccacagacggcagcauaauaaagauaagccuuucaagugucacaacugccaucgcgccuacaccgacgcugccucucucgaggugcaccugagcacccacacagucaaacaugcuaagguguacacguguaccaucugcuccagagccuauacaagcgaaaccuaccugaugaaacacaugcggaagcauaaucccccugaucuccagcaacaggugcaggcggccgcugccgcugccgccgucgcucaggcgcaagcccaggcucaggcccaggcccaagcucaggcccaggcgcaggcucaagcccaggccucucaggcuucccagcaacagcagcaacagcagcagcaacagcagcagcaacagcagcagcccccgccucacuuucaaagccccggcgccgcuccucaagggggaggcgggggagacucuaaccccaauccucccccgcagugcuccuucgaccugacaccuuauaaaaccgccgagcaccauaaggauauuugucuuacgguuacaaccagcaccauccagguggaacaccuggcguccucuuga

SEQ ID NO: 78212 - RNA, 1161 nt, Artificial Sequence
  derived and/or modified sequence opt5 from ZNF385A__Homo_sapiens__NP_001124439
augauccugggcagccucuccagagccgggccccugccucuucugcggcagccgcccauuaugcaaccuccccucgaccugaagcagauccuuccuuucccccuggagccugcuccgacccucggacuguuuucuaacuacagcacaauggaucccgugcagaaagccguccugucccacacguucggcgggccucuccugaagaccaaacgccccguuauuucuugcaauaucugucagauuagauuuaacagccaaucccaggcggaagcucauuauaagggaaaucggcacgcccgcagagugaaaggcaucgaggccgcuaagacacgggggcgcgaaccuggagugagagagcccggcgacccggccccucccggcucuaccccuacaaacggggauggagucgcuccccggcccgugagcauggaaaauggccuugggccugccccgggaucccccgagaagcagccuggcagccccucuccucccuccaucccggagaccgggcagggaguuacaaaaggcgaaggcgggaccccugcgcccgccagccugccuggaggcucuaaggaggaagaggagaaagcuaagcgccuccuguacugcgcccuuuguaaaguggcugucaacucccugagccaacucgaagcccauaauaaggggacgaagcacaaaaccauucuggaggcgagaucuggacugggccccaucaaggccuauccucggcucgggcccccgacaccuggagaacccgaggcucccgcccaggaccgcaccuuccauugcgaaauuuguaacgugaaaguuaauuccgaggugcagcugaagcagcacaucagcuccagacggcaccgcgauggcgucgcuggcaaaccuaacccgcuucugucuagacauaagaaaagcagaggggccggagagcucgccggcacacugaccuuuuccaaggaacuucccaagagccuggcugggggacuccugccuucuccccuggcgguggccgcugugauggccgccgcugccggcuccccucucagccugcggcccgcgccugcugcuccccuucugcaagggccgccuauuacgcacccccuccugcauccugcccccggcccgauccgcacagcccacggaccuauucuuuucucucccuacuga

SEQ ID NO: 78213 - RNA, 1188 nt, Artificial Sequence
  derived and/or modified sequence opt5 from ZNF385B__Homo_sapiens__NP_001106868
auguggagcggccugcccuccagagggucuaccugccacacaacgacccucccugcccuggugcggacaccgacccuuaugaugcagcccagccuggacaucaagccuuucauguccuuucccgucgauucuagcuccgcuguuggacucuucccuaacuuuaauacaauggaccccgugcaaaaagccgugauuaaccauaccuucggcgucucuaucccuccgaagaaaaagcaagugauuagcuguaauguuugccagcugcgcuuuaacuccgauagccaggcggaggcucacuacaaagggucuaagcaugccaagaaagugaaggcccuugacgcuaccaaaaauaagcccaaaauggucccuuccaaggauagcgccaaggcuaaccccucuuguuccaucacaccuauuacgggaaauaacagcgacaaaucugaagauaagggcaaacugaaggccuccagcuccucucagcccagcuccagcgagucuggguccuuccuccugaaaagcggaaccacaccgcugccucccggcgcggccaccucuccuagcaaguccacaaauggcgcucccgggaccgugguugaaucugaggaagagaaagccaagaagcuccuguauugcagccuuuguaaaguggcugucaacucccugagccagcucgaggcccacaauacgggaucuaagcauaaaacaaugguggaagcgagaaacggcgccgggcccaucaaguccuacccucggccgggaagccgccugaaaaugcagaauggcucuaagggguccggacuucagaacaagaccuuucacugcgagaucugugacgugcacgucaauagcgaaauucaacugaaacagcauaucuccucuagacggcacaaggaucgcguugcuggcaaaccccucaagccuaaauauagccccuacaacaagcugcagagauccccuucuauucuggccgcuaagcucgccuuccagaaagacaugaugaagccccuggccccggcuuuucuuagcuccccucuggcggccgcugccgccgugagcucugcucucucccugcccccucggcccagcgccucucuuuuccaagcgccugcuauucccccggcccugcuccgcccuggccaugggcccaucagagccacacccgcuuccauccuguuugccccuuauuga

SEQ ID NO: 78214 - RNA, 1188 nt, Artificial Sequence
  derived and/or modified sequence opt5 from ZNF385D__Homo_sapiens__NP_078973
augagaaacaucauguacuucggcgggaccugccagagccccgcccugccugcucucgugcggccgcccgccccuccccugcaaccuucccuugacauuaagcccuuucugccuuucccgcucgauacagcggcugccgucaaucuguuucccaacuucaaugccauggacccuauccagaaagcuguuauuaaccacacguuuggagugccccuuccucaucgcagaaagcagaucauuucuuguaauaucugccagcugcgguucaacagcgauucccaagccgcugcccacuauaaaggcaccaagcaugcgaaaaagcucaaggcccuggaggcuaugaaaaauaagcagaaaucugugacagccaaggacagcgcuaaaaccacauuuaccuccaucacaaccaacacgauuaauaccucuagcgauaagacagacgggaccgccggaacacccgcgaucuccaccacgacaaccgucgaaauucgcaagagcucugugaugacaaccgagaucaccuccaaaguugaaaagagcccgacaacggccaccggcaacucuuccuguccuagcacagagaccgaagaggagaaagcuaagagacugcucuacugcucucuguguaaaguggccgucaauuccgcuagccagcuugaagcccacaacuccgggacaaagcauaaaaccaugcuggaggcccggaauggaucuggcacgauuaaggcuuucccccgcgcgggcgugaaggggaaaggaccuguuaacaagggcaauacagggcuccagaacaaaaccuuucacugcgaaaucugugaugugcacgucaacagcgagacccaacugaagcagcauauuuccagcagacggcacaaagaccgcgccgcuggaaagccucccaagcccaaauauucuccguacaauaaacuucagaagacagcccauccccugggcgugaagcucguguucuccaaagagccuagcaagccccuggccccuagaauccugcccaacccgcucgcugccgcggcugccgccgcugccgucgcuguuucuagcccuuuuucccugcggaccgcccccgcggccacacuuuuccagacgucugcucugccucccgcccuccugcgcccugcucccgggccgaucagaaccgcccacacaccugugcuuuuugcgcccuauuga

SEQ ID NO: 78215 - RNA, 1077 nt, Artificial Sequence
  derived and/or modified sequence opt5 from ZNF391__Homo_sapiens__XP_011512871
auggagagccugagaggcaacaccgcccaggggcccacaaaugaagaggacuacaagaacgaaggacaacucucccggcagacgaaaugcccugcucagaagaaaucuagcuucgagaauaccgugguccgcaagguuuccgugacacugaaagaaaucuuuaccggcgaggaggggccggaaucuagcgaguucucccuuucucccaaccuggaugcccagcaaaagauuccuaagggacacggcagccccaucucccggaaaaauagcaaggacaacucugaucucauuaaacaucagagacuguuuucccagcgcaagccuuguaaaugcaaugaaugugagaaggcguucagcuaucagucugaccuucuggugcacuccagaauccaugggggagagaagcccuuugaaugcaacaaauguggcaagagcuucucucgguccacacaccucauugagcaucaacgcacccacacaggcgaaaaaccuuacgagugcaaugaaugugggaaggcuuuuagcagauccacccaccugucucugcaucagcggauccacacgggagagaaaccguaugagugcagcgaauguggcaaggccuucucccgcagcaccaaccucucucagcaucagagaacacacacccaagagcggcccuacaaaugcaaugaaugugggaaggccuuuggagaucgcuccacaaucauucagcaccagagaauccauaccggcgagaacccuuaugaaugcagcaagugcgggaaggcuuucucuuggauuagcucccugacggagcaccaacggacacauaccggagagaaucccuacgaauguucugagugcggcaaagucuuuagccgcuccagcucucuuacagaacaccagagaauccauuccggcgagaaaccucacgaaugucgggugugcgggaagggauucagcagaucuuccagccugauuauccaccagcgcacccauaccggcgagaaacccuauaaguguaacgacugcgggaaggccuuuugucaguccucuacacucauucggcaccaacaucugcacacgaaagaguga

SEQ ID NO: 78216 - RNA, 1542 nt, Artificial Sequence
  derived and/or modified sequence opt5 from ZNF395__Homo_sapiens__NP_061130
auggccagcgugcuguccagacggcucggcaagcgcucucugcuuggggcuagaguccugggacccagcgccuccgagggcccuucugcggcuccgcccagcgaaccucuccuggagggggccgcuccccagccuuucaccacauccgacgauacgcccugccaagaacagccuaaagagguucuuaaggccccgucuaccagcggacugcaacagguggccuuucagcccggccagaaaguguacgucugguaugggggacaggaauguacaggccucguggagcagcacuccuggauggagggccaaguuaccguguggcugcuggaacagaagcuccaggucugcugucggguggaggaaguuuggcuggcugagcuucaggggccuugcccccaagccccuccccuggagccgggagcgcaggcccucgcuuaccgcccugugagcagaaacaucgacguccccaaacggaagucugaugccguggaaauggacgagaugauggcugccauggugcugacaucccuuagcuguucuccugucguucaguccccucccggcaccgaagcgaauuucagcgccucucgcgcugccugcgaucccuggaaggaguccggggacauuagcgauuccggaucuagcacaaccuccggccauuggagcgggucuuccggagugagcacgccgucucccccucacccccaagcuagcccuaaauaucugggcgacgccuuuggcucuccccagaccgaucauggguucgaaacagacccggauccuuuucuccuggacgagcccgccccuagaaagcggaaaaacuccgugaaggucauguacaaaugucuguggcccaauugcggaaaggugcuccgcagcaucguuggcauuaagagacacgugaaagcucugcaucuuggggauaccgucgacuccgaccaguucaagcgggaggaagauuuuuauuacacagaggugcagcugaaagaagagagcgcggccgcugccgccgcugccgcggcuggaaccccuguucccggcacgccgacaucugaaccugcccccacccccuccaugacagggcucccucugagcgcccuuccgcccccucugcacaaggcucaaucuuccggacccgagcacccuggccccgagagcucccucccuucuggcgcccugagcaaauccgcucccgggucuuucuggcauauccaggccgaccacgcguaucaggcccugccgagcuuucagauuccugugagcccccauaucuacaccuccgucucuugggcugccgcuccuuccgccgcguguagccucucucccgugcgcuccagaagccugucuuucagcgaaccgcaacagccugcccccgcuaugaagucccaccuuaucgucaccagcccuccccgggcccagucuggagcucgcaaagccagaggcgaggccaagaagugccggaaaguguacgggauugaacacagagaucagugguguacagcuugccgcuggaagaaagcgugccaacgguuucuggacuga

SEQ ID NO: 78217 - RNA, 1416 nt, Artificial Sequence
  derived and/or modified sequence opt5 from ZNF398__Homo_sapiens__NP_065832
augaagggcaacuacgagagccugaucuccauggacuaugccauuaaucagcccgaugugcucucucaaauccagccugaaggggagcacaacaccgaagaccaggcuggaccggaggaaagcgagauucccacagauccuuccgaggaacccggcaucucuacgagcgacauucuguccuggaucaaacaggaggaggaaccucaagucggggcgcccccugagucuaaggaaagcgauguuuacaaauccaccuaugccgacgaggaacuugugaucaaggcugagggacuggccagaagcucucucugcccggaagugcccgucccuuucuccucucccccugccgcugccaaagaugcuuuuagcgacguggccuucaagucccagcagagcacaucuaugacccccuuuggccggccggcgacagaucugccugaggccuccgaggggcagguuaccuucacacaacuuggaagcuacccccugccuccucccgugggcgaacaggucuuuuccugucaucacugcggcaagaaucucucucaggacaugcugcugacccaucaguguagccacgcuacggagcauccccucccgugcgcccaaugucccaaacacuucaccccucaggcugaucuguccagcacaucucaggaccacgccuccgaaacacccccuaccugcccccauugugcgcgcaccuuuacgcacccgagcagacuuacauaucaucugcgggugcacaacucuaccgagcgcccuuuccccugcccugauugucccaagagauuugccgaccaagcucggcucacaagccaccgcagagcccaugcuuccgaacggccuuuccgcugcgcccagugugggagaucuuuuagccugaaaauuucccuucugcuccaccagcggggacaugcccaggagcgccccuucagcugcccgcaaugcggcaucgacuuuaaugggcacucugcucugauuagacaucagaugauccacaccggagagcggccuuaccccuguaccgauugcuccaagagcuucaugcgcaaagaacaucugcucaaccacagacggcugcacacaggcgagagacccuucucuuguccucauugcgggaaguccuuuauucgcaagcaccaccuuaugaaacaucagcggauccacacgggagaaagaccguaucccuguagcuacugcggccgcuccuuccgguacaagcagacccugaaagaccaucucagaucuggccacaaugggggauguggcggggauagcgacccuuccggacaacccccuaaucccccuggcccccugauuacagggcuugagaccucuggacugggcguuaacacagaaggccucgagaccaaccagugguauggggagggaagcggcgggggagugcuguga

SEQ ID NO: 78218 - RNA, 5448 nt, Artificial Sequence
  derived and/or modified sequence opt5 from ZNF407__Homo_sapiens__NP_001139661
augauggacagcgagaacaagcccgaaaaugaugaggacgaaaaaaucaacaaggaggcccaggaucugaccaaacucuccucucacaaugaagacggcgggccugugagcgaugucauugcuuccuucccggagaacucuaugggaaagagaggcuuuagcgaguccucuaauagcgacuccguugugaucggggaagaucggaacaaacaugccagcaagcgcagaaagcuggacgaggcggaaccccuuaaaucuggaaagcaaggcauuugccggcuggagacauccgagagcucugugacggaagggggaaucgcucucgaugagaccggcaaagaaacauuccuguccgacuguaccgucggcgggacaugccuuccuaaugcccugagccccucuuguaacuuuuccaccauugaugugguuagccucaagacagacaccgagaaaacguccgcccaggaaauggugucucuggaucuggagcgcgagagcccuuuccccccuaaggaaaucuccgucagcugcaccaucggaaauguggacacaguucucaaguguucuauuugcggccaccuguuuuccagcuguucugaccuugagaaacaugcugaaagccacaugcagcagccgaaggagcauaccugcugucacugcucccacaaagccgaaucuagcuccgcucugcauaugcacaucaagcaagcccaugggccccagaaaguguucagcugugaucucugcggauuucagugcucugaggagaaccugcuuaaugcgcacuaccugggcaagacacaccucagacggcagaaccuggccgcucgcgggggauucguccaaauucugaccaaacagccuuuucccaagaaguccagaacgauggccacaaaaaaugugcauagcaagccucggaccucuaaauccaucgcuaagaacagcgacuccaaaggccuccgcaaugugggcucuacauucaaggauuuuagagggagcauuuccaagcagucuggaagcuccagcgaacugcuugucgagaugaugcccucucggaacacccugucccaggaaguugagaucguggaagagcacgugaccagccucggccuggcccaaaacccggagaaucagucucgcaaacuugacacacuggucacguccgaagggcuccuggagaagcuggaaagcaccaaaaacacacuccaggcggcccauggaaauucugugaccagcagaccucggcccgagcgcaacauucugguucuuggcaauuccuucagacggagaagcucuacauuuacccugaaggggcaagcuaaaaagcgcuucaaccuccugggaaucaagcggggcacguccgagacacagagaauguauaugaaacaccuucgcacccagaugaagacccaugaugccgaaagcgugcugaaacaccucgaggcuuguuccucuguccagcgggugugcguuacaaccagcgaaacacaagaggccgaacagggccagggguccgccagaccucccgacucuggacugcacagccugacggugaagcccgcuuccggcucucagacccucugugcgugcacagauugugggcaagucgccaccaaucgcacagaccuggagauccaugugaaacggugccacgcuagagagaugaaguucuacugucgcaccugcgauuuuagcuccaugagccggagagaccuugaugaacaucugcacucuaaccagcaccagcagacggccuccguccucagcugucaaugcuguucuuucauuucccuggacgagaucaaucugcgcgaccauaugaaggaaaaacacaacaugcauuuucuuugcaccccuugcaaucucuucuuucugagcgagaaggauguggaagagcacaaagccacagagaagcauauuaacucucugguucagccgaaaacccuccaguccagcaauuccgaccuggugcuucagacacugccccucagcacccuggaaucugagaacgcuaaggaaagcauggaugacuccggaaaagccucucaagaggaaccucugaagagccgggucucccacggcaaugaggugagacacucuagcaagccccaguuccaguguaaaaagugcuuuuauaaaacgcgguccucuacaguucuuacccgccauaucaagcucagacacgggcaagauuaccauuuccuguguaaagcgugcaaccuguauagccucuccaaggagggcauggaaaagcacauuaaacggagcaagcaucuggagaacgcuaaaaagaauaacaucggacuuucuuuugaagaguguaucgagagagugugcauuggcgccaaugacaaaaaggaagaguucgaugucuccgggaacggacgcaucgaaggccacauuggggugcagcugcaggagcacagcuaccucgaaaagggaaugcuggccucugaggagcugucccagagcggcggguccacaaaagacgaugaacuugcuucuaccaccacaccuaagcggggcagacccaaaggaaauaucagccgcacguguucccauugcggccuccuggccagcucuauuaccaaccugacagugcacaucagacggaagcauucccaccaauauagcuaccucuguaaaguuugcaaguacuauaccgucacaaagggggacauggagcgccacugugcuaccaaaaagcauaaaggaagaguggaaaucgaggccucuggcaagcacagcuccgauauuaucguggggccggaaggaggcucucuggaggcggggaaaaagaaugccggcagcgcugucacgauguccgacgagcaugccaacaaaccugcugaaucucccacaagcgugcuugagaagccugaucggggaaauuccauugaagccgagguugaaaacguguuucacagccuggacggcgaggucaauucucaucuccuggacaagaaagagcagaucuccagcgaacccgaggauuucgcgcagccuggggacguguacucccagcgcgauguuaccggaaccggcgaaaacaagugccugcacugcgaguuuucugcccacagcuccgcuucucuugagcuccaugugaaaagaaagcacacaaaagaauucgaguucuauuguauggccugcgacuacuaugcugucacccggcgcgaaaugacaagacaugccgccacggagaagcacaagaugaaacggcaaagcuaccugaauuccgcuaacguggaagcggggagcgccgauaugucuaagaauauuaucaugcccgaggaggaacaccagcagaacuccgaggaauuucagauuaucagcggacaaccgucugacacccugaaaucccgcaacgcugccgauuguagcauccucaaugagaacacaaaucuggacaugucuaagguucuuugcgccgcugauagcguggaagucgagaccgaggaagaguccaacuucaaugaagaccauucuuuuugugagacauuccagcaggccccugugaaagauaaggugagaaagcccgaagagaugaugagccugaccauguccagcaacuauggcucccccucucgguuucaaaaugagaacagcggguccucugcgcucaauugcgaaacggcuaaaaagaaccacgagauuagcaaugacgccggcgaacugagaguccauugugagggagagggcgggaacgccggagauggcgggggaguugugccucaccgccaucugugcccggugacccuugacggcgaacgguccgcugagucucccguccuggugguuacaagaaucacccgcgaacagggcaaucucgagagcgggggacagaaccggguggccagaggccacgggcuggaagaccucaaaggaguccaggaggauccugugcugggcaauaaggagauucuuaugaacucccaacacgaaacagaguucauccuggaagaggacgggcccgcgagcgauucuaccguugaauccagcgacguguacgagacaauuaucucuaucgaugacaaaggacaggcuauguacuccuuuggccgcuucgauagcucuauuauccggauuaagaacccugaggacggcgaacucaucgaucaguccgaggaagggcugauugccaccggagucagaaucagcgagcugccccuuaaggacugugcccagggcgugaaaaagaaaaaguccgaagggagcucuaucggagagagcacgcgcauucggugcgaugacuguggcuuucuggcugacgggcucuccggacugaauguucauaucgccaugaaacacccuacaaaggagaagcauuuccacugccuccugugcggcaaaucuuuuuauaccgaaagcaaccuucaccaacaucuggcuuccgccggccacaugagaaaugagcaggcgucuguggaagagcuccccgaggggggagccaccuucaagugugucaaaugcacagaaccguuugauagcgagcagaaccuguuccugcauauuaagggccagcacgaagagcuucugcgggaagugaauaaauacaucguggaggacaccgagcaaauuaaccgcgaaagagaggaaaaucaggggaacgucuguaaguauugcggaaaaaugugucgguccucuaauagcauggcuuuccucgcccauauccgcacgcacacaggcuccaagccuuuuaagugcaaaaucugucacuucgcuaccgcccagcugggggaugccagaaaccauguuaagcggcaccucggaaugagagaguacaaaugccauguguguggcguggcuuuugucaugaagaaacaccugaauacacaucuucugggcaagcacggggugggaacccccaaggaacgcaaauucacaugccaccugugugaccggagcuuuaccgagaagugggcgcucaacaaucauaugaaacugcacacgggcgagaagccuuucaaaugcaccuggcccacaugccauuauucuuuucuuaccgccuccgcuaugaaggaucacuacagaacacacaccggggaaaagagcuuccugugugaccucugcggauuugccggcgggacgcgccaugcccugacaaaacaccggagacagcauaccggagagaagccguucaaaugugaugaaugcaacuuugcuucuacaacccaaucccaccucacccgccauaagcggguucacacaggcgagaaaccuuauagaugucccuggugcgacuaccgcagcaauugugccgaaaacauuagaaagcacauccugcauacgggcaagcacgagggggugaaaauguacaauugcccuaagugugauuauggaaccaacguccccguggaguuccggaaccaucuuaaagaacagcaccccgacauugagaauccugaucuggcguaccugcacgcuggcaaggggcagaaacucuga

SEQ ID NO: 78219 - RNA, 1551 nt, Artificial Sequence
  derived and/or modified sequence opt5 from ZNF410__Homo_sapiens__NP_001229853
augcugagcgacgagcucgaauccaagcccgagcugcuugugcaguucguccaaaacaccucuaucccucugggccaggggcucguugaaagcgaggccaaagauauuacaugccugucccuucugccggugacggaagcuagcgaguguagcagacucaugcugcccgagccugugcccuggcgggaagaggacggaaaguccggcugcucugaucugaaugacaccacaaaccacagcaauuccagcaaagaagucccuucuuccgccgugcuccgcagccugagaguuaacguggggcccgauggagaggagacccgggcgcagacaguccagaagucuccugaauuucuuuccaccagcgagucuuccagccugcuccaagaccugcagccguccgauucuacaucuuucauccuucugaaucucacccgcgcuggccugggguccagcgccgaacaucugguguuuguucaggacgaggccgaagauucuggaaacgacuuccucuccagcgagucuacggauagcuccauucccugguuucugagagugcaggagcuugcucacgacucucugaucgccgcuacccgggcccaacucgcgaaaaaugccaagacaagcuccaacggcgaaaauguccaucugggcagcggggauggacagucuaaggacuccggcccucuuccccagguggagaaaaagcugaaauguaccguggaagggugcgaccgcacauucgucuggccugcucacuuuaaguaccaucucaaaacccacagaaacgaucggagcuucauuugucccgccgagggaugcggcaagucuuuuuauguucugcagcgccugaaggugcacaugagaacgcauaauggggaaaaaccguucaugugucacgaguccggaugcggcaagcaauuuacaaccgcuggcaaccucaaaaaucaucggcgcauccacacaggggagaagccuuuccugugugaagcccagggaugcggcagauccuuugcggaguacuccucucuucggaaacaccuggugguccauagcggggaaaagccccaccagugucaagugugcggaaaaaccuucucccagucuggcagccgcaacguucauaugagaaagcaccaucuccagcugggggccgcuggaucccaggagcaagaacagaccgccgagccucuuaugggcagcucucugcucgaggaagcuagcgugcccagcaagaaucuggucucuaugaacucccagcccagccugggcggggagucucucaaccugccuaauacaaacagcauccuuggaguggacgaugaaguucuggccgagggcuccccgcggagccucucuuccgugcccgacgucacgcaccaccuggugaccaugcagagcgggagacaauccuaugaggucucugugcugacagccguuaauccucaggaaagccuugcuccccucccucgccuggagugcuccggagcguucucugcccauuguaaccugugccuccccggcagcuccgauucuccggcuagcgccuccuga

SEQ ID NO: 78220 - RNA, 1668 nt, Artificial Sequence
  derived and/or modified sequence opt5 from ZNF415__Homo_sapiens__NP_001129510
auggacggcgaugggcugaccuucagagacguggccaucgaguuuagccaggaugaauggaagugccucaacuccacacaacggacgcuguaccgcgacgucaugcuugagaauuauagaaaccugguuucucucgaucugagccggaauugugugauuaaagaacuugcuccccagcaggagggaaacccuggcgaaguguuccacaccgucacacuggagcagcaugagaagcacgacaucgaagaguuuugcuuccgcgaaauuaaaaagaaaauccaugauuuugacugucaauggagagaugacgagcggaauugcaacaaggugaccacagccccgaaggagaaucucaccugucgcagagaucagcgggaccgcagagggauuggaaacaaauccaucaagcaccagcugggccugucuuuccucccccauccucacgaacugcagcaauuucaggcggaggggaaaaucuacgaaugcaaucacguugaaaagagcgugaaccauggauccucugucagcccuccccagauuaucuccagcacaauuaaaacccacgugucuaauaaguauggcacggauuucaucuguuccagccuucugacccaggagcaaaagucuugcauucgggagaaacccuaccgcuauaucgagugugacaaggcucucaaccauggcucccacaugacaguuagacaggugagccacucuggggaaaaaggauacaagugcgaccuguguggcaaagucuuuucccaaaagagcaaucuugcccggcauuggcgcgugcacaccggggagaaaccuuauaagugcaacgaaugcgauagauccuucucucggaauagcugucuggcccuccauagacgcgugcacacaggagagaagccguacaaaugcuacgaaugugacaaggucuuuucccggaacagcugccuggcucugcaucagaaaacccacauuggcgagaagcccuauacguguaaagagugcgggaaggccuucucuguuagauccacacucaccaaccaccaggugauccauagcggaaagaaaccuuacaaguguaaugaaugcggcaaaguguuuucucagacaagcucccuggcuacccaccagcgcauccauaccggcgagaagcccuauaaauguaacgaaugcgggaaggucuucucucaaacaagcucccuugcccggcacuggcgcauucacacgggagagaagccuuacaaauguaaugaaugcggcaagguguucagcuauaacucucaucuggcgucccacagacggguucauaccggggagaaacccuacaagugcaaugaguguggaaaagccuuuagcgugcacucuaaccucacaacccaucaggucauccacacaggcgaaaagccguauaagugcaaucagugugggaaaggauucuccgugcacagcucccugaccacgcaucagguuauucacacaggcgagaagccuuacaaaugcaacgaauguggcaagucuuuuagcgugagacccaaucuuacccgccaucaaaucauucacaccgggaaaaagccuuacaaaugcuccgauuguggaaagucuuucagcguccggcccaaccuguuuagacaucagaucauccacacaaaggagaaacccuauaagcgcaauuga

SEQ ID NO: 78221 - RNA, 1536 nt, Artificial Sequence
  derived and/or modified sequence opt5 from ZNF419__Homo_sapiens__NP_001091961
auggccgcugccgcgcugagagaccccgcucaggugccugucgccgccgaucuccugaccgaccacgaggaacaaggcuacguuacauucgaggauguggcuguguauuuuagccaggaagaguggagacuucuggacgaugcccagcgccuccuguacagaaacgucaugcuugaaaauuucacgcugcucgcuucccuggggcuggccucuagcaagacccaugagaucacacagcucgaguccugggaggaaccguuuaugcccgcgugggaagugguuaccucugccauuccucggggaugcuggcacggcgcugaggccgaggaagcucccgagcaaaucgccagcguggggcugcuuuccucuaacauucagcagcaucagaaacaacacuguggagaaaagccucugaaacgccaggagggcagaguccccgugcuccggagcugcaagguucaucuguccgaaaagagccuucagucucgcgagguggggaaggcgcugcucaucuccagcggaguccugaagcaccaggugacacacaccggcgagaaaucucauagauccagcaagucucgggaagccuuccacgcuggcaaacgccauuauaaguguuccgagugcgggaaagccuuuggacaaaaguaccugcucgugcagcaccagagacugcacgcuggcaagaaaacauaugaauguagcgagugcgggaaacuuuuccgggacauguccaaucuguuuauucaucaaaucguccacaccggagaacgcccuuacggcuguucuaacugcgggaaauccuucagcagaaaugcccaucucaucgagcaccagcggguucauacgggagagaagccguuuaccuguagcgaaugcggcaaagccuuccgccacaacucuacacuggugcagcaccauaagauucacaccggcgugagacccuaugaguguuccgaaugcgggaaacuuuuuagcuucaauucuagccugaugaagcaucagcggauccacacaggagagagaccuuacaagugcuccgaauguggcaaauuuuacucucacaagagcaaccucauuaaacauuggcgcguccacaccggggagcggcccuauaagugcuccgauuguggaaaauucuucacgcaaugcagcucucugaugcagcaucagaaggugcacacaggcgagaagccuuuuaaauguaaugaaugcgggagauucuuucgcgagaacuccacccugguucggcaucagagagugcacacaggagcuaagcccuacgaaugucgcgagugcggcaaauucuuuagccaaucuuccacccucaugcagcaccggaagguccauaucggcgagaaaccguucaaguguaaugaaugcgggagacuguuucgcgagaacagcucccuugugaagcaccagcggguucauaccggagcgaaaccuuaugaauguagagagugcggcaaguucuuucgccacaauucuagccuguucaaacaucggcggauucacacaggggaaaugcaguga

SEQ ID NO: 78222 - RNA, 2340 nt, Artificial Sequence
  derived and/or modified sequence opt5 from ZNF41__Homo_sapiens__NP_700359
auggccgcuaacggcgacagcccgccuugguccccggcccuggcggcugaggggagaggaucuagcugcgaagccuccgugucuuucgaggaugucaccguugacuuuagcaaagaagaguggcagcaccucgaucccgcccaacggcgccuguacugggacgugacacuugaaaauuauucccaucugcucucugugggcuaccagaucccuaaaagcgaggcugccuucaagcuggagcagggggaaggacccuggaugcuugagggcgaagcuccucaccaguccuguagcggggaggccauuggaaaaaugcaacagcagggcauccccggcgggaucuuuuuccauugcgagagauuugaucagccuauuggagaagacucucuguguuccauucucgaggaacuguggcaagauaacgaccagcuggagcagcggcaggaaaaucaaaacaaucuccugagccacgucaaggugcuuaucaaagagcgcggcuaugagcauaagaacaucgaaaagauuauccacguuacgaccaaacuggugccgucuauuaagagacuccacaauugcgauacaauccugaaacauacccuuaacucccacaaucauaaccggaauagcgcgacaaagaaccuggggaaaauuuucggaaauggcaacaauuuuccccacucuccuuccagcaccaagaacgagaacgccaagacaggggcuaauuccugugaacacgaccauuacgagaaacaccucucucauaagcaggcccccacccaccaucagaaaauccacccugaagagaagcuguaugucugcacggagugugugaugggauucacccagaaaagccaccuguuugaacaucagcgcauucacgcuggcgagaaguccagagaaugcgauaaaagcaacaagguuuucccccagaagccccagguggacguccauccuucuguguacacaggcgagaaacccuaucucuguacccaaugcgggaagguguuuacacugaaauccaaucuuaucacccaccagaagauccacacgggacagaaaccuuacaaguguagcgaaugcggcaaggccuucuuucagcggucugaucuguuccgccaucuccggauucacacaggggagaaacccuacgagugcagcgaauguggaaagggcuucucccaaaacucugaccugagcauccaucagaaaacccacacaggggagaagcauuaugaaugcaaugaguguggaaaagcguuuaccagaaaguccgcccuucgcaugcaccagagaauccacaccggcgagaagcccuacgucugcgcugacuguggcaaagccuucauucagaaaagccauuuuaacacacaccaacggauucauacgggggaaaaaccuuaugagugcucugauuguggaaaguccuucaccaaaaagagccagcugcacguucaucagcgcauccacacaggcgaaaagccguacaucugcaccgagugugggaaaguguuuacacacagaaccaaucucacgacacaucagaagacccacaccggagaaaaacccuauaugugcgcugaguguggcaaggccuucacagaccaaucuaaccugauuaaacaucagaagacccacacaggggagaaaccuuacaagugcaauggcugcggaaaggccuuuaucuggaaaucccggcugaagauucaccagaaaagccauaucggcgaaagacacuaugaguguaaggauugcgggaaggcuuucauucaaaaguccacgcucucugugcaucagcgcauccacaccggagaaaagcccuacgucuguccugagugcggcaaagcguuuauccaaaagagccauuucauugcccaccaccggauccauacaggggaaaaacccuacgaguguuccgacugcggaaaguguuuuaccaaaaagucucagcugagagugcaccaaaagauucauacaggcgagaaaccgaacaucugcgcugaaugugggaaggccuucaccgaucgcagcaaucuuauuacgcaccagaaaauccacacccgggagaagccuuaugaaugcggcgacuguggaaaaacauuuaccuggaaguccagacugaacauucaucaaaagagccacacaggcgagcgccauuacgaaugcucuaaaugcgggaaggccuucauccagaaagcuacccucuccaugcaccagaucauucauacgggaaagaaacccuaugccuguacagagugccagaaggcguucaccgaucggagcaaucugaucaaacaccagaagaugcacucuggcgagaagagauacaaggcuuccgacuga

SEQ ID NO: 78223 - RNA, 3675 nt, Artificial Sequence
  derived and/or modified sequence opt5 from ZNF423__Homo_sapiens__NP_001258549
auggaggacgaaagcaucuauaccugcgaucacugucagcaagacuucgagucccuggccgaucucacagaccauagagcucaccggugccccggcgauggggacgaugacccucagcugucuuggguggccagcuccccgucuagcaaggaugucgcgucccccacgcagaugauuggagacggcugugaucuugggcugggagaagaggaaggcgggaccggacucccuuaccccugccaguuuugugacaaaucuuucauccgccugagcuaccuuaagagacaugagcaaauucacuccgauaaacugccuuuuaagugcacauauuguagccggcuuuucaaacauaagcgcucuagagaccggcacaucaagcugcacaccggcgacaaaaaguaccauugccacgagugugaagcugccuuuucccgcagcgaucaucugaaaauucaccucaagacacacucuuccagcaaacccuucaagugcaccguuuguaagagaggcuuuucuuccacaagcucccugcagucucauaugcaggcccacaaaaagaacaaagagcaucuugcuaagagcgaaaaagaggccaagaaagacgauuucaugugcgacuauugcgaggauaccuuuucccagacggaggaacuggaaaagcacgugcucacccggcauccucaacugagcgagaaggcugaccuucaguguauccacugcccggaaguguucgucgaugagaauacacugcucgcccacauccaucaggcgcacgccaaccagaaacauaagugucccaugugcccugagcaauuuucuuccguggaagggguuuacugucaccuggacagccaccgccagcccgauucuagcaaucauuccgugucuccugaccccguccugggaagcguggcuuccaugagcucugccaccccggauuccagcgcuucuguugagagaggcuccacaccugacagcacccucaaaccccugcgggggcagaagaaaaugcgcgacgauggacaaggcuggacgaagguggucuauuccugcccuuacuguucuaagagagacuucaacagccuugccgugcuggaaauucaccucaaaacaauccaugcggauaagccccagcagucccauaccugccagauuugucuggacucuaugcccacacuuuacaaucugaacgagcacgugcggaaacuccacaagaaucacgccuauccugucaugcaauuugggaacaucagcgcuuuccauugcaauuacuguccggaaauguucgccgauauuaacucccugcaggagcacauccgcguuagccauugcggacccaaugcuaacccuucugacggcaauaacgccuuuuucugcaaucaguguuccaugggcuuucugaccgagagcucucucaccgaacacauucagcaagcccauugcuccguggggagcgcuaaacuggagucucccgugguccagccuacacagagcuucauggaaguguauuccugucccuacugcacgaacagcccgaucuuuggaucuauccuuaagcugaccaagcacauuaaagagaaccacaagaauaucccucucgcgcauuccaaaaagagcaaagccgaacagucccccguuucuagcgauguggaggucuccucuccuaagagacaacggcugagcgcuuccgccaacucuauuagcaauggcgaguaucccuguaaccagugcgaccuuaaguucuccaauuuugaaucuuuccagacacaccugaaacuccaucuggagcugcuccugagaaagcaggccuguccucaaugcaaagaagauuuugacucucaggagucccuucugcagcaccucaccgugcacuacaugacaaccagcacgcauuauguuugugagucuugcgauaagcaauucuccagcguggacgaucugcagaaacaucugcuugacaugcacacauuuguccucuaccacuguacccugugccaggaaguguucgacucuaaggucuccauccaggugcaucuggcuguuaaacacagcaacgagaagaagauguaccgcugcaccgccuguaauugggauuuucggaaagaagcggaccuccaagugcacgucaagcauucccaccuggggaaccccgcuaaagcccauaagugcauuuucuguggagagacauucagcaccgaaguggagcuucagugccacaucacaacgcacucuaaaaaguauaauuguaaguuuugcagcaaagccuuccaugcuaucauucugcucgagaagcaccugagagaaaaacauuguguuuuugaugccgcuaccgagaacggcacagccaauggggugccgccuauggcgaccaagaaagccgaacccgcugaccugcagggaaugcuucucaagaaccccgaggccccuaauucccacgaagcuagcgaggaugacgucgaugccagcgagccgauguacggcugcgacaucuguggcgcggccuauacaauggaagugcugcugcagaaccaucgccuccgggaucacaauauuagacccggggaggacgauggaucccgcaagaaagcugaguucaucaagggcucucacaaaugcaacguguguagccggaccuuuuucuccgaaaacgggcugagagaacaucuucaaacgcaccgcggaccugccaagcauuacaugugccccauuugcggcgagcgguuuccuucucugcucacccugacagagcacaaaguuacccacagcaagucccuggacacagggaccuguagaaucugcaagaugccccuucagagcgaagaggaguucaucgaacauugucagaugcacccugaucuccgcaauucucugacgggcuuucggugcgucguguguaugcagacagugaccuccacacuggagcucaaaauucauggaaccuuccacaugcaaaagcuggcuggcagcucugccgccuccagccccaacgggcagggacuucagaaacuguauaagugcgcucucugucugaaagaauuuagauccaagcaagaccuggucaaacuugacgugaauggccucccguacgggcugugcgcgggauguauggcccggucugcuaacggccagguugggggccuggccccucccgagccugccgaucgccccugcgcuggacucagauguccggaaugcagcgugaaguucgaguccgccgaagaccuggagagccauaugcaggucgaucaccgggaccuuaccccugagacaucuggccccagaaaggggacgcagaccuccccugugccccgcaaaaagacauaucaaugcaucaaaugucagaugaccuuugaaaaugagcgggaaauucagauccacguugcgaaccauaugauugaggaaggaaucaaucacgagugcaagcuguguaaccagauguucgauagccccgcuaaacuccugugccaucugauugagcacucuuucgaaggcaugggagggacauuuaaguguccugugugcuucaccgucuuugugcaagccaauaagcuccagcagcauaucuucgccguucacggccaggaggacaaaaucuacgauuguagccaaugcccgcagaaguuuuucuuucagacggaacugcagaaccacacaaugucccaacaugcucaguga

SEQ ID NO: 78224 - RNA, 1710 nt, Artificial Sequence
  derived and/or modified sequence opt5 from ZNF430__Homo_sapiens__NP_001166142
auggagaaccugaaaagcggcguguacccccucaaagaagccuccgggugcccuggagcugacagaaaucugcuugucuauucuuucuacgagaagggcccgcugaccuuucgggauguugccaucgaauuuagccucgaggaauggcagugucuggacacagcgcaacaggaucuuuaucgcaaagugaugcuggagaacuacagaaaucucguguuucuggggauugcugucuccaagcccgaccugaucacgugccucgagcagggaaaagaaccuuggaacaugaagcggcacgccaugguggaucagcccccuguuaccuauucucauuucgcccaagaccuguggcccgagcagggcauuaaggauagcuuucaggaagugauccuucgcagauacgggaaauguggacacgaggaccugcagcuccggacaggcugcaaguccgucgaugaguguaaucugcauaaagaaugcuaugacgagcuuaaccaaugucugaccacaacccagucugaaauuuuccaguacgauaaguacgugaauguuuucuauaaauucagcaacccuaauauccagaagauccgccacacaggcaagaaaccguuuaagugcaaaaagugugacaaauccuucugcaugcuccugcaucugacccaacacaagcggauucacaucagagagaacagcuaccagugugaagagugcgggaaaguguuuaauugguucucuacgcucacccgccauagacggauucacacaggagagaagcccuauaagugcgaacaguguggcaaggcuuuuaagcaauccagcacccugacaacccauaaaaucauucacacgggggagaagccuuaccgcugcgaagaguguggaaaaacauucaacagaucuucccaccuuaccacacauaagcggauccacaccggcgaaaagcccuaucgcugcgaggagugugggagagccuucaaucggagcucucaucugaccacacacaaaauuauccauacgggagaaaagccuuacaaaugcgaggaauguggcaaggcuuuuaaccaguccagcacccucacaacccacaaaaucauucacgccggcgagaagcccuauaagugcgaagagugugggaaagcguucuacagauuuuccuaccugacaaagcauaaaaucauucacaccggagagaaguucuauaaaugcgaagaguguggcaagggguuuaauuggucuagcacgcuuacaaagcauaaacgcauccacaccggagaaaagccguacaaaugcgagcagugcggcaaggccuucaacgaguccagcaaccugaccgcucacaaaauuauccauacaggggaaaagccuuauaaaugugaggaaugcggaaaggccuuuaaucggucucccaagcucaccgcucacaaagucauccauuccggcgagaagccuuacaaaugugaagagugcggcaaggccuucaaccaguuuagcaaucugacaaaacacaagauuacgcauaucggggauaccucuuauaaguaccuggagugugacaaagcguucagccaauccucuacacucaccaagcacaaagugauucacacaggagaaaagcccuauaacugcgaggaauacggcaaagccuuuaaucagagcuccaaccugaucgagcagagcaauucuuacuggagagaaacccuucagauguga

SEQ ID NO: 78225 - RNA, 1959 nt, Artificial Sequence
  derived and/or modified sequence opt5 from ZNF432__Homo_sapiens__XP_011525850
augaucaacgcccaggagcugcucacccuggaagacgugacagucgaguucacgugggaagaguggcaacuucugggccccuuucagaaggaucucuacagagacguuaugcuggaaauuuauagcaaucuucuguccaugggguaccaggugucuaaaccugaugcucucagcaagcuggagcggggagaggaaccguggaccauggaggacgaacgccacuccagaaucugccccgagaacaaugagguggaugaccaucugcaggaucaccucgaaaaccaacggaugcugaaaucugucgagcaguaucaugaacacaaugccuucggcaacacagcgagccagaccaagucccuuugucuguuucgcgagaaucaugacacauucgaacucuacauuaaaacccugaagucuaaccuuagccuggugaaucagaacaaguccugcgagaucaauaacagcacaaaauuuucuggggauggaaaguccuuccuccacggcaauuaugaggaacuguacagcgcugccaaauuuucuguuuccaccaaggccaacagcacgaaaucucaaguguccaagcaccagagaacccaugagauugaaaagaaucacgucuguagcgagugcgggaaagccuucgugaagaaaucccagcugacagaccaugaacggguucacaccggagagaagccuuauggcuguacacucugcgcuaaaguguuuucucgcaagagcagacugaacgagcaccagcggauccauaaacgcgaaaaguccuucaucuguagcgagugcggcaaggucuuuaccaugaaaucuagacuuauugaacaccaacggacgcauacaggggagaagcccuacaucuguaacgaaugcggaaaaggcuucccugggaagcgcaaucugauugugcaccagagaaaccauaccggagagaaauccuacaucuguagcgagugcggcaagggguuuacaggaaagucuaugcucauuauccaccagcggacccacaccggcgaaaaacccuauauuugcagcgaguguggcaagggguucacaacgaaacauuacgugaucauccaccaacgcaaucauaccggagaaaagccuuauauuugcaacgaguguggcaaaggguucacaaugaaguccagaaugaucgagcaccagcggacccacacaggagaaaagccguacauuugcucugaguguggcaaaggguuucccagaaagagcaaucugaucguccaucagcgcaaccacaccguugaaaaauccuaucuuugcagcgaguguggaaagggcuucacggugaaaucuaugcugauuauccaucagcggacacacaccggcgaaaagccuuauaccugcuccgagugugggaagggauuuccccucaaaagcagacugaucgugcaucaacgcacacacaccggcgagaagccuuaccggugcucugaaugugggaaaggauucauugucaauuccggccugaugcuccaccagagaacacauacgggggagaagcccuacaucugcaacgaaugcggcaaaggauuugcuuucaagagcaaucuggugguucaccagcgcacccauacaggcgagaaaccguuuauguguuccgaaugcgggaagggauucaccaugaagcgguaccuuauugugcaccagcaaauccauacagaggagaaaucuuguauuugcagcgaauguggcagaggguuugccaaggagaccgaacuggcgcuccacaaacagguccacacgggagagaagccuuauggcugcaacgaaugugggaaaggcuucaccaugaagucccgccugaucgugcaucagcggacacacaccggagagaagcccuuuguuugcucugaguguagaaaagccuucagcuccaagcgcaaucuuaucgugcaucagcggacacacaacggcaauaaaccuuga

SEQ ID NO: 78226 - RNA, 2022 nt, Artificial Sequence
  derived and/or modified sequence opt5 from ZNF433__Homo_sapiens__NP_001073880
augauguuccaggacagcguggccuuugaggaugucgcuguuaccuucacacaagaagagugggcccugcucgaccccucccagaagaaccugugcagagaugugaugcaggaaacguuucggaaucuugcgucuaucggcaaaaaguggaaaccucagaacauuuacguggaguaugaaaaucugcgcagaaaccuccggaucgucggggagcgccuguucgagagcaaggaaggacaccaacauggcgagauucuuacccaggugccggacgauaugcugaaaaagacaaccacagggguuaaguccugugaaucuagcguguacggagaggucggcuccgcucacucuagccucaauagacauauccgggacgauaccgggcacaaagccuaugaguaccaggaauauggacagaagcccuacaaaugcaaguauuguaaaaagccuuuuaacugccuguccagcgugcaaacacaugagcgcgcccacucuggcagaaagcuguacguuugugaagagugcggcaaaaccuucauuucccacagcaaucuccagcggcaucgcaucaugcacagaggggacggacccuacaaguguaaauuuugcggcaaggcucugauguuccuuucucuguaucucauccauaaacggacgcacaccggggaaaagccuuaccaguguaaacagugcggaaaggccuuuucccacagcagcucccugcgcauucaugagagaacacacaccggcgagaagcccuauaaauguaacgaaugcgggaaggcuuuccauagcuccacaugccuucacgcccauaaacggacccacacgggagagaagccuuacgaauguaaacaaugcggcaaggcguuuucuagcucccacagcuuccagauccaugagcgcacacacaccggcgaaaagccguaugaguguaaagagugcgggaaggccuuuaaaugucccucuuccgugagacggcaugaaagaacacacagccgcaagaaaccuuacgagugcaagcacuguggaaagguccugucuuaucucaccagcuuccagaaucaucugggcaugcacaccggggaaauuucccauaaaugcaagaucuguggaaaggcuuucuacucucccagcucccugcaaacacacgagaaaacgcauaccggcgaaaaaccuuacaagugcaaccagugugggaaggccuuuaauucuucuuccagcuuccgguaucacgagagaacacacaccggagagaaacccuacgaaugcaagcagugcggcaaggcuuuucgcucugccucccuccugcagacacauggccggacccacacgggggagaaaccguaugcguguaaagaaugcggaaagccuuucagcaacuuuuccuucuuucaaauucaugagagaaugcaccgcgaggaaaaacccuacgaguguaagggcuaugggaagacauucucucuuccuagccuguuucaucggcacgaaagaacccacaccggaggcaaaacauacgagugcaagcagugugggcgcuccuucaauugcucuagcuccuuucgguaucauggcagaacccacacaggagaaaaacccuacgaguguaagcagugcggcaaagccuuccgcagcgcuucucagcuccaaauccaugggcggacgcacaccggagagaagcccuacgaauguaagcagugcggcaaagccuuuggguccgcuagccaucugcagaugcacggaagaacacacaccggcgagaagccuuaugaauguaaacagugcgggaagucuuucggcugcgccucccggcuucaaaugcauggacgcacacacaccggcgagaaaccguacaaguguaagcagugcgggaaagccuucggaugucccagcaaccugagacggcauggcagaacgcacaccggggaaaagccuuauaaaugcaaucaguguggaaagguguuucgcugcucuagccagcuccaagugcacggccgggcucauuguauugauacacccuga

SEQ ID NO: 78227 - RNA, 2487 nt, Artificial Sequence
  derived and/or modified sequence opt5 from ZNF438__Homo_sapiens__NP_001137240
augcagaacagcguguccguucccccuaaggacgagggcgaaucuaauaucccgagcgggaccauucaauccagaaaaggacugcagaacaagucucaguuccggacaaucgcccccaaaauugucccuaaggugcucacgagccgcaugcugcccugccacuccccuucuagaagcgaucaggugaaucuuggccccuccaucaacagcaaacugcucgggaugucuacccaaaauuacgcucugaugcaggucgccggacaggagggcacauuuucccuuguggcgcugccucauguugcuagcgcccagccgauucaaaagccccggaugucucucccugaaaaccugaagcugcccaucccucgcuaucagcccccgagaaauuccaaagccagccggaagaaaccuauccucauuuuccccaagucuggguguuccaaagcuccugcccagacccagaugugcccccaaaugagccccuccccuccgcaccaucccgagcugcuuuacaagccuucucccuuugaagaggugccuagccuggagcaggcucccgccuccaucagcacagcggcccucaccaacggaucugaccacggcgaucugcgcccgccugucacaaauacccauggcucccuuaaucccccugcuacgcccgccagcucuaccccugaagaacccgcuaagcaggaccugacagcccucagcgggaaagcgcacuucguguccaagauuaccucuagcaaaccguccgccguugcuagcgaaaaguuuaaagagcaaguggaucuggccaagacaaugaccaaccugucuccuacgauccucggaaacgcuguccagcugauuuccagcgugcccaaaggcaagcugcccaucccuccguauucuagaaugaagacaauggagguguacaaaauuaaguccgacgccaauaucgccggguucagccugcccggaccuaaagcugauugugacaagauccccuccaccacagaaggcuuuaacgcggccaccaaagucgcuucucggcucccuguuccccaggugagccagcaauccgccugcgagucugccuucuguccucccaccaagcuggaucuuaaucacaagacaaaacugaacagcggggcugccaagcgcaaaggaagaaagcggaaagugccggacgaaauucucgcguuucagggcaagcgcagaaaguauaucauuaacaaaugccgggauggcaaggagcgcgucaaaaaugacccucaggaguucagagaucagaagcuggggacgcugaaaaaguaccgguccaucaugcccaagccuauuauggugauccccacccucgcuagccuggccucuccgacaacccuucaaucccagaugcugggaggccucgggcaggacguucugcuuaacaauagccugacaccuaaauaucucggauguaagcaggacaacucuuccagccccaaaccuucuagcguguuuagaaauggcuucuccgggaucaagaaacccuggcaucgcugccacgucuguaaccaucacuuucaauucaagcagcaccuucgggaucauaugaauacccacacgaacagacgccccuacagcugccggauuuguagaaaaucuuacgugcgcccuggaucccugagcacacauaugaagcuccaccauggcgagaaucggcugaagaaacuuaugugcugcgaguucugugccaagguuuuuggccacaucagaguguauuucgggcaccugaaagaaguccaucgcguggucauuuccaccgagccggcucccucugaacuccagccuggagacauccccaagaaccgggauaugagcgugagaggcauggaggggucccuggaacgcgagaauaaaucuaaccuggaggaagacuuucuucucaaucaggccgaugagguuaagcugcaaauuaagugcggacggugucagaucaccgcucagagcuucgccgaaaucaaauuucaucugcucgacgugcacggcgaggaaauugaggggagacugcaagagggcacauucccuggauccaagggcacccaggaggaacuuguccagcacgcgucucccgauuggaaacggcacccugaacgcgggaagccggagaaagugcauagcuccagcgaggaaucucacgccugccccagacugaagcggcagcuccaucugcaccaaaacggaguugagaugcugauggaaaaugagggcccucaguccgggacaaacaagcccagagaaacgugucagggaccugagugccccggccuucauaccuuucuccuguggagccacucuggguucaacugucugcucugcgcugagaugcugggccgcaaagaagaccuucugcaccauuggaagcaccagcauaauugugaggauccguccaaacucugggccauccugaacacagugagcaaucaaggagucauugaacugucuuccgaggcugaaaaguga

SEQ ID NO: 78228 - RNA, 2016 nt, Artificial Sequence
  derived and/or modified sequence opt5 from ZNF443__Homo_sapiens__NP_005806
auggccagcguggcucuggaggacgucgccguuaacuucaccagagaagagugggcgcuccugggccccugccagaagaaucuuuacaaagaugugaugcaagaaacaauccggaaccuggacuguguggucaugaaguggaaagaucagaauauugaggaccaguaucgcuacccuagaaagaaccuccggugccgcaugcuggaaagauuuguggaguccaaagaugggacgcaguguggagagaccucuagccaaauccaggacuccauuguuacaaagaauacccuuccgggcguggggcccugcgaaucuagcaugcggggagagaaggucaugggccacuccucucugaacuguuauauccgcgugggggcuggacauaaaccucacgaauaccaugagugcggcgagaagcccgauacacacaaacagagaggcaaggccuucagcuaucauaauuccuuucagacccacgaacggcuccacacagggaaaaagccuuacgacuguaaggagugcggaaagagcuucucuucccugggcaaccugcaacgccauauggccguucagagaggggauggacccuauaaauguaaacucugcggcaaggcuuucuuuuggccuagccugcuucacaugcaugaacggacccacacgggggagaaaccguacgaauguaagcagugcucuaaagccuuuuccuucuacagcucuuaucugcgccacgagagaacccauacaggagagaagcccuacgaaugcaagcaguguuccaaggcuuuuccuuucuauagcuccuaccuccggcacgagcgcacccauacaggcgaaaaacccuauaaaugcaagcaauguucuaaagccuuuccugacagcuccagcugccugauucacgagagaacccauacgggcgaaaagcccuacacauguaagcagugcgggaaagcguucucuguguccggaagccuucagcggcacgagaccacacacucugccgagaagccguaugcuugucaacagugcggcaaagccuuucaucaccuggggagcuuccagagacauaugauccgccacaccggaaauggcccucacaaguguaaaaucugcgggaagggauucgauugucccuccucucuccagagccaugaacggacccacacaggcgagaagccuuacgaaugcaaacaaugcggcaaggcucugucccauagaagcucuuuucgcucccacaugauuaugcauacgggggacggaccccacaaauguaaggucugcggcaaagccuucguguaccccagcguguuucagcggcacgagagaacccauacagcggaaaagccuuauaaguguaaacagugcgggaaggccuaccgcaucucuuccagccugcggagacacgagaccacacauaccggagagaaaccguauaaguguaaacucggcaaggcuuucauugauuuuugcuccuuccagaaccacaaaacgacacauaccggggaaaagcccuacgaguguaaggaaugcggcaaagccuuuucucgcuuccgguaucugagcagacacaagcgcacccacacaggagagaaaccuuacgaguguaagaccugccggaaggcuuuuggccauuaugacaaucuuaaaguccacgaaagaauccauuccggggagaagcccuacgaauguaaagagugcggaaaggccuucucuuggcugacaugcuuucuccggcacgaacgcauucacaugagagagaaaagcuacgaguguccucaaugcggcaaggccuucacgcauucccgguuucugcaggggcacgagaaaacccauacaggagaaaaccccuaugaauguaaggagugcggcaaggcuuucgcgagccuuucuucccugcacagacauaaaaagacccacuggaaaaagacacacaccggggaaaauccguacgaguguaaagagugcggcaaggccuucgcuagccucucuucccugcaucgccacaagaaaacgcauuga

SEQ ID NO: 78229 - RNA, 984 nt, Artificial Sequence
  derived and/or modified sequence opt5 from ZNF444__Homo_sapiens__XP_011525370
auggagguggccguccccguuaagcaggaagcugagggccuggcccucgacagcccuuggcacagauuccggcgcuuucaucugggggaugcgccgggacccagagaagcucuuggccugcuccgggcccugugccgcgacuggcuuagaccugaggugcacaccaaagaacaaaugcuggagcuccuggugcuggagcaguuccucuccgcccugcccgcugauacacaggccugggucuguucucggcagccucaaagcggggaagaggcuguggcccuucuggaggaacucuggggacccgcggccuccccugacggcucuagcgcuacgcgcguuccgcaggaugugacccaggggcccggagccacaggcggcaaggaggacuccgggaugaucccucuggcuggaaccgcccccggcgcggaagggccugcccccggagauucucaggcugucagaccguacaaacaagagccuagcuccccuccccuugcccccggccugcccgcuuuucucgccgccccugggacaaccagcugcccggaauguggaaagacaucucugaaacccgcucaucugcuccggcaccgccagucccauagcggcgagaagccucacgcgugccccgaauguggcaaggccuucagacggaaagagcaucugcgcagacaccgggacacccacccugggucucccggauccccgggcccugcucuuagaccccugccugccagagagaagccccaugccugcugugaaugcgggaaaacguuuuauuggcgggagcaccucgugagacaccgcaagacccauagcggagcucggccuuucgccuguugggaaugcggcaaaggguuuggaagacgcgagcacguucugcggcaucagcgcauucacggccgcgcggcugccucugcccagggcgcuguggcccccgggccggauggaggcgggccuuucccucccuggccccuuggauga

SEQ ID NO: 78230 - RNA, 1992 nt, Artificial Sequence
  derived and/or modified sequence opt5 from ZNF44__Homo_sapiens__NP_001157748
auggcccugugcuacggcaccuucuggggguaucccaagaugcucgaggcugccaaccugauggaaggacuuguggacaucggcccuugggucacacugccgagagggcagcccgagguucucgaauggggacugccuaaagaucaagacagcguggcguuugaggauguggcugucaauuucacgcacgaagagugggcccuucugggccccucccagaagaaccucuaccgggacgugaugcgcgagaccauuagaaaucugaacuguaucgggaugaaaugggaaaaucagaacauugaugaccagcaucaaaaucugcggcgcaacccuagaugcgauguuguggagcgguuuggaaagucuaaagacggcagccaguguggcgaaacacucucccagauccgcaauucuauugucaacaagaauacccccgccagaguggaugcuugcgggagcuccguuaacggagaggugaucaugggccacucuagccugaauuguuauauccgggucgacacagggcauaagcaccgcgagugccaugaauacgccgagaaauccuauacccacaagcaguguggaaaaggccuuagcuacagacacucuuuccaaacaugcgaacggccucauaccgggaagaaaccguaugauuguaaggagugcggaaagacguuuuccagccccggcaaccugcgcagacacaugguggugaaaggcggggacggaccuuacaagugugaacucugcggcaaggcuuucuuuuggcccucucugcuucggaugcaugagcgcacccacacaggggagaaaccuuacgaaugcaaacaguguuccaaggccuuccccgucuauagcucuuaccugagacacgagaaaauucauaccggagaaaagccguaugagugcaagcaguguuccaaagcguuuccugauuacagcuccuaucuccggcacgaaagaacacauaccggcgagaagcccuacaaaugcaagcagugugggaaagccuucucuguuagcggaucccugcgcgugcacgagcggauccauacgggcgaaaagccuuauacaugcaagcaauguggcaaggcuuuuugccaccuggggagcuuccagagacacaugauuaugcauucuggagacggcccccacaaauguaaaaucugcgggaagggauuugacuuccccggcuccgcccgcauucaugaggggacccacacacucgaaaaaccuuacgaguguaagcagugcggcaagcugcuuagccaccggucuagcuucagacgccauaugauggcucacaccggagauggcccgcauaaaugcaccgugugugggaaggccuuugacucccccucugucuuccaacggcacgaaagaacacauacgggagagaaaccuuacgagugcaagcaguguggcaaagcguuucgcaccagcuccagccugcggaagcacgaaacaacccacacaggggagcagcccuauaagugcaaauguggaaaggccuucucugaucucuuuuccuuccagagccaugaaaccacgcacucugaggaggaaccuuacgagugcaaagaauguggcaaggcuuuuuccagcuucaaauauuuuugcagacaugagcgcacacacuccgaagagaagucuuacgagugucaaaucugcgggaaagccuucagccgguuuuccuaucugaagacccaugaaagaacccacacagcugagaagcccuacgaauguaaacagugccggaaggccuucuuuuggccgucuuuccuucugcgccacgagagaacccauacaggcgaacggccuuaugagugcaaacacuguggaaaggccuucagcagauccagcuuuugccgcgagcaugaacggacgcacaccggcgagaaacccuacgaauguaaggagugcgggaaggcuuucucuucccucagcucuuuuaauagacacaaacgcacacauuggaaggacauucuguga

SEQ ID NO: 78231 - RNA, 3186 nt, Artificial Sequence
  derived and/or modified sequence opt5 from ZNF451__Homo_sapiens__NP_001026794
augggcgaccccgggagcgagaucauugaauccgugccuccggccggacccgaggcuucugaaagcaccacagaugagaacgaagacgauauccaguucgucuccgagggcccucugagacccguucucgaguacauugaccuggugucuagcgaugacgaagaaccuuccacgucuuauaccgaugaaaauaucaagcggaaagaccacauugauuaccaaaaggacaaaguggcccuuacacuggcgcgccucgcuagacaugucgagguggagaagcagcagaaagaagagaagaaccgggccuuucgcgaaaagaucgauuuccagcacgcccaugggcugcaagagcuugaauuuaucagaggacacagcgacaccgaggcugcccggcugugcguugaucaguggcucaaaaugcccggccugaagacagggaccauuaauuguggaacaaaauccagcuuccgcagaggcggccauaccugggugucugggaagccuauccugugcccgauuaugcacuguaacaaagaguuugacaauggacaccuccugcuuggccaucugaagcgguucgaccacucccccugcgauccuacgaucacccuccaugggcccuuuuucagcucuuuugcuugugucgugugcuauaagaaauucguuacacagcagcaauaccgcgaccaccuguuugauaaggaagccaccgacgauggacacaacaauaaccuucugccucagauuauccaguguuucgcgugccccaauuguuuucuccuguucuccagaaaagaggaaugcagcaagcauaugucuggcaaaaaccacuuccaucaguccuuuaagcugggggacaauaaaggaauugcccacccgaucagcuucccuuccuuugcuaagaagcuccugaucucucuuuguaaagaugugcccuuccaagucaagugcguggccugccauaaaacacugcggagccacauggagcucaccgcucacuuucgcgugcauuguagaaacgccggcccugucgcgguugccgaaaaguccauuacacagguggcugagaaauucauccugcggggcuauugccccgacuguaaucagguguuugucgaugagacgagcacccaaaaccacaagcagaauagcgggcauaaggugcgcguuauuaacuccguggaagagagcguccuucuguacugccacucuagcgaaggaaacaaagaccccuccucugaucuccaucugcugcucgaccagagcaaguucuccagccugaaaagaacaaugucuaucaaggaguccagcucucuugaauguauugccaucccuaaaaagaagaugaaucugaaagacaagucccacgagggcguggcuugcguucagaaagagaagucuguggucaaaaccugguuuugugaaugcaaccaacgguucccguccgaggaugccguggaaaagcacgucuuuucugccaauaccaugggguauaagugugugguuugcggaaaagugugugacgauagcggcgucaucagacuccauaugucccgcauucacgggggagcucaucugaacaauuuccuguuuuggugccggacaugcaagaaagagcugacgagaaaggacaccaucauggcgcacgugacagaguuccacaacggccaucgcuacuucuacgaaauggaugagguugaaggcgagacccuccccucuagcuccacaacccuggacaaucugacggccaacaaaccuagcucugcuauuacagugaucgaucacucccccgccaauagcucuccucgggggaaguggcaguguagaauuugcgaagacauguuugauucccaggaguaugucaaacagcauuguaugagccucgccucucacaaguuccaucgcuacagcugcgcucacugucggaagcccuuucacaaaaucgagacccuguauagacauugccaagacgaacacgauaacgagaucaagauuaaauacuucuguggacuuugcgaccugaucuuuaauguggaagaggccuuccucucccauuaugaggagcaccacagcauugauuacguguuuguuucugagaagaccgaaacauccaucaaaaccgaggacgacuucccggucauugaaacaagcaaccagcugacguguggcugccgcgaguccuauaucuguaaggugaaucggaaggaagauuacucuagaugccugcagauuaugcuugacaaagggaagcucugguuucgcugcagccuguguuccgcgaccgcucagaaccugacagauaugaauacccauauccaccaagugcauaaagagaagucugacgaggaggagcagcaguacgucaucaaaugcggaacauguaccaaggccuuccacgauccugaaagcgcccagcaacauuuucaccggaagcacugcuuccuccagaaacccuccguggcucauuuuggcucugaaaagagcaaccuguauaaauucacggccuccgcuagccacaccgagagaaaacuuaagcaggccauuaacuacucuaagucccuggacauggaaaaggggguugagaaugaucucagcuaucaaaacaucgaagaggaaauuguggagcugccugaccuggauuaccuucggacaaugacccauaucgucuucguggacuuugauaauuggucuaacuucuuuggccaccuccccggacaccugaaucagggcacauucauuuggggguuucagggaggcaacaccaauuggaaaccuccccugaacuguaagaucuauaauuaccucaaccgcaucgggugcuucuuucugcauccgagauguuccaaacggaaggacgcggccgauuucgcuauuugcaugcacgccggaagacuugacgagcagcugccuaaacaaauccccuuuacgauucucagcggcgaccagggguuccuggaacuggagaaucaguuuaagaaaacacagcgccccgcucauauccuuaacccucaccaucucgaaggcgauaugaugugugcccugcuuaauucuauuuccgacaccacaaaggagugcgauagcgacgauaacaugggagcgaagaauaccuccaucggcgaagaguucaucagcaccgaggacguugaacucgaggaagccauucggagaucucuggaggaaauguga

SEQ ID NO: 78232 - RNA, 2049 nt, Artificial Sequence
  derived and/or modified sequence opt5 from ZNF45__Homo_sapiens__NP_003416
augaccaagagcaaagaggccgugacauucaaggacgucgcuguuguguuuuccgaagaggaacugcagcuccuggaucuugcccaaagaaaacuguaccgggacgugaugcucgagaacuuccgcaaugucgugucuguuggccaccagagcacgcccgaugggcugccucagcuugaaagagaggagaagcuguggaugaugaaaauggcgacccagcgggacaacuccucuggagcuaagaaucucaaggaaauggagacacugcaagaagugggccugcgcuaucucccgcaugaggagcuguuuugcagccagaucuggcagcagauuaccagagaacuuaucaaauaccaagauuccgucgugaacauucagcggacagggugucagcuggagaagcgcgacgaucuccacuauaaagacgaaggauucucuaaucagagcucccaucugcaaguucacagagugcauaccggcgagaagcccuacaaaggggaacacugcgucaagagcuuuucuugguccagccaccuucagaucaaccagcgggcccaugccggagagaagccuuauaaaugugagaagugcgauaaugcuuuccgcagauuuucuucccugcaagcccaccagcgggugcauagccgcgcuaaaucuuacacaaacgacgccuccuaucggagcuucucccagagaucucaccucccccaccaucagcgcgugccuaccggcgaaaaucccuacaaguacgaggaauguggcagaaacgucgggaaaagcucccacugccaagcgccucugauuguucauacgggagagaagccguauaaaugugaagagugcggcgugggguuuagccagcggucuuaccuccaggugcaccugaagguccauaccggaaagaaacccuauaagugugaggaaugcggcaaauccuucagcuggagaucucgccugcaggcccacgagcggauccacacaggggaaaagccuuacaaauguaaugcuugcggaaagagcuuuuccuauucuagccaucuuaacauccacugccgcauucauaccggcgagaagcccuacaaaugugaagagugcggcaagggguucuccgugggaagccaucugcaagcccaccagaucucucacacaggcgagaaaccuuauaagugugaagagugcgggaaaggauuuuguagagcuuccaaucuccuggaucaccagcggggccauaccggggaaaagcccuaccagugcgacgccuguggaaagggcuucagcagaucuuccgauuucaacauucacuuucgcguucauacgggcgagaaaccguacaagugcgaggaaugugggaaaggauucagccaagcguccaaucuucuggcccaccagcggggccacacaggggagaagccuuauaaaugcggaaccuguggcaagggguuuucuagaagcuccgaccucaacgugcauugccgcauccacacaggcgaaaagcccuacaaaugcgagcgguguggaaaggcuuucucucaguuuagcucccugcagguccaucaaagagugcacaccggcgaaaaaccuuaucagugcgccgagugugggaagggauucagcguuggcucucagcugcaagcucaucagcgcugccacaccggggagaaacccuaccagugugaagagugcggaaagggcuuuugucgggccuccaacuuccucgcccacagaggggugcauacaggcgaaaaacccuaucggugcgacgucuguggaaagcgcuuuagacagcggagcuaccugcaagcucaccagagagugcauacgggcgagcgcccuuauaagugcgaagagugugggaaagucuucucuugguccagcuaccuucaggcgcaccagcgggugcacaccggagagaagccguacaaaugcgaagagugcggcaagggguuuucuuggagcuccagccugauuauccaucaaagaguucacgccgaugacgaaggagauaaagacuuccccucuuccgaggauagccaucgcaagacaagauga

SEQ ID NO: 78233 - RNA, 7521 nt, Artificial Sequence
  derived and/or modified sequence opt5 from ZNF462__Homo_sapiens__NP_067047
auggaagugcugcagugcgacggcugugauuucagagcccccuccuacgaagaccucaaggcucacauccaagauguccacaccgccuuucugcaaccuacagacguugccgaggauaacgugaaugaacuucggugcggguccgugaacgcuucuaaucagacggaggucgaguucuccuccauuaaagacgaguuugccaucgccgaggaucugucuggacagaacgcuaccagccucggcacagggggauauuacggccacucccccggguauuacggacaacauauugccgcuaaucccaagccuaccaacaaauucuuucaguguaaguucugcgugcgcuauuuuagaucuaaaaaucugcuuaucgaacacacacggaagguucauggcgcccaggcggagggcagcuccagcgggcccccugugcccggaucucugaacuacaauauuaugaugcacgaaggcuucgggaaggucuuuuccugucaguucugcaccuauaaaagcccucgcagagcccggaucaucaagcaccagaagauguaccauaagaacaaucucaaagagacaaccgcucccccucccgcccccgcuccuaugcccgacccggugguuccucccgugucucugcaggauccuuguaaggagcugcccgccgaagucguggagcgcuccauucucgaaagcauggugaagccccugacgaaaucuagaggaaacuuuugcugugaguggugcuccuaccagaccccucggcgcgaaagauggugugaccacaugaugaagaaacaucggagcauggucaagauccuuuccucucugcgccagcaacaggagggcacaaaucucccggauguucccaacaaaagcgcgccuucccccaccagcaauucuacauaucugaccaugaacgccgcuuccagagagauuccuaacacgacagugagcaauuuccgggggucuaugggaaacagcaucaugcgccccaauuccucugccagcaaguuuuccccgaugagcuacccucagaugaaacccaagucuccucacaacuccggccuugugaaucugaccgaaagaagccgguauggcaugacagacaugaccaacucuuccgcugaucucgagaccaauagcaugcugaacgacuccucuagcgacgaagaacugaaugaaauugauuccgagaacgggcucucugccauggaccaccaaacaagcggacuguccgccgagcagcuuaugggcagcgaugggaauaagcugcucgaaacgaaaggaauccccuucagacgcuucaugaaccgguuucagugcccuuucugccccuuucugaccaugcauagacgcucuauuucccggcacaucgagaauauccaucuuagcggcaagacagcugucuacaaaugugacgaaugcccguucaccuguaagucuucccugaaacucggggcgcacaagcagugccauacaggaaccacgagcgauugggacgccgugaacucucaaagcgaguccauuagcagcucccugaaugaaggcguugugagcuaugaguccucuagcaucaacggcagaaaguccggggucaugcuggauccucuccagcagcagcaaccuccccagcccccgcccccucccccucccccucccccgucucagccucagccccugcaacagccucagcccccgcagcuucaaccuccccaccaggugccuccccagccccaaacacagccuccgcccacccagcagccucaacccccuacccaggcugcgccccugcacccuuacaaauguacaaugugcaacuauagcaccacaacgcucaagggacugcgcguucaucagcagcacaaacauuccuuuugugacaaucuuccgaaguucgagggccaacccucuagccugccucucgaaaacgagaccgauucccaccccuccucuuccaauacagugaaaaagagccagaccucuauucuggggcuguccagcaagaacaauuuugucgccaaggcuucucggaagcucgccaacgacuucccucuggaucuuucccccgugaaaaagagaacacgcaucgacgaaauugcgagcaaucugcaguccaaaaucaaccagaccaagcaacaggaggacgcugucaucaauguggaggaugacgaagaggaagaggaagauaacgagguugagauugaaguggagcucgaccgggaagaggaaccgacggagccuaucauugagguccccaccagcuuuucugcccagcaaaucugggugagagauacaagcgaaccccagaaggagccuaauuuccgcaacauuacccacgacuacaaugccacaaacggagcugaaaucgagcugacccuguccgaagaugaggaggacuacuauggcucuagcacgaaucuuaaagaucaucagguuuccaacacagcccuccugaacacccagacacccaucuacgggaccgaacacaauucugagaacaccgacuuuggcgauagcggacggcuguauuacugcaagcauugugacuucaauaacaaauccgcuagaucugugagcacacacuaucaacggaugcauccuuacauuaaguuuuccuuccgcuauauccucgauccgaaugaccacagcgccgucuacagaugccuggaauguuacauugacuauacgaacuucgaggaucuucagcagcacuacggcgagcaucaccccgaagcgaugaaugugcugaacuuugaccauucugaucucaucuaucggugcagauucugcuccuacaccagcccuaaugugcgcucucugaugccccacuaucagcggaugcauccuacaguuaaaauuaacaaugccaugaucuuuuccagcuacgucguggagcaacaggaagggcugaacaccgagucccagacacuuagagaaauucucaauucugcucccaagaacauggccaccagcacgccgguggcucgcggaggcgggcugccugccacauucaauaaaaacacccccaagaccuuuacaccugagugugagaaccagaaggacccccuggucaauaccgugguuguguaugauugcgacgucuguuccuucgcgagcccuaacaugcacucugugcucguucacuaccagaagaaacaucccgaagagaaagccuccuacuuuagaauccagaaaacaaugcggauggugagcgucgaucgcggaucugcucugagccagcuuuccuucgaagugggcgccccgaugucuccuaaaaugagcaauauggggagcccgcccccuccgcagcccccucccccugaccugucuacggagcucuauuacugcaagcacuguagcuauuccaacagaagcguugugggcguccuggugcauuaccaaaagcggcaccccgaaaucaaagugaccgcuaaguauauucgccaggccccuccgacagccgcuaugaugagaggagucgagggcccccaggggucuccucggcccccugcgcccauccaacagcugaaucgcuccagcuccgagagagauggaccgccuguugaaaacgagauguuuuucugccagcacugugacuacggcaaucggaccgugaaaggggugcuuauucauuaucagaagaaacaccgcgauuuuaaggccaacgcugacgucaucagacaacauacagccaccauucggucucucugcgauagaaaucagaagaaacccgccagcugugugcugguuucccccucuaaccuggaacgcgacaagacgaaacuccgggcucugaagugcagacaguguagcuacaccuccccuuacuucuaugcccuucgcaaacacaucaagaaggaccaucccgcgcugaaagcuacagugaccagcaucaugcggugggccuuucucgauggacugauugaggccggcuaccacugcgaauggugcaucuauucucacacagagccuaaugggcugcuucuccauuaccagagacgccacccggagcauuaugucgacuacaccuauauggcuacaaagcugugggccggccccgauccuucucccccuagccugaccaugcccgcggaagcuaaaacguaccgguguagagacugcguguucgaggccguuucuauuugggauaucacaaaccacuaccaagccuuccacccgugggcuaugaauggagacgaauccgugcuccuggauauuaucaaggagaaagacgccgucgagaagccuauccuuagcucugaagaacuggcuggccccgugaacugugaaaauagcauuccuacccccuuuccugagcaggaagccgagugccccgaggaugcgcgccucuccccggaaaaaucucugcagcuggccagcgcuaacccugccaucuccagcacccccuaucaguguacaguuugccaauccgaguacaauaaccuucaugggcugcucacccacuauggaaagaagcaucccggcaugaaagugaaggcugccgacuucgcccaggauauugacaucaacccuggggcugucuacaaaugucggcacugcccguauauuaauacgagaauccauggagugcugacacacuaccagaagcggcaccccucuaucaaagugaccgcggaagacuuuguccaugauguugagcaaagcgccgacauuucccagaacgauguggaagagacaucucgcaucuucaagcagggcuauggggcuuacagauguaagcucugcccuuacacccacggcacacuggagaaacuuaagauucauuaugaaaaauaccacaaucagcccgaguuugacguguucagccaauccccucccaagcugccugucccccucgaaccggagaugaccacggaagugucuccuagccagguuuccaucaccgaggaggaagugggagaggaacccgucagcacaucucacuuuuccaccagccaucuggugucucacacaguuuuccggugucagcugugcaaauauuuuugcuccacccgcaagggcauugccagacauuaccggaucaagcacaacaaugugagagcccagccugaggggaaaaacaaucuuuucaagugugcucugugcgccuauacgaaccccauucgcaaaggacucgcggcucauuaccaaaagcggcacgauaucgacgccuauuacacacacugucuggccgcuagcagaaccaucucugauaaaccgaauaaggucauuaucccuagcccgcccaaggacgauagcccucagcucuccgaggaacugcgccgggccguggagaaaaagaaaugcagccuuuguucuuuucagagcuucuccaagaaaggcauugucucucauuacaugaagagacaccccgggguguucccuaagaaacagcaugcgagcaagcugggaggcuauuuuacagcuguuuacgccgacgaacacgagaaaccgacccucauggaagaggaggaacgcggcaacuucgagaaggccgaaguggagggggaagcucaagagaucgaguggcugcccuuucggugcauuaaauguuucaagcuguccuuuucuaccgccgaacuucugugcaugcauuauacagaucaccacagcagagaccucaaacgcgauuucaucauccugggaaauggcccuagacuccagaacuccacguaccaguguaagcauugcgacucuaagcugcagagcaccgcugagcuuacaucccaccugaauauucauaacgaagaguuucaaaaacgggccaagcgccaggaaagacggaaacagcugcucagcaagcaaaaauaugcggacggggccuucgcugauuuuaagcaggagcgccccuucggacaccuggaggaagucccuaagaucaaagagagaaaggugguuggcuacaaauguaaguuuugcguggaaguccaccccacccuucgggccauuugcaaucaucugagaaaacacgugcaguaugggaacgugccugcuguuucugccgccgucaagggacuccgcucccaugagcggagccaccuggcucucgcgauguucacaagagaggacaaguacucuugucaguacugcuccuuugugagcgccuuccgccauaaccuggaucggcacaugcaaacccaccauggccaccauaaaccguucagauguaaacuuugcuccuuuaaaucuagcuauaauucccggcugaagacgcacauccugaaagcucacgccggcgaacaugccuacaaguguagcuggugcucuuucuccacaaugaccauuagccagcucaaggagcacucucugaaagugcaugggaaggcucuuacccugccccgcccuagaaucgucagccuccuguccucucacagccaucacuccucucagaaagccacacccgcggaagagguggaagacagcaacgauuccagcuauucugagccucccgacguucagcaacagcucaaucacuaccaguccgcugcccuggcccggaacaauagccgcguguccccggucccucuuucuggagcugccgcgggcaccgagcagaagacagaagccgugcugcauugugaguuuugcgaguucagcuccggguauauccaaucuauuagacggcacuaccgcgauaaacauggaggcaagaaacuguuuaaguguaaggacugcagcuucuauacgggguuuaaauccgcuuucaccaugcacguugaggccggacauagcgcugugcccgaagagggccccaaggaucucagauguccucugugccuuuaccacacaaaauacaagcggaacaugaucgaccacauuguccugcaucgcgaggaaagagugguucccaucgaggugugccggucuaaacucuccaaguaucugcagggcgucguguuuagaugugauaagugcaccuucacauguagcucugacgaaucccuccagcaacacauugagaaacauaaugaacugaagccuuacaaaugccagcuuuguuauuacgagaccaagcacacggaggaacuggauagccaucugcgcgacgagcauaaagugucucggaacuuugaacucgucgggagaguuaaucuggaccagcuugagcagaugaaggagaagauggaauccagcucuagcgaugacgaggauaaagaagaggaaaugaacuccaaggccgaggaccgcgagcugaugcgguucagcgaucacggagcugcccucaauaccgagaaaagauuuccgugcgaguucuguggccgcgcguucucccaagggucugaaugggagcggcaugugcugagacacggaauggcccugaacgacacaaagcaagugagccgcgaagagauccaucccaaagagauuauggaaaauuccgucaagaugccuucuaucgaggaaaaggaggaugacgaagcuaucggcauugauuuuagccucaaaaacgagaccguggccaucugcguugugacagcugacaagucccuucuggagaaugccgaagccaaaaaggaguga

SEQ ID NO: 78234 - RNA, 11778 nt, Artificial Sequence
  derived and/or modified sequence opt5 from ZNF469__Homo_sapiens__NP_001120936
augcccggcgagcggccuagaggggccccgcccccuaccaugacaggagaccugcagccccgccaaguggcuagcuccccuggccaccccucucagccuccgcucgaagauaacacgcccgccacccggaccaccaagggggcccgggaggcuggaggccaggcccaggccauggaacugccugaggcucagccccgccaggcccgcgacggggaacuuaaaccucccucccugcggggacaggcuccguccucuacaccuggcaagcgcggcuccccgcagaccccucccgggagaagcccccugcaagccccuucucggcuggccggacgcgccgagggcuccccgccccagagauacauccuugggauugcuuccucccggacaaaaccuacccuggaugagacgcccgaaaauccucagcucgaggccgcucagcugcccgaagucgacaccccgcaaggaccuggcacaggggcgccccugcgcccuggacuccccagaaccgaggcccagccugccgcugaggaacugggcuuccaucggugcuuucaggagcccccgucuuccuucacauccaccaacuauacgucuccuuccgccacacccagacccccugcuccgggacccccucaauccagagggaccucuccccuucagccuggauccuaccccgaauaucaggccagcggcgccgauuccuggccucccgcugccgaaaauucuuuuccgggggccaacuucggaguuccucccgcugaaccugagcccaucccgaagggcagccggccugggggaucccccagaggcgugagcuuucaguucccuuuucccgcccugcacggcgccucuacaaaacccuucccugcugacguggccgggcaugcguuuaccaauggaccgcucgucuucgcuuuucaccaaccccagggcgccuggccugaggaagccguggggaccggacccgcuuacccucugcccacacagccugccccgagcccccuuccuuguuaucagggccaacccgggggccugaaccgccauagcgaucucucuggagcucugagcuccccuggcgccgcgcacucugcgccccggccguucagcgacucccugcacaagagccucacgaagauucugccugagagaccgcccucugcucaggaugggcuuggauccacccgcggcccucccagcucucugccucagcggcauuuuccggggcaggccuacagagcuuccggaguugacacaagccccggcccucccgauaccgaacucgccgccccugggcccccgccugcccgccugccccaacuuugggacccuacagcugcccccuauccuacaccucccggcggaccccuggcugccacgcgguccauguucuucaauggccagcccucucccgggcagagacucugccugccucagagcgccccgcugcccuggccucaagugcuccccacagcucgcccuagcccccacggaauggagaugcugucucggcuuccuuuuccggcgggcgggcccgaauggcagggaggcagccagggggcccugggcaccgcuggaaaaaccccuggccccagagagaagcucccugccguccgcuccagccaagggggaucucccgcccuguucacauacaacggcaugaccgauccgggggcucagccucucuucuuuggaguggcccagccccagguuagcccccacggcacaccuagccugcccccuccgcggguggucggggcgucucccuccgagagcccucuccccucuccugcuacgaauaccgccggcagcacauguuccagccugucucccauguccagcuccccggccaacccuucuagcgaagagucccaacugcccggaccucucggccccucugccuuuuuccacccucccacccacccgcaggaaacagggagcccuuuucccucccccgagccuccgcauucucugcccacccacuaccagccugaacccgcuaaagcguucccuuuucccgcugacggacuuggcgccgagggggccuuccagugccuggaggaaacgccuuuuccccaugagggaccggaagugggcagaggcgggcuccaaggauucccucgggcucccccucccuauccgacccaccauuuuagccuguccagcgccucucuggaccagcuugaugugcuccugacaugucgccagugcgacagaaauuacuccagccuggcugccuuccucgcgcaccggcaguucuguggccugcuucuggccagagcuaaggaugggcaccaacgcucuccuggaccgcccggccucccuucucccccugccgcuccgcggguccccgccgacgcccaugcugggcugcugagccacgcgaaaaccuuucuucucgccggagaugcucaggccgagggcaaggacgauccucugagaacaggcuuccugcccagccucgccgcuaccccuuuuccccugccugccuccgaccuugauauggaggacgaugcgaagcuggacagccucaucacggaagcucugaacgggauggaguaucaguccgacaauccggaaauugauagcucuuucaucgacguuuuugccgaugaggaacccagcggaccucgcggccccuccucugggcauccucugaaaagcaaggccggagugacacccgaguccaaagcuccgccuccccuucccgccgcgaccccugacccccaaacaccuagaccgggcgaucgggggugccccgcucgcggaagaccuaagacccggucucucggccuggcccccaccgaggccgacgcuccuagccagggccgccagcagagacgggggaaacaacugaaacuuuuccgcaaggaucuggacuccggaggcgccgcugaagggucuggaagcggcgggggaggcagagccuccggccuucggccccgcagaaacgaugggcugggagagcggccgccucccagaccucgccggcccagaacacaggcgccgggcagccgcgccgacccugcuccccgggugcccagagccgcugcccucccugaagagacgagaucuucccggagacgccggcugcccccuagaaaggauccgcggaagcgcaaagccagagggggagcuuggggcaaggaacugauccuuaaaauuguccagcagaagaaucggcuccgcgaguacgacuuugcgagcgagucugaagaggaugaacaacccccucccagagggccuggauuccggggcagacgcggcagaggggagaaacggaaggaaguggagcugacccagggaccccgcgaggacgaaccucagaagccgcggaaagccgcuagacaggaggccggcggggacggagcccccgcuaacccugaggaacccggcgggucccgcccuggacccggccggagcccgcaagccagaggcccuucccgcucucuggagacaggggcggcugccagagaaggaggccccaagugugccgaucggcccagcguugcuccuaaagacccccuccaggugccuaccaacacagagaccuccgaagagacgcgcccgagccuggauuuuccccaggaagccaaggagccugagacagcggaagagucugcccccgacuccaccgaguucaccgaggcucuuagaagcccucccgccgcuugcgccggggaaaugggagcuucuccgggccugcucaucccugagcagcccccucccagccggcacgauacagggaccccuaaacccuccggaucucuggccaauacagcgccgcacggcagcucccccacgccuggcgucgggucucugcuuggaggccccgggggaacccaagccccugugagccauaacuccaaggacccgcccgcucgccagccuggcgaguuucuggcccccguugcuaauccuagcucuacagccugucccaagccuuccgugcucagcuccaaaauuucuagcuucgggugcgaucccgccggcuuuaacagagacccgcugggagucccuguggcuaagaaaggcccccagccuuauuccucuccccacagcgaacucuuccuggggccgaaggaucuugcgggaugcuuccuggaggaacuccauccuaaacccuccgcccgggacgcucccccugccuccucuuccugucugugccaagauggcgaggacgccgggagccuggaaccccagcuuccuagaucuccgcccggaaccgcugagacagagccuggccgcgccgcgucucccccuacccuggaaagcagcagccucuuucccgaucugccggucgaccgguucgacccuccccucuacgggucccugucugccaauagagauagcggccuuccuuuugcuugugccgaucccccucagaagacggugcccuccgauccgcccuauccuagcuuccugcuccuggaggaaguuucccccaugcugccuucucacuuucccgaccuuagcggaggcaaggugcuguccaaaaccugcccuccggagcgcacagucgugcccggggcugccccuucucuccccggaaagggcagcggguguuccguugcgcugaugucucaucucagcgaggaugaacuggagauccagaaacuugugaccgaacuggagucccaacugcagcggagcaaggacacaagaggagccccucgggaacucgcugaggccgagucugucggccgcguggaacuggggaccggcacagagcccccgucccagagacggaccugccaggcuacggugccucacgaagauacauucagcgccgcugaccuuacccgcguuggagagucuaccgcccacagagaaggcgcggaguccgccgucgcuacaguggaggccgugcaagggcggcccggaggcaccuggccuugucccgcuagcuuucauccggggcacgccgcccugcucccuugcgcgcaggaagaucuggucucuggagcucccuucagcccccgcggcgccaacuuucauuuccagccugugcagaaagcuggcgccagcaagacggggcucugucaagccgagggagacuccagacccccucaggauguuugccugccggaacccagcaaacagccuggcccccaacuugacgcugggucucuggccaaguguagcccugaccaggagcuguccuuucccaagaauaaagaagcggccucuagccaggaguccgaggauucucuccggcugcuuccuugcgaacagcgcggaggcuuccugccggagcccgggacagcugaccaaccucacagaggagcccccgcuccugaagccuucggcagccccgcggugcaucucgccccggaucuggcuuuucagggcgacggggcgcccccucucgaugcuaccuggcccuucggagccuccccuucucacgcugcccagggccacagcgcggggcgggccggaggccaucugcaccccacagcugggagaccuggauuugagggcaacgaguucgccccggcuggcgccuccagccuuaccgcgccccgcgggcgggaagcguggcuggucccugugcccucuccugcuugcguuuccaauacacaucccagcagacgcucucaggacccggcccuguccccucccauucggcaacuccagcugccuggacccggcguggccaagagcaaagaugggauccuuggacugcaggagcucaccccugcugcccaguccccucccagagucaaccccucuggccuggaagggggaacgguggagggcggcaagguugcuugugggcccgcccaaggaagccccggcggggugcaggucaccacacucccugcgguggccggacaccagcugggccuugaagcugacgggcacuggggacugcugggccaggccgagaaaacccaaggccaggggacagcuaaucagcuccaacccgagaacggaguguccccgggcgggaccgauaaucaugccagcgucaacgcgucuccuaagacggcccugacaggacccaccgaaggcgcuguucuucuggagaagugcaaagggucccgcgccgcuaugagccuccaggaagaggccgaaccuacacccucuccucccagcccgaaucgggagucccuggcucuggcccucaccgcggcccacucuagaagcggauccgagggccgcaccccugaacgggcuucuagccccggccuuaacaagccucugcuggccacaggggacucccccgccccgagcgugggagaucucgcugccugugcgcccucuccuacguccgcugcccauaugcccugcagccugggcccucuucccagagaggacccucugaccuccccgucucgcgcccaagggggccucggcgggcagcugcccgcuagcccuuccugucgggaucccccuggaccccagcagcugcucgccugcucuccggcuugggccccucuugaagaggcggacggcgugcaggccacaaccgacacaggcgcugaagauagccccgucgccccucccucccugaccacgagcccuugugaccccaaagaggcucuggccgggugccuccugcagggagagggcucuccgcuugaagaucccuccagcuggccucccgggucuguguccgcgguuacauguacccacagcggagacaccccuaaggauucuacacugcgcauucccgaggacucccgcaaagaaaagcucugggagagcccuggcagagccaccucuccgccccuggcuggggccgugagcccuuccgucgcugugcgggccacaggccugagcuccacgcccaccggagaugaggcccaagcuggccgcgggcucccuggacccgacccgcagucuagaggcgcgccuccccauacaaacccugaucggaugcccagagggcacagcuccuacucuccgagcaauaccgcccggcuuggacaccgcgaaggccaggcuguuacagccgugcccaccgagccucccacgcugcagggggccggcccugacucccccgcuugccuggaaggagagaugggcaccucuagcaaggaaccugaggauccggggacacccgagaccggaagauccggcgccacaaaaaugccucgggucaccugucccagcacagggcucggacugggccgcacgaccgcgccuucuuccacagcuagcgacuuucaaucugauagcccccagagccauagaaacgccucucaccagaccccucaaggggacccgcuuggcccccaggaccugaagcagcggucccgcggauacaaaaagaaaccugccagcaccgaaaauggccaguggaaggggcaagcuccccauggaccugugacaugcgagguuugcgccgcuucuuucagauccggccccgggcucagccggcacaaggcccgcaaacacagaccgcaucccggagcgccugccgaacccagcccugcugcccugcccgcucagcagccucuggagccgcucgcccagaagugucaacccccucggaaaaagucccaccgcgugucuggcaaagaaagacccaaccauagccgcggggacccuucccacgucacgcagcccccgccugcgcagggcucuaaggaggugcuucgggcccccggaagcccucauucccagcaacugcaucccccuucucccaccgagcacgaaguggacgucaaaacaccggcuagcaagcccagaccugaucaggcccgggaggacgaacugcaucccaagcaggcugagaaaagagaaggccgccgguggagacgcgagccuaccguugauucccccagccacucugaggggaaguccaauaaaaagcggggaaaacucagaggccgccggcugagagaagagagcauccuuccggugucugccgacgugaucuccgaugggcgcggaagccggccuucccccgccauggcuucuuaugcggccagcccuucccauugccugucugucgaaggcggccccgaggcugacggggagcaaccucccagacucgccacacugggaccgggcgugauggaaggggccgcugagaccgaucaggaagcccugugugcgggagagacgggcgcucagaagccucccggggaccgcaugcucugcccuggacggauggauggcgccgcccuuggcgaacagcccacagggcaaaagggagcuagcgccagaggcuuuugggggccgcgggagaccaaagcucugggaguuuguaaggaguccggcagcgaacccgccgaggacucuuccagagcgcacagccgcucugaagagggggugugggaagagaacaccccuccccugggaccucucggcuuccccgagacaagcuccucuccugccgacagcaccacauccagcugccugcagggccuuccggauaaucccgacacccaagggggaguccagggcccugaagggcccacgccugaugcuucuggauccagcgccaaagacccucccucccuguuugaugacgaggugucuuucagccaacucuuuccucccggcgggcggcugacaagaaagcgcaacccccacguuuacggaaaaagaugugaaaagcccgugcugccucuccccacccagccguccuucgaggaaggcggcgaucccacacuugggccugcucggcugcccaccgaccugucugauagcuccucucucugccugugucaugaggacccuugggaggaugaagaccccgccggacuuccugagagcuuucugcucgauggcuuccucaauucccgcgucccggggauugaccccugggcgccuggacugagccucugggcccuugaacccucuagagaggcuggcgccgagaagcugccuucccacugccccgaagacgaucggccggaggcuaucccugaacugcauauggugcccgccgccuggcgcgggcucgagaugccugcucccgcggacgauuccucuuccagccugggagacgucucuccggaacccccuagccuugagagagagcggugugauggcggccugcccgggaacacgcaccuccugccucugcgcgccaccgacuucgaagugcucuccacaaaauuugagaugcaggaucuuugcuuccugggacccuuugaagacccuguuggccugccggggcccagcuuccucgauuuugagggaaccgcuuccucucagggcccucaaagcagacggacagaagaggccgccggggcuggacgcgcccagggcagaggccggcccgcgaaggggcgcagagcuuccuauaaaugcaagguguguuuccagcgguuuagaucucugggagagcuugaccugcauaaacucgcccacaccccugcgcccccuccgacaugcuacaugugugucgaacgccgguucggcagcagagagcugcugcgcgggcaccuccaggaacggcaugcucaauccaaggccggacccugggcuugcggcaugugucuuaaggagguggccgauguuuggauguauaaugaacaccugagagagcaugcggugcgcuuugcccggagagggcaggcucgccggucucugggagaccucccuggcggccuggaggggagcuccgccgucgcucaccuucugaacagcauuaccgaacccgccccuaaacaucacagaggaaagcggucugcgggcaaagccgcugggucccccggagacccguggggccaggagggggaagccaagaaagauagccccggcgagcgcgcuaagccuagagcccggucuacgcccuccaauccugacggagcggccacacccgauagcgcuucugccaccgcucucgccgacgccggcuccccugggccgccccgcaccacaccuagccccucuccugaucccugggcuggaggcgagccgcugcugcaagccaccccugugcacgaagcgugcaaggaccccuccagagauugucaucacugcgggaaacgguucccuaagcccuuuaaacuccagagacaucuggcugugcacagcccucagcgcguuuaccuuuguccccggugcccgagagucuaucccgagcacggagaacugcucgcccaucugggcggggcccacggccuucuggagcgcccugaacuccagcauacaccccuguacgcuugugagcugugcgccacggugaugcggaucauuaagaaauccuucgcgugcagcucuuguaacuacaccuuugcuaagaaagagcaauucgacagacacaugaauaagcaucuccgcggaggcagacagccuuucgccuuuagaggggugcgcagacccggagccccgggccagaaggcucgggcccuggaagggacacuuccuagcaaacgcagacgggucgcuaugcccggauccgccccuggccccggggaggaucgcccucccccgagaggcucuagcccuauccuguccgaaggaucucuccccgcgcugcuucaccugugcagcgagguggccccuuccaccacaaagggcuggcccgaaacccucgagcggccgguugaccccgugacgcacccuaucagagggugugagcugcccagcaaccaucaggaaugcccucccccuucucuguccccguuccccgcugcccucgcugauggacgcggcgacugugcccuggauggggcgcuugagcggccugaaaacgaggccagccccggaucuccuggcccccugcuccaacaggcucugccgcuuggggccucccugccuagacccggcgcucgcggacaggacgccgaaggcaaacgggccccucucgucuuuagcgggaagagacgcgcucccggagcccggggcagaugcgcgccugaccacuuccaggaggaucaucugcugcaaaaagagaaggaagugucuuccagccacaugguuuccgaagggggaccccggggcgcuuuucacaagggcucugccaccaaaccggccgggugucagagcuccagcaaggaccgcucugcugccuccacacccagcaaagcgcucaaguucccugugcaucccagaaaagcugucggaucucuggccccuggcgagcuugcccgggggaccgagaauggaaugaagcccgcuacaccuaaggccaaaccgggccccagcucccaggggucuggaagcccucgccccggcaccaagacgggcgggggaucccaaccucagcccgcuagcggccagcugcagucugagacagccaccacaccggcgaaaccuuccuuucccagcagaucuccugcccccgaacggcucccggcucgcgcccaagcuaaguccugcaccaaagggcccagagaggccggagaacagggcccucacgggagccugggacccaaggagaagggcgaauccucuaccaaacggaagaaaggccaggugccugggcccgcgagaagcgaguccguuggaucuuucggccgcgccccuagcgcuccggauaagcccccucggacacccagaaaacaggccacgccuucccgcgugcuucccaccaagccgaaaccuaacagccaaaauaagccccggccucccccuucugagcagagaaaggcugaacccgggcauacacagcgcaaagaccggcugggaaaggccuuuccgcagggcagaccccuccugcgcccucccaaacgggggaccgccguccacggagcugagccugccgaaccccauacacacagaaccgcggaggcucaauccgaucugcucagccagcuguucggccagcgccuuacgggcuuuaagauuccucugaaaaaggacgccucugaauga

SEQ ID NO: 78235 - RNA, 771 nt, Artificial Sequence
  derived and/or modified sequence opt5 from ZNF483__Homo_sapiens__NP_001007170
augcaggccguggucccccugaacaagaugaccgcuaucagcccugagccgcaaacacucgccuccacggaacagaaugagguucccagaguggugaccucuggcgaacaggaggcgauucugcgggggaacgcugccgacgccgagagcuuccgccagagauuucggugguucugcuacuccgaagucgcuggaccucgcaaagcccuuucucaacugugggagcucuguaaucaguggcugagacccgauauccacacaaaggaacagauucuugagcugcucguguuugaacaguuccugaccauccugccuggcgagauucggaucuggguuaaaagccaacaucccgaguccucugaagagguggucacacucaucgaagaccugacccagaugcuugaggaaaaggauccugugagccaggacuccacaguuagccaggaggagaacucuaaagaagauaagauggugaccgucugcccgaauacggaguccugugaaagcauuacccugaaggacguggcugugaacuuuucucgcggggaguggaaaaagcucgaacccuuccaaaaagagcuguauaaggagguccuucuggaaaaucucagaaaccuggaguuucuggauuucccuguuuccaaacucgaacugaucagccagcuuaaguggguggagcugcccuggcuccuggaagaggugucuaaguccagccggcuugacauucacggagccgucaaaaagaugcagauguuuuccgaggcggaauga

SEQ ID NO: 78236 - RNA, 1590 nt, Artificial Sequence
  derived and/or modified sequence opt5 from ZNF490__Homo_sapiens__NP_065765
augagacggaacagcucccugucuuuccagauggagcgcccccucgaagaacaagugcagagcaagugguccucuagccagggcagaaccgggacaggaggcuccgacguccugcagaugcaaaauucugaacaccaugggcagagcaucaaaacgcagaccgauuccauuagccuugaggacguugccgugaacuuuacacuggaagagugggcucuccuggauccuggacagcggaauaucuaccgcgacgugaugagagccaccuucaagaaccuugcgugcauuggcgagaaauggaaggaucaagacaucgaagaugagcacaaaaaucaggggcggaaccugcgcucuccgauggucgaagcucucugugagaauaaggaggacugccccuguggaaaguccacaagccagauuccugaucugaacaccaaucuggaaacacccaccggccucaaaccuugcgacuguucugugugcggcgagguuuuuaugcaucaggugucccugaacagacacaugcggagccauacggaacaaaagcccaaugagugucacgaauauggggagaaaccucacaagugcaaagaguguggaaagaccuucacaagaucuuccagcauccgcacccaugaacggauccacacaggcgagaagccguacgaaugcaaagagugugggaaggccuuugccuuccuguuuuccuuccgcaaccauauuagaauccacaccggagaaacgcccuaugagugcaaagagugcggcaaggcuuuucgguaccugacagcccuccgcagacacgagaaaaaucauaccggggagaagccuuauaaauguaagcagugcggaaaggcuuucauuuacuaucagcccuuucugacacacgaacggacccauaccggcgagaaaccuuacgaauguaagcaaugcggcaaagccuucucuugucccacauaccuuagaagccacgagaagacgcauaccggggagaaaccguuugucugccgcgaauguggacgggcguucuucucccacagcucucugagaaagcacgugaagacacauaccggcguucagccuuauacaugcaaaaaguguggggaggccuuuaaauccagcucuagcugcgaagugcacgagcgcacccauuucggagagaagcccuacgaauguaaacagugcggcaaggcuuuuaacuccucuagcuaucuccagcugcacgagcggguccacacgggggaaaagacauacgagugcaaagaauguggaaaggccuuccuguauuccacccauuuuagaauccacgagcgcacccauacacgggagaaaccuuacgaaugcaagcaauguggcagaguguucauuuauuuuagccaccuccgccggcaugagagaucucacaccggcgugaaacccugcgaauguaagcagugcgggaaggcuuucacaugucuuaauucccuuaaaguccacaagcgcauccauacgggagagcggcccuuucagugcagacaguguggcaaagccuucagcuacucuaagucccugcacguucaugaacggacccacagccgccaaaaaccuuga

SEQ ID NO: 78237 - RNA, 1596 nt, Artificial Sequence
  derived and/or modified sequence opt5 from ZNF492__Homo_sapiens__NP_065906
augcuggagaacuacagaaaucucguguucgucggcaucgccgcuagcaagcccgaccugauuaccugccuugaacaggggaaagagccuuggaacguuaagcggcacgaaaugguggccgagccgcccguggucuguuccuauuuugcgcgcgaucuguggccuaaacaaggaaagaaaaauuacuuccagaaggugauccucagacgguauaagaaaugcggcugugaaaaccugcagcuucgcaaguacugcaaaucuauggacgaguguaagguucauaaagagugcuauaaugggcugaaccagugucucacaacgacccaaaauaagauuuuucagugcgauaaguacgugaaagucuuccacaaguuuagcaacuccaauagacauacaauccggcacaccggcaaaaagucuuucaaauguaaggaaugcgagaaauccuuuuguaugcugagccaucuggcucagcacaagcgcauucacucuggagaaaagcccuauaaaugcaaggagugcgggaaagccuacaacgagacaagcaaucucuccacccauaagagaauccacacaggcaaaaagccuuacaagugugaagagugcggaaaagccuucaaccggcugagccaucuuaccacgcacaagaucauucacaccggcaaaaagcccuauaaaugugaagagugcgggaaggcuuuuaaucagucugccaaccugacaacccauaagcgcauccacacaggagaaaaaccuuacaagugugaggagugcggcagagcuuucucccaaagcucuacccucacggcccauaaaauuauccacgcgggggaaaagccguauaaaugugaggaaugcggaaaggccuuuucccagagcucuacacugaccacacauaagauuauccacaccggcgagaaauucuacaagugugaagagugcgggaaggcuuuuucccagcuuagccaccugaccacacauaaacggauucacuccggagagaaacccuauaagugugaagagugcggcaaagccuucaagcagucuagcacgcucaccacacauaagcgcauccacgcuggcgaaaaauucuacaagugcgagguguguuccaaagccuuuagcagauucucucaccugaccacacauaagcggauccacaccggggaaaaaccuuauaagugcgaggaguguggaaaggcguuuaaucuguccagccaacucacgacacauaaaauuauccacaccggcgaaaagcccuacaaaugcgaggaaugugggaaggccuucaaccagucuagcacccuguccaaacauaagguuauucacacaggagagaagccuuacaaauaugaggaaugcggcaaggcuuuuaaccagucuagccaccuuaccacacauaaaaugauccacacgggggagaagcccuacaaaugugaagagugcggaaaggccuucaauaacuccagcauucugaaucgccauaagaugauccacaccggcgaaaaacucuauaagccggagucuuguaacaaugcuugcgacaacaucgccaaaauuuccaaguacaaaagaaauugugccggcgagaaguga

SEQ ID NO: 78238 - RNA, 1764 nt, Artificial Sequence
  derived and/or modified sequence opt5 from ZNF496__Homo_sapiens__NP_116141
augcccaccgcccugugcccuagagugcucgcuccgaaggagagcgaagaaccccggaaaaugcgcuccccucccggcgaaaacccuucuccccagggggagcugccuagcccggaauccucuagacggcuuuuccgcagauuucgguaccaagaggccgcgggaccccgcgaggcucugcagagacucugggaccuguguggcggguggcuucggccugaacgccacacaaaggagcagauccuggaacuccugguccuggagcaguuccucgccauucugcccagagagauccaaagcuggguucgggcccaggaaccugaguccggagaacaggcuguggccgcuguggaggcccuugaacgcgagcccggcagaccguggcaguggcugaaacauugcgaggauccugucgugauugacgauggggacucuccccucgaucaagaacaggagcagcugccuguugaaccccacagcgaccuugcgaagaaucaggaugcccaacccaucacgcuggcucagugucucggacugccuucccggccgcccagccagcugucuggcgacccugugcuccaagaugccuuucugcuucaggaggaaaacguccgcgacacccaacaggugacaacccugcagcugcccccuuccagaguuagccccuucaaagauaugauucugugcuuuucugaggaggacuggucccuucuggauccggcucagacaggcuucuauggggaauuuaucaucggagaggacuacggcgugagcaugccucccaaugaccucgccgcgcagccugaucugucucagggggaagagaacgaaccccgggucccugagcugcaagaccuccagggaaaggaggugccccagguguccuaucuggauagcccgucccuucagccuuuccaagucgaagagagacgcaagcgggaggagcugcagguucccgaguuucaggccuguccccagaccguggugccucaaaauacauacccggcuggcgggaaccccagaucucucgaaaauagccuggacgaggaagucaccauugagaucgugcuuuccagcucuggagaugaagacucccagcauggcccuuauugcacggaggagcugggcagccccaccgaaaaacagcgcucucucccugccagccaccgguccucuacagaggcugggggagaaguucaaaccagcaagaaauccuacgugugucccaacugcggcaagauuuucagauggcgcgucaauuuuauccggcaucugagaagccgccgggagcaggaaaaaccucacgaguguucugugugcggggagcuguucuccgauagcgaagaccucgauggacaccuggagucucaugaagcccagaagcccuauagauguggcgccugcgggaaguccuuucgccuuaacagccaucugcucucccaccggcggauucaucugcagccggacagacugcaaccuguugagaaacgcgaacaggcugcgucugaggaugccgacaagggacccaaagagccucuugaaaauggcaaggcuaaacucagcuuccagugcugugagugcggcaaggccuuccagagacacgaccaccuggcccggcacagaucccauuuucaccugaaagauaaggcucgccccuuccaaugucgguacugcgugaagucuuuuacacagaacuacgaccuccugagacaugaacgccuucacaugaaaagacggagcaagcaggcccucaauuccuauuga

SEQ ID NO: 78239 - RNA, 816 nt, Artificial Sequence
  derived and/or modified sequence opt5 from ZNF501__Homo_sapiens__NP_659481
augaacagcucccagaucucucugagaaugaagcacggccgggugaauaugcagaaaaagcccagcaaaugcuccgagugugggaaguucuuuacccaacgcucuagccucacacagcaucagcggauucacagaggagaaaaaccuuacgucugcuccgaguguggcucuugcuuccgcaagcaaagcaaccugacgcagcaucuuagaauccacaccggggaaaagccguauaaauguaaugagugcgaaaaggccuuucagacaaaagcuauucugguucagcaucuccggauccacaccggagagaagcccuacaaauguaacgagugcggcaaggccuucugucaauccccuagccugauuaagcaccagcgcauccauacaggggaaaaacccuauaagugcaccgaguguggaaaagcguuuucucaguccaucugccuuacaagacaccagcggagccauucuggcgacaagccuuucaaaugcaaugaauguggcaaggcuuuuaaccaauccgccugccugaugcagcaccagcgcauucacagcggggagaaacccuacaccuguacggagugcggaaaggccuucacccaaaauucuucccucguggaacaugagagaacacacaccggcgaaaagcuguauaaauguagcgagugcgaaaagacauuucggaaacaggcucaucuguccgagcacuaccgcauccauaccggggagaagccuuaugaaugugugggaugcggcaaaucuuucagacacagcuccgcccuccugcggcaccagcgccuucaugcuggggaguga

SEQ ID NO: 78240 - RNA, 2862 nt, Artificial Sequence
  derived and/or modified sequence opt5 from ZNF507__Homo_sapiens__NP_001129628
auggaggaaagcuccucuguggccaugcugguccccgacaucggcgagcaggaagcuauucucaccgccgagagcaucauuuccccuucucuggaaaucgaugagcaaagaaagacaaaaccggacccccuuauucacguuauccagaagcugagcaaaaucguggagaacgaaaagucccagaaaugccuccugauugggaagaagcggccucgcucuagcgcggcuacgcauucccuugagacccaggaacugugugagauccccgccaaagugauucaaagcccugccgcugauacaagacgggccgagaugucucagaccaauuucacacccgacacccucgcucagaacgaaggaaaggccauguccuaccagugcagccuguguaaauuucugucuuccagcuucucuguccucaaggaucacaucaaacaacauggccagcagaaugaggugauucugaugugcuccgaaugucacaucacaagccgcucccaggaggaacuugaggcgcauguugugaacgaccacgauaaugacgccaacauucacacccaaucuaaggcucagcagugcgucagcccuuccagcucucuguguagaaagacgaccgagcggaaugaaacaaucccggauauccccguguccguugacaaccuccaaacccauacagugcagaccgccagcgucgcugagauggggcgcagaaaaugguaugccuacgaacaguauggaauguaccggugccuguuuuguucuuauacgugcggccagcaacgcaugcuuaagacacacgcguggaaacaugccggggagguggauuguagcuacccuauuuucgaaaaugagaacgagccccugggacuccuggacuccucugcugccgcugccccuggcggcguggaugccgucguuaucgcuauuggggaaagcgagcuguccauccacaauggacccagcguccaggugcagauuugcagcuccgaacagcucucuucuuccagcccgcuggagcaauccgcggaaagaggcgugcaccuuucucagagcgugacccuggacccuaacgaggaggaaaugcucgagguuaucuccgacgccgaagagaaucugauccccgauucucuucugacaagcgcucagaagauuaucuccagcucuccuaacaaaaaggggcaugugaaugucauuguggagcggcuccccuccgccgaagagacccugagccagaaacgcuuucugaugaacaccgaaauggaggaaggaaaggaccucucucugacagaggcccaaaucggcagagaggggauggaugacguuuaucgggcugauaagugcacgguggacauuggaggccuuaucaucggcugguccagcucugagaaaaaggaugaacugaugaacaaagggcucgccaccgacgaaaaugcgcccccuggacgcagacggacaaacagcgagucccugagacuucacagccuggcugccgaagcccucgucaccaugccgauucgcgcugccgagcugacacgggcuaaucugggccauuacggggauaucaaccuccuggaccccgauaccucucagagacagguggacuccacgcuugccgcguacagcaagaugauguccccucugaaaaauucuagcgacggacucacaucccugaaccagucuaauagcacccuggucgcccuucccgagggccgccaagaacucuccgauggacaggugaagaccgggauuucuaugagccugcugacaguuaucgagaagcuccgggaaagaaccgaccagaacgcuuccgaugacgauauucugaaagagcuucaagacaaugcccagugucagccuaacagcgauacaucucuguccggcaauaacguggucgaauauauccccaaugcugagcgcccguaccggugcagacucugucacuauacgagcggcaacaagggguacauuaaacagcaucugcgcgugcaccggcaaagacagccuuaucagugccccaucugugagcacaucgccgacaauucuaaggaucuggaaucccauaugauucaccauugcaaaacccgcaucuaccaguguaagcaaugcgaggagagcuuccacuauaagucucagcuucggaaccacgaaagagagcagcauucccucccugacacacugagcauugcgaccuccaacgaaccccggaucagcucugauacagccgacggaaaauguguucaggagggcaauaagagcuccgugcaaaaacaguaccgcugcgaugucugugacuacaccucuacgaccuaugugggggugagaaaccaccggcgcauucauaauagcgacaagccuuacagaugcucccugugcggauauguuuguucucaucccccgagccucaaaucccacauguggaagcacgcuucugaucagaacuacaauuaugaacaagucaacaaggccaucaaugacgcuaucagccaguccggccgggugcuggggaaaagcccuggcaagacacagcuuaaaucuuccgaggaaagcgccgaucccgugaccggaucuuccgagaacgccgucagcuccucugagcugaugagccagacacccuccgaagugcucggcaccaaugagaacgaaaagcugagcccuacgucuaauacauccuacagccuggagaaaauuucuagccuugcuccgcccuccauggaauauugcguucuccuguuuuguugcuguaucugcggguucgagucuaccagcaaggagaaccugcucgaccacaugaaagaacaugagggagaaauugugaauaucauucugaacaaggaucacaauacagcgcuuaacaccaacuga

SEQ ID NO: 78241 - RNA, 2679 nt, Artificial Sequence
  derived and/or modified sequence opt5 from ZNF512B__Homo_sapiens__NP_065764
augaccgaccccuucugcgugggcgggagacggcugccuggaagcuccaagucuggcccggggaaagauggaagccgcaaggaggucagacuccccaugcugcacgacccucccaaaaugggcaugccuguugugcgcgggggacagacagugcccggccaagccccucuuuguuuugauccgggcucccccgcuucugacaagacggaagggaaaaagaagggacggccuaaagccgagaaccaggcgcugagagauaucccccucagccugaugaaugacuggaaggaugaguucaaagcucauucccgggucaagugcccuaacucuggcuguuggcuugaguuucccagcauuuacgggcugaaauaucacuaccagcgcugccagggaggcgccaucuccgacagacucgccuucccguguccuuuuugcgaagcugccuucaccagcaagacacaacuggagaagcaucggauuuggaaucacauggaucgcccccugccugcuucuaaacccgggcccaucuccagaccugugaccauuagccggccgguuggagugucuaagcccaucggcgucuccaaaccugugacaaucggcaagcccguuggggugagcaaaccuauuggaaucucuaagcccgucuccgugggccgcccgaugccugugaccaaagccauucccgucacaagaccuguucccgugaccaagccugugacggucagccggcccaugccggugaccaaggcgaugccuguuacaaaacccaucaccgugacaaaguccguccccgugaccaaaccuguuccggugacgaagcccauuacagucaccaaacucgugacagucaccaagccugugcccguuaccaagccugugacagucucucgccccaucgugguuagcaaaccugugacggucuccagacccauugccaucagccggcauaccccgccuuguaagauggugcugcuuacaagaucugagaacaaagcuccccgcgccaccgggagaaauuccggaaagaaacgggcugccgacagccuggauacaugcccuauucccccgaagcaggcgcgcccugaaaacggcgaguaugggcccucuagcaugggacaguccucugccuuucagcucagcgcugacaccuccagcggcucucuguccccuggcagccggcccucugggggaauggaagcccuuaaggcugccggccccgccuccccuccggaggaggaucccgaaagaacgaaacaccgccggaagcaaaagacaccuaagaaauucaccggggagcagcccagcaucuccggaaccuuuggccugaaggggcucgugaaggcugaagacaaagcgagaguucaccgcucuaagaaacaggagggcccuggacccgaagacgcccggaagaaagucccugcugccccgaucacagugagcaaggaggcccccgcuccuguggcccaucccgcgccuggcgggcccgaggaacaguggcaaagagcuauucacgagcgcggagaagccgucuguccgaccugcaaugugguuacacggaaaacgcuggugggccugaagaagcauauggaggucugucagaaacuccaggaugcccugaagugccaacacugcagaaaacaguucaaguccaaagcugggcuuaacuaccacaccauggccgaacauucugcuaagccuagcgacgccgaggcguccgagggaggcgaacaggaggaacgggagcgccugagaaaggugcucaaacagauggggcggcugagauguccccaagaaggcugcggagccgcuuuuagcucucuuaugggcuaucaguaccaccagcgccggugugggaagcccccuugcgagguugauucccccagcuucccuuguacacauugcggaaaaaccuauagaucuaaggccggccacgacuaccaugugcgcuccgagcacacagcuccgcccccugaagaacccaccgauaaaagcccugaagccgaggacccccugggggucgagagaacgccgucuggacgggugcgcagaaccagcgcgcagguugccguguuucaccuccaagaaaucgcugaggaugaacuggcccgggacuggacaaagcgcagaaugaaggaugaccuggucccugagaccgcucggcucaauuacacacgccccggccugccuacccuuaacccccagcugcucgaagccuggaaaaaugaggugaaggagaaagggcaugugaacuguccuaaugauugcugugaagccauuuauuccagcgucucuggccugaaggcucaccuugcguccugcagcaaaggagcccaucuggcuggcaaguacagaugucuccugugccccaaggaguucuccucugaaagcgggguuaaauaucacauccugaagacgcacgccgagaacugguuccggacauccgccgacccgccucccaaacaucgcucucaggacagccucgugcccaagaaagaaaagaaaaagaaucuggcuggaggcaagaaaagagggcggaagccuaaagagagaaccccggaggaacccguggccaaacuuccuccccgccgggaugacuggccucccggaugcagagauaaaggcgcgcgcggguccacaggccggaaggucggagugucuaaggcuccugagaaauga

SEQ ID NO: 78242 - RNA, 1617 nt, Artificial Sequence
  derived and/or modified sequence opt5 from ZNF512__Homo_sapiens__NP_001258215
augagcuccagacugggcgccgugcccgcuaccucugggccuacaacguucaagcagcaacggagcacccgcaucgucggagccaaaaacagaacacagugcuccauuaaggacaauucuuuucaguacaccaucccgcacgaugacagccucuccggcucuagcuccgcgagcucuugugagcccguuuccgauuucccugcuagcuuucggaaaucuacauauuggaugaagaugcgcagaauuaaacccgccgccaccucccauguggaagggagcggaggcgugucugcuaaggggaagcggaaaccucgccaggaggaagacgaggauuacagagaauuuccccaaaagaaacacaagcuguauggaucccuugaggagcagugguaccuggaaaucgucgacaaaggcagcguguccugcccuacaugucaggccguuggccggaagaccauugaggggcucaagaaacauauggaaaacugcaagcaggagauguuuacgugucaccauugcggaaaacaacugcgcucucuugcuggcaugaaguaucacgugauggccaaucacaacagccugccgauccucaaagcgggggaugagaucgacgaacccuccgagagagaacggcugcgcaccguccugaagagacucggaaaacugcgguguaugcgcgagagcuguucuuccagcuucacaucuauuaugggcuaccuuuaucaugugagaaagugcgggaagggagccgcugaacuggagaaaaugacccucaagugccaccauuguggcaaaccuuaccggagcaaggccggccuggcuuaccaccuuagauccgagcacgggcccaucucuuucuucccugaaagcggacagcccgagugccugaaagaaaugaaucucgaguccaagagcggcgggcgcguucagcggagaucugccaagauugcgguguaucaucugcaggaacuggccuccgcugagcucgccaaagaguggccgaagcgcaaaguccugcaagaucuugugccugacgaucggaagcugaaauacacaagacccggacucccuaccuuuagccaggaagugcugcacaaguggaagacggacaucaaaaaguaucaucgcauucagugccccaaccaaggcugugaggcugucuacucuuccguuagcgggcuuaaagcccaccugggauccugcacacucggcaauuucguggccggcaaguauaaaugucugcugugccagaaggaauuugugucugagagcggggucaaguaccauaucaacuccgugcacgcugaagauugguucguugugaaucccaccacaaccaaaucuuuugagaagcucaugaaaauuaagcagcggcagcaagaggaagagaaaagacgccagcagcaccggagcagacgcucccugcggagacggcagcaaccuggaaucgaacuuccggagaccgagcugagccuccgcgucggcaaggaccagagacggaacaaugaggaacuggugguuucugcguccuguaaagaacccgagcaggaaccugugcccgcccaguuccaaaaggucaagccucccaaaacaaaccauaagagagggcgcaaauga

SEQ ID NO: 78243 - RNA, 1440 nt, Artificial Sequence
  derived and/or modified sequence opt5 from ZNF513__Homo_sapiens__NP_001188388
augggcuucgagagagacagcgaaggggauucccugggagcccggcccggccucccuuacgggcugucugacgaugagagcggaggcgggcgcgcucuuuccgccgaaucugagguggaggaaccggcgagaggacccggcgaggcucggggcgaacgcccugggcccgccugccagcuguguggaggcccuaccggggagggacccugcuguggcgccgggggaccuggcggcgggccgcuccugcccccuagacuucuguauagcugccggcucuguacauuugucucccacuacucuagccaucugaagcgccacaugcaaacgcauuccggagaaaaacccuucagaugcggccgguguccuuaugcuagcgcccagcugguuaaccucacccgccacacaagaacccauacaggggagaagcccuaccggugcccgcacuguccuuuugcuuguucuucccugggaaaucuucgcagacaccagcggacccaugccgggcccccuacaccucccugcccgaccugcggcuuccgcugcuguacgcccagacccgcgcggccucccagcccuaccgagcaggaaggagccgugcccagacgcccggaggacgcucugcuccugccugaucuuucucugcacgugcccccuggcggcgccuccuuucuccccgacugcgggcaacugcggggagaaggcgaggggcuguguggaacaggcagcgaaccucuccccgagcugcuuuucccguggaccugcagaggguguggccaggagcuggaagagggagaaggcucucgccucggggcugccaugugcggacgguguaugagaggcgaggccgggggaggcgcguccgggggcccucagggacccagcgauaaaggcuuugcuugcucccugugucccuucgccacacauuauccuaaccaccuugcucgccacaugaagacccauucuggggaaaaaccguuucggugcgccagaugucccuacgccagcgcucaccuggacaaucucaagcgccaucagcggguccacacgggagagaagccuuauaaaugcccccugugcccuuacgcguguggcaaccuggccaaucucaagagacaugggcgcauccacuccggagauaaacccuuccggugcagccuguguaacuacucuugcaaucaauccaugaaccuuaagagacacaugcugcggcauacaggcgagaaaccuuuucgcugugcuaccugcgccuauacaaccgggcacugggacaauuacaagagacaucagaaggugcacggccacggaggcgccgggggacccggccucagcgcuucugaagggugggccccgccucauagcccucccuccguucugucuagccggggacccccggcgcuuggcaccgcuggguccagagccgugcacacagauagcucuuga

SEQ ID NO: 78244 - RNA, 3492 nt, Artificial Sequence
  derived and/or modified sequence opt5 from ZNF516__Homo_sapiens__NP_055458
auggacagaaaccgggaggccgaaauggagcugcgcagaggccccagcccuacccgggcugggcgcggacacgaaguggauggcgacaaggccacaugccauacguguugcaucugugggaaauccuucccguuucagucuagccucucccaacacaugagaaagcauaccggagagaaacccuacaagugcccuuauugugaucaccgggcgucucagaaaggcaaucugaagauucauauccgcagccacagaacagggacccuuauucagggacacgaacccgaggcuggcgaggccccucugggcgaaaugcgggccuccgaggggcucgacgcuugcgccucucccacaaagagcgcuuccgccuguaaccgccugcuuaauggagcgagccaggccgauggcgcuagaguccugaacggggccucucaagcugacuccggacggguucuccugcgcagcucuaaaaagggcgccgaaggguccgcgugcgccccuggagaggcuaaagccgcugugcaguguagcuucugcaagucucaguuugagcggaaaaaggaucuggaacuccaugugcaccaggcccauaagccguucaaauguagacugugcuccuacgccacccuucgcgaggaaagccugcucucccacaucgagagagaccacauuacagcucaaggccccggcucuggggaagcgugcgucgagaauggaaagccugagcugagccccggcgaauuuccuugugaggugugcgggcaggccuucucccagaccugguuucuuaaagcucauaugaagaaacaccggggcagcuucgaucauggcugucacaucugcgggagacgcuuuaaggaacccugguuccugaaaaaccauaugaaggcccacggaccgaagacgggcucuaaaaaucggccuaaguccgagcucgaccccaucgccaccauuaacaauguugugcaggaagaggucaucguggcuggccugagccuguaugagguuugugccaaaugcgggaaccucuuuacaaaucuggauucucuuaacgcgcacaaugcuauucauagacgcguggaagccagccggaccagagccccugcugaggaaggagccgagggccccuccgacacaaagcaauucuuucugcagugucucaaccugcgccccucugcugccggggauagcugcccuggaacccaggcgggccggagagucgccgaacuugacccggucaauuccuaccaggcuuggcaacuggccacgcgcgggaaaguggcugagcccgccgaguaucucaaguacggcgcgugggacgaagcccuggcuggagaugucgccuucgacaaggaucggagagaguauguucuggugagccaggaaaaacgcaagcgggagcaggacgcuccugccgcccaaggacccccuagaaaacgggcuucugggcccggagauccggcgccugccggccaccucgacccccgcuccgcugccagaccuaaccggagagccgcugccacaaccgggcagggaaagagcucugaguguuucgaaugcggcaaaaucuuucgcacauaccaucagauggugcugcacucccggguccacagacgcgcgagacgggagcgcgauagcgacggggauagagcugcccgggcccgcuguggcucccuuucugaaggagacagcgcuucccagcccucuagcccuggcuccgccugcgcggcugccgauagccccgggucuggacuggccgacgaggcugccgaagacuccggcgaggagggggcuccggaaccugcccccggaggccaacccagacggugcuguuucagcgaggaagugaccucuaccgagcucuccagcggggaucagucucauaagaugggcgacaacgcgagcgaacgcgauacaggagaguccaaggccggcauugcugccagcguuucuauccuggaaaauuccagcagagaaacgucccggcgccaggagcagcacagauuuucuauggaccuuaaaaugccugcuuuccauccgaagcaagaagugcccgucccuggggauggaguggaguuucccagcuccaccggcgccgaagggcagacaggacacccugccgagaaacugucugaccuccauaacaaggagcacagcggcgggggcaaacgggcucuggcgcccgaucugaugccucucgaccuguccgccagaucuacccgcgaugaccccagcaauaaggaaacagcuuccagccuucaggccgcccugguugugcacccgugcccuuacuguucucauaagaccuauuaccccgagguccucuggaugcacaaacggauuuggcauagaguguccugcaacagcgucgcuccucccuggauccagccgaauggauauaagucuauccgcuccaaccugguguuccugagccggucuggcagaacggggccucccccugcccuuggaggcaaagaaugucaaccccuccugcuggcgcgcuuuacacggacccagguucccgggggaaugccuggcuccaagagcggcuccagcccgcucgggguggucaccaaagcugccucuaugcccaagaauaaagagagccacuccggaggcccuugcgcccugugggcucccgggccugauggauacagacagacaaagcccugucauggccaagagccucacggggccgcgacccagggaccgcuugcuaagccccgccaggaagccucuagcaaaccugugcccgccccuggcggcgggggauucucccggucugcuacacccacgccgaccguuauugccagagcuggcgcccagccuagcgcgaacuccaagcccguggagaaauuuggggugcccccugccggagcuggcuucgcccccacaaauaagcacucugcuccugacagccugaaagccaaguuuuccgcccaaccgcaggggcccccucccgcuaagggagaaggcggcgcgccuccccucccgccucgggagcccccuagcaaagccgcucaggaacugcgcacccuggccacaugcgccgcugggucuagaggagaugccgcgcuucaggcucaacccggcguggccggggccccucccgugcuccauuccaucaagcaggagccgguugcugagggacacgaaaaacggcuggacauucugaacaucuucaagaccuauauuccuaaagacuuugccacgcucuaccagggcuggggagucagcgggcccggccuggagcaucgcggcacccuuagaacacaggcgcggcccggggaguucguguguaucgagugcggaaagucuuuccaccaaccuggccaccugagagcccauaugcgcgcucacuccguggucuuugaaagcgaugggccgcggggauccgaggugcauaccacaucugccgacgcucccaagcagggcagagaucacagcaauaccgggacgguucagacagugccucuccgcaaaggaaccuga

SEQ ID NO: 78245 - RNA, 1623 nt, Artificial Sequence
  derived and/or modified sequence opt5 from ZNF519__Homo_sapiens__XP_011523906
auggagcugcucaccuucagagacguggccaucgaauuuagccccgaggaauggaagugccuggauccugcucagcaaaaccuuuaccgggacgucaugcuggagaauuaucgcaaccucguuucccuggccguguacucuuauuacaaucagggcauucuuccggaacaggggauccaggauagcuucaaaaaggcgacacugggaagauauggcuccugugggcucgagaacauuugccuguggaaaaauugggagucuaucggagaaggcgaggggcaaaaggaauguuacaaccugugcagccaguaucucacgaccucccacaauaaacaucugacagugaagggagacaaggaguaccggauuuuucagaaaaagccccaguuccuuucugcugccccuaccgagcccuguaucccuaugaacaaauaccaacacaaguuucugaaaagcgucuucugcaauaagaaccagaucaauuuuaaccaugauuccaauauuagcaagcaccauucuacacacuuccucgaaaacuauuacaauuguaacgagugcgaaaaaguguuuuaucaguccagcaagcugaucuuccccgagaacauucacauccagaaaaagccuuacaauucuaacgaauguggcgagaccuccgacccguuuagcaaacuuacacaacaucagcgcauuuauaucggcgagucuucccagagaugcaauaagaaauguauuaucguuuucagccaaucccaccugaaggggcauaagaucauuaacaccggagaaaaaucugugaaguacaaagagcggggcaaggccuuuacgcgcgggcuccaccugggacaccagaaaauccauaccggcgaaaagcccuauaagugcaaaaagugcgauaaggcuuucaauaaaagcucccaccuggcccagcaucagcggauucacacaggggagaaaccuuucaaguguaaggaaugcggaaaggcuuuuaacagaggcagcuaccucacccaacaucagcgcauccacacaggcgagagagccuucaaaugugaggaaugcgggaaagcguuuaaucggggaucuuaccugacccagcaccagcgcauucauacgggcgagaagcccuucagauguaaagaaugcgggaaggccuuuaaccgguccagcuaugucacacaacaccagcgcaugcauaccggagagaagccuuucaaauguaaggaaugcggcaaggcuuuuaauagagccucucaccuuacacagcaccagcggauccauaccggggagaaacacuucaaauguaaggagugcggaaaggcuuuuaacagaggcagccaucugacccgccaccaacggauccauacaggcgaaaaauccuucaagugugaggaaugcgggaaagccuuuauuuggggaucucaccucacgcagcaccagagagugcauaccggcgagaaguucuuuaaaugcaaggagugugggaaagcguucacacgcagcucccaccugacccagcaucaacggauccacacaggagaaaagcccuucaagugcaaagaguguggcaaggccuuuaauagacgcagcacccuuacgcagcaucagauuauccacacacgguga

SEQ ID NO: 78246 - RNA, 3936 nt, Artificial Sequence
  derived and/or modified sequence opt5 from ZNF521__Homo_sapiens__NP_056276
augagcagacggaagcaggccaaaccccgcucccugaaggacccuaacugcaaacucgaggauaagaccgaagacggcgaggcucuggauuguaaaaagagaccggaagacggggaggaacuugaggaugaggccgugcacucuugcgacagcugucugcaagucuucgaaucccucucugauaucacagagcauaagauuaaucagugccagcugacggacggaguugauguggaagacgaucccaccuguagcuggccugcguccucucccagcuccaaagaccagacaagcccuucucacggcgaggggugcgauuuuggagaggaagagggcgggcccggacuuccuuacccgugucaauucugcgacaaguccuuuagccggcugucuuaucucaaacaucacgaacagucccauagcgacaagcugcccuucaaauguaccuacugcucucgccuguuuaagcacaagagaucccgggaucgccacaucaaacuccauacaggcgacaagaaauaucacuguagcgagugcgaugcugccuucuccagaucugaccaucugaagauucaccuuaaaacccacacaagcaacaagccuuacaaaugcgccaucugucggcgcggcuuucuguccagcagcucccuccaugggcacaugcaagugcaugaaagaaauaaggauggaagccagucuggcagccggauggaggacuggaagaugaaagauacccagaagugcucccagugugaggaaggguucgacuuucccgaggaucugcagaaacacauugcugaaugccauccugaguguucucccaacgaagaccgcgccgcccuucagugcgucuauugucacgagcuguucguggaggaaacgagccucaugaaucacauggagcaaguucauuccggagaaaagaaaaacagcugcucuaucuguuccgagagcuuucacaccguggaggaacuguacucucauauggauucccaccagcagccggagagcugcaaucacuccaacucuccuagccuggucacagugggcuauaccuccguuucuagcacaacccccgacuccaaucucagcguggacucuuccacgauggucgaagcugcgccucccauccccaagagcagagggcggaagcgcgccgcucaacagacaccugauaugaccggaccgucuuccaaacaggccaaggugacauacagcuguauuuacugcaacaaacagcuguucucuagccuugcugugcugcaaauccaucucaagaccaugcaccuggacaaacccgagcaggcccauauuugccaguauugucuugaaguccugccuucccucuacaaucugaacgagcaccugaagcagguucaugaggcgcaagaucccggccucaucgugagcgccaugccugcuauuguguaucagugcaauuuuuguucugaagucgugaacgaccugaauacccuucaggagcacaucagaugcucccacggcuucgccaaccccgcugccaaggauagcaacgccuucuuuuguccgcauugcuacaugggguuccugacagacuccucucucgaggaacacauucggcagguucauugugaucugagcggauccagauuuggcucuccugugcuugggacgcccaaagaaccugucguggagguuuauagcugcuccuacuguaccaauucucccaucuucaacagcgugcugaagcucaauaaacacaucaaggagaaccauaaaaauauuccucuggcucugaacuauauccacaauggaaagaagucccgcgcgcucagcccccugucuccggucgccauugaacaaacaucccuuaaaaugaugcaggcugugggcggggccccugcccggcccaccggagaguacaucugcaaccaguguggcgcuaaguacacaagccuggacucuuuucagacccaccucaaaacgcaucuggauacaguccugcccaaacuuaccugcccucaaugcaauaaggaguucccgaaccaggaaucccuccugaagcacgugaccauucauuuuaugaucacaagcaccuauuacaucugugaaucuugcgacaaacaguucacauccguugaugaccugcaaaagcaccuccuggauaugcacacguuuguguucuuuagauguacccuuugccaggaggucuucgacagcaagguguccauucagcugcaucucgccguuaaacacagcaaugagaagaaaguguaucgcuguacaucuugcaacugggacuuucggaaugaaaccgaucugcagcugcaugucaagcacaaccaucuugagaaucaaggcaaagugcacaaguguaucuucugcggggaaucuuucggaacagagguggaacuccagugucacauuaccacgcauuccaagaaauacaacugcaaguuuuguucuaaagcguuccacgcuaucauucugcuggagaagcaucucagagagaaacacugcguuuuugaaaccaagacacccaacugcggcaccaauggggccagcgagcagguccagaaggaagagguggagcugcaaacacuucugaccaacucccaggaaucucacaauagccaugacggauccgaggaagauguggacacgucugagccuauguauggcugugauaucugcggggccgcuuacacaauggaaacccuccugcagaaccaccagcugcgcgaccauaauauccggcccggcgagagcgccauugucaaaaagaaagcugagcuuaucaagggaaacuauaaauguaaugugugcuccagaacauucuuuagcgaaaacggccuccgcgagcacaugcaaacccaucuggggccuguuaagcacuacaugugucccauuugcggagaacgguucccuucucugcucacccugacagagcacaaggugacgcauuccaaaagccuugauaccggcaauuguagaaucugcaagaugccccugcagucugaagaggaguuucucgaacacugucagaugcauccggaccugcgcaacucccugacaggguuccggugcgucguguguaugcaaaccguuacaagcacccuugagcucaaaauucacggaacguuucacaugcagaagacaggcaauggguccgccgugcagaccaccggcagaggacagcauguccaaaaacuguacaagugcgcgucuugccugaaagaguuccggagcaagcaggaucucgugaagcuggacaucaacggccuuccuuaugggcugugugccggaugcguuaaucucuccaaaagcgcuucucccggcauuaacgugccucccgggacaaaucgcccgggacugggccagaacgaaaaccuguccgccaucgaagggaagggcaaagucggaggccuuaagaccagauguagcucuugcaaugugaaauuugagagcgaguccgaacugcagaaccacauccaaacaauucaucgggagcucgugccugauucuaauagcacgcagcugaagacaccccaggucuccccuaugcccagaaucucucccagccaguccgacgaaaagaaaaccuaccaauguauuaagugccagaugguuuucuauaacgagugggauauccaggugcacguggcuaaucauaugauugacgaggggcucaaccacgaauguaaacugugcagccagaccuuugacucuccugccaaacuucaaugucaccugaucgagcauuccuucgaaggaaugggcgggacauucaagugcccggucuguuuuaccguguucguucaggcgaauaagcuccagcaacacaucuuuagcgcccauggacaggaggauaagauuuacgacugcacgcagugcccccagaaauucuuuuuccaaaccgaacugcagaaccacacaaugacccagcauuccucuuga

SEQ ID NO: 78247 - RNA, 3903 nt, Artificial Sequence
  derived and/or modified sequence opt5 from ZNF536__Homo_sapiens__NP_055532
auggaggaagccagccugugccucggcguguccucugcugagcccgaagccgagccucaccugagcgggccgguccuuaacggacaguacgcgaugucccaaaagcugcaucagaucaccucucagcucagccacgcuuuccccgaacugcauccuagacccaauccugaggagaaacccccugccucccuugaagagaaggcccacguuccgaugucuggccagcccauggggagccaaauggcucugcucgccaaccagcugggacgggaaguggacacaucccugaauggccgcguggaucuccagcaguuucugaacgggcaaaaucuuggaauuaugagccagaugucugacaucgaggaugacgcuagaaagaaccggaaguauccuuguccccugugcggcaaacgcuucagauuuaauuccauucucagccugcauaugcggacgcacaccggcgagaagccuuucaagugucccuacugcgaucaccgcgccgcgcagaaagggaaccuuaagauccaucugagaacacacaaacucggaaaucugggcaaggggcggggacgcgucagagaagagaaccggcugcuccaugaacuggaggaacgcgccauucuuagagacaaacagcugaagggcucucuccugcaaccgcggccugaucuuaagcccccuccccacgcucagcaggcuccccuggccgccuguacccucgcgcugcaagccaaucacuccgugccugacguugcucauccggugcccagcccuaaacccgccucuguccaggaggaugcuguggccccugccgcuggguuucgcugcacauucuguaagggaaaauuuaagaaaagagaggaacuggaccggcacaucagaauccuccauaagcccuauaaaugcacccugugugauuucgcggccucccaggaggaagaacuuauuagccacguugaaaaggcucauaucacagccgaguccgcccagggccaaggcccgaacgggggaggcgagcagucugcuaaugaauuucgcugcgaggugugugggcaggucuucagccaggccugguuucugaagggacacaugcggaaacacaaggacuccuucgaacauugcugccaaauuuguggcagacgcuuuaaagagccuugguuccucaagaaccacaugaaagugcaucugaauaaacuuagcgugaagaacaaaucucccuccgauccugaaguccccguuccuaugggagggaugagccaggaggcgcacgcuaaccuguacucucgguaucucagcugccugcaguccggcuucaugacccccgacaaggccggccugucugagccgagccagcucuacgggaaaggagaacugccuaugaaggagaaagaagcccuuggcaagcugcucucccccaucagcucuauggcucacggggugcccgagggagacaagcauucccugcugggcugucuuaaucucgugccuccgcugaaaagcucuugcauugagagacugcaagccgcugccaaggcggccgaaauggaucccgucaacuccuaucaggcuuggcagcucauggcccgcgggauggcuauggagcacggcuuucugagcaaagaacauccucuucagcggaaucacgaggacacgcuggccaacgcgggaguucucuucgauaaggagaaaagagaguacgugcuggugggcgccgacggguccaagcaaaagaugcccgcugaucugguccauucuaccaaagugggaagccagcgcgaccuuccuuccaagcucgauccccuggagucuagccgggacuuucugucccacggccucaaucagacacuggaauacaaccuucaagggccuggaaauaugaaagagaagcccaccgaauguccggauugcggcagaguuuuccgcacauaucaccagguggucgugcauagccggguccacaaaagagaccggaagggggaggaagauggccugcaugugggacucgacgagcgcagaggcucuggguccgaccaggagagccagucuguuucccggagcaccacgccuggaucuagcaacgugacagaagaguccggcgucgggggaggccugagccaaaccgggucugcccaggaagauagcccccacccuuccucccccucuagcuccgacaucggcgaggaagcuggaagaucugccggcgugcagcagccggcccugcuucgcgaucggagccucggguccgcuaugaaagacuguccuuacugcggaaagacauuuagaaccucucaucaccugaagguucaucugcgcauucacaccggcgagaaacccuauaaguguccucacugcgauuacgcggggacacaaagcgccucccucaaauaucaucuggagagacaccaccgggaacgccagaauggagcuggcccccuuagcgggcagcccccuaaccaggaccauaaggaugagaugucuuccaaagccagccuguucaucagaccggacauccuccggggcgccuuuaagggacugcccggcauugauuuccgcgggggaccugcuucucaacaguggacguccggcgugcugagcucuggggaccacuccggacaggccaccggcaugagcuccgaaguccccagcgaugcgcuuaagggcacagaccucccuucuaaaagcacccauuuuuccgagaucgggagagcuuaccaaucuauugugagcaauggagugaacuuccagggcucccugcaggccuuuauggauucuuucguucugagcucccucaagaaagagaaggacaugaaagacaaggcccuggcugaucccccuucuaugaagguccacgggguggacggaggcgaagagaaaccgagcgggaaguccagccagcggaaaucugaaaagucccaauaugagccccuugaucugagcgugcgcccugacgccgcgucucuccccggauccagcgucacagugcaggauuccaucgcuuggcauggcugucuguuuugcgccuucaccacgucuagcauggaacugauggcccuucaucugcaggcuaaucaccucggcaaagccaagagaaaggacaacacaauugggguuaccgugaauugcaaagaucaggcucgggaggccuccaagauggcgcugcucccuagccugcaaucuaacaaagaccuuggacuguccaacaugaucagcucucucgauagcgccuccgagaagauggcucagggccagcugaaagaaacccugggggagcagaagucuggagccuggacaggccacgucgaccccgcuuucuguaauuuuccgagcgauuucuacaaacaauuugggguguacccuggaaugguuggcuccggcgccucuagcuccugccccaacaaggaacccgacgggaaggcccacagcgaggaagaugugccuauccuuauucccgagaccacaucuaaaaauacgaccgacgaccuguccgauaucgcuagcuccgaggacauggauucuagcaagggagaaaacaaugacgaggaagaugucgagacagaaccugagaugaugaccaaaccgcucuccgcgcugucuaaggacagcuccagcgauggcggggacucucuccagcccacaggaaccucccagccugugcagggccugguuagcccccuuucucaagccccugagaaacaguggcauucccaggggcugcuccaagcucaggauccccuggccggacugccgaagccugaacgcggcccccagagccuugacaagccuaugaacaugcugucugugcucagagccuauagcuccgauggccuggcugccuucaaugggcucgcgucuagcacggcuaacuccggauguauuaaacggcccgaccugugcggcaaguga

SEQ ID NO: 78248 - RNA, 1884 nt, Artificial Sequence
  derived and/or modified sequence opt5 from ZNF555__Homo_sapiens__NP_001166246
auggacagcguggucuucgaggauguugccguggacuuuacccuggaagagugggcucuccuggauuccgcccagagagaccuuuaccgggaugugaugcuggaaacauuccaaaaccucgcgucugucgacgaugagacgcaguuuaaggcuagcggcuccgugucucagcaggacaucuauggggagaaaauucccaaggaaagcaaaaucgccaccuucacacgcaauguuuccugggccucugugcugggaaagauuugggauagccuuuccaucgaggaccaaaccacaaaccagggcagaaaucugcggaaccacgggcucgaacgccugugcgagagcaaugaucaguguggagaagcucugucucagauuccucaucucaaccuguacaaaaagaucccgcccggcgucaagcaauaugaguacaauaccuaugggaaaguguuuaugcacagacggacaucccuuaagagcccuaucaccguucauacgggacacaaacccuaccagugccaggaguguggccaggccuauucuugccgcucccaucugagaaugcacgugcggacccacaacggcgaacgcccuuacgucuguaagcucugcgggaaaacauuccccagaaccagcucucugaaucggcaugugcgcauucacacagcugagaagaccuacgaauguaagcaaugcggaaaagccuuuaucgacuucuccagccuuacgucccaucugagaucucacacaggcgagaagccuuauaaauguaaggaaugcgggaaagcguuuagcuacuccagcaccuuccggcgccacacaauuacccauaccggagagaagccguauaaauguaaggagugcgccgaggcuuuuucuuacuccagcacauucagacggcacaugaucucucauacgggcgaaaagccccacaaaugcaaggaauguggggaggccuuuagcuauuccucugcuuucagacgccauaugauuacccacacaggagaaaaaccuuacgagugcaagcaguguggcaaaaccuucaucuaucuccagagcuuucggagacacgagcgcauucauacaggcgaaaagcccuacgagugcaagcaaugugggaaaaccuucaucuacccucaguccuuucggagacacgaacgcacgcauggaggcgagaagcccuaugaaugcaaccagugugggaaagccuucagccacccgucuuccuuucggggacacaugagagugcauacaggcgagaagccuuacgagugcaaacagugugggaagaccuucaauuggcccaucagccugcgcaagcacaugcggacccauacaagagaaaaaccuuaugagugcaagcaauguggaaaagcguuuucucuguccgccugcuuccgcgaacacguccggaugcaucccgaggauaagagcuacgagugcaaacucuguggcaaggcuuuuuauugccacauuucccugcagaagcacaugagacggcauaccgccgaaaaacuuuacaaguguaaacagugcggcaaggcuuucucuuggcccgagcugcuccagcaacacguucgcacacauacgguggaaaaaccuuaugaguguaaggaaugcgggaaaguguuuaaguggccgagcucccugcccauccacaugagacuucauaccggagagaagccuuaccaguguaaacacugcggcaaggccuucaacuguucuagcucccugcggagacacguccgcauucauacaaccgagaaacaguacaagugcaauguggggcaucccccugccaacgaauuuauguguagcgcuucugagaaaucccaccaggaacgggaccucaucaagguugugaauaugguccugccccuguga

SEQ ID NO: 78249 - RNA, 1809 nt, Artificial Sequence
  derived and/or modified sequence opt5 from ZNF559__Homo_sapiens__NP_001189335
augagaaucaccgccgcuauucugacagcccggagccgcuggagacuccggaacuccaucucugcguuccuguuuacggugaccuucgcuuggugucccccuggccuuagcaaucugacaauucucuccugcccggaccaccugucucaggaugucuuuugccuucaugagagcaaguucgaagaggaacgcaugguugccggguggcugaccaacuacucccaagacucugugacauuugaggauguggccgucgacuucacccaggaagaguggacacuccuggaucagacccagagaaaucuguaucgggacgugaugcucgagaacuacaaaaaucugguugcuguggauugggaaagccacaucaacacgaagugguccgcuccccaacagaauuuucuucagggaaaaaccagcucugucguggagauggaacgcaaccauuucggcgaggagcuguuugacuucaaucagugugaaaaggcucucuccgagcacagcugccugaaaacacauagacggaccuauuuucgcaagaagacaugugaaugcaaccaaugugagaaagccuucagaaagccuucuauuuuuacccuucacaaaaagacggauaucggggaggaacugcccaauugcaaccagugugagacagcguucucccagcaccuccaucugguuugcaaaaagaccagccagaaucugcaccucguguguaagaaaacacauacccaagaaaagccuuacaaaugcucugacugcgagaagggacugcccuccagcucccaccuucgggaauguguccgcaucuauggcggggagagaccuuacacccacaaagaauauguggagacauucucucauagcacggcccuguuugugcacaugcagacccaggauggagagaaguucuacgaaugcaaagccuguggcaagccguuuacagaguccagcuaccucacccaacaucugcggacacacucucgcguccuucccauugaacauaagaaauucggcaaggccuuugcuuucuccccugaccuggccaaacacaucagacuccggaccagagggaagcacuauguuugcaacgaguguggaaaagaauuuacgugcuucagcaagcugaauauucauauccgcgugcacacaggcgagaagcccuacgaguguaacaaaugcgggaaggcguuuaccgauucuagcggacugauuaaacaucggagaacccacacaggcgaaaagccuuaugaguguaaagaaugcgggaaggccuucgcuaacuccucucaccucaccgugcauaugcgcacacacacgggagagaagcccuaccaguguaaagagugcggcaaggccuuuaucaauagcuccagcuucaaaucucauaugcagacccacccgggcgucaagccuuaugacugccagcaaugugggaaggcuuuuauucgguccagcuuccugaucagacaucuucgcucucacuccgccgaacggcccuucgagugcgaagaguguggaaaagccuuuagauacagcucccaccugucucagcauaagcgcauccacacaggcgaacggccuuauaaaugccagaagugugggcaggcuuucagcauuuccucuggacucaccgugcauaugagaacacacaccggcgagcgccccuuugagugccaagaaugugggaaagcguucacgcggagcaccuaccugaucagacaucuucggucccacagcguugagaagcccuacaaagaaugcggacagacauuuucuaacuccagcugucugaccgagugcguguga

SEQ ID NO: 78250 - RNA, 1743 nt, Artificial Sequence
  derived and/or modified sequence opt5 from ZNF568__Homo_sapiens__NP_001191766
augaagcccgcccagagaaaccuguaccgggacgugaugcucgagaauuauagcaaccuggucaccguuggcugccaagugacaaaaccugaugugaucuucaaacuugaacaggaggaagaaccgugggucauggaagaggagauguuugggcgccacugucccgaagugugggagguugacgaacagauuaaaaagcagcaagagacgcuggugagaaaagucaccuccaucucuaagaagauucucaucaaagagaaggugauugaaugcaaaaagguugcuaaaaucuucccucugagcuccgauaucgugacaucucggcagagcuuuuacgacugugauucccuugacaagggacuggagcauaaucucgaucugcugcgcuaugaaaagggcugcgucagagagaaacagucuaacgaguucgggaagcccuuuuaccacugugccagcuauguggugaccccuuucaaaugcaaucaguguggacaagacuuuucccauaaguucgaucucauucggcacgagcgcauccaugcgggcgagaaacccuacgaaugcaaggagugugggaaggcuuuuagcagaaaggaaaaccugauuacacaccagaagauccacaccggagagaaaccuuauaagugcaaugaauguggcaaagccuucauucagaugucuaaccuuauccggcaucaccgcauucauacaggcgagaagccguacgccugcaaagacugcuggaaggcuuuuucccagaaaagcaaucugaucgagcacgaaagaauccacaccggggagaaacccuacgaauguaaggagugcggaaaaucuuucucccaaaagcagaaccucauugaacaugagaaaauccacacgggcgagaagccuuaugccuguaaugaaugcgggcgggcuuuuagccgcaugucuuccgucacccugcauaugagaagccacacaggagagaagcccuacaaauguaacaagugcggcaaagccuucucccaguguucuguuuucauuauccauaugcggagccacaccggggaaaagccuuaugugugcuccgaguguggaaaagcguuuagccaaucuuccagccuuacagugcacaugcgcaaucauaccgccgagaagcccuacgaaugcaaggaguguggcaaggcuuucucuagaaaggaaaaccugauuacgcaccagaaaauccauacaggcgagaagccguaugaaugcagcgagugcgggaaagccuuuauccagauguccaaucucauucggcaccagagaauccacaccggagagaagccuuacgcuuguacagucugcggcaaagccuucucucaaaagagcaaccugaccgaacaugagaagauucacaccggggaaaaacccuaucauuguaaccagugcggaaaggcguuuucccagcgccagaaucugcucgagcacgagaaaauccauacaggcgaaaagccuuucaaauguaacgagugcgggaaggccuuuagccggauuucuucccugacgcuucacgugagaagccacaccggagaaaagcccuacgaguguaauaaaugcggcaaggcuuucucucaauguucccugcucaucauccauaugcgcagccacacaggcgaaaaacccuuugagugcaacgaaugugggaaggccuucucccagcgggcuucucugagcauucauaaaagaggacacaccggcgagcgccaucagguuuacuga

SEQ ID NO: 78251 - RNA, 2061 nt, Artificial Sequence
  derived and/or modified sequence opt5 from ZNF569__Homo_sapiens__NP_689697
augaccgagagccagggcacagugacguucaaggacgucgccaucgauuuuacccaagaagaguggaaaagacuggaccccgcucagcggaagcucuaccgcaacguuaugcuggaaaauuauaacaaucuuauuacagugggguacccuuucaccaaaccggaugugaucuuuaagcuggagcaggaagaggagcccugggucauggaagaggaagugcucagacggcacuggcagggagagauuuggggcguugacgagcaucagaaaaaccaagaucgccugcuuagacagguggaagucaaguuccagaagacacugaccgaggaaaaagggaaugagugccaaaagaaauuugccaacguguucccucucaauuccgacuuuuuccccucucggcacaaccuguaugaauacgaucuguuuggaaagugucucgagcauaauuucgacugccacaacaauguuaaaugucugaugcgcaaggagcauugcgaauauaacgagccugugaaaagcuacggcaauuccucuagccacuuugucaucacacccuucaaauguaaccacugcgggaagggauuuaaucagacccuugaucugauuagacaucuccggauccacacgggcgaaaaaccuuaugaguguuccaacugccgcaaggcguucucucauaaagaaaagcugaucaaacacuacaagauucacagcagagagcaguccuacaaguguaacgagugcggcaaagccuucaucaagaugagcaaucuuauucggcaucagcgcauccacaccggggaaaaaccguaugcuuguaaggagugcgaaaaaucuuuuucccaaaagagcaaccugauugaccaugagaagauccacacaggagaaaaacccuacgagugcaaugaguguggcaaggccuucucucagaaacagucccucauugcucaucaaaaggugcacaccggggaaaaaccuuaugccugcaacgaguguggaaaggcuuuucccagaaucgccagccuggcgcugcacaugcggucucauacaggcgaaaagccuuacaaaugcgauaagugugggaaagccuucucccaguuuagcaugcucaucauucacgugcgcauccauaccggagagaagcccuaugagugcaaugaauguggcaaagccuucucccagucuagcgcucugacgguccacaugagaucccacacaggcgagaagccguacgaaugcaaggagugucggaaggcuuuuagccauaagaaaaacuucauuacccaccagaagauccauacaagagaaaaaccuuaugagugcaaugagugugggaaggccuuuauucaaaugucuaaccuuguucgccaccagcggauccauaccggagaaaaacccuacaucugcaaggagugcggcaaggcguucucccagaaaagcaaucugauugcccacgaaaagauccacucuggggagaaaccuuacgaauguaacgagugcggaaaggcuuuuagccagaaacaaaauuucauuacccaucagaaggugcacacaggcgagaagcccuaugacuguaacgaaugcgggaaagccuuuucccagaucgcuucucucacgcugcaucuuagaagccacaccggagagaagcccuacgaaugugauaaaugcggcaaggccuucucccaguguagccugcucaaucugcauaugcgcucucacacaggcgagaaaccuuaugugugcaacgaaugugggaaggccuucucccaacggaccagccugauuguccacaugagaggacauacaggcgagaagccguacgagugcaauaaaugugggaaggcuuuuucucaguccagcucccucaccauccacauccgcggacauacgggcgaaaaacccuucgacugcucuaagugcgggaaagcguuuagccagauuuccucucugacacuucacaugcggaagcacaccggcgagaagccuuaucauuguaucgaaugcggaaaagccuucagccagaagucccaccuggugagacaucaacgcauucacacccauuga

SEQ ID NO: 78252 - RNA, 1281 nt, Artificial Sequence
  derived and/or modified sequence opt5 from ZNF577__Homo_sapiens__NP_001129062
augaagaacgccaccaucgugaugagcgucagacgggagcagggcuccucuagcggggaaggaucccugucuuucgaggacguugcugugggcuuuacacgcgaagaguggcaauuccucgaucagagccagaaagugcuguacaaggaagucaugcuugagaauuauauuaaccugguguccaucggguacagaggaacgaaacccgacucucucuuuaagcuggagcagggcgaaccuccggggauugccgagggagcggcucacagccaaaucugccccggcggcaaaccucaugaauguuccguuugcgggcgggccuucagccgcaaggcccagcuuauucagcaccagagaaccgagcggggagagaagccccauggcuguggggaaugcggaaaaacauuuaugcgcaagauccaacugaccgagcaccagagaacacauaccggcgaaaaaccucacgaguguucugaaugcgggaaggcuuucucccggaaaagccagcucauggugcaccagcgcacacauaccggagagaagcccuauagauguucuaagugcggcaaagccuuuucccggaagugucgccugaauagacaccaacggagccauacgggcgagaaacuguacgggugcucugucuguggaaaggcuuucucccagaaagccuaucucaccgcgcaccagcgccugcacacaggcgauaagccuuacaaaugcagcgacugcgggagaaccuuuuauuucaaguccgaucuuacacggcaucaaagaauccacaccggagaaaagccguacgaguguucugaaugcgagaaagccuuucgcagcaaguccaaacugauucagcaucagcggacgcacacaggcgaaagacccuacagcugucgcgagugcgggaaggcuuucgcccauaugucugugcucaucaaacacgagaagacccacauucgggaaacagcuaucaacucccugaccguugagaagccuagcucuagaagccauaccucccuuuauaugucugaacugauucaggagcagaaaacagugaauacgguccccaucgaaaugccuagcuccggaacacccccgcuccugaacaagagcgagcgccuggugggccggaauguggucauuguugagcaaccuuuucccagaaaccaggccuucguggugaaucaggaguucgaacaacgcaucucucucaccaacgaagucaauguggcgccuuccguuaucaacuacauucuguaucuuaccgacaucgugagcgaguga

SEQ ID NO: 78253 - RNA, 519 nt, Artificial Sequence
  derived and/or modified sequence opt5 from ZNF580__Homo_sapiens__NP_057286
augcugcuccugcccccuagaccgccccacccucggagcuccucucccgaggccauggacccucccccuccgaaggcucccccuuuccccaaagccgaaggcccuagcuccacccccucuagcgcggcugggccgcgcccucccagacuuggacggcaucugcucaucgaugccaacggcgugccuuacacauauacgguccagcuggaggaggaaccccgcgggcccccucaaagagaagccccgcccggagagccuggcccccggaagggguacuccugcccugagugugcucgcguuuuugccucuccccuuagacugcagagccaccgggugucccauagcgaccucaaaccguuuaccugcggagcuuguggcaaggccuucaaaagaucuucccaccugagccgccaucgggcgacacaccgcgccagagcuggcccuccccauaccugcccucuguguccccggcgcuuccaggaugccgcugaacucgcccagcacgugagacugcacuga

SEQ ID NO: 78254 - RNA, 594 nt, Artificial Sequence
  derived and/or modified sequence opt5 from ZNF581__Homo_sapiens__XP_006723303
augcuggugcuccccagcccuugcccgcagccccuggccuucuccucugucgagaccauggaaggcccucccagacggacaugucgcagcccugagcccgggccuuccucuagcaucggauccccgcaagcuagcucucccccuagacccaaccacuaccuucugauugacacgcagggcguuccuuauaccgugcucguggaugaagagucccagcgggaacccggggccagcggagcgccgggccagaagaaaugcuacucuuguccugucugcucccgcguguuugaguauaugagcuaccugcaaagacauucuaucacacacuccgagguuaagcccuucgaaugugacauuugcgggaaggcuuuuaaacgggccagccaucuugcccgccaccauucuauccaccuggcuggaggcggcagaccucacggguguccccucugcccccggcgcuucagagaugccggagagcuggcucagcauucccgggugcacagcggcgaacgcccuuuucaguguccgcauugccccagacgguucauggagcagaauacccugcaaaaacacacacgcuggaagcacccuuga

SEQ ID NO: 78255 - RNA, 1554 nt, Artificial Sequence
  derived and/or modified sequence opt5 from ZNF582__Homo_sapiens__NP_653291
augagccugggcuccgaacucuucagagacguggccaucgucuuuucucaggaagaguggcaauggcuggcucccgcccagcgggaucuuuaccgcgacguuaugcuggaaaccuauagcaaccucgugucccuggggcuugcggugucuaagccugaugucauuagcuuccuggagcagggaaaagaaccguggaugguggagagaguuguguccggcgggcucugccccguccuggagucucgguacgacacaaaggaacuguuuccuaaacagcacguguaugagguugaaagcccccaaugggagaucauggagucccucacgagcuacggacuggaauguucuuccuuccaggaugacugggagugccgcaaucaguuugauagacagcaaggcaacccugaccggcauuuccaccagaugauuauccgccaugaagagaugcccaccuuugaucagcacgcuagccuuacauucuaucagaagauucauaccagagaaaaaccuuuuggguacaauaagugucggaaggacuucuggcaaaaagagcugcucaucaaccaccagggaaucuauacaaaugagaagccguacaaaugcaaggaauguggcaaagccuuuaaguacggcucucgccugauucagcacgagaacauccauuccgggaagaaacccuaugaaugcaaggaguguggaaaagccuucaauagcggcucuaacuuuauucaacaccagagagugcauaccggggaaaagccuuacgagugcaaagauugugagaaggcuuucucccggagcucccagcuuaucgaacaccagcgcacacacaccggagagaaacccuaucaaugcaaggaauguggcaaggccuucaauagaauuucucaucugaaaguccacuaccggauccauacgggggagaagccuuaugcuugcaaagaaugcggaaagaccuuuagccaccgcucccagcucauucagcaucagacagugcacaccggcagaaaacuguacgaguguaaggagugcggcaaggccuucaaccaagggagcacacugauccggcaccagagaauccauaccggagaaaaacccuaugaguguaaggugugcggcaaagcguuucgcgucucuucccagcucaagcagcaccaacggauucauacgggggaaaaaccguaccaguguaagguuugcggcagagccuucaagcgcgugagccaccugacagugcacuaccggauccauaccggagagaaaccuuaugaguguaaggaaugcgggaaagccuuuucucacuguagccagcuuauucaucaccaggucauccauacagagaagaaacccuacgaauauaaggagugcgaaaagacccugucccacgacucuaccacagugcaaccucagagaaugcacaaucgcgagacgcauguuaacauuaucaauguggagaaacccagcaucuccagcuacccccuccugauuauccgggaguucaugcuugcuucuaaccacaugaauggauccaacggcgagagcccucuggcuuga

SEQ ID NO: 78256 - RNA, 1710 nt, Artificial Sequence
  derived and/or modified sequence opt5 from ZNF583__Homo_sapiens__XP_011524819
augagcaaggaccuggugaccuucggcgaugucgccguuaacuuuucccaggaggaaugggaguggcucaaucccgcucaaagaaaccuguaccggaaagugaugcuugaaaauuaucgcucucuggugagccucggggucuccgugucuaagccugacguuaucagccugcuugagcagggaaaagaaccguggauggugaagaaagagggcacaagagggcccugcccugauugggaguacgucuucaagaacuccgaauuuucuagcaagcaggagacguaugaagaguccagcaaagugguuaccgugggagcccggcaccugucuuacucccucgacuaucccagccugcgcgaggauugucagucugaagacugguacaagaaucaacugggcucccaggagguccaucucagccagcugauuaucacacacaaagaaauucuuccugaggugcagaacaaggaauauaauaaaucuuggcaaaccuuccaucaggauacaaucuuugacauucagcaguccuuccccaccaaggagaaggcgcacaaacaugagccucaaaagaaaagcuacagaaagaaauccguggaaaugaagcaccggaaagucuacguugagaagaagcugcucaaaugcaacgauugugaaaagguguuuaaucagucuagcucccugacacuucaccagcgcauccauaccggggagaaaccguaugcuugcguggaauguggaaagacguucagccaaucugccaaccuggcccagcacaaaagaauccauaccggcgagaagcccuacgagugcaaggaaugucggaaggcuuuuucccagaaugcccaccucgcucagcaccaacgcguccauacaggcgagaaaccuuaucagugcaaagaauguaagaaagccuucagccagauugcgcaccugacccagcaucaaagagugcacacaggggagcggcccuuugaaugcaucgaguguggaaaggccuucucuaacggcagcuuucuggcucagcaucagcgcauucacaccggggagaagccuuacguuugcaaugugugcggaaaagccuucucccacagaggcuaucucaucguccaucagcggauucacacgggggaacgccccuacgaguguaaggaaugcagaaaggcuuucucucaauaugcccaucuggcgcagcaccagcgggugcacacaggagagaaaccguacgaguguaaaguuugcagaaaggccuuuagccagaucgcuuaccuugaccaacaucagcgcgugcacaccggcgaaaagccuuaugaguguauugaaugcggcaaagccuucuccaacucuagcucccuggcucagcaucaacggagccacacaggggagaagcccuacauguguaaagaaugcagaaagaccuuuucucagaaugccggacucgcccagcaucagcgcauccacaccggcgagaaaccuuaugaguguaacgucugcgggaaggcuuucuccuacagcggaucccugacacuucaccaacggauccauacgggcgaaagacccuaugaguguaaagauugccgcaagucuuuucggcagagagcgcaccuggcccaucacgaacgcauucauaccauggagagcuuccucacacuguccucucccagcccuuccaccagcaaccagcugccgcggcccgugggguuuaucucuuga

SEQ ID NO: 78257 - RNA, 2310 nt, Artificial Sequence
  derived and/or modified sequence opt5 from ZNF585B__Homo_sapiens__NP_689492
augcccgccagcuggaccuccccucagaagucuagcgcucuggccccggaggaccacggcuccucuuacgaagggagcguguccuucagagaugucgcgaucgacuuuucucgggaggaauggcgccaucucgaucugagccaaagaaaccuuuaucgggacguuaugcuggagacauacucccaccuccugagcgugggauaucaggugcccaaaccugaagucgugaugcuugagcagggcaaggagcccugggcucugcagggggaacgcccuagacauucuugccccggagagaaacucugggaucacaaucaacaucggaagauuaucggcuacaaaccugccuccagccaggaccagaagauuuauucuggggaaaaguccuacgagugugccgaguucggaaagagcuuuacguggaaaucucaguucaaaguucaccugaaggugccgaccggcgaaaaacuguaugucugcaucgaguguggccgcgcuuuugugcaaaagcccgaguucauuacacaccagaagacccauaugagagaaaaaccuuacaagugcaacgaaugugggaaauccuuuuuccagguuagcucccucuuucggcaccaucgcauccacacaggagagaagcuguacgagugcucugaauguggcaaaggguuccccuauaauagcgaucuuuccauccacgagaagauucauaccggagaaagacaccaugagugcacagacuguggcaaagccuuuacccaaaagagcacgcugaagauccaccagaaaauucauaccggggaacggucuuacaucugcauugaguguggacaggcuuucauccagaagacacaacucauugcccaccgcagaauccacuccggcgagaaaccuuaugaaugcaacaauugcggcaagagcuuuaucucuaaaagccagcuucaggugcaucagcggguccacacccgcgugaagcccuacauuuguacagaguaugggaagguguucuccaacaauucuaaccugaucacccaugagaaaauucaaagcagagaaaaguccagcaucugcacggaauguggaaaagcguucacauaccggucugagcugauuauccaccagagaauccacaccggcgagaagccguaugaaugcuccgauugugggcgcgccuuuacacagaaaagcgcucucaccguccaucagcggauucacaccggagagaagucuuacaucugcaugaaguguggccuggccuucauuagaaaagcucaucugaucacacaccaaauuauccauacgggggaaaagccuuacaaaugcggacacuguggcaagcucuuuaccuccaaaagccagcugcacguucauaagcgcauccacacaggcgagaagcccuaugugugcaauaaaugugggaaggccuucaccaaccgguccaaucuuauuacacaucagaaaacccacacgggagagaagucuuacaucugcagcaaaugcggcaaggcguuuacacagagauccgaccugauuacccaucaacgcauccacaccggggaaaaaccuuaugaguguaacacaugcggaaaggccuucacccagaagucuaaucucaacauucaccagaaaauccauacaggcgaacggcaguacgagugucacgaaugcgggaaggcuuuuaaucagaaaagcauucugaucgugcaucagaagauccacacgggcgagaaacccuaugucuguaccgagugcggcagagccuucauucgcaaguccaacuuuaucacacaccagcggauucauaccggagaaaagcccuacgaguguagcgauugcgggaaaucuuucacauccaagagccaacuucuggugcaccagccuguucauaccggagaaaaaccguaugugugugcugagugcggcaaggccuuuucugggagauccaaccucagcaaacaccagaagacgcauaccggagaaaagcccuacaucuguucugagugcggcaaaacauuccgccaaaagagcgagcugauuacccaccaccggauccauacaggggaaaaaccuuacgagugcuccgacuguggcaagagcuuuaccaaaaagucucaacugcagguccaccagagaauccauacgggagaaaagcccuaugugugcgccgaguguggcaaggcuuucuccaaucggagcaaccucaauaaacaccagacaacccacacaggggauaaaccuuacaagugcggaauuuguggcaaaggguucguucaaaaguccguguuuucuguccaucagagcucccacgcguga

SEQ ID NO: 78258 - RNA, 3804 nt, Artificial Sequence
  derived and/or modified sequence opt5 from ZNF592__Homo_sapiens__NP_055445
augggcgacaugaagacccccgauuucgacgaucugcucgccgcuuuugacaucccugauccgacaagccuggacgccaaagaggcgauucagacgcccuccgaagagaacgaaucuccucuuaagcccccugggaucugcauggaugagagcgugucccugucucacagcggauccgcucccgacgucccugccguuucugugauugugaaaaauaccagcagacaagaauccuucgaggccgagaaggaucauaucacaccgagccuccugcacaacggcuuucgggggucugaccuucccccugauccccauaauuguggaaaauucgacuccaccuuuaugaacggcgauagcgcucgcucuuucccugggaagcuggaacccccgaaguccgagccucuccccacauuuaaucaguucagcccuauuucuucccccgaacccgaggacccuaucaaagacaacggauuuggcaucaagccgaaacacagcgauuccuacuuucccccuccccugggcugcggggccgucggaggcccugugcuggaggcucucgccaaguuccccguuccggaacugcauauguucgaccacuuuuguaaaaaggagccuaagcccgaaccucuuccccuggggucucagcaggagcacgaacaaagcggacagaauaccguggagccucauaaagaucccgacgcgacaagauucuucggcgaggcccucgaauuuaacucccacccgagcaauucuauuggggaguccaagggacuggcucgggaacuuggaaccugcagcucugucccuccccgccagagacugaaacccgcccauagcaagcucuccucuuguguggcugcccugguugcgcugcaggccaaacggguggcuagcgucacgaaggaggaucaaccuggccacaccaaagaccucuccgggccgacaaaggaaagcucuaagggaucccccaaaaugccuaagagccccaaaucuccucgcagcccccuggaggccaccagaaagagcaucaaaccuuccgauucuccccggagcauuugcuccgacucuagcuccaagggcagcccgucuguggcugccuccagcccucccgccaucccuaaggugcgcauuaaaacaaucaagaccucuuccggggagauuaaaagaacggucacacggauccuucccgauccggacgauccuagcaagucucccguuggaagcccucugggcuccgcuaucgcggaagcccccagcgagaugcccggggacgaagugccuguggaggaacacuucccggaggcuggaaccaacucuggcagcccccagggcgcccgcaaaggggacgagagcaugacaaaggccuccgauucuagcuccccuucuuguagcuccggacccagagucccuaagggcgcugcccccgggucucagaccggcaaaaagcagcaaagcaccgcgcuccaggcuuccacacuggccccugccaaucuucugccgaaagcugugcaucucgccaaccugaaucugguuccccacagcguggcugccucugucacggcgaaguccagcgugcagcggcgcucucaaccucagcucacccagauguccguuccccuggugcaucaggucaaaaaggccgcuccucuuauuguggaagucuuuaacaaggugcugcacagcucuaaucccguuccgcucuaugccccuaaccuguccccucccgcugacagcagaauccaugugcccgccuccggcuacugcugucuugagugcggggaugcguucgcccuggaaaaaucccucucucaacacuauggccggagaagcguccacauugaggugcuguguacacugugcuccaagacccuccuguuuuucaacaaaugcucucuucugcgccaugcucgggaccacaagagcaaaggacucguuaugcaguguucccagcugcuggugaagcccaucucugccgaucagauguuugucagcgcuccuguuaauuccacagccccggccgcucccgcgccuucuagcucccccaaacauggccuuaccagcgggucugccuccccucccccgccugcucucccccuguacccugaccccgugagacugauucgcuauagcaucaagugccucgagugucacaagcaaaugcgggauuacauggugcuggccgcccacuuccagagaacgacagaagagaccgaaggacuuaccugccaggucugucagaugcugcucccuaaccaaugcucuuuuugugcucaucagcgcauccacgcccauaaaucccccuauugcuguccggagugcggcgugcugugucggagcgcguacuuccagacacacgugaaggaaaauugccugcauuacgcuagaaaagucggguaucgcugcauucacuguggagugguucaccuuacccucgcccugcugaagucccauauccaggagcggcacugccaaguguuucauaaaugugccuucugcccuauggcuuuuaagacagccucuagcacggcggaccacuccgcuacccagcaucccacacagccccacagaccuagccaacucauuuacaaguguucuugcgagauggucuucaacaaaaagcgccacauccagcagcauuucuaucagaauguguccaaaacccaaguuggcguguuuaaguguccggaaugcccccugcuuuucguccagaaaccugagcugaugcagcacguuaagagcacacauggggugccccggaacguggaugaacucucuagccugcaguccucugccgacaccagcuccucuagaccuggcagccggguccccacggagccuccggccaccuccguggcugcccgcuccucuucccugcccagcggaagauggggccggccugaagcucacagacgcguggaggcccggcccagacuucgcaauacaggguggaccugucaagagugccaggaaugggucccugauagagaguccuacguuucucacaugaagaaaagccauggacggacacucaagcgcuaucccuguagacagugcgaacaguccuuucacaccccgaacucucugcggaaacauauucgcaauaaccacgacacggugaagaaauucuacacaugcggcuauuguaccgaggauagcccuuccuuucccagacccagccugcucgaaucucauaucucccugaugcacgggauccggaauccugaccuuagccaaacaucuaaggugaagcccccuggaggccacuccccgcaggucaaccaucugaaacgccccgugagcgggguuggcgacgcgccuggaaccucuaauggcgccaccgugagcuccacaaagagacacaaaucucucuuccagugcgcuaaguguagcuuugccacggauuccgggcuggaguuccaaagccauauuccccagcaccaggucgacuccucuaccgcucagugccugcuuuguggacucugcuacacaagcgccuccucucugagccggcaccuguuuaucgugcauaaaguucgcgaucaagaggaagaggaagaggaggaagccgcugcggccgagauggcuguggaagucgccgagccugaagagggcuccggggaggaagugcccauggagaccagagaaaacggacucgaggaaugugccggcgagccgcugucugcugacccugaggcccggagacuucuggggcccgcgccugaagaugacggcggacacaaugaucauagccagccccaggcuucccaggaccaagauagccacacacucucuccucagguuuga

SEQ ID NO: 78259 - RNA, 1515 nt, Artificial Sequence
  derived and/or modified sequence opt5 from ZNF596__Homo_sapiens__XP_011533044
augcccagcccugacuccaugaccuucgaggauaucauuguggacuuuacacaggaagagugggcccugcucgauacgucucaaagaaagcuguuccaggacgucaugcuugaaaacaucagccaccugguuuccauuggcaaacagcucugcaagucuguggugcugagccagcuugagcaagucgaaaaacuguccacccagcggaucucucuccugcaggggcgcgaggugggaauuaagcaucaggagaucccguuuauccaacacauuuaccagaaaggcacaagcaccaucuccacaaugagaagccauacccaggaagaucccuuccuguguaaugaccucggggaggauuuuacacagcacauugcucugacccaaaacguuaucacguauaugcggaccaagcauuucgugucuaagaaauuuggaaagauuuucuccgacuggcuuagcuuuaaucagcacaaagaaauccacacaaagugcaaaucuuacggcucccaucuguucgauuaugccuuuauucagaacagcgcgcuccgcccucacucugucacccauacaagagagaucacccuggagugucgggugugcgggaagacguucuccaagaauagcaaccuucgcagacacgaaaugauccacacaggagagaaaccccauggcugucaccugugcggcaaggcuuuuacccauuguuccgaccuccggaaacacgaacgcacacauaccggggagaagccuuacggaugccaccuguguggcaaagccuucucuaagagcuccaaucugagacggcacgaaaugauucauacccgcgagaaagcccaaaucugccaccucugugggaaggcuuucacacauugcagcgaucugagaaagcacgagcggacgcaccuuggagacaaacccuauggcugccugcucugugggaaggccuuuucuaaaugcuccuaccugcgccagcaugaaagaacccacaacggagagaagccuuaugaaugucaucuuugcggcaaggcuuucagccacuguucucaucugcggcagcacgagagaagccacaauggcgaaaaaccgcaugggugccaccucuguggaaaggccuuuacagaguccucuguucugaaacgccaugagcggauucacaccggcgaaaagcccuacgagugccaugugugugggaaagcguucacagaaagcuccgaucugagacgccacgagcggacccacacgggagaaaagccuuacgagugccaucucuguggcaaagccuuuaaccacagcucuguccugagacgccaugagcggacacacaccggggaaaagcccuaugagugcaauaucugcggaaaggcuuucaacagauccuacaauuuucgccuucaccggagagugcauaccggcgaaaaaccuuauguguguccccugugcggcaaggccuucagcaaauuuuucaaccuccgccagcacgagcggacacauaccaagaaagcuaugaauauguga

SEQ ID NO: 78260 - RNA, 2379 nt, Artificial Sequence
  derived and/or modified sequence opt5 from ZNF606__Homo_sapiens__NP_079303
auggccgcuaucaaccccugggccagcuggggcgcgcugaccgaccaguccugggggaugacagcuguggauccuugggccucuugggcccucugcccgcaauaccccgcuuggcacgucgagggaagccuggaagagggcagacgggccacggggcuuccugcugcccagguucaggaacccgugaccuucaaggacguggcggucgauuuuacacaggaggaauggggacaacuggaccucgugcagcgcacccuguauagagauguuaugcuugagacauacggccaucugcucuccguggggaaucagauugccaaaccugaggucaucucucugcuggaacagggagaggaacccuggagcguggagcaggcuuguccucaacggaccugcccggaguggguucgcaaccucgaauccaaggcccugauucccgcucagucuaucuucgaggaagaacagagccacggcaugaaacuugaaagauauauuugggacgauccuugguuuucccggcuggaggugcucggcuguaaggaccaacuggagauguaccauaugaaucagagcacagccaugcgccagauggucuucaugcaaaaacaggugcuuucucagagauccagcgaauuuugcgggcugggagcggaguucucucagaaccucaauuuugugcccucccaacgggucagccagaucgaacacuucuauaagccugauacccaugcccagucuuggcgcugugacuccgcuaucauguacgccgauaagguuacgugcgagaacaaugacuaugauaaaaccguguaccagagcauucaacccaucuacccggcucggauucagacaggcgacaaccuguuuaaguguaccgacgccgugaaauccuucaaucacaucauucacuuuggggaucauaagggaauccacacaggcgaaaaacuguaugaguacaaggagugccaucagauuuucaaccagucuccuagcuuuaaugaacaccccagacuccacgucggggagaaccaauauaauuacaaggaauaugagaacaucuucuacuucuccagcuuuauggaacaucagaaaaucggaaccguggagaaggccuauaaauacaaugagugggaaaagguuuucggcuacgacucuuuucugacgcagcacacauccaccuauacagcugagaaaccuuacgauuauaacgaauguggcaccagcuucauuuggucuagcuaccuuauccagcauaagaaaacccacacaggggagaagcccuaugagugcgacaaguguggaaaaguguuucgcaacagauccgcgcugacgaagcaugaacggacccacacaggcauuaaacccuacgagugcaauaagugcgggaaagccuucucuuggaacagccaccucaucguccauaagcgcauucacaccggagaaaagccuuauguguguaaugagugcggcaaauccuuuaacuggaauagccaucugaucgggcaccaaagaacacacaccggagaaaagccguucgaguguacggagugcggcaaaucuuuuuccuggagcucucaucuuaucgcucacaugcggaugcauacaggcgaaaagcccuucaaaugugaugagugcgaaaaggccuuuagagacuacuccgcccugagcaagcacgagcgcacccauuccggggcuaaaccuuacaaguguaccgaaugcggaaaaucuuucagcugguccucucaccucauugcccaccagcggacacauaccggcgagaagcccuauaacugucaggagugcgggaaagcguuuagagaacgcagcgcucugacaaagcacgagaucauucauuccggaaucaagccuuacgaauguaauaaaugcggcaagagcugcucucaaauggcccaccugguucggcaucagagaacgcacaccggggagaaacccuaugaauguaacaagugcggcaaauccuucagccagucuugucaccucguggcccaucgccggauucacacaggagagaagccguacaaaugcaaucagugugagagauccuucaacugcagcucucaucugaucgcucaccgccggacccacacaggcgaaaagccuuauagauguaaugagugcgggaaggccuuuaacgaaagcuccagccuuaucguccaucugcgcaaucacaccggagagaaacccuacaaguguaaccauugcgagaaggcuuucuguaaaaauucuucccucauuauccaccaacggaugcauagcggcgagaaaagauuuauuugcuccgagugcgggaaggccuucucuggacacagcgcgcugcuucagcaccagcggaaccauuccgaagagaagcugaacuga

SEQ ID NO: 78261 - RNA, 2088 nt, Artificial Sequence
  derived and/or modified sequence opt5 from ZNF607__Homo_sapiens__NP_001166148
augagcuacggcuccaucaccuucggggacguggccauugauuuuucucaccaggagugggaauaucugagccucguccaaaagacacuguaccaggagguuaugauggaaaacuaugacaaucuugugucccugggacauucugugagcaaacccgaucucaucacgcugcuugagcagggcaaggaaccuuggaugauugucagagaggagacccgcggggaaugcacagaccuggauucccggugugagaucauuucugacggaaaaaugcagcucuacagaaagcacagcugcgugacccugcaucaacggauccacaacggccagaaaccguaugaauguaagcagugccagaaguccuucagccaucugacagagcucaugguucaccaaaccauccacacaucugaggaacccgaucagugugagaaauuucgcaaggcuuucucccaucugaccgaccuuagaaaacaccagaagauuaaugcccgggaaaaaccuuacgagugcgaagagugugggaagguguuuagcuaucccgcgaaccuggcucagcauggaaagguccacguggagaaaccuuacgaaugcaaggaguguggcgaagccuuccgcacgucuagacaacucaccguucaccaucgguuucacuacggcgagaaacccuaugaaugcaaggagugugggaaagccuucuccguguacggacgccugagcagacaucagucuauccacacaggcgagaagccuuuugaaugcaauaaaugcgggaaguccuuccggcuuaaggcuggacugaaaguccaucagagcauucacaccggcgagaagccgcacgaauguaaagagugcgggaaggccuuucgccaauucucccaucucgugggacacaaaagaauccauacaggcgaaaagcccuaugaguguaaggagugcggcaaaggguuuaccugucgguaccagcugacgaugcaccagcgcauuuauucuggagaaaagcacuacgagugcaaagaaaacggcgaggcuuucagcuccgggcaucagcugacagccccucacaccuucgagagcguggaaaagcccuauaaaugugaggaaugcggaaaggcguuuucuguccauggcagacucacacggcaccaagggauccauuccggaaagaaaccuuacgaguguaauaagugcggcaagagcuucagacugaacucuagccuuaaaauucaccagaauauccacaccggcgaaaaacccuacaaguguaaggagugcgggaaagccuuuucccagcgcgcucaucuggcccaccauaaccggauccacaccggauauaagccguucgagugcaaagaauguggcaagucuuuuagaugcgcuagcuaccucguuauucaugagcgcauccacacaggggaaaaaccuuaugugugucaggagugcggaaagggcuucuccuacagccacaaacugacgauucaucggagagugcacaccggggaaaagcccuaugaguguaaggagugcggcaaagccuuuucugucuccggacaacuuacacagcaucugagcauccacucuggcaagaaaccuuucgaauguaauaagugcgggaaauccuuucgcuucauuagcgugcucaaggcgcaccagaacauccauuccgccgagaagcccuacgaauguaaagagugcggaaaggcuuuucggcacgccaccucucugaucuaucaugauagaacacacgcuggcgagaaaagcuacgaauguaaggagugcggggaaaccuucucccaugccucucaccugauuauccacgagcgcauucauacgagcgacaaacccuacgaaugcaagcgguguggaaaggccuuucacugcgcuuccuaucucguuagacaugagagcgugcacgcggauggcaauccuuacaugugugaggaaugcgggaaagccuucaacucuucccacgagcugagcauccaucaccgcguccauacaggcgaaaagccguucaaauguaauaagugccggagaucuuuucggcuucgcuccauucuggaggugcaccagagaauccauaucuga

SEQ ID NO: 78262 - RNA, 4539 nt, Artificial Sequence
  derived and/or modified sequence opt5 from ZNF608__Homo_sapiens__NP_065798
augagcgugaacaucuccaccgccggcaagggggucgaccccaauacaguugauacguacgacucuggagaugacugggagauuggcguggggaaccugaucauugaucucgacgcugaucuggaaaaagacagacagaaguucgagaugaauaacagcaccacaaccacauccucuagcaauuccaaagauugcggaggcccugccucuagcggggcgggagcuaccgccgcccuugcugacggccugaaguuugccuccgugcaagcuagcgccccgcagggcaacucucacaaagaaacauccaagagcaaggucaaacggucuaagaccuccaaagaugcgaauaagagccuccccucugccgcucuguaugggaucccugagauuuccagcacgggaaaacgccaggaagugcagggcagacccggggaggccaccggaaugaacuccgcucuuggccaaucuguuagcuccgggggaagcggcaauccuaacucuaauuccacaagcaccucuacaagcgccgcgaccgccggcgcuggguccuguggaaagucuaaggaggaaaaacccggcaagagccaguccagccgcggggccaaacgggacaaggaugcuggaaaaucuagaaaggacaaacaugaccugcuccagggccaccagaacggguccggaagccaagccccuucuggcggccaucuguacggguucggagccaaguccaauggcgggggagcuagcccguuucacugcggcgggacgggcuccggaucuguggcggccgcuggcgaggucagcaaguccgcccccgauucugggcugaugggaaacagcaugcucgugaaaaaggaagaggaggaagaggaaucccaucggcgcaucaaaaagcugaaaacagagaagguugacccucuuuucaccgugcccgccccucccccgccuaucagcagcucccugacaccccagauucucccuagcuauuuuucucccuccagcucuaauaucgcugcccccgucgaacagcugcuugugagaacccggagcgugggcgucaacaccugugagguugggguggugacagagccugaaugccugggaccgugugagcccggcacguccgucaaccucgaagggauuguguggcacgagaccgaagagggcguucugguggucaaugugacauggcgcaacaagaccuacguuggaacacugcucgauugcaccaaacacgacugggcgccucccagauucugugagagcccuacgucugaucuggaaaugcggggcgggcgcggaagaggcaagcgggcucgcuccgccgccgcugcccccgggagcgaggcuuccuuuacagaaucuagaggacuucagaauaaaaaccggggcggggccaauggcaagggaagacgcggcagccugaacgcguccgggcggagaaccccgccuaauugcgccgcugaggacaucaaagccucucccagcuccaccaacaagcgcaagaauaaaccucccauggaacucgaucugaacucuagcuccgaggacaauaagccuggaaaacgggugagaacaaacagccgcucuacccccacaacgccgcaaggcaagccugagaccacauuccuugaucagggguguuccagccccguccugauugacugcccccauccuaauuguaacaaaaaguauaagcacaucaauggacuccgguaccaucaggcucacgcccaccuggauccggaaaacaaacuggaguuugaacccgacucugaggacaagauuuccgauugcgaggaaggccucagcaacguggcgcuggagugcucugaaccuuccaccagcgucuccgccuaugaccaacuuaaagcucccgccagcccuggggcuggcaaucccccuggaacacccaagggcaaaagagagcugaugucuaacgggccgggaagcaucaucggcgccaaggccgggaaaaauuccggaaagaagaaaggccucaacaaugaacugaacaaucuuccugugauuucuaacaugaccgcugcgcuggauagcuguuccgccgcugacggcucucucgccgccgagaugcccaagcuggaggcugaagggcugaucgauaaaaagaaucucggagacaaagagaagggcaagaaagccacgaacugcaagaccgauaaaaaucugagcaaacuuaaguccgcgcgcccuauugcucccgccccggccccuacacccccucagcugaucgcuauucccaccgccacauucaccacgacaaccacagggaccauccccggacucccuucucugaccacaacgguugugcaggcgaccccgaagucucccccucugaagcccauccagccuaaacccacaauuaugggcgaaccuaucaccgucaacccggcucuugugucccucaaggacaaaaagaaaaaggagaagcggaaacugaaggauaaagaagggaaggagacaggaagccccaaaauggacgccaagcugggcaaacucgaggauucuaagggcgccuccaaggaccugccugggcauuuucuuaaagaucaccugaauaagaacgaaggacucgcuaauggccugagcgagucucaagaauccagaauggccagcauuaaagcugaggccgacaagguuuacaccuucacggacaacgcgcccuccccuucuaucgggagcgccucccgccuggaauguagcacacuugugaacggacaggcucccauggccccgcuccauguccugacccagaauggcgcugagucuuccgccgccaaaaccagcucuccugcuuacagcgauauuuccgacgcggccgaugacgggggaucugauagccgguccgagggcaugagaucuaaggcuagcucccccagcgacaucaucucuuccaaggauagcguggugaaaggccacuccucuacaaccgcccagagcucccaacugaaggaaucucauagccccuauuaccacuccuaugacccuuacuauagccccucuuacaugcacccugggcagguuggagccccggcugccggcaacuccgggagcacacagggaaugaaaauuaagaaagagucugaagaggaugcggagaagaaggacaaagcugaacagcucgauuccaagaaagucgaccauaauagcgccucucugcaaccccagcaccagagcgugaucacgcagcggcauccugcccuugcucaaucccuguauuacggccaguacgccuaugggcucuacauggaucagaagucucugauggcgaccagccccgcuuaucgccaacaguacgagaaauauuacgaagaccagagacuggccgagcagaagauggcccaaacaggacggggcgacugcgaaagaaaguccgagcuuccucucaaagagcugggcaaggaagagaccaaacagaagaacaugcccagcgcuacaauuuccaaagccccgucuaccccugaacccaauaagaaccacagcaagcuggggccuuccgugcccaauaaaacggaggaaaccggaaagucucagcuccugagcaaccaccagcaacagcuucaggcugauuccuuuaaagccaagcagauggagaaucaucaacugaucaaagaggcggucgaaaugaagucugugauggacagcaugaaacagacaggcguugauccuaccucccgcuucaagcaggaccccgauagccggacauggcaccauuauguguaccaaccgaaguaccucgaccagcagaaaucugaggaacuggauagagagaagaaacugaaggaagacuccccucgcaaaacccccaacaaggagagcgggguccccucucuuccugugucccucacaagcauuaaggaggaaccgaaagaggccaagcaccccgauucucaguccauggaagagagcaaacugaagaaugacgauagaaaaaccccuguuaacuggaaggacucccggggaacgcgcguggcugucagcucucccaugagccaacaucaguccuauauccaguaccugcacgccuauccuuacccccagauguaugacccuucucacccggcuuacagagccgugagccccguucucaugcauuccuauccuggcgccuaccugucucccggguuccacuacccuguguauggaaagaugagcggccgggaggaaacagagaaagucaauaccucccccucugugaacaccaagacaaccacggaaagcaaagcucuugaucugcuccaacagcaugcgaaucaguaccgcuccaagagcccggccccuguggagaaagcuacagccgaaagagagcgggaggccgaacgcgagagagaccggcacucucccuuuggccagcgccaucugcacacccaccaucacacacaugucgggaugggauauccccugauuccuggccaauacgaucccuuccaggggcuuaccuccgcugcccugguugcgagccaacagguggcugcccaggccucugcuuccggaauguuuccuggccagagacgggaauga

SEQ ID NO: 78263 - RNA, 2229 nt, Artificial Sequence
  derived and/or modified sequence opt5 from ZNF615__Homo_sapiens__XP_011525128
augaugcaggcccaagagagccugacccucgaagacguggcugucgauuucacaugggaggaauggcaguuucugucccccgcccagaaggaccuuuacagagauguuaugcuggagaacuauucuaaucucguggcggugggcuaccaggcuagcaaaccugacgcccuguccaagcuggaaagaggggaggagacgugcaccacagaagaugagaucuauucucgcauuuguagcgacuccggaggcgccucugggggagcuuacgccgaaaucagaaaaauugaugacccgcugcaacaccaucuccagaaccagagcauccagaaguccgucaaacaaugccacgagcagaauauguucggcaacauugugaaucagaacaaggggcauuuucugcugaagcaggauugugacaccuucgaucuccacgagaaaccccuuaagagcaaucuuucuuuugaaaaccaaaaacgguccagcggacugaagaauagcgcugaguucaaccgcgacggcaaaucccucuuucaugccaaucacaagcaguucuauacagaaaugaaguuuccugcgaucgccaaacccaucaacaagagccaguucauuaaacaacagagaacccacaauaucgagaacgcucauguuugcucugaauguggcaaggccuuucugaaacuuucccaguucauugaucaccagcgggugcauacaggggagaagccucacgucugcagcauguguggaaaggcuuuuucccgcaagucuagacugauggaccaccaacggacccauacggagcucaagcacuacgaaugcaccgagugugacaaaacauuccugaagaaaagccagcugaauauccaucagaagacccacaugggcgggaaacccuauacaugcucccaguguggaaaggccuucauuaagaaaugccgccucaucuaccaucaaagaacccacacgggcgaaaagccucacgggugcagcguguguggaaaagcguuuucuacaaaguucucccugaccacacaucagaaaacccacaccggcgagaagccguacauuugcagcgaauguggcaagggguuuaucgagaaacggcgccuuacagcccaucacagaacgcacaccggagagaagcccuucaucugcaacaaauguggcaagggguuuacacugaaaaacucucucauuacccaucagcagacacacaccggagaaaagcuguauacgugcagcgaguguggcaagggguucuccaugaaacauugccuuaugguucaccaacggacacauaccggagaaaagccuuacaaauguaaugagugcggcaagggcuuugcucugaaaucuccccucauccgccaccagagaacccacacaggggaaaagccuuauguguguaccgagugccggaaaggauucacaaugaagucugaucugauuguccaucagagaacgcacaccgccgagaagcccuacaucugcaacgacuguggcaaaggguuuacagugaagucccgccugauugugcaucagcggacccacacaggagaaaaaccguaugucugcggcgagugugggaagggcuucccugcuaaaaucagacucaugggacaucaacgcacccacacgggcgaaaagcccuacaucugcaaugagugugggaagggauuuaccgagaaaagccaccugaacguucaucggagaacacacaccggcgaaaagccuuaugugugcucugagugugggaaaggacuuacaggcaaguccaugcugauugcccaucagcgcacccacacgggggaaaaacccuacaucugcaaugaguguggcaagggauucacaaugaaaagcacccucucuauucaccagcaaacacauaccggcgaaaaacccuacaagugcaacgagugugauaaaaccuuucggaagaaaacaugccugauccagcaccagagauuccauacggggaagaccuccuucgccugcacagaguguggaaaguuuagccuucgcaaaaaugaccugauuacccaccagcggauccauacaggcgaaaagccuuauaaaugcuccgauugugggaaggcuuucaccacgaaaucuggacucaacgugcaccaaagaaagcacacaggcgagcgcccguacgggugcagcgacuguggcaaagcguuugcccaucuguccauccuggucaagcaccggcggauucaucgguga

SEQ ID NO: 78264 - RNA, 2586 nt, Artificial Sequence
  derived and/or modified sequence opt5 from ZNF618__Homo_sapiens__NP_588615
augaaccagcccggcggggccgcugccccucaagcggacggagcuagcgccgccggcagaaaguccaccgcuucucgggagcgccugaagagaagccagaaguccacaaaaguggaagggccggagcccgucccugccgaagcuagccucagcgccgagcagggaacgaugaccgaaguuaaggugaaaacagagcugcccgaugacuacauccaggaggugauuuggcaaggcgaagcgaaggaggaaaagaaagccgucuccaaggaugggaccucugacgugccugcugagaucugcguugugauuggaggcguccggaaucagcagacacuuggcagcuaugagugugggaucugcggaaagaaguacaaauauuacaacuguuuccagacccacgugcgcgcccauagagauacagaagcuaccuccggcgagggggccagccaaucuaauaacuuucgguauacgugcgacauuuguggaaagaaguacaaauauuacuccugcuuccaggaacaccgcgaucugcaugcgguugacguguuuagcgucgagggcgcccccgaaaauagagcugauccuuucgaccagggggugguggccaccgaugaggucaaggaggaaccgcccgagccuuuucagaaaaucggacccaugaacaauaucacaucugacauuuucaagaaaaaggaaguucggcaaugucagaaacgcgagaccggcaacuacacaugcgaauuuuguggcaagcaguauaaguacuauaccccuuaccaagagcacguggcucuccaugcccccaucaaauccgccuucagcagacggguggaggggaaggcucagaaucacuuugaagagacgaacucuuccagccaaaauuccucugaaccguauacaugcggagcguguggcauucaguuccaguuuuacaacaaucugcuugagcacaugcagagccaugccgcugauaacgaaaauaacaucgccuccaaccagagccgcucuccucccgccgucguggaggagaaauggaagccucaggcucaaagaaauuccgccaacaauaccacaaccagcgggcugacccccaacucuaugauucccgaaaaagagcggcagaauaucgcggaacgccuccugagaguuaugugcgcugaccugggagcccucagcguggucuccggcaaggaguuccugaagcuggcccagacacugguggacucuggggcucgguauggagccuuuagcguuacggagauucucggcaacuucaauacccuggcucuuaaacaccuuccuagaauguacaaccaggugaaggucaaagugacaugcgcccucggcuccaaugcgugucuggggaucggagugaccugccauagccaaucugucggcccggauuccuguuacauccugacagccuaucaggcugaagggaaccacauuaagagcuacguucucggagugaaaggcgccgacauccgcgauucuggggaccugguccaccauugggugcagaauguucuuuccgaguucgugaugagcgaaauucggaccgucuaugugacggauugcagaguguccacaucugcuuuuagcaaggccggcaugugucugcgcugcuccgcgugugcccucaacucuguuguccagagcgugcuguccaagcggacccuucaagcuagaagcaugcacgaggugaucgaacugcucaaugucugcgaggaccuggccggaucuaccggccuggcuaaagagacauucgggucccucgaagagaccucucccccucccuguuggaacucugugacagauucccugcuucugguucaugaacgcuacgagcagauuugcgaauuuuauagccgggccaagaaaaugaaucucauccagucucugaacaagcaccuucugagcaaccucgccgcuauccugacgccugugaaacaagcggucauugagcuguccaaugagagccagcccacccuccagcuggugcuuccgacauacguuagacuggaaaaacucuucaccgccaaggcuaacgacgccggaacagugucuaaacugugucaucuguuucuugaggcccucaaggaaaauuucaaaguccacccugcucacaagguggccaugauccuggauccccagcaaaaacugcgcccuguucccccuuaucagcaugaggaaauuaucggcaaggugugcgagcucauuaacgaggucaaagaauccugggcggaggaagcugacuuugagcccgccgccaagaagccgcggagcgcugccguggagaauccugcggcucaggaagaugacagacuggggaaaaacgagguguacgacuaccuucaggaaccccuguuccaagccacccccgaucucuuucaguauugguccugcgucacgcagaagcacaccaaacuggccaagcuggcuuucuggcuucucgccguuccugcugugggagcccgcucuggcugugugaauaugugcgagcaggcgcugcugaucaaacggagacggcuccugagcccggaagacaugaacaaacuuauguuucugaaguccaauaugcucuga

SEQ ID NO: 78265 - RNA, 1386 nt, Artificial Sequence
  derived and/or modified sequence opt5 from ZNF627__Homo_sapiens__NP_660338
auggacagcguggccuucgaggaugucgcuguuaacuuuacccuggaagagugggcccuccuggaccccucccagaagaaucuuuacagagaugugaugcgggaaacauuccgcaaccuggcgucugugggcaaacaaugggaggaccagaauaucgaagauccuuuuaagauuccgagacggaacaucagccacauucccgagcgccucugcgaguccaaagaagggggacagggcgaggaaacguucucucagaucccugacgggauucugaauaagaaaacccccggagucaagccuugugagagcuccgugugcggcgagguugggaugggacccucuagccuuaacagacauauccgggaucacacaggccgcgaaccuaaugaguaucaagaauacggcaagaaauccuauaccagaaaccagugugggcgggcucugagcuaccaucgcucuuuuccggugagagagcggacacaccccggaggcaagccuuaugacugcaaagaauguggggagaccuucaucucccucgucagcauucgcagacauaugcugacacaccggggaggcgugcccuacaagugcaaaguuugugggaaggccuuugauuauccuucucuguuccgcauccacgagagaucccauaccggagaaaagcccuacgagugcaaacaguguggcaaggccuuuagcuguucuuccuacauucggauccacgaaagaacgcauaccggcgacaaaccguaugagugcaagcagugcgggaaggcuuucagcugcuccaaauacauucgcauccacgaacggacacacaccggagagaaaccuuaugaguguaagcaaugcggcaaggccuuuagaugugcuucuagcgugcgcucccaugaacggacacacaccggggagaaacucuucgaaugcaaggaguguggaaaagcccugacgugccuugcgagcgucagacgccauaugauuaagcacacaggcaaugggcccuacaaauguaaggugugcggaaaggccuuugauuucccuucuuccuuccggauccaugaaagaacccacacaggcgagaaacccuaugacuguaagcagugcggcaaggcuuuuagcuguucuagcuccuuccgcaaacacgagcggauccauaccggggaaaaacccuacaagugcaccaagugcggaaaagccuuuucuagaagcuccuauuuccgcauucacgagcggacacauacgggcgaaaagccuuacgaguguaaacagugcgggaaggcuuuuagcagaucuaccuacuuccgggugcacgagaaaauccacacaggagaaaagccguaugagaaccccaauccuaacgccuccgucguucccgugcugagcuga

SEQ ID NO: 78266 - RNA, 2610 nt, Artificial Sequence
  derived and/or modified sequence opt5 from ZNF629__Homo_sapiens__NP_001073886
auggagcccgaaaccgcccuguggggcccugaccuccaggggccggagcaaagccccaacgaugcucacagaggagccgaauccgagaaugaagaggagucuccucggcaggaaagcuccggcgaggaaaucauuaugggggaccccgcgcagucuccugagagcaaggauuccacagagaugucucuggaacgcagcucccaggaccccagcgugccucaaaacccgcccacgccucuuggacauucuaauccccuggaucaccagaucccucucgaucccccggcuccugaggucguucccaccccuuccgacuggacaaaagccugcgaagccagcuggcaguggggcgcucugaccacauggaacucuccucccguggugcccgccaaugagccgucccuuagagaacugguccaggggcggcccgcuggagccgagaagccuuacauuuguaacgagugcggcaagagcuucucucaaugguccaaacuccugcgccaucagagaauccacaccggcgaacggcccaauacauguagcgagugcgggaaauccuuuacccagucuagccaucuggugcagcaccaacgcacgcacaccggagaaaagccuuauaagugucccgacugcggcaaauguuucuccuggagcucuaaccucguucagcaucagagaacacacaccggggagaagccguacaaaugcacagaaugugagaaggcguuuacccaauccacgaaucugauuaaacaucagcggagccacacaggagagaagccuuauaagugcggcgaaugucgcagagccuucuaccggucuagcgaucuuauccagcaccaggcuacccauacaggggagaaacccuauaagugcccugaaugcggaaaacgcuuuggccaaaaccacaaucugcucaagcaucagaaaauccacgccggcgagaagcccuacagauguaccgaaugcgggaaauccuucauucagucuagcgagcugacccagcaucaacggacacacacgggagagaagccuuaugaaugucuugagugcggcaaguccuuugggcacagcucuacccugaucaaacaucagcgcacacaccucagagaagaccccuucaaguguccggugugcggaaaaaccuuuacacuguccgcuacccugcuccggcaucagagaacgcacacaggcgagcgcccuuacaagugucccgagugcgggaaaucuuucucugucuccagcaaccugauuaaucaccagcggauccauagaggagaacgccccuacauuugugccgauugcggcaaguccuuuaucaugucuagcacccuuauucggcaccaaagaauccauaccggcgagaagccuuauaaauguuccgacugcgggaagucuuucauccgcagcucccaccugauucagcaucggagaacacacaccggagaaaaaccguacaagugccccgaguguggcaagagcuuuucucaguccagcaaccucaucacacacgugcgcacgcauauggaugaaaaucuguucguuugcucugacugugggaaagcguuccuugaggcccacgagcuggaacagcaucgggugauucacgagagaggaaagaccccugcucgccgggcccaaggcgacucccuccuggggcugggcgaucccagccuccugacaccucccccuggagcuaaaccccauaagugccuugucuguggcaaaggguuuaacgacgaaggaaucuucaugcagcaccagcggauucacaucggcgagaacccguauaagaaugccgaugggcugaucgcccaugcugcgccuaaacccccucaacucagaucuccccgccugccguuuagaggaaacagcuacccuggcgccgcugaagggcgggccgaggcccccggccagccucuuaagccucccgagggacaggaaggcuucucccagagacgcgggcugcucagcucuaagaccuauauuugcucccacuguggagagagcuuucuggaccgguccgugcugcuccaacaucagcugacacacggcaaugaaaaacccuuccuuuuuccggauuacagaaucgggcugggagagggcgcugggcccucuccuuuccucagcggcaagcccuuuaaaugcccugaauguaagcaguccuucggacugucuagcgagcugcuucuccaccagaaagugcaugccggcgggaaguccucucagaaaagccccgagcugggaaaguccagcucuguccugcucgaacaucugcgcuccccucuuggcgcgagaccguaucggugcagcgacugucgcgcuucuuuucuggauagaguugcccucacccggcaccaagagacgcacacccaggaaaagcccccuaaccccgaggacccucccccggaggccgugacacuguccaccgaucaggaaggggagggagaaacaccuacccccacggagagcagcucccauggcgaagggcaaaaucccaaaacacugguggaggagaagccuuaccuuugccccgaaugcggcgcuggauucaccgaggucgccgcucuccugcugcaccgcagcugucacccuggcgugucccucuga

SEQ ID NO: 78267 - RNA, 1458 nt, Artificial Sequence
  derived and/or modified sequence opt5 from ZNF639__Homo_sapiens__NP_001290355
augaacgaguaccccaagaaaagaaagcggaaaacccugcacccuagccgcuauuccgacucuagcggcaucuccagaauugccgauggguucaauggaaucuuuucugaccauugcuacagcguguguuccaugcggcagccggaucucaaguauuucgacaacaaagaugacgauucugacacagaaacgagcaaugaucugcccaaguuugcugacggcauuaaggcccgcaacagaaaucaaaacuaccuugucccuucccccguucugcggauccucgaucacaccgcguucagcacagagaaaucugcugacauugugaucugcgaugaagagugugacuccccugaaagcgugaaucagcagacccaggaggagucucccaucgaaguccauacagccgaggacgugccuauugccguugaagugcacgcuaucuccgaggauuaugacauugagaccgaaaacaauagcucugagucccugcaagaucagacagacgaggaaccgcccgccaagcugugcaaaauccuggauaagagccaggcucucaacgucaccgcccagcaaaaauggccucugcugcgcgccaauuccucugggcucuacaagugugaacugugcgaguuuaacagcaaguauuucuccgaccuuaaacagcauaugauucugaagcacaaaagaacggauagcaaugugugucggguuugcaaggagucuuuuuccaccaacaugcuccugaucgaacacgcgaaacuucaugaggaagaccccuacauuuguaaguacugcgauuauaaaacagugaucuucgagaaucugagccagcacaucgcugacacccauuuuucugaucaccucuacuggugugaacagugcgacguccaauucagcuccucuagcgagcuguaucugcacuuucaggagcauuccugcgacgaacaguaccucugucaauucugcgagcacgaaacaaacgauccugaggaccugcauagccacguggugaacgaacaugccuguaaacuuauugagcugucugauaaguauaauaacggagagcacggccaguacucccuccugagcaagaucaccuuugacaagugcaaaaauuucuucgucugucagguuugcggguuucgcucuagacuucacacgaacgugaaucggcauguggcuauugaacacacaaagaucuucccccaugucugugaugacugcggaaaaggcuuuuccagcaugcuggaguauuguaagcaccucaacucccaccugucugaaggcauuuaccugugccaguacugugaguauagcaccgggcaaaucgaggaucucaagauccaucuggacuucaaacacuccgccgaucuuccgcauaagugcucugacugccugaugcgcuuuggaaaugaaagagagcucauuagccaccuuccugugcaugaaacaaccuga

SEQ ID NO: 78268 - RNA, 4107 nt, Artificial Sequence
  derived and/or modified sequence opt5 from ZNF644__Homo_sapiens__XP_011540563
augagauccuuccugcagcaagacgugaacaagaccaaaucccggcucaauguccugaacggccuugccaauaacauggaugaccugaagaucaauacagauauuacgggggcuaaagaggaacuccuggacgauaacaauuuuaucucugacaaggagagcggaguucacaaacccaaggauugccagaccuccuuccagaagaacaauacacuuacccugccugaggaacucucuaaagacaagagcgaaaacgcccuguccggcgggcagucuagccuguuuauucaugcgggagcuccgacaguguccagcgagaauuucauccuccccaaaggcgccgccgugaacgggccugucucucacuccagccugaccaagacaucuaauaugaacaaaggauccgugagccuuaccacgggccaacccguugaucagccuaccacagagucuuguuccacccugaagguggcugccgaccuccagcugagcacaccccagaaggcuucccaacaucagguccuuuuucugcucucugauguggcccacgcgaaaaauccuacccauagcaacaagaaacugccgacguccgccagcguuggcugcgacauucagaacucugugggguccaauaucaagagcgauggaacacugaucaaccaggucgaagugggcgaggacggggaagaccuccuggugaaagaugacugugucaauaccguuacaggaauuucuagcggcaccgauggguuccgcuccgagaacgacaccaauugggauccccaaaaggaguuuauccaguuccuuaugacaaacgaagagacgguggacaaagcuccuccccacucuaagauuggacuggaaaagaaaagaaagcggaaaauggaugugagcaagaucacccgcuacacagaggacugcuuuuccgauagcaauugugucccuaacaaaucuaagaugcaggaaguggacuuccucgagcaaaaugaggaacugcaggccguugauucccagaaguaugcucuuagcaaagugaagcccgagucuaccgacgaagaccuggaguccgucgaugccuuucagcaccucauuuacaacccggacaaaugcggcgaagagagcuccccugugcauacaucuaccuuccugagcaauacgcugaagaaaaagugugaggaauccgauucugagagccccgcgacauuuuccaccgaggaaccuagcuucuaucccugcaccaaguguaacguuaauuucagagaaaagaagcaccuccaucggcacaugauguaccaccuggacggcaacucucauuuucgccaccuuaaugugcccagaccuuaugccugccgggagugugggcgcacauucagagaucggaacucccugcucaaacauaugaucauucaccaagagcgcagacagaagcugauggaagagauccgggaacuuaaagagcugcaggacgagggacgcagcgcuagacuccagugcccgcaaugcgucuuuggcaccaacugucccaagacauucgugcagcaugccaagacgcacgaaaaagauaagcgguacuauugcugugaggaaugcaauuuuauggcugucaccgagaacgaacuggagugucacagagggaucgcccauggagccgugguuaaaugcccuauggugacaucugacauugcucagcgcaagacccagaaaaagacauucaugaaagauuccgucgugggcagcucuaaaaagagcgcgaccuacaucuguaaaaugugccccuuuacgaccuccgccaagagcguucugaaaaagcacacagaguaccuccauucuuccagcuguguggacuccuucgggucuccucugggacuugauaaacggaagaaugacauucuggaggaacccgucgauagcgacuccaccaagacacucaccaaacaacagucuacgacauuuccgaagaacagcgcucugaaacaggacgugaagagaaccuucggcuccacaucucagagcuccagcuuuucuaaaauccacaagcgcccucaccggauucaaaaggccagaaaauccaucgcccagagcggcgugaauaugugcaaccaaaauucuuccccucauaagaacguuaccaucaaaagcucugucgaucagaagcccaaauauuuccaccaggcugccaaggaaaaguccaaugcgaaagcuaacagccauuaccuguaucgccacaaguacgagaauuaucggaugauuaaaaaguccggggaaagcuaccccgugcauuuuaaaaaggaggaggccucuagccuuaacucccuccaccuguucucuagcuccucuaauagccacaacaauuucaucuccgacccucauaaacccgaugccaagagaccggaaucuuuuaaggaccaccgccggguggcugucaaaagagugauuaaggagagcaaaaaggaauccagcguuggaggcgaggaucuggacucuuauccugauuuccuccauaaaaugaccguggucgugcugcagaaacuuaacuccgccgaaaagaaagacagcuacgagacagaggaugaaucuuccugggacaacguugagcugggggauuacacgacccaggcuaucgaagacgagacauauagcgauauuaaucaagagcacgugaaccucuuuccccuguucaaguccaaagucgaaggacaggagcccggcgaaaaugccacccugucuuacgaccagaacgacggguuuuauuucgaguacuaugaagauacaggcagcaauaacuuucuucaugagauccacgacccucagcaccucgagaccgcggaugccucccugagcaagcauucuuccguguuccacuggacggaccugagccucgaaaagaagucuuguccguacugccccgcuacauuugagaccggaguuggccugagcaaucaugugcgcgggcaccuucaccgggccggacuguccuaugaagcuagacaugucgugucuccugagcaaaucgccaccagcgauaagaugcagcacuucaaacggacaggcaccgggacacccgugaagcgcgucagaaaagcgauugaaaaguccgagacgaccucugagcauacaugccagcucuguggaggcugguuugacaccaaaaucgggcugagcaaccacguucggggccaucugaagagacuuggaaagacaaaaugggaugcccacaaguccccuauuugcgugcucaaugaaaugaugcagaacgaggaaaaauacgagaagauccugaaagcucugaauagccgccggauuauccccagaccuuucguggcccaaaagcucgcuucuuccgacgauuuuauuagccagaacgucaucccccuggaagccuaccgcaauggccuuaagaccgaggcccuguccgugucugcuagcgaggaagaggggcucaacuuccugaaugaauaugacgagacgaaaccggagcugccuuccggaaagaaaaaccagucucuuacccucaucgaacugcugaagaacaaaagaaugggcgaggaacggaauagcgcgauuagcccccaaaagauccacaaccagacagcccgcaaaagauucguucagaagugugugcucccucugaaugaggauagcccccuuauguaccagccgcaaaagauggaccugaccaugcauucugggaugccugucaaacuccggacaugcgugcacuguaacaccacauuuaccuccgcuguuagccugucuaaucaucugcgcgccuaugccagaaagaaauccgcuggacuucugacgggcacagcccucgacugcaagcagaaaaagagccggucucgcagcggguccaagaaaaagaugcugacccucccccacggcgcggaugaaguguacauucugagaugucgguucugcggacuugucuuucgcggcccucugucugugcaggaggacuggaucaaacaccuccagagacauauuguuaacgcuaaucugccccggaccggggccggaaugguggaggucacaagccugcuuaagaaacccgccuccaucaccgaaacgagcuucucccugcucauggcugaggccgcgucuuga

SEQ ID NO: 78269 - RNA, 1278 nt, Artificial Sequence
  derived and/or modified sequence opt5 from ZNF645__Homo_sapiens__NP_689790
augaacaagaugcccgccggcgagcaggaaugcgaguacaauaaagaagggaaguauuacagcaaaggagucaagcugguccggaaaaagaagaaaaucccuggcuauagauggggagacauuaagaucaacauuaucggggagaaagaugaccucccgauucacuucugugauaagugcgaccugcccaucaaaaucuacggccgcauuaucccuuguaagcaugcuuuuugcuaucacugugccaaucuuuacgauaagguuggguauaaagugugccccagaugucgguacccugugcugcgcauugaagcgcauaagagaggauccgucuucaugugcucuaucgugcaacaguguaaacggaccuaccucagccagaagucccugcaggcucacauuaaacgcagacauaagcgggcccgcaaacaaguuacaucugccagccuugagaaggugagaccccacaucgcuccuccgcagacggagauuuccgacauccccaagcggcugcaggaucgcgaccaccucucuuauaucccucccgaacagcauaccauggucagccugccuuccgugcaacacaugcugcaggagcagcauaaccagccccacaaagauauucaagccccgccucccgaacucagccugucucuuccuuuucccauccagugggagacaguuuccauuuucaccagaaagcacggcaaucugacaguggaccauauccagaacaauagcgauucuggcgcuaaaaagcccaccccuccggacuacuaucccgagugccaaucccagccugccgucagcucuccccaccauauuaucccucagaaacagcacuacgcgcccccgccuucccccagcuccccugugaaccaucaaaugcccuauccuccccaggauguggucacacccaauucuguucggagccaggugccugcccucaccacgaccuacgaccccuccagcggguauaucauugugaaggugcccccugacaugaacucuccgccccugcgcgcuccucagucccaaaauggaaaccccagcgccucugaauuugcuagccaccacuacaaucuuaacauccugccucaguucacagagaaucaggaaacccucucuccccaguuuacacaaaccgaugccauggaccauagacgguggccugcguggaagagacugucccccuguccgccuacgcgcagcccgccucccuccacacugcacggccggagccaucacucucaccagagacgccaucggagauacuga

SEQ ID NO: 78270 - RNA, 5499 nt, Artificial Sequence
  derived and/or modified sequence opt5 from ZNF646__Homo_sapiens__NP_055514
auggaggacacacccccuagccuguccugcucugauugucagagacacuucccgucccuccccgaacugucccggcaccgcgagcuucugcacccuucucccaaccaagacagcgaagaggccgauuccaucccucggcccuaccggugccagcaguguggccgcggguaucggcacccuggaucucucgugaaucaccggcgcacccacgaaacgggccuguuucccugcaccacaugugggaaggacuucagcaaccccauggcucuuaaaucccacaugagaacccacgccccugagggacggcgcagacaucggcccccucgccccaaggaggcgacaccccaucugcagggcgaaaccgucagcacagauucuugggggcaaagacucggauccagcgagggcugggaaaaucagaccaaacauacggaggagaccccugacugcgaaucuguucccgauccucgggcugccuccggcacaugggaggaccugcccacccgccagagagaagggcuggccagccaccccggaccugaggauggcgcugacggguggggaccgucuacaaacuccgcccgggcucccccucuccccauuccugccagcucccugcuuucuaaucuggaacaguaccucgcggagagcguggugaacuuuaccggcgggcaagagcccacgcaguccccgccugccgaagaggaaagacgcuauaaguguagccagugcggaaaaacauacaagcacgcuggcucucugaccaaucaucggcagucccacacacuuggcaucuaucccugugccauuugcuucaaggaguuuagcaaccugauggcucucaaaaaucauucuagacugcacgcccaauaccgcccuuaucauuguccccacugcccucgggucuucagacugccccgcgaacuccuggagcaccagcagagccaugagggggaacggcaagagccgagaugggaagagaagggaaugccuaccaccaacggccacacagaugaauccucucaggaccagcuucccagcgcgcagaugcugaauggguccgccgagcucagcacgucuggagagcuggaagauuccggccuugaggaauaccgccccuuucggugcggggacuguggaagaaccuaccgccaugcuggcagccugaucaaccaccggaaaucucaccaaacaggcguguauccuugcucccucuguagcaagcagcuguucaaugccgcugcccugaaaaaccauguuagagcccaccaucggccgcgccagggggugggagagaauggccagcccuccgucccucccgcuccucuccugcuugcggagaccacacacaaggaagaggaagaccccaccacgacacuggaucauagaccuuacaagugcucugagugugggcgggccuauagacaccgcggaagccucgugaaccaccggcauucccacagaaccggcgaauaccaaugcucucuguguccccgcaaauauccgaaccuuauggcucugagaaaucauguucgggugcacugcaaggccgcccgcagaagcgcugacauuggggccgagggcgcgccuucccaucucaaagucgagcugcccccugaucccguggaagcugaggccgccccgcacaccgaccaggaucacguguguaagcaugaagaggaagcuacagacaucaccccugccgcugauaaaacagccgcgcacaucugcagcauuuguggacugcucuuugaggacgccgagucucuggaacggcauggccuuacgcacggggcuggagagaaggaaaacucccgcaccgagacaaccaugucucccccuagagccuucgcuugccgggauugcggcaaauccuaccgccacuccgggagccugaucaaucauagacagacacaccagaccggagacuuuucuuguggcgccugcgcgaagcauuuccacacgauggccgcuaugaagaaccaucuccggcgccacagcagacggagaucccgccggcacagaaaacgcgccgggggcgcuagcggaggccgggaagccaagcugcuggccgcugagucuuggaccagagagcuugaagauaaugaggggcucgaaagcccccaggaccccagcggagaguccccucauggcgcggaggggaaccuggaaucugacggagauugucugcaggccgagagcgaaggcgacaaaugcgggcucgagcgcgaugaaacacacuuucagggcgacaaggaguccggaggcaccggggagggacuggaacggaaagaugcuucucuucuggacaaucucgauauuccgggcgaggaagggggaggcacacauuucugugacagccugaccggggucgaugaggaccagaagcccgccacgggccaaccuaacuccucuagccacuccgccaaugcuguuacaggauggcaggccggcgcggcucauaccugcagcgauugugggcauucuuucccccacgccacaggacugcuuucccauagaccuugccaucccccuggcaucuaucaguguagccucugcccgaaggaauuugacucucugcccgcccugcgcucccauuuccaaaaccaccggccuggggaggcuaccagcgcccagcccuuucucuguugccugugcggaaugauuuucccuggcagagcgggcuaccggcuucaccgcagacaggcucauucuuccagcgggaugaccgagggauccgaagaggaaggcgaggaagaggggguggccgaggccgcucccgcccggagcccgccucugcagcucucugaagcugagcugcugaaucaacuucagcgcgaaguggaggcccucgauagcgcgggauacggccacaucugugggugcuguggacagacauaugacgaccugggcucccuggagagacaucaccagucucaaagcuccggcacgaccgccgauaaagcucccucuccccucggggucgccggagacgcuauggaaauggugguugauagcgugcuggaggacauugucaacuccgugucuggcgaagggggagaugccaagagccaggagggcgccgggacaccucuuggagacucccugugcauccagggcggcgaaagccuccuggaggcucagccccggccuuuuagauguaaucaaugcgggaaaaccuaccgccacggaggcucucugguuaaccaucggaagauccaccagacaggggauuuccuuuguccggugugcuccagauguuaucccaaucucgcggccuaccgcaaccaucugcggaaccacccuagaugcaaaggaagcgagccccaggucggcccuauucccgaagcugccgggucuuccgagcugcaagugggaccgaucccugaaggcggcagcaauaagccccagcauauggccgaggaagggccuggacaggcugaggucgagaagcuccaggaagaacugaaaguggaaccccuugaggaaguugcccgcgugaaggaggaggucugggaagagaccacggugaaaggcgaagagauugagccucggcuggaaacagcggagaaggggugucaaaccgaggcuuccucugagagacccuuuagcugcgaaguuugcggacgcuccuauaaacacgccggcagccucaucaaccacagacagucucaucagaccgggcacuucggaugucaggccugcuccaagggcuuuagcaaucugaugucucugaagaaccaucggcgcauucacgcugacccgagacgguuccgcuguagcgagugcggcaaagccuuuagacuucggaagcaacuggcgucccaucagagagugcacauggagcgcagagggggaggcgggacaagaaaagcuacccgcgaagaucggccuuucagauguggacagugcggccggacauaccgccacgccgggucucuccugaaucauagacggagccacgagacgggacaguauuccuguccgaccugccccaagacauacucuaaccgcauggcccucaaagaccaucaaagacugcacagcgaaaaucggcgcagacgggcuggccgcuccagacggaccgccgucagaugugcucuuugcggccgcagcuuuccugggcggggaucucuggagagacaccuccgcgaacaugaggagacagaacgggagccggccaacggccaagggggacuggauggcaccgcggccuccgaagcuaaucugacggggagccagggacuugagacccagcugggcggcgccgaacccgugccucaccucgaggacggggugcccagaccuggagagcgcucccaaucucccauccgggcugccagcuccgaagccccugagccgcugucuuggggcgcugggaaggcgggaggcuggcccguugggggcggacucggcaaccauagcgggggaugggucccucaguuccugacaagauccgaagaacccgaggauagcgugcaccgcucuccuugucaugccggcgacugccagcuuaaugggcccacccugucccacauggacagcugggauaaccgggacaauucuucccaacuccagccgggaagccacucuagcugcucccaguguggcaaaacauacugccagucugggagccugcugaaccauaauaccaacaagacagauagacacuauugucuucugugcuccaaggaguuccucaacccuguggcuaccaaaagccauucccacaaucacaucgacgcccaaacguuugccugucccgauugcggcaaggcuuucgagucucaucaggaacuggccagccaccuccaggcgcaugcucgcggacacucccagguccccgcccaaauggaggaagcccgggacccuaaagcuggcacaggggaggaucaggugguucugcccggacagggcaaggcccaggaggcgccuucugaaaccccgagagggcccggagagagcguggaacgcgccagaggcgggcaagcugucaccuccauggccgcugaggacaaagaacggccuuuucgcuguacacagugcggcagaucuuaccggcaugccggaagccuucugaaccaccagaaggcucacaccacgggccuguaucccuguucccucugcccuaagcugcuucccaaucugcucagccugaaaaaccauucuagaacacacaccgauccgaagcggcauuguugcuccauuugcgggaaagccuuccgcacagcggccagacucgagggacacggccgggugcaugcuccucgcgaggggcccuuuaccuguccucacugccccagacacuuccggcgcagaaucagcuuuguucaacaucagcagcagcaccaagaagaguggacaguggccggaucuggcgcuccugucgcccccgugaccggcagaggggaccugccgcuuccuccgcccccuacgccgaccacaccccugcuggauccuagcccccaguggccugccgaccucagcuucucucuguga

SEQ ID NO: 78271 - RNA, 1821 nt, Artificial Sequence
  derived and/or modified sequence opt5 from ZNF652__Homo_sapiens__NP_001138837
augagccacaccgccuccucuugccaggagcugguggaaaacugugcuguccauguugccggcauggcgcaagaggacagcagacggggacaggugcccuccucuuucuaccacggagcuaaucaggaacucgaucugagcacaaagguguauaaacgcgaguccggcucuccuuacagcguccuuguggacacgaagauguccaaaccgcaucugcacgaaaccgaggagcagcccuauuuuagagaaacacgggccguuagcgaugugcaugccgucaaggaggaccgcgaaaacucugaugacaccgaggaggaagaggaagagguguccuacaaaagagaacaaaucaucguugaggugaaucucaacaaucagacacugaacgucagcaagggggagaagggagugucuucccagagcaaagaaaccccugugcuuaagacaucuuccgaggaagaggaagaggagagcgaagaggaagcuaccgaugacuccaaugauuauggcgagaacgaaaaacagaagaaaaaggagaagaucgucgagaaaguuucugugacgcaacggcgcaccagacgggccgcuagcguggccgcggccacaaccucccccacaccucgcaccacgagagggcggcgcaagagcgucgaacccccuaaaagaaagaaacgggcuacaaaggagccgaaagcccccgugcagaaggcuaagugcgaagagaaagagacccugacaugugaaaagugcccucgcguuuucaauaccagaugguaccucgagaaacacaugaacgugacccaccggagaaugcagauuugugacaagugcgggaaaaaguuuguccuggaaucugagcugucccuccaucagcaaacagauugugaaaagaauauccagugcgugagcuguaacaaaucuuucaagaaacuguggagccuucacgagcauauuaagaucguucacggcuaugccgagaaaaaguuuuccugcgaaaucugugagaagaaauucuacacgauggcgcacgugcgcaagcauauggucgcccacaccaaagacaugcccuuuacaugcgaaaccugcggcaagucuuucaaacggagcaugucccugaaggugcauagccuccagcacucuggggagaagccuuuuagaugugaaaauugcgaugagcgcuuccaauacaaauaucagcugcggucccauaugagcauucacaucggacacaagcaguuuaugugucaguggugcggcaaagacuucaacaugaagcaauacuuugacgagcauaugaaaacacacaccggggaaaagcccuucauuugugagaucugcggaaaaucuuucacguccagaccgaauaugaagcgccaucggagaacacacaccggcgaaaagccuuaucccugugaugucugcgggcagcgcuuucgguucagcaacaugcuuaaagcucacaaggagaaauguuuuagagugaccuccccuguuaacgugccucccgccguccagauuccccugacaaccucuccggcuacacccgugccuagcguugugaauacggccaccacacccaccccucccaucaacaugaauccggucuccacacucccuccccgcccuauuccccauccuuucucucaucugcacauccacccccauccgcaccacccucaucaccuccccauucccccugugccgcaucugcccccucccccugcccuguuuaagagcgaaccccuuaaccaccggggacaguccgaggacaauuuccugagacaucucgcugagaaaaacagcucugcgcaacaccacuga

SEQ ID NO: 78272 - RNA, 1746 nt, Artificial Sequence
  derived and/or modified sequence opt5 from ZNF654__Homo_sapiens__NP_060763
augcugugcaacaaggaguuccucggcgggcacaucgugagacaugcccaggcucaccagaaaaagggaucuuuugccugugucauuugcggccggaaauuccgcaauagagggcugaugcaaaagcaucuuaaaaaccacguuaagaagauccagcggcagcaaauugcggcugcccagcaggacgaucaggaagugaccgcccuggaggaaaucaauuguuccucuagcuccauuucuuuugagaacggaaauagcgacuccaaagaucucgaaguggagacacugacggcuucuagcgagggcaacaaggaagucauccccgagcauguggccgaguucaucgaaauuccuaucuccguuccggaggacgugauugaaaaugucaucgagaacgggagccccaauaacucucuuaauaacguguuuaaaccucugaccgaaugcggagaugacuacgaggaagaggaggaugaagagggcgacuaugaagaggaugacuacgaucucaaucaagaaacauccguuauucacaagaucaacggcaccgugugucaccccaaagacauuuaugcuacagaucaggaggggaauuucaagugcccugcccugggauguguccgcaucuuuaagagaaucggcuuccugaacaaacaugcgaugaccgugcaccccacagaccucaacgugcggcagaccgucaugaaguggagcaaagggaagugcaaauuuugucagcgccaauucgaggacucucagcauuuuauugaucaccugaauagacacuccuacccuaacguuuauuucugccuucauuuuaauuguaacgagagcuucaagcugccguuccagcucgcccaacacacgaaaucucaucggaucuuucaggcucagugcuccuuccccgaaugccacgaacuguuugaggaccuuccucugcucuacgaacaugaggcccagcacuaucugagcaagacccccgaguccucugcucaaccuagcgaaacaauucugugggaugugcagaccgacuccaaucccaaccaggagaaggauagcagcuccaaugaaaaacagacaaucagccucccggugucuaccagcaagucccgcaaagagucuacggagccuaagacauguauugaaagcauggagaaaaagaccgacucccugguccaaaacggaaaugaaagaagcgaugacacagugucuaacaucucccuuaucgaucagaagaugcccgacauugagccuaauagcgaaaacaauuguucuuccagcgauaucguuaacggccacuccgagauugagcagacaccccuggugucuagcgaccccgcccucaaaaucgacaccaaucggauucgcaccgaaaacggguccauccugccuucugucgugccgcaggagcauaacacgcuucccguuagccaagcgccuuccaagcccaaucugaccagcgaacacacaucuuacggacucauccugaccaaaccuuacgugagaccccugccgccuuccuaucucgaugagcgguaccugagcaugcccaagcgcagaaaauuccuuacagaccgggucgaugccugcucugaccaggauaacguguauaagaaguccgucaaaagacugcgcugcggcaagugucucaccacguacugcaaugcugaagcccuggaggcucaucuugcccagaaaaagugucagacacuguuuggcuucgacagcgaugacgagucugccuga

SEQ ID NO: 78273 - RNA, 786 nt, Artificial Sequence
  derived and/or modified sequence opt5 from ZNF664__Homo_sapiens__NP_689650
augaucuacaagugccccauguguagagaguucuuuagcgaacgggccgaccuguucaugcaccagaaaauucauaccgcugagaagccucacaaaugcgauaagugugacaaaggcuuuuuccauaucuccgaacuccacauucauuggcgcgaucacacaggggagaagguguauaagugcgacgauuguggaaaagacuuuucuacgaccacaaagcugaacagacacaaaaagauccauaccgucgaaaaaccguacaagugcuaugaguguggcaaggccuucaauuggagcucccaccuucaaauucauaugcggguucacacaggggagaaacccuacgugugcucugaauguggacgcggcuuuagcaacuccucuaaucugugcaugcaccagagagugcauaccggggagaagccuuucaaaugugaagagugcggaaaggcguuucggcacacaagcucccucugcaugcaucagcgcguccacaccggcgagaaacccuauaaguguuacgaaugcggcaaggcuuucagccagucuuccagccuguguauccaucaaagagugcacacgggggagaaaccuuaucggugcuguggaugcggcaaggccuuuucucaguccagcucucuuuguauccaccagcgcguucauaccggggaaaaacccuucaagugcgaugaguguggaaaagccuuuucccagagcacaucccugugcauucaccaaagagugcauaccaaggaacggaaccaccucaaaaucucugucauuuga

SEQ ID NO: 78274 - RNA, 1833 nt, Artificial Sequence
  derived and/or modified sequence opt5 from ZNF667__Homo_sapiens__NP_071386
augcccagcgccagaggcaaguccaaaucuaaggcuccuaucaccuucggggaccuggccauuuacuuuagccaggaggaaugggaguggcucuccccgauccaaaaagaucuguaugaagacgugaugcuugagaacuaccggaaucuggucucucucggacugagcuuccgcagacccaacguuauuacacuucuggaaaagggcaaagcgccuuggaugguggagcccgugcggcgcagacgggcuccugauuccgggucuaagugcgagacgaagaaacugcccccuaaucaguguaacaagagcggacaguccaucugccagaaacuggucagcgcccaacagaaggccccgacccgcaaaucuggcuguaauaagaacuccgugcugguuaagcccaaaaaggggcacagcggcaaaaagccucucaaaugcaaugacuguggaaagacauuuucuagauccuucagccugaaacuucaucagaacauucacaccggcgaaaagcccuuugagugcucuaauugucggaaggcuuuccgccagaucuccagcauccugcuccaucaacggauucacuccgggaaaaagucucaugaaugcaacaaauguggagagagcuuuaaucagagaacaacccugauccuucacaugcgcauucacgauggcaaggagauccuggacugcgggaaagcccucucccagugucagagcuucaacauucaucaaaagauccacguggucggaaaugugugccagugcagaaaguguggcaaagccuuuaaccagaugucuucccugcugcuccauaagaaaauucacaaugggaagaaaacacacaaguauaacaagugcggacggggcuucaaaaagaaaagcguuuuugugguccauaagcgcauccacgcuggcgagaaaaucccugaaaacgcgaaggcccugucucaaagccuucagcagagaucccaucaccuggaaaaucccuucaagugucggaaaugcgggaagcucuuuaacagaauuucuccgcugaugcuucaucagcgcauccacaccagcgagaaaccuuacaagugugauaaaugcgacaaguucuuccggagacuguccacgcucauucugcaccuccgcauccauaauggagaaaaacucuaucgguguaacaagugcgagaagguguguaauagacacagcucucugauucaacaucagaaagugcacaccaagaaaaagaaacuuuuugagugcaaggaauguggcaagauguucuccgggacagcuaaccugaaaauccaccagaauauccauagcgaggaaaagcccuuuaaaugcaacaagugcucuaaagucuucggacgccaguccuuucucauugagcaccaacggauccauaccggcgaaaagccuuaccagugugaggagugcgggaaggccuucagccacagaauuucccugacacgccauaaacggauccacaccgaagauagacccuaugagugugaccagugcggaaaggcuuuuucucagagcgcccaccuugcgcaacaugaacgcauucacacgggcgagaaacccuacacauguaagaccugcggcaaagccuucucccagcggacaucucugauccuccaugaaagaagccacaccggggagaagccuuacgaguguaaugaaugcggaaaggcuuuuuccagcggcucugaucugauccggcaucagcgcucccacagcucugagaaaccguaugaauguuccaagugcgggaaagccuacagcagaucuagcucccugauucggcaccagaacacccauagcgaggagaaggcuuga

SEQ ID NO: 78275 - RNA, 1860 nt, Artificial Sequence
  derived and/or modified sequence opt5 from ZNF668__Homo_sapiens__NP_078982
auggagguggaagccgcugaggccagaagccccgcgccuggcuacaagcgguccgggcgcagauauaaaugccugucuuguaccaagacauucccgaacgcuccccgggccgcccgccacgcugccacgcauggaccugcugacugcagcgaagaggucgccgaaguuaaacccaagccugagaccgaggcgaaagccgaagaggcuuccggcgaaaaggugucugggagcgccgcuaagcccagaccuuacgccuguccgcucugccccaaagcguauaagacagccccugagcugcggucccacggacgcucucauaccggcgagaaacccuuuccuugucccgaaugcgggagacgguucaugcagccggugugucuucgcguccaccuggcuagccaugccggagagcucccuuuuagaugcgcucacugucccaaggccuacggcgcccuguccaaacuuaagauccaccaacggggccauacaggggaacgcccuuaugcuugcgcggauuguggaaagagcuucgccgaccccucuguguuuagaaaacaccggcgcacccaugcuggccugagacccuacuccugcgagcggugcgggaaggccuaugccgaacucaaagaucugagaaaucacgagcgcagccacacaggagagcggccuuuccuguguucugaaugcggcaaguccuuuagcagaucuuccagccucaccugucaucagcgcauucacgcugcccagaaaccguaccggugccccgcgugugggaagggauucacgcagcuguccucuuaccaaagccaugagagaacccacuccggcgaaaaaccuuuucuuugcccccgcuguggccggauguucagcgacccuucuuccuuuagacgccaucagcgggcucacgaggggguuaagcccuaucacugcgaaaaguguggaaaagauuucagacagccggccgaccuggccaugcaucgccgggugcacacaggcgauagaccuuuuaagugccuccagugugacaaaaccuucgucgcuagcugggaucugaagcggcaugcccuugugcacucugggcaacgccccuucagaugcgaggagugcggacgggcuuuugccgaaagagcgagccugacaaaacacucccgcguucauucuggcgagcggccuuuccacuguaacgccugcggaaagagcuuuguggucuccagcucucucagaaagcaugaacgcacccacagauccagcgaggcugccggggugcccccugcucaggaacugguggucggccuggcccuccccguuggcguggcgggggagucuuccgccgcuccggccgcuggagccggccugggggacccucccgccggacuucugggccugcccccugagagcgggggcgugauggcuacgcaguggcaggucgugggaaugacaguugaacauguggagugucaagaugcgggcguccgggaagccccggggccccucgagggagcuggcgaggccgggggagaagaggccgacgaaaaaccuccccaguucgugugccgcgaguguaaggaaaccuuuuccacaaugacccuucugagacggcacgagcgcucucacccugagcucagacccuucccuugcacccaguguggcaagagcuuuuccgaucgggcugggcugcgcaaacauucuagaacacacagcuccguucggcccuacacgugcccgcauuguccuaaagccuuccugagcgcgucugaccuccgcaagcacgaaagaacccaucccgugccuaugggcacacccaccccgcuggagccucuugucgcucugcucggaaugcccgaagagggcccugccuga

SEQ ID NO: 78276 - RNA, 1728 nt, Artificial Sequence
  derived and/or modified sequence opt5 from ZNF674__Homo_sapiens__NP_001139763
auggccaugagccaggagucccugaccuucaaggacguguuugucgauuucacacucgaagaguggcaacagcuggacucugcucagaaaaaccuuuacagagauguuaugcuggaaaauuauagccaccucguguccgugggccaucuggucgggaagcccgacgugaucuuucggcuuggaccuggcgaugagucuuggauggccgacgggggaacgccgguuagaaccugcgcggugugggaagucgaugagcagauugaccacuacaaagagagccaagauaaguuccuguggcaggcugccuuuaucggcaaagaaacacucaaggacgaguccgggcaggaauguaagauuugccgcaaaaucauuuaucugaacaccgauuucgugucuguuaagcagcggcugcccaaauacuauagcugggagcgcuguuccaagcaucaccucaauuuucugggacaaaacagaagcuacgugcggaaaaaggacgauggcugcaaggccuauuggaaagucugucuucauuacaaucugcacaaggcucagccugccgagcgcuucuuugaccccaaccagagaggcaaagcucuccaccagaagcaagcccugcggaaaucucagcgcucccagacaggggaaaaacuuuacaaaugcaccgaguguggaaagguguucauccaaaaggcgaaucuggugguccaucagagaacacacaccggcgaaaaaccuuaugagugcugugaaugcgccaaggcuuuuagccagaaaucuacgcucaucgcccaucagcggacccacacaggggagaagcccuacgaguguuccgaaugcggaaaaaccuucauucaaaagagcacacugaucaagcaccagcgcacccauacgggcgagaaaccuuuuguuugcgacaaguguccgaaggcuuucaagucuuccuaucaccugauuagacaugagaaaacacacauccggcaggccuucuacaaggggauuaagugcaccacaagcucccucaucuaucagcgcauucauaccucugaaaaaccccaauguagcgaacacggaaaggcguccgaugagaaaccuagccccaccaagcacuggagaacacauacgaaagagaacaucuacgaaugcucuaaguguggcaaguccuuucggggcaaaagccaccugucugugcaucagagaauccacaccggggagaagccuuaugaaugcagcauuuguggaaaaacauucuccggcaagucucaccuuagcgugcaucaccgcacccauacaggggagaaacccuacgaaugccggagauguggaaaggccuuuggcgagaaauccacccugaucguccaccagcgcaugcauacgggggagaagccguacaagugcaaugaauguggaaaggcuuucagcgagaagucuccucucauuaaacaccagcggauccacacaggcgaaagacccuaugagugcaccgacugcaagaaagccuuuucccgcaagagcacccugauuaagcaucaacggauccacacaggcgagaaaccuuacaaguguucugaaugcgggaaggcuuucuccgugaaaagcacccuuaucguucaucacagaacacauacgggagagaaacccuaugaaugucgcgauugcggcaaagccuuuuccgggaagucuacccugauuaaacaccagcggagccacacaggagacaagaaccucuga

SEQ ID NO: 78277 - RNA, 1896 nt, Artificial Sequence
  derived and/or modified sequence opt5 from ZNF676__Homo_sapiens__XP_011526034
auguggagcgugcugugccucucccugcagcccgagggcgcccuuaccuucagagacgucgcuaucgaauuuucucuggaggaauggcaaugucucgauagcacacagcagaaccuguaccggaauguuaugcuugagaacuaucgcaaucugguguuccucgggauugccgcguuuaagccugaccugaucauuuuccuggaacagggaaaagagccguggaacaugaagagacacgagaugguggaggagcccccugucaucugcucccauuuuucucaagaguucuggcccgaacagggcauugaggauagcuuucagaaaaugauccuccggcgcuacgacaagugugggcacgaaaaucugcaucuuaaaaucuccugcacgaacguggaugaguguaauguucacaaggaaggauauaacaagcugaaucagucucucaccacaacccaaagcaaaguguuccagugcggcaaguacgcuaacgucuuucauaaauguuccaauagcaacagacacaagauucggcacacaggggagaaaggacugaagugcaaggaauaugugcgcucuuucuguaugcuuucccaucugagccagcacgagagaaucuacacccgggaaaauucuuauaaaugcgaagagaacggcaaggccuuuaauugguccagcacacucaccuacuacaaaucuauucauacgggcgaaaagccuuauaaaugugaggaaugcgggaaggccuucuccaaauuuagcauccugaccaagcacaagguuauucacacaggagagaaacccuacaagugcgaggaauguggcaaggcuuucaaccgcuccucuauccugaccaaacauaaaauuauccacacaggggagaagccuuauaagugcgaagaguguggaaaaggcuucagcuccgugagcacccucaacacgcauaaggccauccacgcugaagagaaaccguacaagugcgaggaaugugggaaagccucuaauuccagcucuaagcugauggagcauaagcggauucacacaggagaaaaacccuauaagugcgaggaguguggcaaagcguuuagcugguccucuagccuuaccgaacacaagagaauccaugccggcgagaaaccuuacaagugcgaagagugugggaaggcuuucaaccgcuccagcauucugacaaaacacaagaucauucauaccggagaaaaacccuauaagugcgagggcugugggaaagccuuuucuaaggucuccacccucaauacacacaaagcuauccacgccgaggaaaagccuuacaagugcgaggaaugcggaaaagcgagcaacucuuccagcaagcugauggagcauaaaagaauccacacgggcgaaaagcccuacaaaugugaggagugcgggaaggccuucuccuggucuagcucccuuaccgaacauaagcggauucacgcuggagagaaaccguauaagugugaagagugcggcaaagccuuuacauggucuagcuccuucaccaagcauaaacgcauccacgcugccgaaaagccuuacaagugugaggagugcggcaaaggguuuagcacauucucuauucugaccaagcacaaaaucauucauacgggagaaaagagauauaaaugugaggaaugcggcaaggccuuuuccuggagcucuauccucacagagcacaagaucauucauaccggggagaaacccuacaagugugaagagugcggaaaggcuuucucccggagcucuagccugaccagacacaaacgcauccauacaggcgaaaaaccuuauaagugugaggaaugcgggaaagcguuuaaguccagcucuaccguguccuaccacaagaaaauucacacaggcgagaaucccuga

SEQ ID NO: 78278 - RNA, 1743 nt, Artificial Sequence
  derived and/or modified sequence opt5 from ZNF678__Homo_sapiens__NP_848644
augcccggccacccugagagcagaaagacccggcgcauccugacaaugcucccgagacuggugcuuaacuccuucccccaggucauucugcucccuaaucccccuaaaguucugcggcuucaagggcugcucgccuuuucugacguggugaucgaguucagccccgaagaaugggcuugccuggauccugcccagcgcaaccuguacagagacgucauguuugagaauuaucggaaccucgugucccuggcgauucuuucuuacagcauccaggaucugcucccggaacaggacaugaaggaucugugucaaaaaguuacgcuuacccgccauagauccuggggacuggacaaucuccaccuggugaaggauuggcggacagucaacgagggcaaagggcagaaggaguauugcaaucgccugacccaguguucuagcacaaaguccaaaauuuuccagugcaucgaauguggaagaaacuuuagcuggcggucuauccucaccgagcauaagcgcauucacacaggcgaaaaacccuacaagugcgaggagugugggaaaguguucaauagaugcuccaaccugaccaagcauaagcggauccacacgggagaaaaaccuuauaagugugacgagugcggcaaaguuuuuaauugguggagccaacuuaccaaccacaagaaaauucauacaggcgaaaagcccuacaaaugugaugagugcgacaagguguucaauugguggucucagcugaccucccacaagaaaauccauagcggggaaaagccuuaucccugcgaggaguguggaaaggcuuuuacacaguucucuaaccucacccagcacaaacgcauucacacgggcgaaaaaccguacaagugcaaggaguguugcaaagccuuuaauaaguucuccaaccugacacaacauaaaagaauccacaccggggaaaagccuuacaaaugugaggaaugcggaaacgucuuuaaugaguguagccaucuuacacggcacagacgcauucauaccggcgagaagcccuauaagugcgaagagugugggaaagccuucacccaguucgcuucccugacacggcacaagagaauccacacgggagaaaaaccuuaccagugcgaggaauguggcaagaccuuuaaccgcugcucucaucucagcucccacaaacggauccauacaggcgagaagcccuauaagugcgaggaaugugggagaaccuucacacaauuuagcaaucugacccagcacaaacgcauucacacgggagagaagcccuacaaaugcaaggaauguggcaaagccuucaacaaguuuucuucccugacacagcaucggagaauccacaccggggugaaaccuuauaagugcgaggaguguggaaagguguucaaacagugcagccaucucaccucucacaagcgcauucauacaggcgaaaaaccguacaaguguaaagagugcgggaaggcuuuuuaucaaagcuccauccugucuaagcacaaacggauucacaccgaagagaagcccuacaaaugugaagagugcggaaaggccuucaaucaguuuagcucccuuacaagacauaaacgcauccacacgggcgagaagcgguacaaguguaaagaaugcggcaagggguucuaucagagcucuauccauuccaaauacaagagaauuuauaccggagaggaaccugauaaaugcaagaaguguggcagccuguga

SEQ ID NO: 78279 - RNA, 1623 nt, Artificial Sequence
  derived and/or modified sequence opt5 from ZNF683__Homo_sapiens__XP_011539498
augaucaccagagugggcugggagguccggauugaagggaacggagacaugaaggaggaaagcgccgcucagcugggcugcugucaccgccccauggcccucgggggaacaggcgggucccugucuccuagccuugauuuccaacuguuuagaggagaccagguuuucuccgcgugccggccgcuccccgauaugguggacgcucauggcccuucuugugccagcuggcugugcccccuuccucuggcccccggccgcuccgcucuccuggccugucugcaggaucucgaccugaaucuuugcacgccucagccggcuccccuggggaccgaucuccaaggacugcaggaggacgcccuuucuaugaaacacgaaccucccggccugcaggcgagcuccacagaugacaagaaauuuaccgugaaguacccucagaacaaagauaagcucgggaagcaacccgagagagccggagagggcgcuccguguccugccuucagcucucauaauuccagcucucccccuccccugcagaaccggaaaucccccagcccucuggcuuuuugcccgugucccccugucaauucuaucuccaaggaacuccccuuccugcuucacgccuuuuauccuggguacccccugcuccugccgccuccccaucuuuucacauauggagcgcugccuagcgaccagugcccccaccuccugaugcugccucaggaucccuccuacccgaccauggccaugccuucucuccugaugauggugaacgagcuuggccaccccagcgcucgcugggaaacacugcuccccuauccuggcgccuuucaagcuagcgggcaggcccugccgagccaggccagaaaucccggagcuggcgcggccccuaccgacucucccgggcuugagcggggaggcauggcuuccccugccaaacgcguuccccugagcucucaaacggggaccgccgcucucccuuacccccugaagaaaaagaacggaaagauucuguaugaguguaauaucugcggcaagagcuucggccagcucuccaaccugaaagugcaucuuagaguccacucuggggaacggccguuucagugcgcccugugucagaaauccuucacacaacucgcgcaucugcagaagcaccaccuggugcauaccggagagcgcccucacaaaugcuccauucccuggguuccuggcagaaaucauuggaagucuuuucaggcuuggcgggaacgcgaggugugucacaaaagauucagcuccagcucuaaccuuaagacacaucuccggcugcacuccggggccagacccuuccagugcagcgucugucgcucccgguuuacccaacacauccaucugaagcuccaccauagacugcacgccccgcagccuugcggacuugugcacacgcagcugccccucgcuucucuggccugucuggcucaguggcaucaaggcgcccuugaccucauggcgguggccagcgaaaaacacaugggguacgauaucgacgaggucaagguuuccucuacaagccagggcaaagcucgcgccgugucccugagcucugcuggaaccccucuggugaugggccaggaucagaauaacuga

SEQ ID NO: 78280 - RNA, 3714 nt, Artificial Sequence
  derived and/or modified sequence opt5 from ZNF687__Homo_sapiens__NP_001291693
augggcgacaugaagacccccgauuucgacgaucugcucgccgcuuuugacaucccugauauugacgccaacgaggcgauccacagcgggccggaagagaaugaaggacccggcgggccuggaaaacccgagccuggcgugggguccgaaucugaggauacagcugccgccagcgcuggagacggccccggcgucccugcccaggcuuccgaucaugggcugccgcccccugacauuucuguugugagcgugaucgucaagaacacggugugccccgagcaauccgaagcccuugcgggaggcucugccggggauggagcucaggccgcuggcguuaccaaagaggggccugugggaccccacagaaugcagaauggcuucggcagcccggaaccuucccugcccgggacaccucauagccccgcucccccuucuggaggcaccuggaaggagaaagggauggagggaaagacaccgcucgaccuguuugcgcacuucggccccgaaccuggggaucauuccgacccccuuccucccagcgccccgucuccuacccgggagggagcucugacacccccucccuuuccuuccagcuucgaacucgcccaggagaacggccccggcaugcaaccgccugucucuuccccgccccugggggcucugaagcaggaaagcuguuccccucaccacccccaggugcucgcccagcaaggaucuggcagcucccccaaagccaccgacauuccugcuagcgcgucucccccucccguugccggggugcccuuuuucaagcagucccccggacaucagagcccgcuggcuucuccuaaaguccccgugugccagccucuuaaggaggaggaugacgaugaaggccccguggacaaaagcuccccggggucuccucaaagccccuccagcggcgccgaggccgcugaugaagacucuaaugauuccccugccuccucuuccagccgcccccugaaggucagaaucaagacgaucaaaaccuccuguggaaacauuacacggaccguuacacaggugcccucugacccugauccgcccgcgccucucgcugagggcgccuuucuggccgaagcuagccuucugaagcucucccccgccaccccuacgucugaggggcccaaaguggucagcgugcagcugggagacggcacacgccugaaggggaccguucucccuguggcuacaauccaaaaugccuccaccgcgaugcugauggccgcuagcgucgccagaaaagcugugguucuuccgggaggcaccgccacaucucccaagaugauugcgaaaaacgugcuggggcucgucccucaggcccugcccaaggcugauggccgggccggacuuggcaccgggggacagaaggugaauggcgcuuccgucgugaugguucagccuagcaaaaccgccacagggcccucuaccggaggcgggacagugaucucccgcacccaaagcucucuggucgaggccuucaacaagauucucaauagcaaaaaccugcugccggcuuacagaccuaaucucuccccucccgcggaagccggccuggcccuuccucccacgggauaucggugccuggaguguggcgacgccuuuagccucgaaaagucucuggcccgccacuacgacagacgguccaugcgcaucgaggugacaugcaaccauugugcuagacggcuuguuuucuuuaauaaaugcagccugcuccugcacgcccgcgaacacaaggauaaggggcuggugaugcaguguucccaucucgucaugagaccuguggcgcuggaccagauggugggacagccggauauuacgccccuucugccuguugcugugcccccugucucuggcccccucgcccugccggcccuggggaaaggagagggcgcuaucaccagcuccgccaucacaaccguggcggcugaggccccuguccuuccccucucuacagaaccucccgccgcuccugccacgagcgcuuauaccugcuuccggugucuggagugcaaggaacaaugcagagacaaagccgggauggcggcccacuuccagcagcugggacccccggcuccuggcgccacauccaacguguguccuaccugccccaugaugcuccccaaccgcuguucuuuuagcgcucaucagcggaugcacaagaauagaccgccccauguuugcccugaguguggcgggaacuuccugcaagccaauuuucagacacaccuucgcgaggccugccugcacgugucccggagagucggauaccgcugucccagcugcucugugguuuucggcggggugaacuccauuaaaagccauauccagaccucucacugugaagucuuucauaagugcccuauuugucccauggcuuucaaguccggaccuagcgcgcacgcccaccucuauucucagcauccguccuuucaaacgcagcaggcuaaacugaucuacaagugcgccaugugcgauaccguguucacacacaaaccccugcuuagcucccauuuugaccaacaccuccugccucagcggguuagcguguucaagugucccucuugcccucugcucuuugcccagaaaagaaccaugcuggagcaucuuaagaauacacaccagagcggccgccuggaagagaccgcuggcaagggggccggaggcgcgcuccugacgcccaaaacagaaccggaggagcuggcugucucccaagggggagccgccccugcuaccgaagagucuagcuccucuagcgaagaggaagaggugcccuccucucccgagccuccccggccugccaagagaccgcgccgggaacuuggcagcaaagggcucaagggaggcggcgggggacccggcggguggacauguggacugugccacuccugguucccugagagagaugaauauguggcgcauaugaaaaaggagcacggcaaaagcgucaagaaguuucccugucggcugugcgaacgcucuuucuguuccgcuccuagccucagacggcauguuagagugaaccacgaggggauuaaacgcguguaccccugccgguacuguaccgagggaaagagaaccuucucuucccgccugauccuugaaaaacauguccaggugagacacggccugcagcucggcgcccagagcccggggcggggaacaacgcuggcccgcggcuccucugcuagagcccaagggccuggacggaagcgcagacagagcuccgacagcugcucugaggaacccgauuccaccacaccucccgcuaaaagcccucggggcgggcccggaucuggcggccacgggccgcugcgcuauagaagcuccucuagcaccgagcagucccuuaugaugggacuccggguugaggacggcgcccagcaaugucuggauugcgggcugugcuuugcgucuccuggaagccucucccgccauagauucaucagccacaagaagcggagaggcguggggaaagccucugcucugggacuuggcgacggcgaagaggaagccccucccucccgcagcgaucccgacgggggagacuccccgcugcccgcuucuggcgggccucucacauguaaggucugcggaaaaagcugugauagcccccugaaucugaagacccauuuucggacgcacggcauggccuucauuagagcccgccagggggcugugggagacaacuga

SEQ ID NO: 78281 - RNA, 1503 nt, Artificial Sequence
  derived and/or modified sequence opt5 from ZNF689__Homo_sapiens__NP_612456
auggcucccccuagcgccccgcugcccgcccagggcccugggaaggcgagacccucccggaaacgcggaagacggccucgcgcucucaaguucguggacgucgccguuuacuuuucucccgaggaauggggcugccugagaccugcccaacgggcucuuuaucgcgaugugaugagagagaccuacgggcaccugggagcccucggcugugcugggccgaaacccgcccugaucagcuggcuugaacggaacacagacgauugggagccugcggcccuggacccccaggaauauccucgcggacucacggugcagagaaagucccggacccgcaaaaagaauggcgagaaggaggucuuucccccgaaagaagcuccuagaaagggcaaacgggggcgcagacccucuaagccucggcugauucccagacagacaagcggaggccccaucugcccugauugugggugcaccuucccggaccaucaagcccuggagucccacaaaugugcucagaaccucaagaagcccuacccuugccccgauuguggacgccgguucucuuauccuagccugcuugugucccauagacgcgcccacagcggcgaaugccccuacguuugugaccagugcgggaaacgguuuucucagagaaagaaucugucccaacaucaggugauucacacaggagagaaaccguaucacuguccugauugcggccgcugcuuccggagaagccgcucucucgcgaaccaucggaccacacacaccggcgagaagccccaucaguguccuuccugcgggagacgcuuugccuaccccagccugcuugcuauccaccagcggacgcacaccggagaaaaaccuuacacaugucuggagugcaauagacgguuccgccaaagaaccgcccucgucauucaucagcggauccacacaggcgaaaagcccuauccguguccugacugcgagagacgcuuuucuuccagcucccggcuggugucucauagacgcguucacagcggggaaagacccuacgcuugugagcauugcgaggcccgguucucccagcgcagcacccugcuccaacaccagcugcuucacacgggagaaaaacccuauccuuguccggauugcggcagagccuuucggcgcucugggucccuggcuauccauagaagcacacacaccgaggaaaagcuccaugcgugugacgauugcggacggcgcuucgccuaccccucucugcuugcuagccacagacgggugcacuccggcgagcgcccuuaugccugcgaccuguguucuaagagauuugcccaguggagccaucucgcucagcaccaacugcugcauacaggcgaaaaacccuucccuugccucgagugugggcggugcuucagacagcgcuggucccuggccguccacaaguguagccccaaagcgccuaacugcucuccccgguccgcuauuggaggcagcucucagagagggaaugcccauuga

SEQ ID NO: 78282 - RNA, 1773 nt, Artificial Sequence
  derived and/or modified sequence opt5 from ZNF703__Homo_sapiens__NP_079345
augagcgacucccccgccggcucuaacccuagaaccccggagagcuccgggucuggaagcggcgggggaggcaagcggcccgcugugccugccgcggucucccugcugcccccugcugauccccugcgccaggccaauagacuuccuauccggguucugaaaaugcucucugcccacacagggcaucugcuucacccggaauaccugcaaccccucagcuccacgccugugagccccauugagcuggacgcuaagaaaucuccucuggcccuccuggcucagaccugcucccagaucggaaagcccgauccgccucccagcucuaaacuuaacuccguggccgcggccgcuaauggccugggcgccgaaaaggacccugggcgcagcgcucccggagccgcgucugccgcugccgcucucaagcagcugggcgauucccccgccgaggacaaaagcuccuucaagccuuauucuaaagggagcggaggcggggauuccagaaaggacagcggaucuuccagcgucucuagcacauccucuagcuccucuagcuccccgggcgauaaagccggcuuucgggugcccagcgcugcguguccucccuucccuccccauggggccccgguuucugcuuccagcuccucuagcuccccuggaggcucucgcgggggaagcccccaccauuccgacugcaagaacggcgggggagugggcggcggggaacuugauaagaaagaccaagagccuaagcccagcccugagcccgccgccgucucuagaggaggcgggggagaaccgggcgcucacgggggcgccgaguccggagcgagcggccggaaaucugaaccucccuccgcucuggugggggccggacacguugcccccgugagcccuuacaagccgggccauucugucuuuccccucccucccagcuccauuggguaucacggaagcaucgugggcgcuuacgccggguauccuucucaguucgugcccggccuggauccuuccaaaagcggacuggucggcgggcagcucuccggaggccuggggcuucccccgggaaagccucccucuagcuccccucugaccggcgcuucucccccgagcuuucuccaggggcugugucgcgacccuuacugccuuggcggauaucauggcgccucccaccucgggggaucuagcuguuccacaugcagcgcgcacgaccccgccggcccuucucucaaagcugggggauacccccugguuuaccccggccauccucugcaaccggccgcucucuccagcucugccgcgcaggccgcucugcccgggcacccucuuuauaccuacggcuucaugcugcagaaugagccccucccucauuccuguaacuggguggccgcuagcggacccugcgauaagagauuugccacaucugaggaacugcuuucccaucugcggacccacacggcccucccuggcgcugagaagcugcuggcggccuauccgggggcuagcggacucggcuccgccgccgcugccgcggcugccgccgcuagcugucaucugcaccuucccccucccgccgcgccugggucucccggaagccugucccuccgcaauccgcacacccugggccugucuagauaccacccuuauggcaaaagccaucuuuccacagcugggggacucgccgugcccucucugcccaccgccggcccuuacuauagccccuacgcucuguacgggcagcggcucgccuccgcuucugcccugggauaucaauga

SEQ ID NO: 78283 - RNA, 1239 nt, Artificial Sequence
  derived and/or modified sequence opt5 from ZNF704__Homo_sapiens__NP_001028895
augaccuucacauuucagagcgaggaccugaagagagauugcggcaaaaagaugucccaccaacauguguucucucucgccauggaagaggacgucaaaacggcugauaccaagaaagccagccggauccuggaccacgaaaaggagaacacacgcuccauuugucuucuggaacagaagagaaaaguugugucuagcaauaucgaugugcccccugcgcggaaguccucugaggagcucgacauggauaaagucaccgcugccauggugcugacaagccuuuccaccagcccgcugguucgcucucccccugugagacccaacgaaucccucagcgggucuuggaaggagggaggcugcgucccuuccagcacaucuuccagcggguacugguccuggucugcccccagcgaccaguccaauccuagcaccccgucucccccucuguccgcugauagcuuuaaacccuuccggucuccugcccagcccgacgauggaauugacgaagcugaggccagcaaccugcucuuugaugagccgaucccucgcaagagaaagaacuccaugaaagugauguucaagugucuguggaaaaauugcggcaagguucuuucuacggcggccgggauucaaaaacauauccggaccauccaccugggacgcgugggcgacagcgacuauuccgauggcgaagaggacuuuuacuauacagaaauuaagcucaauaccgauagcgucgcugacgggcugucuucccuugcccccgugagcccuucucagucccuggcuagcccucccacauuccccaucccggauuccucuagaaccgagacgcccugugccaaaacagaaaccaagcucaugacaccucugagccgguccgcgcccaccacccuguaccucgugcauacagaccacgccuaucaggcuacgccucccgucaccauuccgggaucugccaaguuuacaccuaacggcagcuccuucagcaucucuuggcaguccccucccguuaccuuuacagggauucccgugagcccuacccaccaucccgugggaacgggcgagcaacgccagcacgcucauacaguccugucuuccccgccuagagggaccgugagccuucggaaaccccgcggagagggcaagaaaugcagaaagguuuacggcauggaaaaucgggauaugugguguaccgccugcagauggaaaaaggccugucagcgcuuccuggacuga

SEQ ID NO: 78284 - RNA, 231 nt, Artificial Sequence
  derived and/or modified sequence opt5 from ZNF706__Homo_sapiens__NP_001254638
auggccagaggccagcaaaagauccagagccagcagaaaaacgcuaagaaacaagccgggcagaagaaaaagcagggacacgaccagaaggcggcugccaaagccgcucugauuuacacaugcaccgugugucggacgcaaaugcccgauccuaagaccuucaaacagcauuuugaguccaagcacccgaaaacaccccucccucccgaacuggccgacguccaggcuuga

SEQ ID NO: 78285 - RNA, 2286 nt, Artificial Sequence
  derived and/or modified sequence opt5 from ZNF711__Homo_sapiens__NP_068838
auggacagcggcgggggaucccugggccuccacacccccgauucuagaauggcccauacaaugaucaugcaggacuucguggcugggauggccggaacggcgcacauugauggcgaccauaucgucguuagcgugccugaggcugugcuggucuccgaugugguuaccgacgaugggauuacacuugaccacggacuggccgccgaagugguccauggcccggauaucauuaccgagacagacgugguuaccgaaggcgugaucguccccgaggcugugcucgaagccgauguggcuaucgaggaggaccuggaagaggaugacggggaccacauucuuacaucugaacugaucaccgagacgguccggguuccugagcaaguguuuguggccgaucucgucaccggacccaacggccaccuggaacaugugguucaggacugcgugagcggggucgauuccccuacaauggugucugaggaaguucuggugaccaauagcgacacagagaccgucauucaggcggccggaggcgugcccggguccacggucacaaucaagaccgaagaugacgaugacgaugacgugaaaagcacaucugaggauuaccucaugauuucccuggacgacguuggagagaaacuugaacacaugggcaacaccccucugaagaucggcagcgaugggucucaggaggacgcuaaggaagauggauucggcuccgaggugauuaaagucuauaucuuuaaggccgaagcugaggacgauguggagaucgggggaaccgaaauuguuacagagagcgaauacacgucuggccauuccguggccgggguccucgaccaaagccgcaugcagagagagaagaugguguauauggcggugaaagauuccucucaggaagaggacgauauccgggacgagcgcagaguuagccggcgcuacgaagauugucaggccuccggaaauacccuggacagcgcucuugagucuagauccagcacagccgcucaauaucugcagauuugcgauggcaucaacaccaauaagguccucaaacagaaggccaaaaagcggcgcagaggcgaaacacggcaguggcaaaccgccgugauuaucgggccggacggacagccccugacgguguacccuugucacaucugcacaaagaaauucaagucucgcggcuuucugaaaagacacaugaagaaccaucccgaccaccucaugcggaaaaaguaucaguguaccgauugcgacuucaccacaaauaaaaaggucagcuuucauaaccaccuggagucccauaaacuuauuaauaagguggauaagacccacgaguucacagaauacacgcgcagauaccgggaggcuucuccucugagcuccaacaaacucauccugagagacaaggaacccaaaaugcacaaguguaaguauugcgauuacgagaccgcggaacaagggcuucugaaucgccaucuccuggccguucacagcaaaaacuuuccgcaugugugugucgagugcggaaagggcuuccggcacccuucugagcugaaaaagcacaugagaacacauaccggggaaaaacccuaucagugucaguacugcauuuuucgcugcgcugaccaguccaaucucaagacacacaucaagagcaaacauggcaacaaucugccuuauaagugugagcacugcccccaagccuucggagaugaacgggagcuucagagacaucuggaccucuuucagggccacaaaacccaccaguguccccauugcgaucacaagucuacgaacuccagcgaccugaaacgccauauuaucuccgugcacaccaaggauuucccucauaagugugaaguuugcgacaaaggguuccaccggccgucugagcuuaagaaacacagcgauauccauaagggaagaaaaauucaccaaugucgccauugcgacuuuaagacauccgaccccuucauccugucuggccacauucucagcgugcacaccaaagaucagccucugaaguguaagcggugcaaaagaggguuucgccagcagaacgagcugaagaaacauaugaagacacacaccggacggaaaaucuaccaaugugaauauugcgaguacuccacgacagacgccagcggcuucaagagacaugucauuucuauccacaccaaggauuacccccaucggugcgaauuuuguaaaaagggguuccgcagaccuuccgagaaaaaucagcacauuaugcggcaccauaaggaagcucucauguga

SEQ ID NO: 78286 - RNA, 1488 nt, Artificial Sequence
  derived and/or modified sequence opt5 from ZNF716__Homo_sapiens__NP_001152751
auggccaagagacccggcccuccggggagccgggagaugggacugcucaccuuccgcgacaucgcuauugaauuuucccuggccgaguggcagugccuugaucacgcgcaacagaaccuguacagagacgugaugcucgaaaauuaucggaaccuggucucucuuggcaucgcuguuagcaaacccgaucugauuacaugucucgagcagaauaaggaaccucagaacaucaaacgcaaugagaugguggccaagcaucccgugacgugcucccacuucacccaagaccugcagucugagcaggggauuaaagauagccugcagaaggucauccucagacgguacggaaaguguggccaagaagaccuucaggugaaaaagugcuguaaauccguuggggagugcgaagugcauaagggaggcuauaacuacgucaaucagugucugucugccacacagaacaaaaccuuucaaacacacaagugcgugaagguuuucggcaaauuuagcaauuccaaccgccauaagaccagacacacagggaaaaagcacuucaaauguaagaaugauggaaagagcuuuugcaugcugucucggcucaaccagcaucagaucauucacacccgcgagaaauccuauaagugugaggaaugcggcaagagcuucaauuguucuuccacgcugaccagacauaaacggauccacacaggggagaaaccuuaccgcugcgaagagugcggaaaggcuuuuagcuggucugccucccuuaccaaacacaagcggauucauacaggcgaaaagcccuauaccugugaggagagagggaaaguguucagccgcuccacgcugacaaacuacaagagaauccacaccggagaaaaaccuuacacaugcgaggaauguggcaaggcuuuuucucggagcuccacccucaccaaucauaaacgcauucacacaggcgagagaccguauaagugcgaagagugugggaaggccuucagccugucuuccacgcugaaaaagcauaaaaucguccacaccggagagaagcucuacacaugcgaagaguguggcaaagcguuuaccuucagcucuacacugaacacccacaagcggauucauacgggggaaaagcccuauacaugcgaggaauguggaaaagccuucagccuuccuuccaccuuuaccuaccacaagagaacacauaccggcgagaaacccuauaagugcgaggaaugcgggaaggcuuucaacuguucuagcacacugaagaaacacaaaaucauccacacgggagagaagcucuacaaaugcaaggaauguggcaaagccuuuaccuucuccagcacacugaauacccauaagcgcauucacacaggcgagaaaccuuauaagugcgaggaaugugaccaaaccuuuaaguggcauucuucccuugcuaaccacaaaaauaugcauacgggggagaagcccuacaaauacgaauga

SEQ ID NO: 78287 - RNA, 2745 nt, Artificial Sequence
  derived and/or modified sequence opt5 from ZNF717__Homo_sapiens__NP_001277137
auguuccccguguuuagcggcugcuuccaggagcugcaagaaaagaacaaaucccucgagcuggucucuuuugaagagguugccgugcacuucaccugggaagaguggcaggaccuugaugacgcucagagaacacuguaccgggaugugaugcucgagacguauagcucccuggucucucuugggcauuacaucaccaagccugaaaugauuuuuaaacuggagcagggagccgaaccguggaucguggaggagacacccaaucuccgccugagcgcgguucaaauuaucgacgaucugauugaaagaucccacgagucucaugaccgguucuuuuggcagaucgugaucaccaacagcaauacauccacccaggaacgcgucgagcucggcaagacauucaaccugaauagcaaccacgugcuuaaucugauuaucaacaaugggaacucuuccggaaugaaaccuggccaguuuaaugauugucaaaacaugcuguuccccauuaagccuggggaaacccagagcggagagaagccccauguuugcgacaucacgagacggucucaccgccaccaugagcaccucacccagcaucacaaaauucagacacuucugcaaaccuuucaguguaaugaacagggcaagacauucaacaccgaggcuauguuuuucauccacaaaagagugcauauuguccaaacguucggcaaguauaaugaauacgagaaagccugcaacaacuccgccgugaucgugcaggucaucacacagguugggcagccuaccuguugccggaaaagcgauuuuacaaagcaccaacagacccauaccggagaaaaaccguaugaguguguggagugcgaaaagcccucuauuuccaaaagcgaccucaugcugcaguguaagaugccuacagaggaaaaacccuacgcuugcaauuggugugagaagcuguucuccuauaaaucuagccucaucauucaccagcgcauccauacgggcgaaaagccuuacgggugcaacgagugcggaaagaccuuuagacggaaauccuuccugacacuucacgagcgcacccacacaggcgauaagcccuacaaauguauugaaugcgggaagaccuuucauuguaaaagccugcucacgcugcaccauagaacacacucuggagagaagccguaucaaugcuccgaauguggcaagaccuucagccagaaaucuuaccuuaccauccaccaucggacacacaccggcgagaagccuuaugccugcgaccauugugaggaggcuuuuagccacaaaucccgccugacagugcaucagagaacgcacaccggggagaagcccuacgaaugcaaugaguguggaaaaccuuucaucaacaagucuaaucuccggcugcaccagagaacacauaccggcgaaaagcccuaugagugcaacgagugugggaaaacauuucaccgcaagagcuuccugaccauucaucaauggacgcacaccggagaaaaacccuacgagugcaaugaaugcggcaagacauuucgguguaaauccuuccucaccguccaucagagaacacacgccggggagaagccuuaugcgugcaacgaauguggaaagaccuacagccacaaaucuuaccugacggugcaucaccgcacacauaccggcgagaagccguaugagugcaaugaauguggcaaauccuuucacugcaagagcuuccuuacaauccaccagcggacccaugccgggaaaaagcccuacgaguguaacgaaugcgagaaaaccuucauuaauaagcugaaccucggaauccacaagagaacacauacgggcgaacgcccuuaugaguguaaugagugcgggaaaaccuuucggcagaagucuaaccuguccacacaccaaggaacccauacaggcgaaaaacccuacguuuguaaugagugcgggaagaccuuccacagaaagagcuuucuuacgauucaccagcgcacacauaccggcaagaaccggauggaugugaugaacgucgaaaagcuguucgugagaaaucacacccuccuguauauccgcgagcugacaccuggaaaaucccccaugaacguuaugaauguggagaacccguuuauccggagacagauuuuccggucuaucaaggucuuuacccgcggcagaaauccuaugaacguggcuaaugucgaaaaacccugccaaaagagcgugcucacaguucaucaccggacgcacaccggggagaaaccuuacgaauguaacgagugcggaaagacauucugucauaaguccaaucugucuacccaccagggcacacauagcggggaaaaacccuaugagugcgacgaguguagaaagaccuuuuacgacaaaacggugcuuaccauucaccagcgcacacauaccggagaaaagccuuucgagugcaaagaaugucggaagacauuuucccaaaagagcaaacuguucguccaccacagaacccauacaggcgagaagcccuuucgcugcaacgaauguagaaaaaccuucucucagaaguccgggcucagcauccaccagcggacgcauacaggcgagaaaccguacgagugcaaggaauguggaaaaaccuucugccagaagucucaccugucccgccaccagcaaacccauauuggcgaaaagagcgauguggccgaagcuggguauguuuuuccucagaaucacucuuucuuucccuga

SEQ ID NO: 78288 - RNA, 1938 nt, Artificial Sequence
  derived and/or modified sequence opt5 from ZNF746__Homo_sapiens__NP_001156946
auggccgaggcuguggccgcgcccaucagcccuuggaccauggcugccacaauucaggccauggaaagaaagaucgagucccaagcugcccggcugcucucucuggaaggccgcacggggauggcugagaaaaagcuggccgacugcgaaaagaccgcggucgaguucggaaaccagcuggagggcaagugggccguucucgggacacugcuucaggaauacggacugcuccagagacggcuggagaauguggaaaaccugcuccgcaauagaaacuuuuggauucugcggcuuccgcccggcagcaaaggggaguccccuaaggaguggggaaagcuggaagauuggcaaaaagagcucuauaagcacgugaugcgcggcaauuacgaaacccuggucucucuugacuaugcuaucagcaaacccgaggugcugucccagauugaacagggcaaggagccuuguaacuggagacggcccgggccuaaaaucccggauguucccguggacccuucucccggaagcggcccucccgucccggccccugaucuccugaugcagaucaagcaagagggggaacugcagcuccaggagcagcaagcucugggaguggaagccugggcggccggccagcccgacauuggggaggaaccuuggggacuuucccagcuggauagcggcgcuggcgacaucucuacagaugccaccuccgggguucauagcaauuucucuacaaccauuccucccacguccuggcaaaccgaccucccuccgcaccaucccagcucugcuugcuccgauggaacacugaaacuuaacaccgccgccagcacagaggcugacgugaaaaucgucauuaagaccgaggugcaggaagaggaaguggucgcgacgccuguucaccccacagaucuggaggcccauggcacccucuuugggccuggacaggcuacacgcuucuuucccuccccggcccaggaaggcgccugggagucucaagggagcuccuucccuagccaggaccccgugcugggacugagagagccugcucggcccgaacgcgacaugggcgagcucucuccugccguggcgcaggaagagacacccccgggcgauuggcuguuugggggagucagauggggcuggaauuuccgguguaaaccucccguggggcuuaacccccgcaccggaccugagggccugccguacuccagccccgacaauggggaagcuauccucgauccuucucaggcccccagaccuuuuaacgagcccugcaaguauccuggccggaccaaaggauucggccacaagcccgggcugaaaaagcacccggccgcuccucccggaggcagaccuuuuacgugugcuaccugcggaaagagcuuccaacuucagguuucccugucugcccaucagcgcagcuguggggcccccgacggcuccgggccgggcacaggaggcgggggaagcggcucugggggaggcgggggcggauccggcgggggaagcgcgcgggauggcucugcccucagaugcggggaauguggacgcugcuuuacccggccugcucaccugauuagacaucgcaugcugcacacaggcgagcggcccuucccuuguaccgaaugcgagaaaagauucacggagcgcuccaagcucaucgaccacuaccggacacauaccggggugagacccuuuaccugcacagucuguggcaagagcuucauccgcaaagaucaccuucggaaacaucagagaaaucacgccgcuggagccaagacccccgcgcggggccaaccucuuccgacacccccugccccucccgaccccuuuaagucccccgcuucuaaagggccgcuggccagcacggaucucgugaccgacuggacaugcggacuguccguucugggccccaccgaugggggagacauguga

SEQ ID NO: 78289 - RNA, 1935 nt, Artificial Sequence
  derived and/or modified sequence opt5 from ZNF74__Homo_sapiens__NP_001243453
auggagauccccgccccugaaccggagaagaccgcucugagcucccaggaccccgcccucucucugaaagaaaaccuugaggauauuagcggcugggggcugccugaagcgagauccaaggagucugugagcuucaaagacgucgcuguugauuuuacacaagaggaauggggacagcucgacagcccccagcgggcccuguaccgcgaugugaugcuugagaauuaucagaaccugcucgcccugggcccuccccugcacaagccugacgugaucucucaccucgaaagaggggaggagccguggagcaugcaacgggaagucccccgcggaccuugccccgagugggaacugaaagcugugccuucccagcagcagggcauuuguaaggaggaacccgcccaagagccgaucauggagagaccucuugggggagcucaggccuggggccggcaggcgggcgcccugcagcgcagccaagcugcccccugggcuccugcccccgcgaugguuugggaugugcccgucgaagaguucccucucagaugcccgcuguuugcccagcagcgggugcccgaagggggaccucuucuggacacgcgcaagaauguucaagcuaccgagggcagaacaaaagcccccgcucggcucugugccggggaaaacgccucuaccccuuccgagcccgagaaguucccccaggugcgcagacagcggggagcuggcgcgggggaaggagaguuugucugcggcgaauguggcaaagccuuccgccaguccucuucccugacacugcacagacgguggcauagcagagagaaggcuuacaaaugcgaugaaugugggaaggccuuuaccuggucuacaaaucuccuggagcaccgccggauucauaccggagagaagccuuucuuuugcggcgaaugugggaaagccuucuccugccacagcucccuuaacgugcaccaaagaauccauacgggagagcgccccuauaaguguucugcuugcgaaaaagccuuuagcugcuccagccugcucucuaugcaucugcgggugcacaccggcgagaagccuuacagauguggggagugcggaaaagcguucaaucagcgcacacaccuuacccggcaccauagaauccacacaggcgaaaagcccuaucaguguggcuccugcgggaaggcuuuuaccugucauagcucucugacgguccacgagaagauucauagcggagacaagccuuucaaaugcuccgauugugaaaaggccuucaacucucgcagccggcucacacugcaccagagaacccacacaggcgagaaacccuuuaagugcgccgacugugggaaaggauucuccugccaugcuuaccugcucguucaccgccggauccauagcggcgaaaagccguuuaaguguaaugagugcgggaaagccuucucuucccacgcuuaucugauugugcacagacggauccauaccggcgagaagccuuuugauugcagccaauguuggaaagccuucucuugccacuccagccuuauugugcaucagcgcauccacaccggagaaaagcccuacaaauguuccgagugcggcagagcguuuucucagaaccauugucugauuaagcaccagaagauccacagcggggaaaaauccuucaagugcgagaaauguggagaaauguuuaauuggucuagccaucucacagagcaccaacggcugcauuccgagggcaagccccuugccauccaguucaacaaacaucugcucagcacguacuaugucccugggucucugcugggagcuggcgacgccgggcucagagacguggauccgauugacgcucuggauguugccaaacuucugugcguggucccgccucgcgcgggccggaauuuuucccucggaagcaagcccagaaacuga

SEQ ID NO: 78290 - RNA, 2172 nt, Artificial Sequence
  derived and/or modified sequence opt5 from ZNF750__Homo_sapiens__NP_078978
augagccugcucaaggagagaaaacccaagaaaccucacuacaucccgcggcccccuggcaagcccuucaaauauaagugcuuucaguguccuuuuaccugcaacgaaaagucccaucuguucaaucacaugaaauacgggcuuuguaagaacucuauuacacuggugagcgagcaagaccgcguccccaaaugcccuaaguccaauucucucgauccgaaacagacgaaccagcccgacgccaccgcuaagccugccagcuccaagucuguugcgaauggacugagcgcuuucgauuccaaacuucagcauagcucugccagagaagacaucaaggagaaccuggaacuccaagcccggggcacacaccgcugucuggggcagaaacccgcucugcauagagccuccccuugcaagagccccgcuccggaggccgcgcucggagcccagccugcucuggagggcgccgcucggcccucugccuuugugccugugggggaacaccgccuuaaaggacccgauaaugcggaggcccccgaaacccuggcucuccacaacccuacagccaaggcugucuccuuccauaccaaaagcgccuuucacacaccgggcuaucccuggaaggccggcucuccuuuccugcccccugaguuuccccauaagauuuccagcaccaaagggcuuggagcuaucuccccguacaugcacccuacgauucccgaguauccuccccacuucuacaccgaacauggccuggcgacaaucuauucuccuuaccuccuggccgggagcucccccgagugugacgcuccgcugcucagcguguacggaacccaggauccuagacacuuucugccccaucccggcccuaucccgaagcaccuugcccccucuccugccacauaugaccauuaccgguucuuucaacaguaucccuccaaucugccuauucccuacggguucuaucgcccugaaagcgcuuucucuagcuacggacucagacugcccccgguuaccggccuuacgcgggaucaguccucucaucugcucgaggaagccacacugguguauccugcgagcucccccagccgccugaacccuucugaccccaauagaaaacacgucgaguuugaguccccgaucccugaagcuaaggauagcucuaaagccggccagcgggacaccgagggguccaagaugagcccccgcgccggauccgcugccacaggcucuccugggagacccagccccaccgauuucaugcaaaccucccagacaugcgaaggacucuacgaccugucuaacaaggcugccagcuccgcgcuuggccggcuguacccuccggagcagagccucacggccuuuagacccgugaaaaagucuaccgaaugucugccugcucaagccgcugagacaaccgccgagucccccguuagccuuaauguggucaacggggacccucccgcgccuacaggaucugccucccuggugagcgaagcugccccgucuagccccgaugacuccagcggcaugggcccucucaaucugucuaaaaaguccgagauuaaccuggcugccacccacgaacccacguaucaggggagcccucaggccgagacagcuuccuucucugaacuccaggaucugccccuuaaccugagcgugaaagacccgugcaauacccaagcgccucgccccgccuuucccggacggccuagagcugccgagcccgccgcugccgucccucagaagaccggcacagagggguccgaagauggaccgucucaccccgagaccaagccuggcagccucgacggggauggcgcgcccccuacaggacccggcgaagaggcuccggacgccugugccguugauuccucugaggaacagaaacagacggcugccguggcgcugugccaacuggcugccuacagcccucgcaacauccgggugggggacggagaugccgcugcccccgagccugcuugcagacaggacacccccacacuuuccagcauggaaucucaggaggcccagugugaccuccgcccuaagggccaaaaacggaccucccugagagaugcgggaaagagccagcagggggccaaaaaggcuaagcugcaggacacagcccgcgucuucacccuccggagacgcgcucgggugucuuga

SEQ ID NO: 78291 - RNA, 1194 nt, Artificial Sequence
  derived and/or modified sequence opt5 from ZNF763__Homo_sapiens__NP_001012771
augauguuccaggaccccguggccugcgaggaugucgcuguuaacuuuacccaagaagagugggcccugcucgacaucagccagagaaagcuguaccgggaagugaugcuugagacauuccgcaaucugacguccauuggcaaaaaguggaaagaucagaacaucgaauaugaguaccagaauccuagacggaacuuucgcucucucauugaggggaaugugaacgaaaucaaggaggacagccacuguggagaaaccuucacacaagucccggaugacagacugaauuuucaggagaaaaaggcgucccccgaggcuaagucuugcgauaacuucguguguggcgaaguugggauuggaaauagcuccuuuaacaugaauauccggggcgacaucgggcauaaagccuaugaguaccaggauuaugccccuaagcccuacaaaugccagcaaccuaagaaggcuuuccgcuaucaccccucuuuuagaacccaggaacggaaccauacaggagagaaaccuuacgccuguaaggaaugcggcaaaaccuucauuagccacuccggcauccgcagacggauggugaugcauagcggggacggaccguacaaguguaaauuuugcggcaaggcuguccacugucuucgccuguaucucauucacgagagaacacauaccggggagaaacccuacgaaugcaagcagugugugaaaucuuucuccuauagcgccacgcaccggauccaugagcgcacccacacaggagaaaagccuuacgagugccagcaaugcggcaaggcguuucacucuuccagcucuuuccaggcccauaaaagaacccacacagggggaaagcccuaugaauguaaacagugcggcaaguccuucagcuggugucauuccuuucaaauucacgagcggacccauacgggcgagaaaccuugcgaauguucuaagugcaauaaggcuuucagaagcuaccgcuccuaucugcggcacaaaagaagccacacaggggagaagcccuaccaguguaaagaaugccgcaaggccuuuaccuacccgucuucccugcggagacaugagcgcacacacagcgcuaaaaagccuuaugaauguaagcagugcggaaaagcccucucuuacaaguucagcaacacccccaaaaaugcgcuguggcggaagacccuuuga

SEQ ID NO: 78292 - RNA, 1224 nt, Artificial Sequence
  derived and/or modified sequence opt5 from ZNF764__Homo_sapiens__NP_001166150
auggcucccccucuggccccgcugcccccuagagaccccaacggcgccgggccugaguggcgggaacccggagcggugagcuucgcugaugucgccguuuacuuuugccgcgaggaauggggcugucucagaccugcccagcgggcucuuuaucgcgacgugaugagagagaccuacgggcaccuguccgcccucggaaucggcgggaauaagccggcucugauuucuuggguggaagaggaggccgaacuuuggggacccgcggcccaagauccugaggucgcuaaaugccagacacagacggaccccgauagccggaacaagaaaaaggaacgccagagagagggcaccggcgcccuggagaaaccugaccccguggcugccggguccccgggacucaagucuccucaagcgcccagcgccggcccucccuaugggugggaacagcuguccaaggcuccccaucggggacgcccuucucugugugcccacccgcccguuccuagagcugaucagcggcauggcugcuacgugugugggaaauccuucgccuggcgcagcacacucgucgagcacguguauagccauaccggagaaaagcccuuucacugcacagacuguggcaaaggcuucgggcacgccucuucccugagcaagcauagagcuauccaccggggagagcgcccucauagaugccuugaauguggccgggcguuuacccagagaucugcccugacaucccaccuccgcguucacaccggggagaaacccuacggaugcgcugauuguggccggagauucagccaaucuuccgcccuguaucagcaucgccgggugcacagcggggagacgccguuuccuugccccgacugcggcagagccuucgcuuacccuuccgaucuucgccggcaugucagaacccacacaggagaaaagcccuacccuugucccgacugcggccgcuguuuucggcagucuagcgagauggccgcgcauagacgcacccacuccggggaaaagccguauccuugcccccaguguggacggagauucggccagaaaagcgcuguggccaagcaccaaugggugcaucggcccggggccggaggccaccgcgggagagucgcuggccggcugucuguuacacucaccccuggacauggcgaucuggacccgcccgugggguuucagcuguacccugagauuuuccaagaaugcggauga

SEQ ID NO: 78293 - RNA, 1572 nt, Artificial Sequence
  derived and/or modified sequence opt5 from ZNF765__Homo_sapiens__XP_006723529
auggcccugccccagggccuccugaccuucagagacguggcuaucgaguuuagccaagaagaguggaagugccuugauccugcccagcggacacuguaccgcgacgucaugcucgaaaacuauagaaaucugguuucccuugauauuucuagcaaauguaugaugaaggaguucuccucuacggcgcaggggaaccgggaaguguuucacgcuggaaccagccagcgccaugagucccaccauaauggcgacuucugcuuucaagauaucgacaaagauauucacgacaucgaguuccaguggcaggaagaugagagaaacgggcaugaagcccugaugacaaagauuaaaaagcucaccggaucuacagagcgguacgaccagaauuaugccggcaacaagccggugaaauaccaacugggguuuagcuuccacucccaucugcccgagcuccacaucuuucacaccgaagagaagaucgauaaucaggucgugaaaagcauucaugacgcuucucugguuuccacagcccagcgcaucagcuguagaccugaaacccacauuucuaacgauuauggaaauaacuuccuuaauuccagccuguuuacgcagaagcaagaggugcacaugcgggaaaaaucuuuccagugcaacgacuccggcaaggcuuacaauuguagcucccuccugcgcaagcaucagcuuauccaccugggcgagaaacaauauaagugcgacauuugugggaaagucuuuaacucuaagagauacguggcccggcaucgcagaugccacaccggagagaaacccuacaaguguaaugaaugcggcaaaacauucagccagaccuauuaccucacaugucaucggcgccugcacaccggggagaagccuuauaagugcgaagagugcgauaaagcguuccacuuuaaguccaaacugcagauccauagacggauucacacgggagaaaagcccuacaaauguaacgagugcggcaagacauucagccagaagucuuaucucaccugucauagacgccugcacacaggggagaaaccuuacaagugcaacgaauguggaaaaaccuuuuccagaaagagccacuuuaccugccaucaccggguucauacaggcgagaaaccguauaaguguaaugaaugcucuaagacguucagccacaaauccucucuuaccuaccaucgccggcugcacacagaggaaaagcccuacaaauguaacgagugcggcaagaccuucaaucaacagcucacacugaacaucuguagacuucacagcggggagaaaccuuauaagugcgaagagugcgacaaggccuacuccuuuaaaagcaaucuggaaauccaucagaagauucacaccgaggagaaccccuauaaauguaaugaaugcggaaagacguucucucgcacauccagccucaccuaccaucaccggcugcauaccggccagaaaccuuauaagugugaggauugcgacgaggcuuuuucuuucaaauccaaccuggaaagacaccgccggaucuacacaggggaaaagcuccacguguga

SEQ ID NO: 78294 - RNA, 1548 nt, Artificial Sequence
  derived and/or modified sequence opt5 from ZNF76__Homo_sapiens__NP_001278961
auggagagccugggccuccacaccgugacacuguccgacgggacgaccgccuacguccagcaagcuguuaagggagaaaaacuucuggagggccaggugauccagcucgaagaugggacaaccgccuauauucaucaggugacaguccaaaaggaggcgcugucuuucgaagacggacagcccgugcagcuugaggauggcagcauggcuuacauccacagaaccccucgggagggguaugacccguccacacuggaagccguucagcucgaggauggaucuaccgccuacauucaucaccccguggcugucccuagcgaauccacgauccuggccgugcaaaccgagguuggccuggaggaccucgcugccgaagaugacgagggcuuuucugcggaugccguggucgcucuggaacaguaugccagcaaagugcuucaugacucccagauuccccgcaacgggaagggacagcaagugggcgauagagcuuuccggugcggguacaaaggauguggccgccuguauacaaccgcccaccaccucaagguccaugagagagcgcacacaggggaccggccuuaccgcugcgauuuucccagcuguggaaaggccuucgcuaccggcuacggccugaaaucucauguuagaacgcacacaggggaaaagccuuauaaaugcccggaggagcuuuguuccaaggccuuuaaaaccagcggagaccugcagaagcacgugcggacacauaccggcgaacgccccuuccagugcccuuuugagggguguggaagaucuuucaccacauccaauauccggaaggugcacguccgcacgcauaccggcgaaagacccuacacaugcccugagccccacugugggcggggauuuaccagcgcuacaaacuauaaaaaucaugugcgcauccacaccggcgaaaagccguacguuugcacggugccuggcugugggaaaagauucacagaguauucuucccucuacaagcaccaugucgugcacacccauugcaaacccuauaccugcagcacauguggaaagaccuaccggcaaacauccacgcuggccaugcacaaaagaucugcccacggcgagcuggaagcuaccgaggaaagcgagcaggcgcucuacgaacagcagcaacuggaggccgcuuccgccgccgaggaaagcccuccucccaagcgcccccggauugcuuaucuuucugagguuaaggaagagagagacgauaucccggcccagguggcgauggucacagaggaagacggggcuccccagguggcccugauuacccaggauggagcccaacaggucacaaucauuaccuccggcgcugugguugccgaggacagcucuguggcuagccuccgccaucagcaggucgcccugcuugcgacggccaacgggacccacaucgcugugcaacuggaggaacagcagacacucgaagaggccauuaauguugcuaccgccgcgaugcagcaaggcgccgugacacuggagaccacggucuccgaaucuggaugcuga

SEQ ID NO: 78295 - RNA, 1452 nt, Artificial Sequence
  derived and/or modified sequence opt5 from ZNF774__Homo_sapiens__NP_001004309
auguggcugggcaccagcgggaaguccggacuccccggccacugccuggagaacccucuucaggaaugucauccggcccaacuggaggaaugggcucucaaagggaucucuagacccagcgugauuucccagccugagcagaaggaagaacccuggguccugccucuucagaauuucgaggcccggaaaaucccccgcgaaucucacacagacugcgagcaucaaguugcgaagcugaaccaggauaauagcgaaacggcugagcaguguggaaccuccucugagagaacaaacaaagaccucagccacacccuguccuggggcgggaauugggaacagggacuggagcucgaaggccaacauggcacacugccuggggagggacagcuugagagcuuuucucaggagcgggaucugaacaagcuccuggacggcuacgugggggagaagccgaugugcgccgaauguggaaaauccuucaaucagagcucuuaucuuauucgccaccugagaacccacacaggcgagcggcccuauaccugcaucgaaugugggaagggauuuaaacaauccagcgaucucgugacgcaucgcagaacccacacaggcgagaagccuuaccagugcaaaggcugugaaaagaaguucucugacuccagcacccugauuaaacaucagcggacacacaccggggagcgccccuacgagugcccugaauguggaaagacguuuggcagaaaaccccaccugaucaugcaucaacggacacacaccggggagaagccguaugccugccucgaaugccauaaauccuucucucgcagcuccaacuuuaucacacaccagagaacccauaccggagucaagccuuaccgguguaaugauugcggcgagagcuucucucaguccagcgaccugauuaaacaccagcgcacacacacgggggaaagacccuuuaaguguccugagugcggaaagggcuuccgggauucuagccauuuuguggcucacauguccacccauucuggcgagagacccuucagcugucccgacugccacaaauccuuuagccaaucuucccaccuuguuacacaucagcgcacccacacaggggaacggccuuucaagugugagaacugcggaaaaggcuucgccgauagcucugcucugaucaagcaucagcgcauucacaccggggaaagaccguauaaauguggagagugcggcaaguccuuuaaucagagcucccauuucaucacgcaccaacggauucaccucggggacagacccuaccgcuguccugagugcggcaagacauuuaaccagcggucucauuuccugacccaccagagaacccauacaggagaaaaacccuuucacugcagcaaguguaauaaauccuuccgccagaaggcccaucuucugugccaccaaaacacccaccucaucuga

SEQ ID NO: 78296 - RNA, 1557 nt, Artificial Sequence
  derived and/or modified sequence opt5 from ZNF776__Homo_sapiens__NP_775903
auggccgcugccgcgcugagacccccugcucagggcaccgugacauucgaggacgucgccguuaacuuuagccaagaagaguggucccuccugucugaagcccagcggugccuuuaccacgaugugaugcuggagaaucucacgcugaucagcucccuuggguguugguauggagcuaaggacgaaaccccgucuaaacagacacugagcauucagcaagagucuccccuccgcacccauuggacaggcgugugcaccaagaaaguccaccugugggggauguguggaccucugcucggcgauauccugcaucaggggacacagcacaaccagaaacuuaauggauucggcgccuacgagaaaaagcuggacgaugacgcuaaccaucaccaagaucagaagcagcacauuggcgaaaaauccuauagaagcaaugccaaggggaccuccuuugugaaaaacugcaaguuccauaugagccacgagcccuuuaucuuccaugaaguuggaaaagacuuucucucuucccugcggcuucugcagcaagaggauauucacacgagcggcaagucuaauuucgagaccaagcacgggaucccucuccagggaggcaaaacacauuacaucuguggggaauccaccauucccuuuagcaacaagcacucucuggugcugcaucagcgccuccugccuagagagggaccguaugucugcuccgacagcggcaaauucacauccaagucuaauagcuuuaacaaucaccaaggcgugcggaccgggaaacgccccuaccaguguggacagugcgaugaauccuucugguauaaggcgcaucuuacggagcaccagagaguucacacaggcgaacggccuuacgaguguggggagugcgacaagagcuuuucucauaagcacucccugguggaucaucaacgcguccacaccggagaaagacccuacgagugugacgaaugcggcaagagcuucucucacaaacggagccucgugcaucaccagcgcgugcauacaggggagagaccuuaucagugcggagaauguggcaaguccuucaaccacaaaugcaaucugauccagcaucaacggguccacaccggcgagcgccccuuugaguguaccgccugcgggaaacuuuucagaucuaacagccaccugaaggaacaucagcggguucacacaggagagagaccguacgaauguaaggagugccgcaaguccuuucgguauaaaagccaucucacggaacaccagagagugcauaccggcgagcgcccuuacgagugucgggaaugcgggaaguguuuccaccagaaaggaucucugauucaacaccagcagauccauuccggcgagagaccccacgaaugcggggaguguggcaagugcuuucaucagaaaggaagccugauucgccaccaacagauccacucuggcgagcggccucaugaaugcggggaguguggaaagugcuucagacagaagggcaaucucauuaaacaccaacgcgugcauacaggggaacggcaccaugaguguuga

SEQ ID NO: 78297 - RNA, 2274 nt, Artificial Sequence
  derived and/or modified sequence opt5 from ZNF778__Homo_sapiens__NP_001188336
auggccgcucccgaccuggcccacggcgggcaugugagcagagauuccgucugccuccacgaggaacagacccaagcggcuggaaugguugccggcuggcugaucaacuguuaccaggacgccgugacauucgaugacguggcugucgauuuuacgcaggaggaauggacccuucuggacccuucucagcgggaucucuaucgcgacgugaugcuggagaauuacgaaaaccuugccagcguugggcaucaccuguuccaaccguccgugauuuauuggcucgagcaggaggaggaacugagagcuggacggcgcgccguccugcaggaauggagacucaagacaaaaggccccgcgcugcggcaggaucgcucuugguuuagagccagcaaugagacccaaacagcucggucccauaacgggggacagcuuugcgaccgcacccaguguggcgaggccuucucugaacacagcggccuguccacacacgugagaacccagaauacgggggauagcugcguuucuaaccauuacgagcgggacuuuuucaucccuugucaaaagacccucuuuaaaauuggagaacaguucuccgugcugggccagugcgggaaggcuuuuagcucuacacccaaugucgugucccaacaggccuguacccgcgauagaagccuugacuauucuuccugcggagagguguuccugaaccagagcuaccuccaggcgcgggccggcucccacaauggggaagagacauggaaauggaagccuuguggaaaggcucugacccauucuaugggcugcgccacgcccgucgagaugcacgcuguucgcaacccucacguguguagagaaugcggcaaagccuuucgguauacagccuaccugaccgggagagugcaaguccauccgggagagaagcccugcgaacucgaggaauguggcaaagcuagcccuguguccagcucucugacacagcacguucgcauccaugcggccgagaagcccugcgaguguaaagaaugcgggaaggcuuucaccggacuuuccggccugagcaagcacgugcagaccgacccugggcagaaacccuacgaguguaaggauugcggaaaagccuguggcggcuuuuaucuccugaaugaacaugggaagacacacacgcgggagaaaccguucgccugcgucguguguggaaaguacuucagaaacucuagcugccuuaauaaccacguucgcauucauaccggcaucaaaccuuauacauguuccuacugcgggaaggcuuuuaccgugcggugcggacugacaagacacguccgcacccauacgggcgaaaagcccuauacauguaaagacugcgggaaggccuucuguaccucuagcggccucaccgagcacgugcggacacacaccggagagaaaccuuacgaaugcaaggauuguggcaaauccuuuacagucucuagcucccugacggagcaugcgagaauccacaccggggaaaagcccuaugagugcaagcaauguggaaaggcuuucacaggccgcagcgggcugaccaaacauaugcggacacacaccggagagaaacccuacgaaugcaaggacuguggcaaagccuacaauagaguguaucuccugaacgagcauguuaagacgcacaccgaagagaagccuuuuauuugcacagugugucgcaaaucuuuccggaacuccagcugccuuaauaagcacauccagauucauaccgggaucaaaccguacgaaugcaaggauuguggcaaaacauuuaccgucuccucuagccugacggagcacauuagaacacauaccggagagaagcccuaugaaugcaagguguguggcaaagccuucacaaccuccucucaccucaucguucauauucggacccacacaggggagaagccuuacaucugcaaagaauguggaaaggcuuuugccagcuccagccaccugaucgagcaucgcagaacgcacaccggcgaaaaacccuauauuugcaacgagugugggaaggcuuuccgggccucuucccaucuucacaaacacggaagaauccauacaggccagaagccuuacaagugcaaagagugugggaaggcguauaaucgcuuuuaccugcucaaagaacaccugaagaccuacacagaggaacagguguucgucugcaaagacuguggcaagagcuuuaagaacucuuccugccugaaucaucacacccaaauucauacggaugagaaacccuucuga

SEQ ID NO: 78298 - RNA, 972 nt, Artificial Sequence
  derived and/or modified sequence opt5 from ZNF784__Homo_sapiens__NP_976308
auggccgcugccagacccgaggcgcagagccgguccucuccuaccccggaaagccgcucccaagagccccuggaccucgugcuggucccugaugacugcagacccggcacaccucccucugaucuuaucgaaauucagguugugaaggugacggacaccacacuggucccugagccgcccgaaccugggagcuuccacugugcucucugccccgccgccuuucggcugguguccgagcuucuguuccaugagcacggacaucucgcuggcgccgaagggggaggccaagggggagauccuucucgcugucacguuugcggccauagcugucccggcccggcuucccugagagcccacuacagccugcacaccggggagcggccuuaucgcugcgcgcucugucccagagccuuuaaagcucuggccccucuucugcggcaucagcaccgccauggaguggaacccggcacaucuagacggcccccugacaccgcugccgucgcggagcagcgcccggggguggcccccgagagagcugaaguugugauggccgcugccgccgcuggagcggccgucggcaagccuuucgcuugccgguuuugugccaaacccuuccgcagauccagcgauaugcgggaccacgagagagugcacacaggggaacgcccuuaccauugcggaaucuguggcaagggcuuuacccagucuuccgugcucagcgggcacgcccggauucauacgggagagagacccuuccgcugcacccugugcgaucggacauuuaacaauucuuccaacuucagaaaacaccagcgcacccauuuucacggcccggggccuggacuuggcgacagcgggggacagcugggcuccucugcugccgaaggcagcggguccggauguggcgucggggaucccgcggaggagggacggggcgaaacagcuaagguuaagguggaggccgaccaauga

SEQ ID NO: 78299 - RNA, 1425 nt, Artificial Sequence
  derived and/or modified sequence opt5 from ZNF79__Homo_sapiens__NP_001273625
auggccgcuggccugcucaccgccgggcccagaggaagcacauucuuuuccucugugacggucgcguucgcucaggagcgguggcgcugccugguuagcaccccuagagaccgguuuaaggaaggcaucccggggaaaucccgcucucuugugcugcucggacugcccgugagccaaccuggcaugaacucccagcuugagcagagagaaggggccuggaugcuggagggagaagaucuccggucucccagcccuggcuggaagauuaucuccggcucucccccugagcaggcccugagcgaggcuuccuuccaagacccgugugucgaaaugcccccuggggauagcgaccacggaacaucugaucuggagaaauccuuuaaucuccgccccgugcugagcccucagcagagaguucccguggaagcccggccgcgcaagugcgagacccauacagagucuuucaaaaacuccgaaauucuuaagccucacagagcuaagcccuacgccuguaaugagugcggcaaagcguuuagcuauuguuccucucugagccagcaucaaaagucccacaccggggaaaaaccuuacgagugcagcgaauguggaaaggccuucucucaguccagcucucucauccagcaucagcggauucacacaggcgagaaacccuauaagugcagcgagugugggcgcgcuuuuucccaaaacgccaaucugaccaagcaccagagaacgcauaccggagaaaaacccuaccggugcucugagugugaaaaggcuuucagcgacugcuccgcccuuguccagcaccaacgcauccauacaggcgagaaaccuuaugaaugcagcgauuguggcaaggcguuuagacacucugccaaccugaccaaucaccagcggacacauaccggggagaaaccguacaagugcuccgaguguggaaaggcuuucagcuauugcgccgcuuuuauccagcaccagcgcauucauacgggcgaaaaacccuacagaugugccgccugcgggaaggcuuucucucaauccgcgaaccucacaaaucaccagcggacccauacaggagagaaaccuuacaaguguagcgaaugcggcaaagccuucucccagucuaccaaccugaucauucaccagaagacccacacaggggagaaacccuauaaguguaaugaaugcggaaaguuuuucagcgaguccucugcucugaucagacaucacauuauccauacgggcgagaaaccuuacgaauguaacgagugcggcaaggccuuuaaucaaagcuccagccucucucagcaccagcgcauucacaccggggugaaacccuaugaaugcuccgaguguggaaaggccuuccggugcagcucugcuuuuguuagacaucagcgccugcacgccggcgaguga

SEQ ID NO: 78300 - RNA, 447 nt, Artificial Sequence
  derived and/or modified sequence opt5 from ZNF7__Homo_sapiens__NP_001269725
auggagguggucaccuucggcgacguugccgugcacuuuagcagagaagaguggcagugccuggaucccgggcaacgggcccucuaccgcgaagugaugcuggagaaccauuccucugucgccggacuugcgggcuuccugguguuuaagccugaacucaucagcagacuggagcagggggaggaaccguggguucuugaccugcagggagcugagggcacagaagcuccccggacguccaaaaccggguuccucggacgcccuacaaugggccaggagcccagacacccucaugcucccccugccaccccggugcccggccugccuaagcacuguucucaacggcugacacugcccccucccgggcucagcuccucuccgcuuggacauuuucugguccacgaucaggaccgcagacggggcaccagcgccauuuggaugguguga

SEQ ID NO: 78301 - RNA, 1995 nt, Artificial Sequence
  derived and/or modified sequence opt5 from ZNF800__Homo_sapiens__XP_005250238
augccccugagagacaaguacugccagaccgaucaccaucaccauggcuguugcgagccuguguauauccucgaaccgggggaucccccucugcuucaacagccccugcagacaagcaaauccggcauucagcaaaucauugaguguuuccggucuggaacgaagcagcucaaacacauccugcuuaaggacgucgacaccauuuuugaaugcaaacugugucgcagccucuucagagggcugccuaaccugaucacacauaagaaguuuuacugucccccuucccuccagauggaugacaaucugccggauguuaacgacaaacagucucaagccaucaaugaucuucuggaggcuauuuaucccagcguggacaagcgggaauacaucauuaaacucgagccuaucgagaccaaccagaaugccguguuccaguauauuucccgcacagauaaccccaucgaagucaccgagucuagcuccacaccugaacagaccgaggugcaaauucaggagacgagcaccgaacagucuaagacaguucccgugaccgacacagaggucgaaaccguggagccgccucccguugaaaucgugacggaugaggucgcgccuacauccgacgagcaaccccaggaaagccaggcugaccuggagaccucugauaauuccgacuuuggacaccagcuuaucugcugccuguguagaaaagaguucaacagccggcgcggcgugagacggcacauucgcaaggugcauaagaaaaagauggaagaacucaaaaaguacaucgagacaagaaagaaucccaaccaaucuuccaaggggcggagcaaaaauguccugguuccucugucccgcucuugcccgguguguugcaagagcuuugccaccaaggccaacgugagacggcacuucgaugagguccaucgcggacucagacgggacuccauuacccccgauaucgcuacaaaaccuggccagccccuguuucuugacagcauuucuccuaagaaauccuucaagacgagaaaacagaaaagcucuagcaaggccgaauauaaucugaccgcuugcaaaugucuccugugcaagcgcaaauacuccucucagaucaugcuuaagcggcacaugcaaaucgugcacaaaauuacacugagcggcaccaacuccaagagagagaaggggcccaauaacacagccaacagcucugaaaucaaaguuaagguggagccggcggauuccgucgaaagcucuccucccuccauuacccauagcccucagaaugagcucaaaggaacgaaccacuccaaugagaagaaaaacacacccgccgcucagaagaauaaggugaaacaggacucugaaagcccuaaguccaccucucccagcgccgcuggcgggcaacagaaaacccgcaagccgaaacuguccgccggauuugauuucaagcagcuguacuguaaacucugcaagcggcaguuuacaagcaagcaaaaccugaccaaacauaucgagcuucacacagacggcaauaacauuuauguuaaguucuacaaauguccucugugcacguaugaaaccagacgcaagcgggaugugaucagacauaucacagucgugcacaaaaagucuucccgcuaccucgggaagauuaccgcgagccuggagauccgggccauuaaaaagcccaucgacuucguccuuaauaaaguggcuaagagaggacccucucgcgacgaggccaaacacuccgauagcaagcaugacggcacaucuaacagcccuuccaagaaauaugaaguugcugaugugggcauugaggucaaggugaccaaaaauuuuagccugcaccgguguaacaagugcgggaaagccuucgccaagaagacguaccucgaacaucacaaaaagacccacaaagcuaaugcgucuaacuccccggagggaaauaagacaaaaggcagaagcacccgguccaaggcccugguuuga

SEQ ID NO: 78302 - RNA, 3630 nt, Artificial Sequence
  derived and/or modified sequence opt5 from ZNF804A__Homo_sapiens__NP_919226
auggagugcuacuauaucgugauuagcuccacccaccugucuaacggccauuucagaaauaucaagggggucuuucggggaccccucagcaaaaacggcaauaagacacuggacuacgccgaaaaagagaacacgauugcuaaggcccuugaagaucugaaagcgaauuucuauugugagcucugcgacaagcaguacuauaagcaccaagaauuugauaaccauaucaauuccuacgaccacgcucauaaacagcgccugaaggagcuuaaacagagagaguucgcccggaacguugccucuaagagccgcaaagaugaaagaaagcaggagaaggcucugcaacggcuccacaaacuggccgaacugcgcaaggagaccgugugugcuccuggguccggaccgauguuuaaaucuacaaccgugacagucagagagaauugcaacgaaauuagccagcgggugguuguggacuccgucaauaaccagcaggauuucaaguauacccucauccacagcgaggaaaauacaaaagacgccaccacgguggcggaggaucccgaaucugccaacaauuacaccgcuaagaacaaccaaguuggcgaccaggcccaggggauccaucgccacaaaauuggauuuuccuucgcuuuuccuaagaaggccagcgugaaacuggagucuuccgcggccgcuuucagcgaguacucugaugacgccuccgucggcaagggcuuuagcagaaaaucccgguucgugcccucugcuugucaucuucagcaaagcuccccuacagaugugcugcucagcucugaagagaagaccaauuccuuucaucccccugaagccaugugccgcgacaaagagacaguccagacccaggaaaucaaggagguuagcucugagaaggacgcccugcuucugccgagcuucuguaaauuccaacuccagcuguccucugaugcugacaacugccagaauagcgugccccuggcggaucagauuccucucgaauccguggucaucaacgaggacauucccgugagcggaaauucuuuugaacugcuuggaaacaaguccacgguucuggauaugagcaaugacuguaucucugugcaagccacaaccgaggaaaacgucaaacacaaugaggcuuccacaaccgagguggaaaacaagaauggcccugagacccucgcccccagcaacacagaagagguuaauauuacgauccacaaaaagaccaacuucugcaagagacagugugagccguuugugccuguccugaauaaacaccgguccacagugcuucaguggcccucugaaaugcuggucuauaccacaaccaagccuagcaucuccuacucuugcaacccccucugcuucgauuuuaaaagcacgaaggugaacaauaaccuggacaaaaauaagcccgaucugaaggaccucuguucccagcaaaaacaggaggauauuugcauggggccucugagcgacuauaaggacguuucuacagaaggacuuaccgauuacgagaucggcuccagcaaaaacaaguguucucaggugaccccgcugcucgccgacgauauucuguccagcucuugcgacagcgggaaaaaugaaaacacaggacagcgcuauaagaauaucuccuguaaaauuagagagaccgagaaguacaacuucacaaagagccaaaucaaacaggauacgcuugacgaaaaguauaauaaaauccggcugaaggagacccaugaauacugguuucacaaaucuagacgcaagaagaaacggaagaaacucugccagcaucaccacauggagaagacaaaagaauccgagaccagauguaagauggaggcugaaaacagcuacacagagaaugccggcaaguaucugcuggaacccauuuccgagaaacaguaccucgcggcugaacaacugcuugauucucaucagcugcucgacaagcgcccuaaaagcgaguccaucucucugagcgauaacgaggaaaugugcaagaccuggaauacggaguauaacaccuacgacacaauuuccucuaaaaaucacuguaagaagaacaccauccugcuuaacggccagagcaaugccacaaugauucauuccgggaaacacaaccucaccuauagccggacguacugcuguuggaagacaaaaaugucuuccugcagccaagaucacagaucucugguccugcagaaugacaugaagcauaugucccagaaccaggccgugaaacgcggauauaauagcguuaugaacgaaucugagcgguucuacagaaagcgccggcaacacucccauagcuacuccagcgaugagucucucaauagacagaaccaucugcccgaagaguuucuucgcccucccagcaccuccguggcuccgugcaaaccuaagaagaaacggagacggaagcgcggcagauuccaccccggguuugaaacacuggagcucaaagaaaauaccgacuauccugucaaggacaacucuagccugaauccccuggaucggcuuaucuccgaggacaaaaaggagaagaugaaaccucaggaaguggccaagaucgagagaaacucugaacagaccaaucaacuccgcaacaaacugagcuuccaccccaauaaccugcucccguccgagacaaacggagaaacggagcaccuggagauggaaaccacaucuggcgagcuuagcgauguguccaaugacccuaccacaagcguuugugucgcuucugcccccaccaaggaagcgauugauaacacgcugcucgagcauaaagaacgguccgagaauaucaaccugaaugagaagcagauucccuuucaggugccuaacaucgaaagaaauuuccgccagagccaaccgaagucuuaccugugccacuaugagcuugccgaagcucucccccaggggaaaaugaacgagacaccuaccgaguggcugagauacaauuccgggauucugaacacccagcccccucuccccuucaaggaagcccaugugagcggccacacauuugucaccgcugagcaaauccuggccccucuugcgcugcccgaacaggcccuccugauuccgcuggagaaucaugacaaauucaagaacgugccuugugaaguuuaucagcacauccuucagcccaauaugcucgcuaacaaagugaaguuuacauucccucccgccgcucugccgccucccuccacgccucugcaaccccucccccugcagcagucucuuugcagcaccuccgucacaaccauccaccauacagugcugcagcaacacgccgccgcugcggccgcugccgccgcugccgcggcugccggcaccuuuaagguucuccagccucaucagcaguuccugagccaaauuccggcccugacgcggaccucucuuccccagcuguccguggggccugucggaccccgccucuguccuggcaaucagcccacauuuguggcuccuccgcagaugcccaucauuccugccagcguucugcaccccucucaccucgcguucccuagccugccccaugcucuuuuuccgucccugcucucuccucaccccaccgugaucccccugcaaccucuguucuga

SEQ ID NO: 78303 - RNA, 4050 nt, Artificial Sequence
  derived and/or modified sequence opt5 from ZNF804B__Homo_sapiens__NP_857597
auggccugcuaccuggugaucagcuccagacaccucucuaacggccauuaucgggggauuaagggagucuuccgcggcccccuguguaaaaaugggagcccuuccccggacuuugcugagaagaaaucuaccgccaaggcgcuugaagauguuaaagcuaacuucuacugcgagcugugugacaagcaguaucacaagcaucaagaauuugauaaucacaucaacagcuacgaccaugcccacaaacagagacucaaggagcugaaacagcgggaguucgcccgcaauguggcuuccaagucuuggaaagaugaaaagaagcaggagaaagcccuuaagagacugcaccaacucgcugaacugcggcagcagagcgagugcguguccggaaacggccccgccuauaaagcgccucgcgucgccauugaaaagcagcugcaacaggggaucuuucccauuaaaaauggaagaaaggugagcuguaugaaaucugcucuccugcuuaagggcaagaaccugccucggaucaucuccgacaaacagcgcagcacaaugcccaauagacaucagcuccaaucugaucggcgcugccuguucggcaaccagguucuucagacguccagcgaccugucuaaugccaaccacagaaccgggguguccuuuacauucagcaagaaaguccaucucaagcuggaguccucugcuagcguguuuuccgagaauaccgaagagacacacgauuguaacaaaagcccuauuuacaagaccaagcaaacagccgacaaaugcaaguguugccgguucgcgaauaaagauacccaccugacgaaggaaaaagagguuaacaucucuccgucccaucucgaaagcgugcugcacaacaccauuucuaucaauagcaagauucuucaggacaagcaugauuccaucgacgagacacuggaggacucuauuggaauccacgccagcuuuuccaaaagcaacauccaucucucugaugucgacuucacccccacaucccgcgaaaaggagaccagaaauacgcugaaaaacacacuugaaaauugugugaaccacccuugccaggcuaaugccagcuuuucucccccuaacauuuauaaucacuccgaugcucggaucagcgagugccuggacgaguucuccucucucgaacccagcgagcagaaguccaccgugcaucugaaccccaauucuagaauugaaaaccgcgagaaaagccuggauaagacagaacgggucuccaagaauguucaaagacucgugaaagaggccuguacccacaacguggccagcaagccucugcccuuccuucauguccagucuaaagacggccacaccacacugcaguggccuacggaacuccugcuuuuuaccaagacagagcccugcaucuccuacggguguaauccccuguacuucgauuuuaaacucagccgcaacaccaaggaggaccacaaccuggaagaucugaaaacagagcucggaaagaagccucuggaacuuaaaaccaagcgggagucucagguguccggccugacggaggaccaacagaaacucauucaggaagauuaucaguacccgaagcccaaaacaaugaucgcuaauccugacugggagaaguuccaaagaaaguauaaccuggacuacagcgauucugaacccaauaaaagcgaguauaccuuuuccgcgaacgaccuggaaaugaagaauccuaaaguuccccuuuaccucaacaccagccugaaggauugcgccgggaaaaauaacucuuccgagaauaagcugaaggaggcuagccgcgcccauuggcagggaugucggaaagccgugcucaacgacaucgaugaagaccuguccuucccgucuuauauuagcagauuuaagaaacacaagcugaucccuugcuccccgcaucuggaguucgaagaugagcgccaguuuaauuguaaaucuagcccuugcacagucggcggccacuccgaccaugggaaggauuucucugugauucucaagagcaaccacaucuccaugaccagcaaaguuucuggauguggcaaucagcgguacaagagauacagcccccaauccugccugucucgcuauuccagcucucuggacacauccccuagcuccaugagcucucuucggagcacguguuccucucacagauuuaacgggaauagccggggaaaccuccugugcuuccauaaacgcgaacaccauuccguggagagacacaagcggaaaugccugaagcauaacuguuuuuaccucucugaugacauuaccaaaagcucccagaugcagucugagccccaaaaggaaagaaauugcaagcugugggagagcuucaaaaacgaaaaguauuccaaacgccgguacugucacugcagagagcgccagaaacuuggcaagaaucagcagcaauucagcgggcugaagucuacaagaaucaucuauugugauuccaacagccagauuucuugcaccggauccagcaagaaaccgccuaauugucagggcacacagcacgaccggcucgacuccuacucuaucgaaaagauguauuaccugaacaaaagcaagcgcaaucaagagucccugggcagcccccauauuugcgaucuugggaaagucagacccaugaaguguaacucuggaaauaucuccugccuccugaagaacuguagcucuggcccuagcgagaccacggaauccaauaccgcugagggggaacggacaccgcugaccgccaaaauucuccuggagcgcgugcaggcgaagaaaugccaggagcagucuagcaacgucgaaaucuccucuaauagcugcaaguccgagcuugaagcucccagccaagugccuuguacaauucagcuggcccccucuggaugcaacagacaggcccucccucuguccgagaaaauccaauacgcuagcgaaucccggaaugaccaggauucugccaucccccgcaccacggagaaggacaagagcaaauccucucacacaaacaacuuuaccauucuggcugauacagacugugauaaucaucuuagcaagggcaucauucaccucguuaccgagucccagagccugaacaucaaaagagacgccaccacaaaggaacagucuaaaccucugauuuccgagauccaacccuucauccagagcugcgauccggugccuaaugaauuucccggggcguucccuucuaacaaguauacgggcgucaccgacuccacagagacccaggaagaucagauuaaucucgaccugcaagaugugagcaugcacaucaaccauguugagggaaauauuaacucuuacuaugaccggacaaugcagaagcccgacaaaguggaggauggccuugaaaugugucacaagagcaucuccccgccucugauucagcagcccaucaccuuuucuccugacgagaucgauaaauacaagauucuccaacugcaggcccagcagcauaugcaaaaacagcugcuuagcaagcaccuucgcguccuccccgcugccgggcccacggcuuucuccccugccagcacagugcagaccgugccgguucaucaacacaccuccaucacaaccauucaccauacauuucugcagcacuucgcggucucugccagccucuccucucauagcucccaucugcccaucgcucaccuucacccucugucucaggcccacuuuagccccauuuccuucagcacgcucaccccuacaaucauccccgcucauccuaccuuucuggccggacacccgcugcaucuuguggccgcuacacccuuccacccuucucacauuacccugcagccccucccucccacggcguuuaucccgacccuguucggcccucaucucaaucccgccacaaccuccauuauccaccugaacccccuuauucaaccuguguuccaggggcaggacuuuugccaucacagcuguucuucccagaugcaacagcugaaugaagucaaagaggcucucaacgugagcacacaccugaauuga

SEQ ID NO: 78304 - RNA, 822 nt, Artificial Sequence
  derived and/or modified sequence opt5 from ZNF80__Homo_sapiens__NP_009067
augagccccaagagagacggccuggggaccggagauggccuccacucccaggugcugcaagagcaggucucuacaggggacaaccuucaugaaugcgauagccagggaccuuccaaagacacgcugguucgggagggcaagaccuacaaauguaaggaaugcgggucuguguucaauaaaaacagccuccuggugcgccaccagcaaauccauacaggagucaagccguaugagugucaggaaugcggcaaggccuuucccgagaaaguggauuucguuagaccuaugcggauucacaccggcgagaagcccuguaaaugcguggaaugugggaaggucuuuaaucgcagaucccaucuucugugcuaccggcagauccacacaggagagaaaccuuaugaauguucugagugcggcaagaccuucagcuaccacuccguguuuauucagcaucgcguuacacacaccggggagaaacucuucggauguaaggaaugcggcaagacguuuuauuacaacagcucucugaccagacauaugaaaauccacacaggggagaagcccugcaaauguuccgaaugcggaaagaccuucacauaucggagcguguuuuuccgccacucuaugacccauacggcuggcaaaccuuacgaguguaaggaaugcggcaagggguuuuacuauuccuacagccugacaagacacacccggucucauacaggagagaaaccguaugagugucucgaacaccgcaaggacuucggcuaccauuccgccuuugcgcaacagagcaaaauucacuccgggggaaagaaucuguga

SEQ ID NO: 78305 - RNA, 1185 nt, Artificial Sequence
  derived and/or modified sequence opt5 from ZNF812__Homo_sapiens__XP_011526544
augccccugcagagaugcgacgugggcgagcucugugaaccugggcugugcggacggcaagaggccaccgucgauggcaacagcgaaaauuguggggagguuuucuccgaaugguuuugccuuaagacacacaugcgcgcucagaacggaggcaauaucuucgaggggaacuguuacggaaaagacauucugucugugcauaaggaggccagcaucggccaggaacucuccaaauuuaauccgugcggcaagguguucacgcugacccccgaucuugcggcucaccuggggauucucaacgccagacagccuuauaaauguaaggagugccggaagggauuuaaauacuucgccucucuggacaaucauaugggcauccacauuggggaaaaguuuugugaguuccaagagugccgcagagcuaucacacauagcucccaccugaaacagugugucaccgugcacacaggaaagaaaucuaagaagaccaaaaagcauggcaaaucuuuuacaaacuucucccagcucagcgcccacguuaagauccauaaaggggaaaagucuuuugagugcaaagaaugcggacgguccuuccgcaauagcagcuccuuuaacgugcacauucagauccacaccggcauuaagccccauaaguauacggaguguggcaaggcuuucaccagaagcacacaccugacccaacauguccggacacacaccgggaucaaaccuuacgaaugcaaagaguguggacaggccuucacgcaguauacaggccuugcgauucauauccgcaaucacaccggggagaagcacuaccagugcaaagaauguggaaaggccuuuaacgggucuuccacacugacccaacauaagauuauccacaccggcgagaaacccuauggaugcguggaauguggcaagacauucaucacgagcuccuacagaucuaaacaucucaagacccaccacgaggaacggccuuuuguuugcaaaauuuguggcaaggcuuuccuguacagcuccccgcuuaaugugcaucugcagacacacacccgcgagaaggcccucaucugcaaagagugugggaaggcuuuugccgucagcucucaucuguccagacacgaacggauucauacaggagaggaacccuaugaguacaaaggcaugaacgugaccaucuga

SEQ ID NO: 78306 - RNA, 1854 nt, Artificial Sequence
  derived and/or modified sequence opt5 from ZNF813__Homo_sapiens__NP_001004301
auggcccugccccagggccuccugaccuucagagacguggcuaucgaguuuagccaagaagaguggaagugccuugauccugcccagcggacacuguaccgcgacgucaugcucgaaaacuauagaaaucugguuucccuugauauuucuagcaaauguaugaugaaggaguucuccucuacggcgcaggggaaccgggaagugauccacaccggaacacugcagcgccaugagagccaccauaccggcgacuuuagauuccaagagauugauaaagacauccacaaucucgaauuucaguggcaggaggaugaacggaacucccaugaggcuccgaugacagagauuaagaaacugaccgggucugccgaccgcuacgaucagagacacgccggaaauaagcccaucaaggaccaacugggcagcuccuuccacagccaucucccugaacugcacauguuucagacacaggggaaaaucggaaaccagguggagaagucuauuaaugaugcuuccagcaucucuaccucccaacggauuagcugccgccccaaaacgcauaucucuaacaauuauggcaacaauuucagaaacuccagccuucugacccagaagcaggaaguccacaugcgggagaaauccuuucaauguaaugaaucuggcaaggccuucaacuacagcucccuccugcgcaagcaccagauuauccaucuuggggagaaacaguauaagugcgacguguguggaaaaguuuuuaauagaaagcggaaccuggugugccaccgcagaugucauacaggcgagaaaccuuaccggugcaacgaaugugggaagaccuucagccagacauauucucugaccugccacagacgccuccauacgggagagaaacccuacaagugugaagagugcgauaaggcuuuuuccuucaaaagcaaucugaagcggcacagacgcauucacgccggcgaaaaaccuuacaagugcaacgagugugggaaaacauucucucaaaccagcucccucacaugccaucggagacugcacaccggagagaagccguuuaaguguaaugaaugcggcaaaaccuucucucgcaagagcucccuuacaugucaucaccggcugcacacgggcgagaaacccuauaagugcaacgaaugugggaaaaccuuuagccaggagcucacacugaagugccauagacgccuucacaccggagaaaagccuuacaaauguaaugagugcggcaaggucuucaacaaaaaggcgaaucuggcccggcaucacagacuccauucuggggagaaacccuauaaguguacagaaugcgugaagaccuuuucccgcaacagcgcucugguuauccacaaagccauccacauuggagagaagcgguacaaaugcaaugaauguggcaagacguucucuagaaucuccgcucuggugauucauacagccauccacaccggggagaaaccuuauaagugcaacgaguguggaaaaggcuuuaaucggaagacccaucucgcgugccaccaucgccugcacacaggcgaaaagcccuacaaauguaacgagugcgggaaggucuucaauagaaaaacccaccuugcccaucaccaucggcugcacacaggagacaagccguauaaauguaacgaaugcggcaagguguuuaaucagaaggcucaccucgccagacaucaccgccugcauacgggggagaaaccuuacaaguguaacgaaugcggaaaaguguucaaccagaaggcuaaucuugcccggcaccauagacugcacaccggcgagaaacccuacaaguuuaacgagugugggaaggccuucaauuga

SEQ ID NO: 78307 - RNA, 1956 nt, Artificial Sequence
  derived and/or modified sequence opt5 from ZNF816__Homo_sapiens__NP_001189386
augcugagagaggaagccaccaagaaaagcaaggagaaagaacccggcauggcucucccucaggggcggcugacauuccgcgacguggccaucgaguuuucccuugaagaguggaagugccugaacccggcgcaaagagcucucuaccgggccgucaugcuggagaauuaucgcaaccuugaguucguugauucuagccugaaauccaugauggaauuuucuagcacgagacacuccauuaccggagaagugauccauacaggcacccuccagcggcacaagucucaucacauuggggacuucuguuuucccgagaugaagaaagauauccaucacuucgaguuucaguggcaggaaguggagcgcaauggacacgaagccccuaugacaaagauuaaaaagcugaccggcagcacagacagauccgaucaucggcacgcugggaacaaacccaucaaggaccaacugggacucagcuuccauucucaucugccugagcuucacauguuucagaccaagggcaaaaucuccaaucagcuggauaagagcauuggcgccucuuccgcuagcgaaucucagcgcaucuccugcagacucaaaacgcacauuagcaacaaguacgggaaaaauuuccugcacuccucuuuuacccaaauccaggagauuuguaugcgggagaagcccugccagagcaacgaauguggaaaagccuucaauuauuccagccuucugcgcagacaucacaucacacauucucgggagcgcgaauacaagugcgacgucuguggcaagauuuuuaaccagaaacaauauaucguguaccaccacagaugccauaccggggagaagacauauaaauguaaugaaugcggaaagaccuucacgcagauguccagccucguuugucaccggagacugcauacaggcgagaaaccuuacaagugcaacgagugcgggaagaccuucucugagaaaagcucccugcgcugucaccggagacuccacacaggagaaaagccguacaaaugcaaugaauguggcaagaccuuuggccgcaacucugcgcuggugauccauaaagccauucacaccggggagaagcccuauaagugcaaugaauguggaaaaacauucagccagaaguccagccuucaaugccaucacauccugcauacgggcgagaaaccuuacaagugugaggaaugcgauaacgucuauauucggagaucucaccucgagcgccaccggaaaauccauaccggggaaggauccuacaaguguaaggugugcgacaaaguuuuuagaagcgauucuuaucuggcugagcaccagcgcgugcauacaggcgagaagcccuacaaauguaacaagugcgggcgguccuucagcagaaaauccucucuucaguaucaccauacccugcacacaggagaaaagccuuauaccugcaaugaguguggcaaagucuuuagccgccgggaaaaccucgccagacaccaucggcugcacgcuggcgagaagcccuacaagugcgaagagugugacaaaguguucucccgcagaucucaucuggagcggcacagacgcauucacacgggggaaaagccguacaaaugcaaggugugugauaaagccuuucggagcgacuccugccucgcgaaucauacaagaguccacaccggagagaagccuuacaaguguaacaaaugcgccaagguuuucaaucagaaaggcauccuggcucaacaucagcgcgugcacaccggggaaaagcccuauaaauguaacgagugcggaaagguguuuaaucagaaggccagccuugcuaaacaucagagaguccacacagccgaaaagccuuacaaauguaacgagugcggcaaggccuucaccgggcaaucuacacugauccaccaucaggcuauucacggcugccgggagacgcuccagauguga

SEQ ID NO: 78308 - RNA, 1986 nt, Artificial Sequence
  derived and/or modified sequence opt5 from ZNF81__Homo_sapiens__XP_011542204
augcccgccaacgaggacgcuccucagccgggcgaacacgggagcgccugcgagguguccgucucuuucgaagauguuaccguggacuuuagcagagaggaauggcaacagcuggauuccacacagcggcgccucuaccaggacgugaugcuggagaauuauucucaucuucugagcgucggauucgaggugcccaagccugaaguuaucuuuaaacucgagcaaggcgaagggcccuggacgcuggagggagaggcgccucaccaguccuguucugauggcaaguucgggauuaaacccagccagagacggaucuccggaaagagcaccuuucauucugaaauggagggcgaagacacacgcgaugacucccuuuacagcauucuggaggaacucuggcaggaugcugagcaaaucaaaagaugccaggagaagcacaacaagcugcugucucggaccacauuccucaauaaaaagauucugaacaccgaaugggacuaugaguacaaagauuuuggcaaguucgugcauccuuccccgaaucuuauccugagccagaaacgcccccacaagagagacucuuuugggaaguccuucaaacacaaccucgaucugcauauccacaauaagagcaacgccgccaaaaaucuugacaagacaauuggacauggccaggucuuuacccaaaacuccucuuauagccaccacgaaaauacgcauaccggggugaaauucugugagcggaaccagugcggaaagguucugucccucaaacacagccugucucagaaugugaaguuuccuaucggcgaaaaggcuaacacauguaccgaguucgggaaaauuuucacacaacgcucccacuuuuucgcuccccagaagauccauaccgucgagaaaccucaugaacugagcaagugcgugaauguguuuacgcagaaaccccuccugucuauuuaccuuagaguccaccgggacgagaagcuguauaucuguacaaagugcggaaaagccuucauucagaacagcgaacucaucaugcacgagaagacccauacacgcgaaaaaccguacaaguguaacgagugcggcaaauccuuuuuccaaguuucuagccugcuuagacaccagaccacccauacaggcgagaagcuguuugaauguuccgagugcgggaagggauucagccucaauucugcccugaacauccaccagaaaauucacacgggcgaacggcaucacaagugcuccgagugugggaaagcguuuacccaaaagagcacacugcgcaugcaucagagaauccacaccggagagcggucuuacauuugcacacaguguggccaggccuucauccagaaagcucaucucauugcccaccaaagaauccacaccggggaaaagccuuaugagugcuccgauuguggaaagagcuuucccuccaaaucucagcugcagaugcauaagcgcauccacacgggcgaaaaaccuuacauuugcacagaguguggcaaggcuuucaccaaucggagcaaccuuaauacccaucagaaaucccacacaggggaaaagucuuauaucugcgccgaguguggaaaagcguuuaccgacagaagcaacuucaauaagcaucaaacaauucacacgggcgagaagcccuacgugugcgccgauugugggcgcgcuuucauccagaaauccgaacugauuacccaccagcggauccauacaaccgagaagcccuauaaaugcccugacugcgaaaagagcuuuucuaaaaagccgcaccucaaggugcaucaaagaauccacacaggagagaaacccuacauuugugccgaaugcggcaaggcuuucaccgaucgcuccaacuuuaauaaacaccagacgauccauaccggggacaagccuuauaaauguagcgauugcggcaagggauucacacagaagucuguccuguccaugcaccggaacauucauaccuga

SEQ ID NO: 78309 - RNA, 1833 nt, Artificial Sequence
  derived and/or modified sequence opt5 from ZNF823__Homo_sapiens__NP_001073962
auggacagcguggccuucgaggaugucgcuguuaacuuuacccaggaagagugggcccugcucggccccucccaaaagucucuguacagaaaugugaugcaggaaacaauccggaaccuugacugcauugagaugaaaugggaagaucagaauaucggggaccagugucaaaacgcgaagcgcaaucugagaagccacacgugcgagauuaaagaugacucccaguguggagagaccuucggccagaucccugauucuauugugaacaagaauacaccgcgggucaaccccugcgacagcggggaauguggagaggugguucucggccauuccucucugaauugcaacauccgcguggauaccgggcacaaaagcugugaacaucaggaguauggagagaagccuuacacacacaagcaaagaggcaaagcuaucucccaucagcacagcuuucagacccacgaacggcccccuacaggcaagaaacccuucgacugcaaggagugugccaaaaccuuuucuucccuugggaaucugcgcagacauauggccgcucaccauggagauggcccuuauaagugcaagcucugugggaaagccuucgucuggccgagccuguuucaucugcacgaacggacgcacaccggagagaagcccuacgaaugcaaacagugcucuaaggcuuucccuuuuuauuccagcuaccuccgccacgagcggauucauacaggcgagaaagccuaugaauguaagcaaugcucuaaagcguuccccgacuacuccaccuaccugagacacgagcgcacacauaccggggaaaagccuuauaaguguacgcagugcggaaaagccuuuagcuguuacuauuacacaagacuucacgagcggacccacacaggcgaacagcccuaugcuugcaagcaauguggcaaaaccuucuaccaucacaccuccuuucgcagacauaugauccggcacacaggggauggaccgcacaagugcaaaauuuguggcaagggguucgacugcccuucuagcgugagaaaccaugagacgacccacacaggagagaagcccuaugaauguaaacagugcggcaagguucugucccauucuagcuccuuccgcagccacaugaucacccauacaggggacggaccucagaaaugcaagauuuguggcaaagccuuuggcugccccucucucuuccagcggcacgagagaacccacacgggggaaaagcccuaccaauguaagcagugcggaaaggcuuuuagccuggccggcucccuucgccggcaugaggcgacacacaccggggugaaaccuuacaaaugucagugcggaaaggccuucucugaucugagcuccuuucagaaucaugaaaccacacacaccggcgagaaaccguaugaguguaaggaaugcgggaaggcuuucagcuguuuuaaauaccucucucaacauaagagaacacacacggucgagaaacccuaugaaugcaagaccugucgcaaagccuucucccacuuuagcaaccugaaggugcaugagcggauccacucuggcgagaaaccuuacgaaugcaaggagugcggaaaggcuuucuccuggcugacaugucuccugagacaugaacgcauucacaccggcgagaaacccuaugaaugccuucagugugggaaggccuuuacacggagcagauuccugcgcggacacgagaaaacccauacgggcgagaagcucuacgaaugcaaagagugugggaaggcccuguccucucuucggagccugcacagacauaagcggacccacuggaaagacacacucuga

SEQ ID NO: 78310 - RNA, 3234 nt, Artificial Sequence
  derived and/or modified sequence opt5 from ZNF827__Homo_sapiens__NP_849157
augcccagacggaagcaggagcaaccuaaacgccugccgagccacguguccagacaggaagaggccgaaggcgagcucucugaaggggagcauugguacggaaacagcuccgagacccccucugaagcuagcuauggcgagguccaggaaaauuacaagcugucccuugaggaccggauccaggagcaaucuacaagcccugauacgucccuggggagcaccacacccucuucccacacccucgaacugguugcccuugacagcgaggugcugcgcgauucucuccagugccaggaccaucuguccccuggagugagcucucugugugaugacgaucccggcuccaacaaaccucucagcuccaaucugagacggcuucuggaagcggggucucucaagcuggacgcugccgccacagcuaacggacgcgucgagagcccggugaauguuggcuccaaccuuagcuucucucccccuucccaccaugcccagcaacugagcgugcucgcuagaaaacuggccgaaaagcaggagcagaaugaucaguauacccccucuaaccgguuuauuuggaaucaaggcaaguggcugccuaacagcacaaccacgugcucccucucucccgacagcgcgauccugaaacuuaaggccgcugccaaugcuguccugcaggauaaaucccucacccgcacagaggaaaccaugagauucgagagcuuuucuuccccguucagcucucaguccgccagcuccacacuggcggcccuuucuaagaaagugagcgaacggucccugaccccugggcaagagcaucccccucccgcuucuagcuuucucucccuggccagcaugacgucuuccgcugcccugcucaaggaaguugccgcucgcgcggccggaagccugcuugcugagaagucuucccugcuccccgaggacccucugccgcccccucccagcgaaaagaagccugagaaagugacacccccgccucccccucccccucccccgccucccccucccccgccccagucucuugaacugcuccugcugccuguccccaagggcagagugagcaaaccuuccaacagcgccucugaggaagaguccgggaagcccuuccaguguccuauuugcggacucgugaucaaacgcaagagcuacuggaagcggcacauggucauucacaccggccugaaaucccaccaguguccccuuugcccguuuagaugugcccggaaggauaaucugaaaucucauaugaagguucaccaacaccaggacagaggggagacauuccagugccagcucuguccuuuuaccagcucccgccauuucucucugaaacugcacaugcggugccaucaacacuuucuuagaaccgaagcuaaggugaaggaggaaauccccgacccugaugugaaaggaagcccccaucucuccgacucugccugucugggccagcagcgcgagggcgggggaacagagcuggucggcacgaugaugaccagcaacacaccggaacggaccucccaagggggagcgggcgugagcccucuccugguuaaggaggaacccaaagaggauaaugggcuuccuacaucuuucacccugaacgcugccgacagacccgccaaccacacgaagcucaaagaucccuccgaauauguggcuaauagcgccucugcucuguuuucccaagacaucagcgucaagauggccucugauuuccugaugaaacuuuccgcggccaaccagaaagagccuaugaaucucaacuucaaggugaaagaggaaccgaaggagggagaaagccuguccacaacccugccccgcagcucuuacguuuuuagcccugaguccgaagugucugcucccggcgucagcgaggacgcccucaaaccucaggagggcaagggguccgugcugcggagagaugucucugugaaggcugccagcgaacuucugaugaaacucuccgcggagucuuauaaggaaacccagaugguuaaaauuaaggaggaacccauggagguggacauccaagauagccacgucuccauuagcccuucucgcaaugugggauacuccacacugaucggccgggagaaaaccgaaccgcugcagaagaugcccgaggggagaguuccucccgaacgcaaccuuuucagccaggacauuucugugaaaauggccuccgagcuccuguuucaacugagcgagaaggucuccaaggaacauaaucacacaaaagagaacacgauccggaccacaaccucuccuuucuuuagcgaagacacauucagacagucccccuuuaccagcaauucuaaggagcuccugccguccgauagcgugcuucauggacggauuucugcuccugaaacggagaaaaucgugcuggaggccggcaacgggcuccccagcuggaaguucaaugaccagcuguuucccugcgauguuugcggcaaagucuucggacgccagcaaacccuguccagacaccuuucucuccacacagaggaacggaaguacaagugucaucugugcccuuaugcugccaaauguagagccaaccugaaucagcaccucaccgugcauagcgugaagcuggucuccacagacaccgaagauaucgugucugcuguuacgagcgagggcuccgacgggaaaaagcaccccuacuauuacagcugccauguguguggauuugaaacagagcuuaacguccaguucgugucucacaugucccugcacguugauaaagagcaguggauguuuagcauuugcuguaccgcgugcgacuucgugacaauggaagaggccgaaaucaagacccauauuggcaccaagcacacaggggaggaucgcaaaacgccuuccgaaucuaauagcccguccucuagcucccucagcgcucugucugacuccgccaacagcaaggaugacucugauggaucccagaaaaacaagggcgggaauaaccugcuugucaucagcgugaugcccggcucucagccuagccucaauuccgaggagaaacccgaaaagggauucgaguguguguuuugcaacuucguuuguaagaccaaaaauauguuugaacggcaucugcagauucaccugaucacaagaauguucgagugcgacgucugccauaaguuuaugaaaaccccugagcagcuccuggaacacaagaaaugucacacagugcccaccggcgggcuuaaguga

SEQ ID NO: 78311 - RNA, 1542 nt, Artificial Sequence
  derived and/or modified sequence opt5 from ZNF829__Homo_sapiens__NP_001165450
augaccggcaaggggcugggagaggacacagaagauagauggggcgccggggcucucggacccugcggccggagcgggcugaaaggaggcggcugugugugggaggccgaagcugggggaucccgcggccaggagaucgaaacgauucuugcuaacauggagaccucucugagaagcgggcaaaucccuacacucgacuccucugagcacaaucugagcccggaaccccuugagcuggaucggaugccucauagcccccucauuucuaucccucacgucuggugccaucccgaagaggaggaacgcaugcacgacgagcugcugcaggccguuagcaagggaccugugauguucagagauguguccauugacuuuagccaggaagagugggaaugucucgaugccgaccagaugaaccuguacaaagaggucaugcuugagaauuucucuaaccugguguccguuggccucagcaauucuaagccggcugugaucucccugcuugaacaagggaaagagcccuggauggucgaucgggaacugacccgcggacucugcagcgaccuggagucuaugugugaaacaaagauccugucccucaagaaaagacauuuuagccaggugauuaucacccgggaggauauguccacauucauucagccuaccuuucugauucccccucagaagacgaugucugaggaaaaacccugggagugcaagauuuguggcaaaaccuucaaccaaaauagccaguuuauccagcaccagcgcauucacuucggcgaaaagcauuaugaguccaaggaauacgggaaauccuuuucuagaggaucccuuguuacacggcaccaacgcauccauaccggcaagaaaccguaugagugcaaggagugugggaaagccuucagcugcucuagcuacuuuucccagcaccagagaauccacacaggagaaaagccuuaugaguguaaagaaugcggcaaggcuuucaaguacugcucuaaccugaaugaccaucaacggauucacaccggggagaaacccuaugaguguaaggugugcggaaaagccuuuacaaagagcucccaacucuuccugcaucuucgcauccacacgggcgaaaaaccuuacgaguguaaggaaugcggcaaggcguucacccagcauagcagacugauucagcaccagcggaugcacacaggggagaaacccuacgaauguaagcagugcggaaaagccuuuaacucugcuuccacccucaccaaucaucacagaauccaugccggcgagaagcuguaugagugugaagagugccgcaaagcguucauucagagcucugaacugauccagcaccaacggauccacacagaugagaagcccuacgaauguaacgagugcgggaaggccuuuaauaaaggauccaaccucacgagacaucagcgcauucacaccggcgagaagccuuaugacuguaaagaaugcgggaaggcguucggcagccgguccgaccugaucagacaugagggaauccacacaggcuga

SEQ ID NO: 78312 - RNA, 5034 nt, Artificial Sequence
  derived and/or modified sequence opt5 from ZNF831__Homo_sapiens__NP_848552
auggaagugcccgaaccuaccugccccgcgcccccugcuagagaccagcccgccccuacccccggcccuccgggggcgcccggaggccaagcuagcccucaccugacgcucgggcccguccugcuuccucccgagcagggacuggcucccccuaccguuuuccucaaggcccugcccaucccucuuuaccacacagugccgcccggcgggcugcagccucgggccccgcucgugaccggaucccuggauggcggcaacguccccuuuauucugucuccugugcuccagcccgaagggccuggacccacacaaguuggcaaaccggccgcuccuacccugacagugaauaucgucgggacccuucccgugcugagcccuggacucggccccacgcugggguccccuggaaagguucgcaacgccggcaaauaucuuuguccccacugcggcagagacugucugaagccgucugugcucgagaaacauauucggucccacaccggggaacgcccuuuccccugcgcgacauguggaaucgccuuuaagacccaguccaaucuguacaagcauagacggacacagacccaccugaacaauucucgccucagcuccgagagcgagggcgcugggggaggccugcuugaagagggggauaaagccggagaacccccuagaccggagggccggggcgagucucgcugccaggggaugcacgaaggagcuuccgagagaccccugagcccuggcgcccaugucccccuccuggccaagaaccuugacgugcggacggaagccgcuccuugucccgggucugccuucgcugaucgcgaggccccuugggacuccgcccccauggcuagcccgggacugccugcggccucuacacaacccuggagaaaacucccugaacagaagucccccaccgcuggcaaaccgugcgcccugcagcggcagcaagccacagcugccgagaagccuugggaugcgaaggcucccgaggggcgccugagaaaaugugaaagcaccgacuccggcuaucucucucggagcgauuccgccgagcagccucacgcccccugcagcccccugcauucucuuuccgaacacagcgcugagucugaaggagagggcgggccuggaccgggccccgggguggccggagcugagccuggcgccagagaagcggggcuggagcucgaaaagaaacgccuggaggaacggauugcccagcuuaucagccacaaucaagcugucguugacgaugcccagcuggacaacgugagaccccgcaagaccggccucuccaaacagggaucuaucgaucugccuacacccuacacguauaaggacagcuuucauuucgacauucgggcucuggagccuggcagacgccgggccccggggcccgugagauccaccuggacaccucccgauaaaagccgcccucucuuuuuccacucuguccccacccagcuguccacaaccguggaguguguuccggugacgcggagcaauucucuuccuuuugucgaaggauccagaacauggcuggagccccgcgaaccccgggacccuuggagcagaacccaaaagccccucuccccucggccgggccccgcgcgccuggggugcagaucuggacugagcuccaccgaugugccuucuggccauccccgggcccuuguuagacaggcugccguggaggaccucccugggacacccaucggcgaugcucuggucccggccgaggacaccgaugccaagcgcacagcugcgcgggaagccauggcuggaaaaggcagagccgggggacgcaagugcggccagagacggcugaaaauguucagccaggagaaguggcaaguguacggggacgaaacguuuaaacgcauuuaucagaagaugaaggccuccccucacggaggcaaaaaggcuagagaggucgggaugggcagcggagccgaacucggcuucccccugcagaaagaggcggcugggucuuccggaaccgugccuacacaggaucggcgcacccccguucaugaggacaucagcgccggcgccacaccugaacccugggggaacccgccugcucuugaggccucucuggugaccgaacccacgaagcacggagagaccgucgcgagacggggcgauuccgaccgccccagaguggaagaggcuguuagcucuccugcccucggcgggcgggacagcccguguuccggaagccgcucuccccugguguccccuaauggcagacuggagcuuggguggcaaaugcccccugcccccggaccucucaaaggcggggaugucgaagcuccgcggcccguguggccugaccccaagcuggagggaggcgccagaggcgugggggauguucaggaaacaugccugugggcucagaccguccuccgcuggccuagccggggauccggcgaggacaagcugcccucugaacgcaagaaacuuaaaguggaggaucugcacagcuggaagcagccggagccuguguccgccgaaacacccgggggacccacccaaccugcgucucucagcucccagaaacaggacgccgaucccggcgaggucccugggggaucuaaggaaagcgcucgccaagugggcgagccgcuggaguccagcggcgccucucuggcugccgccuccguugcucuuaagcggguggggcccagagacaaagcgacgccucuccaucccgccgcuccugcccccgccgaacacccgagccuggcuacaccuccccaggccccucgcguccugucugcgcucgcugauaacgccuuuucccccaaguaccugcuucggcugccucaggccgagacaccccugccgcugccuauucccuggggacccagacauagccaggacucucuguguuccagcggcuggccugaagaaagagcuuccuucguggggagcggacuuggcacaccgcucucucccagcccugccuccgggcccucuccuggagaagcggauagcauccuggaggaccccuccugcucucggccucaagauggcagaaaaggcgcucagcucgggggagacaagggcgaccggauggccaccagccgccccgccgcuagagagcucccgauuuccgccccuggggcuccccgggaagccaccucuagcccucccacaccgacgugugaggcgcaccugguucaggauauggaaggagacucccaccgcauccauagacuuugcaugggcagcacccuggcccgggcuagacucucuggggaugugcugaauccuuggguccccaacugggagcugggagaacccccuggcaaugcccccgaggacccuuccagcggcccgcuuguggggcccgauccuuguucuccccugcagccuggauccuuccucacagcucugacccgcccccaaggcguuccuccgggguggcccgagcucgcccugagcucccacucuggaacaagccggucccauagcaccagaucuccucacuccacgcagaaccccuuuccuagccuuaaagccgaaccccgccugacauggugcugucucucucggagcgugccgcugccugcugagcagaaggcgaaagccgcuuccgucuaccuggccgugcauuuccccggcucuagccuuagagacgaagggcccaacggaccucccggcuccaauggcggguggaccuggaccucuccuggagagggcgggccggcccagaugagcaaguuuuccuaucccacagugccuggagucaugccccaacaccagguuagcgaaccugaguggaagaaaggccugcccuggcgcgcuaagaugucucgggggaacuccaaacagagaaagcucaaaaucaauccgaagcgcuacaagggaaacuuccugcaaagcugcgugcagcucagagccucccggcugcgcaccccuacaugggugagacggcgcucuagacaucccccugcgcuugagggccugaaacccugucggacgccgggccagaccagcuccgaaauugcugggcucaaucugcaggaggaaccuucuugcgccacaagcgagagcccgcccugcuguggaaaggaggagaaaaaggagggcgauugcagacaaacccuggggacacuuagccugggaaccucuucccgcaucguccgggaaauggacaaaagaacggugaaggauauuagcccuucugccggcgagcauggggacuguaccacacacuccaccgcugccacaagcggccucucucugcagagcgauaccugccucgcgguugugaacgacgucccccugccuccgggaaagggccuugaucuggggcugcucgaaacacagcugcuugccucccaggacucugugagcaccgaccccaaaccuuauaucuuuuccgaugcucaacgccccagcuccuucggaucuaagggcacguuuccucaucacgacauugccacaagcguugcugccguguguaucucccugcccguccggaccgaucauaucgcucaggagauucacucugccgagagcagagaccacucccagaccgcggggcggacacucaccucuagcuccccugauagcaaagugacggaagagggacgcgcccagacacugcucccgggcagacccucuuccgggcaacggaucagcgacucuguuccucuggaauccaccgagaagacacaucuugaaauucccgcuagcggcccuucuuccgccagcucccaccauaaagagggacgccacaagaccuucuuucccagcagaggccaguacgggugcggagagaugacagugccguguccuucucugggcagcgaugggcggaagcgccaggucuccggacugaucaccagaaaagacucuguggugcccagcaagcccgaacagccuauugagauccccgaagcuccuuccaaaucucucaagaaacggagccuggagggcaugcgcaagcaaacgagagucgaguucuccgauaccucuagcgacgaugaggaccggcuuguuaucgagauuuga

SEQ ID NO: 78313 - RNA, 3480 nt, Artificial Sequence
  derived and/or modified sequence opt5 from ZNF91__Homo_sapiens__NP_001287880
augcccggcaccccugggagccuggagaugggacuccugacauucagagacguggccaucgaauuuuccccggaggaauggcagugccuugauacggcucaacagaaccuguaccggaaugucaugcucgagaacuaucgcaaucuggccuuccuuggcauuuguccccacuuuccucaggacuucuggcccgaacagucuauggaggauagcuuucaaaagguucugcucagaaaauacgagaagugcgggcaugaaaaccugcagcugcggaaaggauguaaguccguggacgagugcaaagugcacaaggaaggcuauaauaagcucaaccagugucugaccacagcgcagucuaaagucuuccaaugcgggaaguaccuuaaaguguuuuauaaguuccugaauagcaaccgccauaccaucagacacacaggcaaaaaguguuuuaagugcaaaaaguguguuaaauccuucugcauucggcuccauaagacccagcacaaauguguguacaucacagagaagucuugcaaaugcaaggagugugaaaagaccuuucacuggagcuccacgcugaccaaucauaaagagauucacacagaagauaagccuuauaaaugcgaggaauguggaaaggcuuucaaacagcuuagcacccugacaacccauaagaucaucugcgccaaggagaaaauuuacaagugugaggaaugcggcaaagccuuucucuggucuuccacgcugacacgccacaagagaauccacaccggggagaaacccuacaagugugaagagugcggaaaggcuuucagccauucuuccacacuggccaaacacaagcggauucauaccggcgaaaaaccuuauaagugugaggagugcgggaaggcuuucagcagaucuuccacccucgccaaacacaagagaauccauacaggagaaaaaccguacaaguguaaagagugcggcaaggcguuuagcaacuccucuacgcuggccaaucacaaaauuacccacacagaagagaagcccuauaaaugcaaggaaugugacaaggcuuucaaacggcuuagcacccugacaaagcauaaaaucauucacgccggggagaagcucuacaaaugcgaggaauguggaaaggcuuuuaaccgcuccagcaaucugaccauccauaaguucauccacacgggcgagaaaccuuauaagugcgaagaguguggcaaagccuuuaacuggucuuccagccuuacaaagcacaaaagauuccauacccgggagaagcccuuuaagugcaaagaaugugggaaggcguucauuuggucuagcacccugacacgccacaaaagaauccauaccggagagaagccuuacaaaugcgaagaguguggcaaggccuuucggcaguccucuacacucacgaagcacaaaauuauccauaccggggaaaagcccuauaaauucgaggagugcggaaaggcuuuuagacaaagccugacacugaauaaacacaagauuauccacucccgcgaaaaaccguacaaguguaaggagugcggcaaagccuucaagcaguuuagcacccucacaacccauaaaaucauucacgcugggaagaaacuguacaagugcgaagaguguggaaaggccuucaaccauucuuccagccuuucuacgcacaaaaucauucauaccggcgaaaaguccuauaaaugcgaggaguguggcaaggccuuccuguggagcuccacacuccggagacacaaacgcauccacaccggggaaaagccuuacaagugcgaggaauguggaaaggcuuuuucucauagcuccgcgcuggccaaacacaaacggauucauacaggcgagaagcccuauaaaugcaaggaaugugggaaggcuuucucuaacagcuccacccuugccaaucacaaaaucacgcacacagaggagaagccuuacaaaugcaaggaaugugauaaaaccuuuaagagacugagcacacucaccaagcauaaaaucauucacgccggagagaagcuguauaaaugcgaagaguguggcaaggcuuucaaccggucuuccaaucugaccauccauaaauuuauucacacaggggagaagcccuacaaaugcgaagagugcggcaaggccuucaacuggucuagcucccucacgaagcauaaacggauccacaccagagaaaagcccuuuaaauguaaggagugcggaaaagcguucauuuggagcucuacacugacccgccacaagcggauccauacaggcgaaaagccuuauaaaugugaggagugcgggaaggcuuuuagcagauccagcacccuuacgaaacacaagacaauucauaccggagaaaaaccguacaaguguaaggagugcggcaaagccuucaagcacucuuccgcccuggcuaaacacaagaucauccaugccggggaaaaacucuacaagugugaggaaugcggaaaggcuuuuaaucagagcuccaaccugaccacacacaaaauuauccauaccaaggagaaacccucuaagagcgaggaaugugacaaagccuucauuugguccucuacacugacggagcacaagcgcauccauacccgggagaaaacauauaagugcgaagaauguggcaaggcguuuagccaaccuucccaccuuaccacacacaaaagaaugcauaccggggagaagcccuacaaaugcgaggaaugcggcaaggccuucucucagagcuccacgcucaccacacacaaaauuauccauaccggagagaagccuuauaagugugaagagugcggcaaggcuuuccgcaaaagcucuacacugaccgagcacaaaaucauucacacaggggaaaagcccuacaaaugugaggaaugcggaaaggccuuuucccagagcucuacccugacgcgccauacaagaaugcacaccggcgagaagccguauaaaugugaagagugcgggaaggcuuucaaucgguccagcaaacucaccacacauaagaucauucacaccggagagaaaccuuacaagugugaagagugcggcaaggccuuuaucucuuccagcacgcugaacgggcauaaacgcauucacacacgcgaaaagcccuauaaaugugaggaaugcggcaaggcguucucccagagcucuacccuuacacggcacaaaagacugcauaccggagagaagccuuacaaauguggcgagugcgggaaggccuuuaaggaaagcuccgcucucacaaaacacaagaucauccauaccggagagaaacccuacaagugcgaaaaauguggcaaggccuucaaucaaucuagcauucugacgaaccacaagaaaauccauaccauuacaccugucaucccccugcuuugggaggcugaagccgggggaucccgcggccaggagauggagaccauucucgccaauacagugaagccgcugcuguauuga

SEQ ID NO: 78314 - RNA, 1665 nt, Artificial Sequence
  derived and/or modified sequence opt5 from ZNF92__Homo_sapiens__NP_001274461
augggcccccugaccuucagagacgugaagaucgaguuuagccucgaagaguggcagugccuggauacagcccaacggaaccuuuaccgcgacgucaugcuggaaaauuauagaaaccucguuuuccuggugauguguucccacuuugcucaggauguguggccugagcauucuauuaaagacagcuuccagaaggucauccuucggacguacgggaaauauggacacgaaaaucugcagcuccgcaaggaucauaaauccguggacgccugcaagguuuacaagggcggguauaacggacugaaucaaugucugaccacaaccgauucuaaaauuuuucagugcgacaaguacgugaaagucuuccacaaguuuccgaacgugaauagaaacaaaauccggcauacaggcaagaagcccuucaaauguaagaaucgcgggaaauccuuuugcaugcucucccagcugacccagcacaagaaaauucacacaagagaguauucuuacaagugugaggaaugcggaaaagcguucaacuggagcuccacccuuacgaagcauaagaucauccacaccggcgagaaaccuuacaagugugaagagugcggcaaggcuuuuaaucggagcucuaaccugacaaaacauaaaauuauccacaccggggagaagcccuauaagugugaagagugcggaaaagccuucaaucgcuccagcacacucaccaagcacaaaagaauccauacggaagagaagccuuacaaaugcgaagaguguggcaaggccuuuaaccaauucucuauucugaauaagcacaaacggauucauauggaggauaagcccuauaaaugcgaagagugugggaaggcuuuccgcguuuuuagcauccuuaaaaagcacaagauuauccauacaggagaaaaaccuuacaagugcgaggaauguggcaaagccuucaaccaguuuagcaaccugaccaagcacaaaaucauucacacaggggagaagccguauaaaugcgacgaguguggaaaggcuuucaaucagucuuccacccucaccaagcauaaaagaauccacacaggcgaaaagcccuacaaaugcgaggaauguggcaaggccuuuaaacagagcuccacgcugaccgagcauaagauuauccacacaggggaaaagccuuauaaaugcgagaaguguggaaaagcguucucuuggagcuccgccuuuaccaagcacaaacggaaccauauggaggauaagcccuacaagugcgaagagugcggcaaggcuuucagcguguuuucuacacugaccaaacacaaaauuauccauacgcgcgaaaagccuuacaaaugugaggagugcgggaaggccuucaaucaauccagcaucuuuacaaagcacaaaauuauccauaccgaaggaaagucuuauaaaugugagaagugcggcaacgcuuucaaucagagcuccaaccucaccgccagaaaaauuaucuacacaggggaaaagcccuauaaauacgaggaaugugacaaggcguuuaauaaguucucuacccugauuacacaccagaucaucuauacgggagagaaaccgugcaagcacgaguguggccgggccuucaacaaaagcuccaauuacaccaaggaaaaacuucaaacauga

SEQ ID NO: 78315 - RNA, 1863 nt, Artificial Sequence
  derived and/or modified sequence opt5 from ZNF93__Homo_sapiens__NP_112495
augggcccccugcaguucagagacguggccaucgaguuuagccucgaagaguggcacugccuggauaccgcucaacggaaccuuuaccgcaaugucaugcuggaaaacuauuccaaucucguuuuccuggggauuguggugucuaagccugaccuuaucgcccaucuggagcagggcaaaaagccgcucacaaugaaaagacacgaaauggucgcgaaccccagcgugauuuguucccauuuugcucaggaucuguggccugagcagaauaucaaggacucuuuccaaaaaguuauucugcggcgcuacgagaagagaggacacgggaaccuccagcugaucaagcggugcgaaagcguggaugaguguaaaguccauacgggaggcuauaaugggcuuaaccagugcuccaccacaacccagucuaagguguuucaaugugacaaauacggaaagguuuuccacaaauuuagcaauuccaaccgccacaauaucagacauacagaaaagaagcccuucaaaugcauugaguguggcaaggccuuuaaccaguucagcacccugaucacacacaaaaagauucauaccggcgagaaaccuuauaucugcgaagagugugggaaggccuuuaaauacucuuccgcucucaauacgcacaagcggauucacaccggagaaaagcccuauaaaugcgauaagugugacaaagccuucaucgcuagcucuacacuguccaagcaugagauuauccacaccggcaaaaagccuuacaagugcgaagagugcgggaaagccuuuaaccagagcucuacacuuaccaagcauaaaaagauccacacgggagagaaaccguacaagugugaagagugcggcaaggcguucaaucaguccagcacacugaccaaacauaagaaaauucacacaggggaaaagcccuaugugugugaggaaugcggaaaagccuucaaguacucccgcauccucaccacccacaagcggauucauacaggcgagaaaccuuauaaguguaacaaaugcggcaaggcuuuuaucgccucuagcacgcuguccagacacgaguucauucauauggggaaaaagcacuacaaaugugaagagugcggaaaggcuuuuaucuggagcucuguccugacccgccacaagagagugcauacaggcgaaaaacccuauaagugugaggaaugcgggaaagccuucaaguacuccagcacccucucuagccacaaacggucccauacaggagagaagccuuauaagugugaggaaugcggcaaagcguuuguggccucuagcacccuguccaagcacgagaucauucauacggggaaaaagcccuacaaaugcgaagaguguggaaaggcuuucaaccaaagcagcucccuuacaaagcacaaaaagauccacaccggcgagaaaccguacaagugcgaagaguguggcaaagccuuuaaucagucuucuucccugaccaagcauaagaaaauucacacaggggaaaagccuuauaaaugcgaggaauguggaaaggcuuucaaccagagcuccacccucaucaaacauaagaaaauucacacacgcgagaagcccuacaagugcgaggaauguggcaaagccuuucaucugucuacgcaccuuaccacacacaagauccugcauaccggggagaaaccuuauagaugccgggaauguggaaaggccuucaaucacagcgcuacacucuccucucauaaaaagauccacagcggcgagaagcccuacgaaugcgauaaaugugggaaggcguuuauuucccccagcucucuguccagacacgagaucauucauaccggcgagaaaccuuga

SEQ ID NO: 78316 - RNA, 1719 nt, Artificial Sequence
  derived and/or modified sequence opt5 from ZNF98__Homo_sapiens__NP_001092096
augcccggcccucuggggagccucgagaugggagugcugaccuucagagacgucgcccuugaauuuucccuggaggaauggcagugccucgauacagcucaacagaaccuguaccggaauguuaugcuugagaacuaucgcaaucugguguucgugggcaucgccgcgucuaagccggaccucauuacgugucuggaacaggggaaagagcccuggaacgucaagagacacgagauggugaccgaaccucccguuguguacagcuauuuugcucaggaucuguggccuaaacaaggaaagaaaaauuacuuccagaaggucauccuccggacauauaagaaaugcggccgcgagaaccugcagcuuagaaaguacuguaaauccauggacgaaugcaaggugcauaaagaguguuauaaugggcugaaccagugccucaccacaacccaaaauaagauuuuucaguacgauaaguacguuaaaguguuccacaaguuuucuaacagcaaucggcauaaaaucggacacacaggcaagaaauccuucaaguguaaagagugcgaaaagucuuuuuguaugcugagccaucuugcccagcacaagcgcauucacuccggcgagaaacccuauaagugcaaagaaugugggaaggccuacaacgaggcuagcaaucugucuacccauaaaagaauccacacgggaaagaagccuuauaaaugcgaagagugcggcaaggccuucaaccggcucucccaucugaccacacacaaaaucauucacaccgggaagaaaccguacaagugugaggaaugcggaaaggcuuuuaaucagagcgccaaccugacaacccauaaacgcauccacacgggcgagaagcccuauaaaugugaagagugcgggagagcguucucucaauccagcacacucaccgcccauaagauuauccacgcuggagaaaaaccuuacaagugugaggagugcggcaaggccuuuucucaguccagcacacugaccacccauaaaauuauccacacaggcgaaaaguucuauaaaugugaggaaugcgggaaggcuuucucccggcuuucucaccugacgacccauaaacgcauucacagcggagagaagcccuacaaaugugaagagugcggcaaggccuuuaagcaguccagcacacucaccacacauaaaagaauccacgcgggggagaaguucuacaaaugugaagucugcucuaaggccuuuucccgguucagccaccugaccacgcauaaacgcauccacacaggagagaagccuuauaagugcgaagaguguggcaaggcuuuuaaccuuucuagccaacugaccacccauaaaauuauccacacaggggagaaacccuacaagugcgaagaguguggaaaagccuucaaucaguccucuacccucagcaagcauaaggugauucacacaggcgaaaaaccguauaagugcgaggaauguggcaaggcuuuuaaccaguccagccaccugacgacccauaaaaugauccacacaggggagaaaccuuacaagugcgaggaauguggaaaggccuucaauaacucuuccauucugaauagacauaaaaugauccacaccggcgagaagcucuauaaacccgaaagcugcaacaaugccugugacaacaucgcuaagauuucuaaauacaagcggaauugcgcgggggagaaauga

SEQ ID NO: 78317 - RNA, 5757 nt, Artificial Sequence
  derived and/or modified sequence opt5 from ZNFX1__Homo_sapiens__NP_066363
auggaagaaagacggccccaccuggacgcccgcccuagaaacagccauaccaaucaccggggcccgguggauggggagcugcccccucgcgcuagaaaccaggccaauaaucccccugcgaaugcucugcggggaggcgccucccaucccgggcgccacccuagagccaacaaucauccggcugccuacuggcaacgggaagaacgcuucagagcuaugggacggaacccccaccagggccgcagaaaucaggaagggcacgccucugacgaggcgcgggaucagcgccaugaccaagagaacgauacaagauggcggaauggaaaccaggacugcagaaaucgccggccucccuggagcaacgauaauuuucagcaguggagaacgccucaccaaaagcccaccgaacagccgcagcaggccaagaaacuuggcuauaaauuccuggagucccuccugcaaaaagacccuucugaagucguuaucacccuugcuaccagccugggccucaaagagcugcugucccauucuagcaugaaguccaacuuucucgagcugauuugucaggugcuucgcaaggccugcagcucuaaaauggaucggcaguccgugcugcacguccucgggauccugaagaacagcaaauuccuuaaggugugucugcccgcuuacguugugggaaugauuacagaaccuauccccgacauuagaaaucaauaucccgagcacaucucuaacaucauuucccuccugcaggaucuggucagcguguuuccugccucuuccguucaggaaaccagcaugcucgugucccugcuuccgacaucucugaaugcgcuccgcgccagcggcgucgacaucgaggaagagaccgagaaaaaccuggaaaaggugcagacgauuaucgagcaucuucaagaaaagcggagagaggggacccugcgcguggauacauacacccucguccagcccgaagcugaggaccacguugaguccuaucggacaaugccuauuuaccccaccuauaaugaagugcaucuggacgagagaccuuuccugcgccccaacaucauuagcggaaaauacgauucuacggccaucuaccucgacacacacuuucggcugcuuagagaagauuucgugcggccgcugcgcgagggcauccucgaacugcuucaguccuuugaggaccaggggcugagaaagcggaaauucgaugacauuagaaucuauuuugauacccgcauuaucacaccuaugugcagcucuagcggaauugucuacaaggugcaauucgacaccaaaccccucaaguuuguucgguggcagaacuccaaaagacugcuguauggcucucucguguguaugagcaaggauaacuucgagaccuuccuguuugcuacagucuccaaucgcgaacaggaggaccuuugcagaggcaucgugcagcuguguuucaacgaacaaagccagcagcuccuggccgagguucagccuucugauuccuuucugaugguggagacgaccgccuacuucgaggcuuaucggcauguccuugaggggcuccaagaagugcaggaggaagacguccccuuucagcgcaauaucguggagugcaacagccacguuaaggagccuagauaccugcugaugggaggccgguaugacuucacaccccucauugaaaauccgucugcgaccggggaguuucugcgcaacguggaaggacuuagacacccucggaucaauguccuggaucccggccaauggcccuccaaagaggcccucaagcuggacgauagccagauggaagcucugcaguucgcccuuacacgcgagcucgccauuauccaggggccuccgggaaccggcaaaacguacgugggccugaagauuguucaagcucugcucacaaacgaguccguguggcagaucucucugcagaaauuucccauccuugucguguguuacaccaaccaugcccuggaccaguuccucgaagggauuuauaauugccaaaagaccagcaucgugagaguuggaggccgguccaacucugagauucugaagcaguuuacacugcgcgaacuuagaaauaaacgggaguucagacgcaaccucccuaugcaccuccggagagcguacaugagcaucaugacccagaugaaggaauccgagcaggagcugcaugaaggggcuaaaacacucgaguguacgaugcgcggaguccugcgggaacaauaucuucagaaguacauuagcccccagcacugggagucucugaugaauggcccugugcaagauuccgaguggaucugcuuucagcacuggaaacauagcaugaugcucgaauggcuggggcugggcgugggaucuuucacccaguccgucagccccgccggcccugagaacacagcccaggcugaaggggacgaggaagaggagggagaagaggaaucuagccuuauugagaucgccgaagaggcugaucucauccaagccgacagagugauugaggaagaggaaguugugcgcccccagcggagaaagaaggaggaauccggcgcggaucaggagcuggccaaaaugcugcucgcuaugcgccuggaccacugcgggaccggaacagccgcuggccaggagcaagccaccggggaauggcagacgcagcggaaucagaagaaaaagaugaaaaagagagucaaggaugagcuucggaaacugaacaccaugacagcggccgaagcuaaugagaucgaggacguguggcaacucgaucugagcucucgcuggcagcuguauagacuuuggcugcagcucuaccaggccgacacccggcgcaagauucuguccuaugaaagacaauaccggacaagcgcugagagaauggccgaacuccgccugcaggaggaccuucauauccugaaagaugcccagguugugggcaugaccacgacaggagcugcgaaguaccggcaaauucuccagaaagucgaaccgagaaucgugaucguugaggaggccgcugaagugcuggaggcccacaccauugccacacuguccaaggcuugucagcaucuuauccugauuggcgaccaccagcaacuccgcccuucugccaacgucuaugaucuggcgaaaaauuucaaccucgaagugagccuguuugagcggcuugugaaggucaauauccccuucguuagacugaacuaccagcaccgcaugugcccugaaauugcucggcuccugacaccccauaucuaucaggaccuggagaaucacccguccgugcuuaaguacgagaaaaucaagggggugucuagcaaccuguuuuucgucgaacauaacuuuccugagcaggaaauucaagagggaaaaucccaccagaaucagcaugaagcccacuucgugguugagcucuguaaguauuuucugugccaggaguaccuccccucucaaaucaccauucugacaacguauaccggccagcuuuucugucugagaaaacugaugccugccaagacauuugcuggggugcgcguccacgugguugauaaguaccagggagaagagaacgacaucauucuccugagccuugugagauccaaucaagaaggcaaagucggguuccugcagaucagcaaccggaucugcguggcccucucucgcgcgaagaaaggcauguacuguauuggaaauaugcagaugcuggcuaagguuccccucugguccaaaaucauucauacccugagagagaacaaucagaucggccccaugcuucggcugugcugucaaaaccacccugagacacauacccuggugagcaaggccucugauuuucagaaggucccggaagggggaugcucccuccccugugaguuccgccugggcugcgggcacgugugcacgagagccugucacccuuaugacagcucucauaaagaauuucagugcaugaagcccugucagaaagugauuugccaagagggacaccgguguccucuugucugcuuccaggaaugucagcccugccagguuaaggugccuaaaacaaucccgagauguggccaugagcaaauggugcccugcuccgucccugagagcgauuucuguugccaggaacccugcuccaagagccugcgcugugggcaccggugcucucauccuuguggcgaggacugcgugcagcucuguagcgaaaugguuaccauuaagcugaaaugcggacacucccagcccgugaaguguggccacgucgaggggcuccuguacggaggccuucuggugaaaugcaccacaaagugugggaccauccuggauugcggacauccguguccuggcucuugccacagcugcuuugaaggcagauuccaugagcgcugucaacagcccugcaaacggcuccugaucuguucccacaagugccaggagcccuguauuggggaaugcccucccugucaaagaacaugccagaaucgguguguucacucucagugcaaaaagaaguguggagagcuuugcagcccuugcguggaaccgugugucuggcgcugccagcauuaucaauguacgaaacugugcuccgagcccuguaacagaccucccugcuacgugccuuguaccaagcuccuggucugcggccaccccuguaucgggcucugcggagaaccguguccuaaaaagugccggauuugccauauggacgaggugacacagaucuuuuucggcuuugaggaugaacccgacgcucgcuucguucagcuggaggacuguucucacauuuuugaagugcaggcccuugauagauauaugaaugagcaaaaagacgaugaggucgcuauccggcugaaggugugcccuaucugucagguucccauucgcaagaaccugagauacgggaccagcaucaaacagcggcucgaagagauugaaaucauuaaggagaaaauccagggauccgccggcgaaaucgcgacaagccaagagcgccugaaggcccuucuggagagaaaaucucuccugcaucagcugcucccugaagacuuccuuaugcugaaggagaagcuggcucagaaaaaucucuccgugaaggaucugggccuugucgaaaacuauauuagcuuuuacgaccaccuggccucucucugggauucccugaaaaagaugcacgugcuggaggaaaaacgggugagaacccgccucgagcaaguucaugaguggcuugcuaagaagcggcugagcuucacgucccaggaacugucugaccucagaagcgagauccagcgccugaccuaccuugucaaucugcucacacgguauaaaauugccgaaaagaaagugaaggauuccaucgccguggaggucuacagcgugcagaacauucuggagaagaccugcaaguuuacacaagaggacgagcagcugguucaggaaaagauggaggcucucaaagcgacccuucccuguucugggcugggaaucuccgaagaggagagagugcagauugucagcgccaucggcuauccgcgcgggcacugguucaagugccggaacggacauaucuacgugauuggcgauugugggggagcuauggaaagaggcacaugcccugacuguaaagagguuaucggcgggaccaaucacacgcuggaacgcucuaaccaacucgccagcgagauggacggagcccagcacgcugccugguccgauacagcgaauaaccugaugaauuucgaagagauucagggcaugauguga

SEQ ID NO: 78318 - RNA, 1212 nt, Artificial Sequence
  derived and/or modified sequence opt5 from ZNHIT2__Homo_sapiens__NP_055020
auggagcccgccggcccuugcggguucuguccggcuggagaagugcagcccgccagauauaccugcccucgguguaacgcgcccuacugcagccugcgcuguuacagaacacacggcacgugcgcugagaauuuuuaucgggaccaaguccucggggaacugcgcggauguuccgccccucccucuagacuugccagcgcucugcggcgccucagacagcagcgggagaccgaagaugagccuggcgaggccgggcuguccucuggaccggcucccggcggccuuagcgggcugugggaacgccucgccccuggagagaaggcggccuucgaaagacugcugucccggggcgaggcugggcgccuccugcccccuuggagacccuggugguggaaccggggagccggcccgcagcuucuggaggaacucgacaaugcuccugggucugaugccgcggagcuggaacuugcccccgcucgcacaccucccgacagcguuaaagaugccuccgcugccgagcccgccgcugcggaaagagugcugggagacgugccuggcgccugcaccccggucgugcccacacggaucccugcuauuguuagccucucuagaggccccguguccccucugguccgcuuucaacugcccaacguucucuucgccuacgcccauacccuggcucuuuaucacgggggagaugacgcccugcucagcgauuuuugugcgacacugcuuggcgugucuggggcucugggagcccaacagguguucgccuccgcugaggaggcccuccaggcugccgcgcauguccuggaagccggcgagcacccgccugggccccugggaacccggggcgcuaugcaugaaguggccagaauccuccugggcgaggggccuacgaaucagaagggauacacccuugcugcccugggcgaccucgcgcagacacuggggcgcgcccggaaacaggcuguggccagagaggaacgcgaucaccuuuaucgggcuagaaagaaaugccaguuucugcucgccuggaccaacgagaaugaagccgcucugacaccccuggcgcucgacugugcccgcgcucaccaagcccaugccgucguugcugaggaaguggccgcgcugaccggagagcuugaacggcuguggggcgggccugugcccccggcuccuagaacgcucauugaggagcugcccagcuga

SEQ ID NO: 78319 - RNA, 468 nt, Artificial Sequence
  derived and/or modified sequence opt5 from ZNHIT3__Homo_sapiens__NP_004764
auggccagccugaagugcuccaccguggucuguguuaucugccucgagaaacccaaguacagauguccugcuugccgggugccguauuguucuguggucugcuuccgcaaacacaaggaacaguguaaccccgagacaagaccuguggagaaaaagauucggagcgcccugcccacgaagaccguuaaaccuguggaaaauaaggacgaugacgauuccaucgcggacuuucuuaacucugaugaagaggaggaccgcgucagccugcaaaaucucaaaaaccugggcgaauccgcuacacuuagaucucugcuccugaauccccaucugcggcagcucauggugaaccuggaucagggggaggacaaggccaaacuuaugcgcgccuacaugcaggaaccucuguucguugaguuugcugauugcugucucggaauuguggagccgagccaaaaugaagaguccuga

SEQ ID NO: 78320 - RNA, 381 nt, Artificial Sequence
  derived and/or modified sequence opt5 from ZNRD1__Homo_sapiens__NP_001265715
augagcguuauggaccuggccaauaccugcuccucuuuccagagcgaucucgacuuuuguuccgauugcggcucuguccugccccuuccuggggcucaagacacaguuacguguaucagaugcggauucaacauuaacgugcgggauuuugagggcaagguggucaaaaccagcgugguuuuccaccagcuggggacagccaugccgauguccguggaagagggacccgaaugucagggcccugucguggaccgcagaugcccccggugugggcaugagggaauggcguaccacacccgccagaugagaucugcugaugaaggccaaacaguguuuuauaccugcacaaauuguaaguuccaggagaaagaggacagcuga

SEQ ID NO: 78321 - RNA, 2811 nt, Artificial Sequence
  derived and/or modified sequence opt5 from ZNRF3__Homo_sapiens__NP_001193927
augagaccccggagcggcgggcgcccuggagccaccggcagacggcgcagacggcugcgcagacggccgcgcgggcucagaugcucccggcugcccccucccccuccccuuccucugcuccugggacuucugcucgcugccgcgggcccgggggcugcccgcgccaaggagacagcuuucguggaagucguucuguuugagucuagccccuccggagacuacacgaccuauacaaccggccugacaggcagauucucucgggccggggcuacccucagcgccgaaggagagaucgugcagaugcacccucugggccuuuguaacaauaacgaugaagaggaccuguacgaguaugggugggugggagucgugaaacucgaacaacccgagcuggauccuaagcccugccuuacaguucugggcaaagcgaagcgcgccgugcagagaggggcuaccgccgucauuuuugacguguccgaaaauccggaggcuaucgaucagcucaaccagggaucugaggacccucugaaacggcccguuguguacgucaagggcgccgaugcgauuaagcugaugaauaucgugaacaaacaaaagguggccagagcucgcauucagcaucggccucccagacagcccacggaauauuucgacaugggcaucuuucucgccuucuuugucguugugagccuggugugucuuauccugcucgucaaaauuaagcugaaacagcgccggucccaaaauagcaugaacagacuugcugugcaggcccuggagaagauggaaacccgcaaguucaauucuaaauccaaggggcggagagagggaagcugcggcgcccucgauacacugucuuccagcucuaccuccgacugugcuaucugccuggaaaaauacauugauggggaggagcuccgcguuaucccuuguacacaccgguuucauagaaagugcguggacccguggcugcuucagcaccauaccuguccccacugccgccacaacauuaucgaacagaaaggaaauccuagcgcggucuguguggagacguccaaccugucucggggcagacaacagcggguuacacuccccgugcauuauccugggcgcguccacagaaccaaugccauucccgcuuacccgacacggaccagcauggauucccauggaaacccugugacccugcuuacaauggacagacacggcgaacagagccuguacucuccccaaacgccugccuauauccgcuccuaucccccucuccaccuggaccauagccuggccgcucaccggugcggccucgagcauagagccuacucucccgcgcacccguuccgcagaccuaagcugagcgggcgguccuuuucuaaagcugccugcuucagccaguacgaaaccauguaucagcauuacuauuuucagggacuuuccuaccccgagcaagagggccagucucccccuucucuggccccgcgcgggcccgcuagagccuucccucccuccggaagcggcucucuccuguucccuacagucgugcacguugcucccccuucccaccuggaaagcggguccaccucuagcuuuuccuguuaccauggccaccggucugugugcagcggauaucuugccgauugucccggcuccgacagcagcuccagcagcuccagcgggcagugccauuguucuagcuccgauagcgucguggacugcacagagguuucuaaucagggaguguacggcuccuguagcaccuuccgcuccucucucagcuccgauuaugacccguuuaucuacagaucucggagcccuugccgcgcguccgaagccgggggaucuggcagcuccgggagaggccccgcucuguguuucgagggaagcccucccccggaggaacugccugccguccacucucacggcgcugggcggggagagcccuggccuggccccgccucccccagcggggaucaagugucuacgugcucccucgaaaugaacuauagcucuaacuccagccuggagcaucgcggaccuaauuccagcacaucugaagugggccuugaggcgagcccgggggccgcucccgaccugagacggaccuggaagggcggacacgagcucccuuccugugccugcugcugugaaccccagccuucucccgcuggcccuagcgccggggccgcuggauccucuacccuguuucugggcccgcaucuuuacgaggggagcggacccgcgggcggggaaccucaguccggcucuagccagggacucuauggccugcaccccgaucaucugccuagaacagacgggguuaaguacgagggacuccccugcuguuucuacgaagagaaacaagucgcccgcggcgggggaggcggcuccgggugcuauaccgaggauuacagcgugucugugcaguauacacugacggaggaaccgccucccggauguuaccccggcgcucgggaccuuucccagcggauuccuaucauucccgaagacgucgauugcgaccuggggcucccuagcgauugucagggaacccacucucugggcuccuggggagggacacgcggcccggacacccccagaccucacagaggccugggggccacacgcgaggaggaacgggcccuuugcugucaagcuagagcccuccugcgccccggaugcccucccgaggaagcgggcgcugugcgggccaacuuuccgagcgcccugcaggauacccaggaguccucuacgaccgcuacagaagccgcggggccuagaagccauuccgcugacucuucuucccccggagccuga

SEQ ID NO: 78322 - RNA, 1917 nt, Artificial Sequence
  derived and/or modified sequence opt5 from ZP1__Homo_sapiens__NP_997224
auggccggcgggagcgcuaccacauggggauaccccguggcccugcuccugcuugucgcgacgcugggccucgggagauggcugcagccugacccgggacuucccggccugcggcacuccuaugauugcgggaucaagggaaugcaacuccugguuuucccucgccccggccagacccugagauuuaaagugguggacgaguucggcaaccgguuugaugucaauaacuguucuauuugcuaccauugggugacaagccgcccucaggaacccgcuguuuucuccgccgacuauagagggugucacgugcucgagaaggauggacgguuucaucugcgcgucuucauggaagccgugcuuccuaauggcagaguugacguggcucaggaugccacccugaucugcccgaaacccgacccuucucggacacucgauagccaacuggcucccccugccauguuuuccgucucuacaccccagacccuuagcuuccugccgaccuccgggcacacgagccagggaucuggccaugcguuuccuagcccccucgacccugggcacuccucugugcaccccacccccgcccugccuuccccgggacccggcccuacacuggcuacccucgcccagccccauuggggcacacuggagcacugggaugugaacaagcgcgacuacauugggacccaucuuagccaagaacagugucaggucgcuucuggacaucugccuugcaucguuagacggacguccaaagaggccugucagcaagcgggcugcuguuaugauaauacacgcgaggugcccugcuacuaugggaacaccgccacagugcaguguuucagagacggauacuuuguccucgugguuagccaggaaauggcucugacccaccggauuacccuugccaauauccaccuggcuuacgccccgacauccugcucuccuacgcaacacaccgaggccuucguggucuuuuauuucccccucacacauugcggcaccacaaugcaaguggcuggggaccagcugaucuacgaaaacuggcugguuagcggcauucacauccagaagggaccucagggcuccauuacccgcgauagcacguuccagcuccaugugagaugugucuuuaaugcgucugacuuccugcccauccaggccuccauuuuuccucccccgagcccugcucccaugacacagcccgggccucuucggcuggagcucagaaucgccaaggaugagaccuucucuagcuauuacggagaagacgauuauccgauugugcgccugcuucgggagcccguccacguggaaguuagacugcuccaacgcaccgacccuaaccuggugcugcuccugcaccagugcuggggcgcccccuccgcuaauccuuuucagcagccccaauggccuauccuuucugaugggugucccuucaaaggagacagcuaccggacacagauggucgcccuggauggcgcgaccccguuucagucccauuaucagagauucacaguggcuacguuugcccuccuggacagcgggucucaacgcgcccugcggggccuuguuuaccucuucugcuccaccagcgcuugucacacaucuggacuggagaccugcuccacagccuguagcaccggcacgaccagacagcgccgguccucugggcauagaaacgauacagcucgcccucaggacaucgugagcucccccggaccugucggcuuugaagacucuuacgggcaagagcccacccugggaccgacagauagcaauggcaacuccagccuccggccucugcuuugggccgugcugcuccugcccgcgguggcccugguucuuggguucggcgucuuugugggacucucucagaccugggcucagaagcugugggaguccaauagacaguga

SEQ ID NO: 78323 - RNA, 1623 nt, Artificial Sequence
  derived and/or modified sequence opt5 from ZP4__Homo_sapiens__NP_067009
auguggcugcucagaugcgugcugcuuugugucagccugucccucgccguuucuggccagcacaagcccgaggcuccugacuacagcuccgugcugcacugcgggccguggucuuuccaauuugccgugaaccuuaaucaggaagcgaccagcccucccguccugaucgcuugggauaaccagggacuccugcacgagcugcagaaugacuccgauuguggcacauggauucggaaagggcccggaucuagcgugguucucgaagccacguauuccagcugcuacgugaccgagugggacucucauuauaucaugccugucggcguggaaggggccggagcugccgagcacaagguugugacagagcgcaaacugcuuaagugucccauggaucugcucgcuagagacgccccugauaccgacuggugcgauuccauuccggcgcgggaccgccugcccugugccccuagccccaucucuagaggcgauugcgaaggccuuggguguugcuacuccagcgaggaagucaacucuuguuauuacggaaauacagugacccugcauugcacacgggagggccacuucuccauugcugugagccgcaacgucaccuccccuccccuccugcuggacucuguuagacucgcccugcggaaugauagcgcuugcaacccggugauggccacgcaagcguuugugcuuuuccaguuuccuuucaccuccugugggacaacccgccagaucacaggagacagagccgucuaugagaaugaacugguggcuacccgggacguuaaaaacggcagccgcgggucugugacgagagauuccaucuuucggcuccacgucagcugcucuuacagcguguccucuaauagccugcccauuaacguucagguguucacacuuccuccucccuuucccgagacccaaccgggaccccugacacucgaacugcagaucgccaaggacaagaauuacggcuccuauuacggcgucggggauuauccuguggucaaacugcuccgcgaccccauuuacguggagguuagcauccugcauagaaccgauccuuaucuuggacugcuccugcagcaguguugggcuacccccucuacagacccgcuuucccaaccucaguggcccauucuggugaagggcugcccuuacaucggggauaacuaucagacgcaacucauucccguccagaaagcccuggaccugccuuuccccagccaccaucagcgguuuucuaucuucaccuuuuccuucgugaauccgacaguugaaaagcaggcccucagaggaccugugcaucugcacuguagcgucuccgugugccaacccgcugagacccccucuugugugguuacaugcccugaucuuagccgccggagaaacuucgacaacuccucucagaauaccacggcgagcgucuccagcaaaggcccgaugauccugcuccaggccacaaaggaucccccugagaagcugcgcgugcccguggacucuaaaguccuguggguggcugggcuuuccggaacccucauucugggcgcccugcucguuagcuaccuggccgugaagaaacagaagucuuguccugaccaaaugugccaguga

SEQ ID NO: 78324 - RNA, 951 nt, Artificial Sequence
  derived and/or modified sequence opt5 from ZPBP2__Homo_sapiens__NP_942141
augaugagaaccugcgugcugcucagcgccguccuguggugucuuacaggcgacaagaucuacguugagcugcaccagaacucccccgugcucauuugcauggauuucaaacugucuaagaaagaaaucguggacccuacguaucuuuggauugggccgaaugagaagacccugacaggaaacaaucggaucaacauuaccgaaacaggccaacucauggucaaagauuuucuggagccccugagcgggcucuacaccuguacacuguccuauaagaccgugaaggcugaaacgcaggaggagaaaaccguuaagaaacgcuacgacuucaugguguuugccuauagagaaccugauuacucuuaucagauggcgguccgguucacaacccgcagcugcaucggaagauacaaugacguguuuuuccggguucuuaagaaaauccuggauucccucauuucugaccugagcugucaugugaucgagcccuccuacaagugccacagcgucgaaauuccugagcauggccuuauccacgagcuguuuauugcuuuccaggugaaccccuuugccccuggguggaagggagccuguaauggcucuguggauugcgaagacacaaccaaccauaauauccuccaagcucgcgauagaauugaggacuucuuucggucccaggccuauaucuucuaccacaacuuuaauaaaacgcugccggcuaugcacuucgucgaucauagccugcagguugugcgccucgacucuuguagacccggcuucgggaagaacgaacggcugcacuccaauugcgccagcuguugcguggucugcucuccugcgacauuuucccccgacgugaacguuaccugucagacaugcgugagcguccuuaccuauggagccaaauccuguccucaaaccucuaauaagaaccagcaguacgaggauuga

SEQ ID NO: 78325 - RNA, 1296 nt, Artificial Sequence
  derived and/or modified sequence opt5 from ZPLD1__Homo_sapiens__NP_778226
augaugcugagauucagcaugugccggggcaacgacgagggguuugccauggaacagaucuggcuccugcuucugcucaccauucgcgugcugcccggauccgcucaauucaauggcuacaacugugaugccaaucuucacucuagauuuccugcggagcgggacaucagcgucuauugcgggguucaggcuauuacaaugaagaucaacuucuguacggugcuguuuuccggauacucugaaaccgaucucgcccugaauggccgccauggggacagccacugcagaggauucauuaacaauaacacauuuccggccguggucaucuucaucauuaaucuguccacccucgagggcuguggcaacaaucuggugguuucuacaauccccggggugagcgcuuauggaaacgccaccuccguccaggugggcaauauuagcggguacaucgauacaccugaucccccuaccauuaucucuuaucuucccggacugcucuacaaauuuuccugcagcuauccucuggaauaccuuguuaacaauacgcagcuggcuucuuccagcgccgcgauuucugugcgggagaacaacggcaccuucgucuccacacucaaucugcugcucuacaacgacagcaccuauaaucaacagcugaucaucccguccauugggcuuccccugaagacaaaaguguuugccgcugugcaggccaccaaccucgacggacgcuggaauguccugauggauuacuguuauacgacaccuucuggcaaccccaaugacgauaucagauacgaccuuuuccugagcugcgauaaggacccucagaccacaguuauugagaacggccggucccaacgcgggagauuuagcuucgaaguguuccgguuugugaaacauaagaaucagaagaugucuaccgucuuccuccacugugugaccaaacugugccgcgcugacgauugucccuuucugaugccgaucugcucccauagagagcggcgcgacgccggaagacggacaacguggagcccucagucuagcuccggcucugcgguucucagcgccgggcccauuaucaccagauccgaugaaacaccuaccaacaauagccagcugggaucucccuccaugcccccuuuccaacuuaacgcuaucacaagcgcccugauuucuggcauggugauccucggggucaccuccuuuagccugcuucugugcucccucgcucugcugcaccgcaagggaccgacgucucucgugcugaauggcauucggaaccccguuuucgacuga

SEQ ID NO: 78326 - RNA, 1380 nt, Artificial Sequence
  derived and/or modified sequence opt5 from ZPR1__Homo_sapiens__NP_003895
auggccgcuagcggcgccguggagcccgggccuccgggagcggcugucgcccccuccccugcccccgcuccucccccugccccggaccaccuguucagacccaucucugcugaagaugaggaacagcaaccuaccgagauugaaagccucugcaugaacuguuacugcaauggcaugacacggcugcuucugacgaagauccccuuuuuccgcgagauuaucguuuccucuuuuagcugugagcauugcggguggaacaauaccgaaauucaguccgccggaagaauccaggaccagggcgugcgguauacacucucugugcgcgcgcuggaggauaugaacagagaagucgugaaaaccgacagcgccgcuacacggaucccugagcuugauuucgagauucccgccuuuucccaaaagggggcucugaccacaguugaaggacucaucacccgcgccauuagcggccuggagcaggaccagccggcgagacgggccaauaaagaugcuacggccgaacgcaucgacgaguucauugugaagcugaaagaacucaagcaggucgcuucuccuuuuacccugaucauugaugaccccuccggcaacagcuucguggagaauccucacgcuccccaaaaggaugacgcccuuguuaucacacauuacaacagaacccggcagcaggaggaaaugcuggggcuccaggaggaagcccccgcggagaaaccugaagaggaggaucugcgcaaugaagugcuucaauuuucuacaaacuguccggagugcaaugcccccgcucagaccaacaugaagcugguccagaucccucacuucaaagaagugauuaucauggccacgaauugugagaacugcggacauagaacaaaugaagugaaguccggcggggccgucgagccccucggaacccggauuacacugcacaucaccgacgcuagcgacaugacccgcgaucugcucaaaucugagacauguuccguugaaauuccugagcuggaauuugagcuuggcauggccgugcucgggggaaaguucacgacccuggagggccugcuuaaggacaucagagaacuggugaccaaaaaccccuuuacacucggcgauagcuccaacccggggcaaacagagcggcugcaggaguucucucagaagauggaccagaucauugagggaaauaugaaagcgcacuucaucauggaugacccugcuggcaacagcuaucugcaaaaugucuacgcccccgaagaugacccugagaugaagguggagagauauaaacgcaccuuugaucagaacgaagaacucgggcugaaugacaugaagacggaaggauacgaggccggccuugcuccccagcgguga

SEQ ID NO: 78327 - RNA, 3234 nt, Artificial Sequence
  derived and/or modified sequence opt5 from ZRANB3__Homo_sapiens__NP_001273497
augcccagagugcacaacaucaagaaaagccugaccccucauauuuccugcgucacaaaugagucugacaaccuccuggauuuccuuccggaccggcugcgcgccaagcuccugcccuuucagaaagauggcaucauuuucgcucuuaagagaaaugggcgguguaugguugccgacgaaaugggacugggcaaaacgauccaagcgauugggaucaccuacuuuuauaaggaggaauggccucuccugaucguggugcccagcucccugcgcuacccuuggacagaggaaauugagaaguggauccccgagcucucuccugaagagauuaacgucauccagaauaaaaccgaugugagacggaugagcacauccaagguuaccgugcugggauauggccuucugacagcugacgccaaaacccucauugaugcccugaacaaucagaacuucaaggucgugaucguugacgaaucucacuacaugaaaagccgcaaugcuacgagaucccggauucuucugccgaucgugcagaaggcccgcagagcuauccuccugaccgggacacccgcccugggacggccugaggagcucuuuaugcaaauugaagcgcuguucccccagaaguuuggccgcuggaccgauuaugccaaaagauacugcaacgcucauauccgguauuucggcaagcgcccucagugggacuguagaggggccagcaaucuuaacgagcugcaccagcuccugucugauauuaugauccggagacuuaaaacagaaguccugacccaacucccuccgaaggugcgccagcggauuccuuuugaccugcccuccgcugccgcgaaagagcugaauacgagcuucgaagagugggagaagaucaugagaacaccuaacucuggagccauggaaaccgugaugggccucaucacacgcauguuuaaacagaccgcuauugccaaggcuggggccgucaaggauuacaucaaaaugaugcugcagaaugacucccuuaaguuccugguuuuugcccaucaccucagcaugcugcaggcuugcaccgaggcggugauugaaaacaaaacacgguacaucagaauugacggaucuguguccagcuccgagcgcauccaccuugucaaccaauuccagaaggaucccgacacgcggguggccauccugucuauucaagcugccggccaggggcucaccuucacagccgcuagccauguuguguuugccgaacuguauugggaucccggacacaucaaacaggcggaggacagagcucaucgcauuggccaguguuccagcgucaauauccacuaccugauugccaacggcacccucgauacacugaugugggggaugcuuaaucggaaggcccaagugaccggaucuacgcugaacggcagaaaggagaaaauccaggcugaagagggggacaaggaaaaaugggauuuccuccaguuugccgaggcuuggacaccuaaugacuccagcgaggaacugcgcaaggaggcccuguucacccacuuugaaaaagagaagcagcaugauauucggucuuucuuuguuccgcaacccaagaaaagacagcuuaugaccagcugcgacgaauccaagcgguuccgcgaggagaacacaguggucucuagcgauccuaccaaaacagcggccagagacaucaucgacuaugaauccgauguggagcccgaaacgaagcggcucaaacuggcugccagcgaggaccacuguucuccuuccgaagagacccccagccagucuaagcagauuagaacaccgcuggucgaguccgugcaagaagcuaaggcccagcucaccacacccgcguuucccguugagggauggcagugcagccuguguaccuacaucaauaacuccgaacuuccuuauugcgagaugugugaaacgccccagggcucugccgugaugcaaauugauagccugaaucauauccaggacaaaaacgagaaggaugacucccagaaagauaccucuaagaaaguccaaacaauuagcgacugcgagaagcaggcucucgcccaguccgaaccugggcagcuggcugauagcaaagaggaaacccccaagaucgagaaggaagacggacugacaucucaaccggagcaguggaaauccagcgauacccuuccuguguacgacacgcucauguucugcgccucucgcaauacagaucggauccacauuuauaccaaggacggcaaacagauguccuguaacuuuaucccccuggacauuaagcuggaucucugggaggaccugcccgccagcuuccagcuuaaacaauacagaucucugauccuccgcuuuguuagagaauggagcucccugacagcuaugaagcagcggauuauccgcaagagcggccagcuguucugcucuccuauccuugcgcucgaggaaauuaccaaacagcaaaccaagcagaauuguacaaaaagauacaucacgaaggaggauguggccgucgcuuccauggacaaagugaagaacguugggggacaugugcggcugauuaccaaggagagccgcccgagagaucccuucaccaaaaagcugcucgaagacggcgccugcgucccuuuucugaaucccuauacagugcaggccgaucuuacagugaaaccuuccaccucuaagggguaccugcaagcugucgacaacgagggaaacccccucugucugcggugccagcagccuacgugucagacaaaacaagccugcaaggcgaauagcugggauucccgcuucuguucucugaagugccaggaagaguuuuggaucagaagcaacaauuccuaucuucgggcuaaaguguucgaaaccgagcacggcguuugucagcucugcaacgugaaugcccaggagcuguuucugcgccucagagacgcccccaagucucaacggaaaaaccugcuuuacgcuaccuggacaagcaagcugccgcucgaacagcugaaugagaugauuagaaacccuggggaaggccacuucuggcaggucgaucauaucaaacccguguauggaggcgggggacagugcucccuggacaaucuucaaacccuguguacaguuugccacaaggagcgcacggcccggcaggcgaaagaaagaagccaggugcgccggcagucucucgcuuccaagcauggcagcgauaucaccagauuucuggucaagaaauga

SEQ ID NO: 78328 - RNA, 1449 nt, Artificial Sequence
  derived and/or modified sequence opt5 from ZRSR2__Homo_sapiens__NP_005080
auggccgcucccgagaagaugaccuucccugaaaaaccgagccacaagaaauacagagccgcgcugaagaaagagaagcggaagaaacgcagacaggaacucgcucggcugcgcgacuccggccuuucucaaaaggaggaagaggaggauacauuuaucgaagaacagcagcuggaagaggagaaacuccuggaaagagagcggcagcgccuucaugaagaguggcugcucagagaacaaaaggcccaggaggaguuccggauuaaaaaggaaaaggaggaagccgcuaaaaagcgccaggaggaacaggagagaaaacugaaggagcaaugggaggagcagcagcggaaagaacgcgaggaagaggagcagaagagacaagagaaaaaggaaaaggaagaggcccugcagaaaaugcucgaccaggcugagaacgaacuggagaaugggacgaccuggcaaaaccccgaaccucccguggauuuucgggucauggagaaggaccgcgccaauugcccuuucuauagcaaaacaggagcguguagauuuggcgaucggugcuccagaaagcacaacuuccccaccucuagcccuacacuucugaucaaauccauguuuaccacauucgggauggaacagugucgccgggacgauuacgacccggaugccucucucgaguauagcgaggaagagaccuaccagcaguuucuggacuucuaugaagauguucuucccgaguuuaagaaugugggaaaggugauucaauucaaagucuccugcaaccuggaaccucaucucagaggcaauguguacguucaguaucagagcgaggaggaaugucaggcugcccugucucuguuuaacgggcgcugguacgcuggacggcaacuccagugcgaguucugucccgugacgagauggaagauggccaucugcggccuguucgaaauucagcaguguccucgcggcaaacacugcaauuuucuucaugucuuccggaaccccaauaacgaguuuugggaagcgaauagagacaucuaccuguccccggaucgcaccgggagcucuuucggaaagaacuccgagcggagagagcgcaugggccaccacgacgacuauuacagccggcucagagggcggcgcaauccuucucccgaucauuccuauaaaagaaacggagaaagcgagcggaaguccucuagacaccgcggcaagaaaagccauaagcggacauccaaaagcagagaacgccacaacucuagaucccgggggcgcaauagagaccggagccgcgauagaucucggggacgcggcagcagaucccggucucgcagcagaucccggagaagccgccggucuagaucccaaucuagcucccgcagccgguccagaggccgccggagaucugggaaccgcgaccggaccgugcagagcccuaaguccaaauga

SEQ ID NO: 78329 - RNA, 1701 nt, Artificial Sequence
  derived and/or modified sequence opt5 from ZSCAN18__Homo_sapiens__NP_001139014
augagacgggugggcgggcgcgccgacgaggaugcuaccgccgcgggaagccuguggguccucgcucccccugaaccgacaggccaccugguuauccccgggacguccccucuugagcccccuugccccuggcuggacucucauauuuuccaguguagauuuggaaagaugcucccucuggaaaaagccuucgccagcccgcgguccucucccgcuccucccgaucuuccuacccccggcagcgccgcuggggugcaacaggaggaaccggagacaaucccugagcgcacccccgccgaccuggaauuuuccagacuccgguuccgcgaguuuguguaccaggaagcggccggaccucaccagacacuggcuagacugcaugagcucugccggcaauggcugaugcccgaggcccgcucuaaggaacagaugcuugagcugcucguccuggaacaguuccuuggcauucugcccgauaaagugagaccuuggguuguggcucaguauccggagagcuguaagaaagccgcgucccucgucgaaggccuggccgacgugcuggaggagcccgggaugcuccugggaagcccugcuggcagcuccagcauccuuucugaugggguuuacgaacggcacauggacccccugcuccugccuggagagcuugccucccccagccaagcucugggcgccggggaaauuccggccccuucugagacccccuggcucuccccugauccccuguuucuggaacagcgcagagugcgggaggcuaagacagaggaagacggaccugcgaacaccgagcagaagcucaaaucuuuccccgaagauccgcagcaucugggcgaguggggccaccuugacccugccgaagagaaucugaaguccuaucgcaaacuccugcuuuggggguaccaacugucucagcccgaugcugccagcagacucgacacggaggaacugcggcuggucgagagagacccccagggauccagccucccugaaggcgggcgccggcaagagucugccggaugcgcuugugaggaagccgcgccggcuggcgugcugcccgagcuuccuaccgaagcucccccuggggaugcccuggccgaucccccuuccggaacaaccgaggaagaggaggaacagcccggcaaggccccggacccucaggacccccaggaugcugagagcgacucugccacaggcagccaaagacaguccgugauccagcagccugcgcccgaucgcgggaccgccaaacucggaacgaagcggccgcacccugaagacggcgaugggcaaucucuggagggagucagcuccagcggcgacucugcugggcuggaagccggccagggacccggcgcugaugagccugggcuuuccagaggaaagcccuaugccugcggcgaguguggggaagcguuugccuggcucagccaucugauggagcaccauucuucccacggaggccgcaaacgguacgcuugccagggguguuggaagacauuccacuuuagccuggcccucgcugaacaucagaaaacccacgagaaggaaaaauccuaugcccugggcggagccagaggcccccaaccuucuacacgcgaggcucaggcgggggcccgggcuggaggcccgcccgagagcguugaaggggaggccccucccgccccucccgaagcucagagauga

SEQ ID NO: 78330 - RNA, 1476 nt, Artificial Sequence
  derived and/or modified sequence opt5 from ZSCAN22__Homo_sapiens__NP_862829
auggccauccccaagcacagccuguccccugugccgugggaggaagacucuuuccuccaggucaaaguugaggaagaggaagaggcuagccugucccaaggcggggagucuagccaugaucacauugcccauuccgaagcggcuagacuucgguuucgccacuucagauacgaggaagccucuggaccccaugaggcccuggcucaccuccgggcccugugcugucaguggcuucagccugaggcucacagcaaggaacagauccuggagcuccuggugcuggaacaauuucucggcgcccugcccccugagauucaggcgugggugggggcccagucccccaaaagcggagaagaggcugccguccuuguggaggaccugacccagguucucgauaagcgcggcugggacccuggggcugaaccgacagaggccucuugcaaacaauccgaucugggagaaagcgagcccucuaacgugacggaaacccuuaugggcggcgucucccuggggccugcguucgugaaggccugugagcccgagggaagcucugaaagauccggccucagcggggagaucuggacaaaguccguuacccagcagauucauuuuaaaaagacaucuggaccuuauaaagacgugcccaccgaucagcggggccgcgaaagcggggcuuccagaaauucuagcuccgccuggccgaaccugacaagccaagagaagccucccucugaagacaaauucgaucuggucgacgcuuacggaaccgagccucccuauacguacagcggcaagcgguccucuaagugccgcgaguguagaaaaauguuucagagcgccuccgcccucgaagcucaccagaagacccauagccggaaaacacccuaugcgugcucugaguguggcaaggccuucucccgcagcacccaccuggcucaacaccagguggugcauacaggggccaaaccucacgaaugcaaggaguguggaaaagccuuuucuagagucacccaucuuacgcagcaccagcggauccauacaggcgagaagccguacaagugcggggaauguggaaaaaccuucucccgcagcacacaccugacccaacaccagagaguucauaccggcgagcggcccuaugaaugcgaugcuugcgggaaggccuuuucccagucuacacaccucacgcagcaucaaagaauccacaccggagagaaaccuuacaagugugacgcgugcggccgcgcuuucagcgauuguuccgcccugauucggcaccuuagaauccauucuggcgaaaaacccuaccagugcaagguguguccuaaggccuuugcucagagcuccagccugauugagcaccagcgcauccauacaggggagaaacccuauaagugcucugacuguggaaaagccuucucccggagcucugcucucauggugcaccugagaauccauauuaccguccugcaauga

SEQ ID NO: 78331 - RNA, 1437 nt, Artificial Sequence
  derived and/or modified sequence opt5 from ZSCAN26__Homo_sapiens__NP_001104509
auggccaccgcucuggugagcgcccacucccucgcgccccugaaccuuaagaaagagggccugagagucguucgggaagaccauuacucuacaugggagcagggguucaagcuccaaggaaauagcaaaggccuggggcaggaaccucuuugcaagcaguuucgccagcugagauaugaggaaacgaccggaccgcgggaggcucucucccgccugagagagcugugucaacaguggcuccagcccgaaacacacaccaaagagcagauccuggaacuucuggugcucgagcaauuccugauuauccuuccuaaggagcugcaggcccgggugcaggaacaucaccccgagucucgcgaagaugucgugguugugcucgaggaccugcagcuggaucucggcgaaacagggcaacaggacccugaucagcccaagaaacaaaagauucuggucgaggagauggccccucuuaaaggagugcaggaacagcagguuagacaugagugcgaagugaccaagccggagaaagaaaagggcgaggagacacggaucgaaaacggcaagcugauugucgugaccgacagcugugggcgcguggaguccucuggaaaaaucagcgaacccauggaggcucacaaugaaggcuccaaccucgagagacaccaagccaagccuaaagagaagaucgaauacaaaugcagcgagcgggaacagcgcuuuauucagcaucuggaucuuaucgagcacgcuucuacgcauaccgggaagaaacugugugaguccgacgucugccagucuagcucccucacaggacacaagaagguucugagcagagaaaaaggccaccaaugucaugagugcgggaaggccuuccagcggucuucccaccuggugcgccaucagaaaauucaccucggagaaaagcccuaucaguguaaugagugcggcaaaguguuuagccaaaacgcgggccugcuugaacaucugagaauccacaccggggagaagccuuaccucuguauucacugcggaaagaauuuccggagauccucucaucugaaccgccaccagcggauccauagccaggaggaacccugcgaguguaaagaaugcggcaagacauuuucccaggcccuucugcucacccaccaccaacgcauucauagccacucuaaaucccaucaguguaaugagugcgggaaggcuuucagccugacgucugaucugaucagacaccaucggauccacacaggagaaaaaccguuuaaguguaacauuugccagaaggccuucagacucaauagccaccuggcucaacauguccgcauccacaacgaggagaaaccuuaucaguguuccgaaugcggcgaggccuuucggcagagaucugggcuuuuccagcaucaacgcuaccaccauaaggacaaacuggcguga

SEQ ID NO: 78332 - RNA, 744 nt, Artificial Sequence
  derived and/or modified sequence opt5 from ZSCAN31__Homo_sapiens__NP_001230173
auggugacccagcugagauacgagagcuucugccuccaccaauuucaggaacaggacggcgaguccauccccgaaaaccaggagcuggccucuaagcaagaaauucuuaaagagauggagcaucugggggauagcaagcuccagcgggacgucucccuggauucuaaauaucgcgaaacauguaagagagacagcaaagcugagaagcagcaggcccacuccacgggagaacggcgccauagaugcaaugaguguggcaagucuuucaccaaaagcuccguucuuaucgagcaccaacggauucauacaggggaaaagccuuacgagugcgaagaguguggaaaagcguuuagccgcagaucuucccugaacgaacaccggcgcagccacaccggcgagaagccguaucagugcaaagagugugggaaggcuuucucugccuccaauggacucacaagacaucggcgcauccacaccggcgaaaagcccuacgagugcaaaguguguggcaaggccuuucugcugagcucuugccucgugcagcaucagagaauccacacaggggaaaaacgguaucaaugucgcgagugcggaaaggcuuucauucagaacgccggccuguuucagcaccuuagaguccauaccggggaaaaaccuuaccaaugcucccaguguagcaagcuguucuccaaacggacgcuccugaagaagcaccagaaaauccauaccggagagagacccuga

SEQ ID NO: 78333 - RNA, 1227 nt, Artificial Sequence
  derived and/or modified sequence opt5 from ZSCAN32__Homo_sapiens__NP_001271458
auggccgagggccugugggaacagggguuccucagaacccccgagcaaugccggacaaaguuuaaaagccugcagcuuuccuaccgcaaggugagacggggacgcgucccugaaccguguaucuucuaugaggaaaugaacgcucugucuggcagcugggccuccgcgcccccuauggcuucugacgccguucccgggcaggagggaagcgauauugaggccggcgaacucaaucaccagaacggggagccuacggaaguggaggacggaaccguggauggcgcugacagagaugagaaagacuuucggaaucccggccaagaaguccgcaagcuggaucuuccugugcuguucccgaacagacucggguuugaguucaaaaaugaaaucaagaaggagaaccugaaaugggacgauuccgaagagguugagauuaauaaggcccugcagcggaaaucucgcggaguguacuggcauagcgaacuccagaagggccuggaguccgaacccacaagcagacggcagugccgcaacucuccuggggaguccgaagagaaaacccccagccaagagaagaugucucaccaguccuuuugugcuagagacaaggccugcacacauauccuuuguggcaaaaauugcagccagucuguccacuccccucauaagcccgcgcugaaacucgaaaaggugagccaguguccggagugcggaaaaaccuucucccggucuagcuaucugguucgccaccaacggauucacacaggggaaaagccucauaaauguuccgagugcggaaagggcuuuagcgaaagaucuaaccuuaccgcccaccugagaacgcauaccggcgagcgccccuaccagugugggcagugcggaaaguccuucaaucaaagcucuagccucaucgugcaccagcggacacacaccggcgagaaaccuuaucagugcaucgucugugggaagagauuuaacaauuccucucaguucagcgcucaucgccggauucacacaggagaaucccccuacaaaugcgccguguguggcaagaucuuuaacaauagcucucauuucuccgcucacagaaaaacccauacgggggagaagcccuaucgcugcagccacugugaacggggauucacaaagaacucugcccugaccagacaccaaacagugcauaugaaagcgguccuguccagccaggagggccgcgaugcccucuga

SEQ ID NO: 78334 - RNA, 1338 nt, Artificial Sequence
  derived and/or modified sequence opt5 from ZSCAN9__Homo_sapiens__NP_001186408
augaacaccaauagcaaggaggugcugucccucggcguccagguucccgaagccugggaggaacugcuuacaaugaaaguggaggcuaagucucaccuccaauggcaggaaagcagacucaaacgguccaacccucuggcccgcgagaucuucagacggcauuuucgccagcuuugcuaccaggagacgccggggcccagagaagcgcugacccggcuccaagagcuguguuaucaguggcugcgcccucacgugucuacaaaggaacagauucucgaccugcuuguccuggagcaguuccucagcauccugcccaaagagcuucaaggaugggugagagaacauugcccugaguccggcgaagaggcuguuauucugcucgaagaucuggagcgggagcuggacgaaccccagcacgagaugguggcccaucgccacagacaggaaguccucuguaaggagauggugccucuggccgaacagaccccgcuuacacugcaaucucagcccaaggagccucagcugaccugcgauagcgcucaaaaaugucacuccaucggggagacagaccugauucggagccuucgcagacgggccguucugaucccccucggagcucaucuguuuucuaccgauacguuccuguuuuccaagccuguggucaucccccagcucaaaggcgggggagaaaccuggccgaauaaccgcggcgugcugagagacgaggugacaaagaccgaagaucgggagcuuguccugagaaaagacugcccuaagauuguugaaccccacggcaagauguucaaugagcagacaugggaggugagccagcaagauccuucucauggggaagugggagagcacaaagaccgcaucgaacggcaguggggcaaccuccugggggagggacagcacaagugugaugagugcggcaaauccuuuacccagagcucugggcuuauuagacaucaacgcauccacacgggagaacggcccuacgaguguaaugaaugcggcaaggccuucuccagaagcuccggccuguuuaaccaucgcgggauucacaauauccagaaacgguaucauuguaaggagugcggaaaagucuucucucagagcgcgggccucauucagcaccaaagaauccacaagggggaaaagcccuaccagugcucccaguguagcaaaucuuauucccgccggagcuuucugaucgagcaucagagaucucacacaggagagcgcccucaucaaugcauugaauguggcaagagcuucaaccggcacugcaaucugaucagacaccagaaaauucauaccguggccgagcucguuuga

SEQ ID NO: 78335 - RNA, 1902 nt, Artificial Sequence
  derived and/or modified sequence opt5 from ZSWIM2__Homo_sapiens__NP_872327
augcugagacggggcuacaaggccagcgagcgcagacggcaccucuccgaacgccugucuuggcaucaggaccaagcucuuagcuccucuaucuaucugcucagagagauggggcccaccggauuccugcuucgggaagaggaaccugaguacauggauuuucgcguguuccugggcaacccgcacgucugcaauuguagcacauuucccaaagggggagagcucugcaagcauauuuguuggguucugcugaaaaaguucaaacucccuagaaaccacgaauccgcccugcagcuuggccugggggagcgggaaaucucugaccuccugcgcggcauucauagagugcagacgccccagccuggaaccaaugaugagaacgagcacguggaagaggacggcuauaucaagcaaaaggaaauugauagcgaggacaucugcuccaucugucaggaacuucugcucgagaaaaagcugcccgucacauuuugccgguucggguguggaaauagcauucacaucaaaugcaugaagauucuggcgaacuaccagucuaccuccaauacaagcaugcucaaauguccucugugccgcaaggaguuugcuccgcuuaagcugauccucgaagaguucaaaaacucuuccaagcugguggccgccgcugaaaaagagagacuugauaagcaucugggcauucccuguaauaacugcaaacaguuuccuaucgaagggaagugcuauaaauguaccgagugcauugaguaccaccucugucaagaaugcuucgacagcuguugccaucugucucacacauuuaccuuccgggagaagcgcaaucagaaguggagaucccuggaaaaacgggccgaugagguugugaaguauaucgacacgaaaaacgaaaucgaggagaagaugagccacuuucaggaaaaacagggacaagucuacacccccaagcauauugugagaucccucccucugcagcuuaucacaaagaacucuaaacugcucgcucccggcuaccagugucugcuuugccugaaggccuuccaccucgggcaacauacccgccugcugccguguacacacaaauuccaucggaagugcauugauaauuggcucuuucacaaauguaauagcugcccuaucgacggacagguuauuuauaacccccugaccuggaagaacuccgcggugaauggccaggcccaccagagcgucucuaacagagauaucauccaucuuuccaagcaaaaagagccugaccuguucauucccggcacggggcucgugcugaagcagaaucgccugggaauccuucccagcauuccucagugcaacuuugacgaacucaauacaccgcagucucccaaagaugcuuacgagaacaccacaaucgacaaucuguguagcauuaagcuggauaacuccaauucuaaaaagcucaccuaugacuacaagaucagccaacacuucccucgguaucugcaggaucuucccaccguguccuuuggcaaaaucccuagccagacacugcugcccccgauuguccauaagaacaucguuugcccuacggccauggagucucccuguauuuccgggaaauuccacaccagccucucuagaaugacaaagggaugcaaauguaauaaccacaaucugaagaaaaccccugcuacaaagauccgcgaagacaacaagcgguccacccuucuccccgaggauuuuaaucugauugugaacuggagcacggccaaacugucccucucuaagagauacagcaacugcaugggcgaaaucacacgcaaauguucccaucugucucggcagccugugagccacuccgucaauaccaagagcaccgagcuuucucugauuaucgaaggggugcaacucuga

SEQ ID NO: 78336 - RNA, 3648 nt, Artificial Sequence
  derived and/or modified sequence opt5 from ZSWIM6__Homo_sapiens__NP_065979
auggccgagagaggccagcaacccccuccggcuaagcggcugugcugucgccccgggggaggcgggggaggcgggggaagcuccggcggcgggggaggcgccgggggaggcuacucuagcgcgugcagaccugggccccgggcuggaggcgccgccgcugccgcugccuguggcgggggagcggcccucggccugcuuccucccgggaaaacccaguccccugaaucucugcucgacaucgcugcccgcagaguggcugagaaguggccguuccagcgggucgaggaacgcuuugaacggauucccgagccuguucagagacgcaucguguauuggagcuuccccagauccgagcgggaaauuugcauguacucuagcuuuaacacaggaggcggggccgcgggaggcccuggcgaugacuccgggggaggcgggggagccggcgggggcggaggcgggggauccucuuccagccccgcugccacgucugcugccgccaccuccgcugcggccgcugccgccgcugccgcggcugccgccgcugccgcugccggcgcgggggccccgagcgugggagcugccggcgcugccgaugggggcgacgagacacgccugccuuucagacggggaaucgcgcuucuggaaucuggcugugucgauaaugugcuccaaguuggguuucaccuguccggaaccgugacagagcccgccauucagagcgagccugaaaccgucugcaacguggcuaucuccuucgaccgcuguaaaaucacaucuguuaccugcagcuguggcaauaaggauauuuucuauugcgcccauguggucgcucugucccucuacagaauccggaaacccgaccaggugaagcugcaccuucccauuagcgagacgcuguuccagaugaacagagaucaacuccagaaguuugugcaguaucugaucaccguccaucacacagaaguucuuccuaccgcccagaaacuggccgacgagauucucucucaaaauuccgaaaucaaccaggugcauggggcuccggaucccacagcgggagccagcauugacgaugagaauuguuggcaccuggacgaggaacaggugcaagagcaggucaagcuguuccucucucagggcggguaccacggcagcggaaaacagcugaaccuucuguuugcuaaggugcgcgaaaugcucaaaaugcgggacuccaauggcgccagaaugcugacccuuaucacggagcaauucauggccgauccucgccugucucucuggcggcagcaggggacagcuaugaccgacaaguauagacagcugugggaugaacugggagcccucuggaugugcaucguucugaacccccauugcaaacuugagcaaaaggcgagcuggcugaagcagcucaaaaaguggaauagcguggacgucuguccuugggaggauggcaaccacgggagcgaacugcccaaucuuacaaacgcucugccgcagggagccaaugccaaccaggacucuuccaaccgcccucaucggaccguguuuaccagagcuauugaggccugcgaucuccacuggcaagacagccaucugcagcacaucauuucuuccgaucuguacacaaauuacuguuaucacgacgauacggaaaacagccucuucgacucccgcggcuggccccuguggcaugagcacguuccuaccgcgugcgcucggguggacgcccuuagaucucauggguacccccgcgaagcccugcggcucgcuaucgccauugucaauacacugagacggcagcagcaaaaacagcuggagauguuccgcacccagaagaaagagcuuccucacaagaacaucacaagcaucaccaaucucgaaggcugggugggacacccccuggauccggucggcacgcuguuuuccucucucauggaggcuuguagaauugacgaugaaaaccugagcggguucuccgacuuuacagagaauaugggacaaugcaagagccuugaguaucagcaucugccugcccacaaauuccucgaagagggcgaaucuuaccugacccuggcgguggagguugcccuuaucgggcucggacagcagcggauuaugcccgauggccuguauacccaagaaaagguguguagaaacgaggagcagcugaucuccaaacuccaggaaauugagcuggacgauacacuugucaagaucuuucgcaaacaggcuguguuccugcucgaagccggccccuacagcgggcugggagagaucauucaucgggaaucuguuccuaugcacaccuuugcuaaguaucuguucacaucccuucucccgcacgacgccgagcuggccuacaagaucgcucugagagcgaugcgccuccuggugcuugagagcacggcccccucuggcgaucugaccagaccucaucacauugcuagcgucgugcccaaucgguacccucgcugguuuacacucucccauaucgaaagccaacagugcgagcuggccucuaccaugcugacagccgcuaaaggggacgugagacggcuugaaaccguucucgaguccauucagaagaacauccacagcuccucucauauuuucaaacuggcccaggaugcguuuaagaucgcuacgcugauggacagccuccccgauaucacccugcuuaaagucucccuggaacucggacugcaagugaugcgcaugacacugucuacccuuaauuggagacggcgcgagauggugagauggcuggucacaugugccaccgaggugggcguuuaugcccucgacagcauuaugcagacgugguucacacuguuuaccccuacagaagcuaccuccaucguggccaccacagucaugucuaacagcacgauugugcggcuccaccuggacugccaccagcaagagaaacuugcguccagcgcucgcacccuggcccuccagugugccaugaaggauccccagaauugcgcucugucugcccugacacuuugcgaaaaggaccauaucgcuuucgagaccgccuaccagauuguucuggaugcggccacaaccgggauguccuauacgcaacucuucacaaucgcuagauacauggagcaccggggauauccgaugagagccuacaagcuggcuacccucgccaugacccaucugaaccuuagcuauaaucaggacacacacccugccaucaacgaugugcugugggcuugugcgcucucucauucccugggcaaaaacgaacuggccgcuauuaucccccuugucguuaagagcgugaaaugcgccaccgugcugucugacauucuccgccgguguacacugacgaccccuggcauggucgggcuccacggaagacgcaauuccggcaagcugaugagccuugauaaggcuccccugcggcagcugcucgacgccacaaucggggccuacauuaacaccacacacuccagacugacccauaucagcccgcgccacuacucugaguuuaucgaauuucuuagcaaagcgcgggagacguuucugauggcucaugauggacacauucaguucacccaauuuaucgacaaucucaagcagauuuauaaaggcaagaaaaagcugaugaugcucgugagagaacgcuucggguga

SEQ ID NO: 78337 - RNA, 2340 nt, Artificial Sequence
  derived and/or modified sequence opt5 from ZW10__Homo_sapiens__NP_004715
auggccagcuucgugaccgagguccuggcucacuccggcagacucgaaaaggaggaccuggggacacggaucucucgccuuacgagacggguugaagagauuaaaggagaagugugcaacaugaucagcaagaaauacuccgaguuucugcccucuaugcagagcgcccaaggccucauuacccagguggauaagcuguccgaggacaucgaucuucugaaaucucgcauugaaagcgaggucagacgggaccuccauguguccacaggggaguucaccgaucugaagcagcagcuggaacgcgacagcguugugcucucucugcuuaagcaacugcaggaguuuuccacagcgaucgaagaguauaauugugcucucaccgaaaagaaguacgucacaggagcccagagacuggaggaagcccagaaaugccuuaagcugcucaaaagccggaaguguuucgaucugaagauccugaaaucucucuccauggagcugaccauucaaaagcagaacauccuuuaucaccugggcgaggaauggcagaaacucauuguguggaaguuuccuccgagcaaagacacgucuucccuggagagcuaccuucagaccgaacugcaucucuauacagagcaaucccacaaggaagagaaaacccccaugccucccaucucuagcguucugcuggcuuucuccgugcucggggagcugcauagcaagcucaagucuuuuggacagaugcugcucaaauacauucugcgcccucuugccuccugccccagccugcacgcugucaucgaaucucagccuaauauugugaucaucagauucgagagcauuaugacaaaccucgaauauccgucccccucugagguguuuaccaagauccggcugguccuggaaguucuccaaaaacagcugcuugaucugccucucgacacggaucuggagaaugagaagacaagcaccgugccccuggccgaaaugcuuggcgacaugauuugggaggaucucuccgaaugucugaucaaaaacugccugguguacagcauuccuacaaauucuuccaagcuccagcaguacgaggagaucauccaaagcaccgaagaguucgaaaacgcgcugaaggagaugcgcuuucuuaaaggcgacaccacagaccugcucaaguaugccagaaauauuaacucucacuucgcuaauaaaaagugucaggaugucaucguggccgcucggaaccugaugacguccgaaauucauaauaccguuaaaaucauucccgacagcaagaucaacgugccggagcugccuacacccgaugaggacaauaaacuugaaguccagaaaguguccaacacccaguaccacgagguuaugaaccucgaaccugagaauacacuggaucaacauucuuuuagccugccuaccugccgcaucuccgaaucugugaagaaacucauggagcuggccuaucagacgcuucuggaggcgacaaccagcuccgaccagugugccguccagcuuuucuacagcgugagaaacauuuuccaccuguuucacgaugucgugcccaccuaucauaaggaaaaucugcaaaaacuuccccagcucgcugccauccaccauaacaauugcauguacauugcucaccaucugcugacacucgggcaccaguuccggcugagacuugccccgauccugugugacggaaccgccacauuuguugaucucgugcccggcuuccgccggcuggggacggagugcuuucuggcucagaugagagcgcaaaagggagaacuucucgagcgccugucuuccgcccggaacuucagcaauauggacgaugaagagaacuauucugcugccuccaaggccgucagacaggugcugcaccagcucaaacgccugggcauuguuuggcaagacgugcuuccugucaauaucuacugcaaggcuauggggacccugcucaacacagccauuagcgaggugaucggaaaaaucaccgcgcuggaagacauuucuacagaggauggcgaccggcuguacagccuuuguaagaccgugauggaugaaggcccccagguuuuugcuccucuguccgaggagagcaaaaauaagaaauaucaggaagagguccccguguacgugccgaaguggaugccuuucaaggaacucaugaugaugcugcaggccucucuccaagagaucggggacagaugggccgauggaaaaggcccccuggcugccgcuuuuuccagcuccgaagucaaggcccuuauucgcgcgcuguuccagaacacggagcggagagccgcugcccucgcuaaaaucaaguga

SEQ ID NO: 78338 - RNA, 1434 nt, Artificial Sequence
  derived and/or modified sequence opt5 from ZWILCH__Homo_sapiens__NP_001274752
auggcccacaaccccaauaugacccaucugaagaucaaccucccugugacagcucugccgccccuuugggucagaugcgacagcuccgauccugagggcacguguuggcugggggccgaacucauuaccacaaauaacucuaucaccggaauuguucuguacguggugagcugcaaagcggacaagaauuauuccgucaaccuugagaaucugaaaaaccuccacaagaaacggcaucaccugucuacagugaccagcaagggcuucgcucaguacgaacuguuuaaguccucugcccucgaugacacaaucaccgccagccaaacggcuauugcccuggauaucuccuggagccccguugacgagauccuucagauuccuccccugucuuccaccgcuacacucaauaucaaaguggaaagcggggagccucgcggaccgcugaaccaucuuuauagagagcugaaguuccuccugguccuggccgauggccuccggaccggggugacagaauggcuggagccccuugaagcgaaaucugccguugagcuggugcaggaguuucucaaugaccugaacaaacuugauggauucggcgacuccaccaagaaggauacggaagucgagacacugaagcacgacaccgcugccguggaucgcagcgugaaaagacucuuuaagguccggucugaccuggacuucgcugaacagcugugguguaaaauguccagcuccguuauuucuuaccaagaucucgugaagugcuuuacacugaucauucagagccuucagcgcggcgacauccagccuuggcugcacuccgggagcaauucucuccuguccaaacuuauucaucaaagcuaucacggaaccauggauaccgugucucugagcggcacaauccccguccagaugcuccuggagaucgggcuggacaagcucaaaaaggauuacauuuccuucuuuaucggacaggaacuggccucucuuaaccaucuggaguauuucauugcgccuagcguggacauccaggagcaaguuuacagagugcagaagcuccaccacauucuggaaauccuggucuccuguaugcccuuuaucaaaagccagcaugagcuucucuucucucugacgcaaauuugcaucaaguacuauaaacagaauccgcuggaugaacagcacauuuuucagcucccugugcggcccaccgccguuaagaaccuguaccaauccgagaaaccucagaaguggcgcguggaaaucuauagcggccagaagaaaauuaagacagucuggcagcuuucugacuccagccccaucgaucaucugaacuuccacaaacccgacuucuccgagcucacccugaaugggucucuggaggaaagaaucuuuuucacaaacauggugaccuguagccaaguccauuuuaaguga

SEQ ID NO: 78339 - RNA, 693 nt, Artificial Sequence
  derived and/or modified sequence opt5 from ZWINT__Homo_sapiens__NP_001005413
auggaggccgcugaaaccgaggccgaagcggcugcccuggaggugcucgccgaagucgcuggcauccuggagcccguugggcuucaggaggaagccgagcugccugcuaagauucucguggaguucguggucgacagccagaaaaaggauaaacugcuuugcucccagcugcaaguggccgacuuucuccagaacauccuggcgcaagaagauacagccaagggacuggacccgcucgcuucugaggauacgagcagacagaaagccauugcugccaaggaacaguggaaggagcugaaagcgaccuaccgggaacacguugaggccaucaagauuggccuuacaaaagcucugacccagauggaagaggcccaacgcaagagaacacagcuccgggaggcuuucgaacagcugcaggccaaaaagcaaauggccauggagaagcgcagagcugugcagaaucaguggcaacuucagcaggaaaaacaucugcagcaccucgcggaggucuccgccgaagggaagcugcuguuucccgaggcugaggccgaagccgagaaccucccugacgauaaaccccaacagccuacccggccccaggaacagucuacaggagacaccaugggccgcgauccuggggugagcuucaaggcuguuggacugcaaccggccggcgacgugaaucuucccuga

SEQ ID NO: 78340 - RNA, 1719 nt, Artificial Sequence
  derived and/or modified sequence opt5 from ZYX__Homo_sapiens__NP_001010972
auggccgcucccagaccuagcccggccaucuccgugucugucagcgcgcccgcuuucuacgccccucagaagaaauuuggccccguuguggccccuaagcccaaagugaacccuuuccggccgggggacuccgagcccccucccgcuccuggagcccaacgcgcucagaugggcagagucggggaaauucccccgccucccccugaggauuuuccccugcccccuccgccccucgccggagacggcgaugacgcggaaggggcccugggaggcgcuuucccucccccucccccgccuaucgaggaaucuuuucccccugcuccccuugaggaggaaauuuucccuagcccgcccccuccucccgaggaagagggcgggcccgaggccccgauucccccucccccucagccccgggaaaagguguccucuaucgaucuggagaucgacagccucuccagccugcuugaugacaugaccaaaaaugauccuuuuaaggcccgcguuucuuccggauaugugcccccgccugucgcgacacccuucagcucuaaguccagcacgaaaccugccgcuggcgggaccgcuccccugccgccuuggaagucucccuccagcucccagccucucccccaagugcccgccccugcccagucucagacacaguuucacguucaaccgcagccccagccuaaaccccaggugcaacugcauguccagagccagacccaaccugugucccuggccaacacacagcccagaggaccuccggcuagcucucccgcgccugcccccaaguucuccccugugacccccaaauuuacaccggucgcuagcaaguucucuccuggcgcccccgggggaagcggcucccagcccaaucagaagcucggccacccugaagcccugucugcugggaccggaagcccccaaccuccguccuuuacguacgcccagcagcgggagaaaccccgcguucaggaaaagcaacauccugugcccccucccgcgcagaaccagaaucaggugagaagcccgggcgcuccugggccccuuacccugaaagaggucgaggaacucgagcaacugacacagcagcuuaugcaggacauggaacacccucaacggcagaacguggccguuaaugagcugugcggacgcugucaucagccccucgccagagcucaaccugccgugcgggcucugggccagcuguuccacaucgccugcuucaccugucaccagugcgcgcagcaacuccaggggcagcaguuuuauucucuggaaggagcccccuacugugagggcugcuauacagauacccuugagaaguguaacacgugcggcgaaccgauuacagaccgcaugcugagagcuaccgggaaagccuaccauccucacuguuucacaugcgucgugugugcucggccccucgagggaaccuccuuuaucguugaucaagccaaucgcccccauugcgugccugacuaucacaagcaguacgcgccgagaugcagcgucuguucugaacccauuaugccugagcccggccgggacgaaaccgugagagucguggcccuggauaaaaacuuccacaugaagugcuacaagugugaggacugcgggaaaccucuuuccaucgaggcugaugacaauggauguuuuccccuggauggccauguucucugccgcaagugucacacagcccgggcucagacguga

SEQ ID NO: 78341 - RNA, 8886 nt, Artificial Sequence
  derived and/or modified sequence opt5 from ZZEF1__Homo_sapiens__NP_055928
augggcaacgcccccagccacuccucugaggacgaagcugccgcggcugggggagagggcugggggccucaucaggauugggccgccgugagcggaaccacaccgggccccggggucgcugccccugcucugcccccugccgcggcccuccuggaacccgcuagacuucgggaggccgcugccgcgcugcucccuacgccgcccugcgaaucccugguuucucgccacagaggagcccuuuuccgguggcuggaggagcgccucggcagaggcgaagagagcgugacccuggaacaauuucgggagcugcucgaggcucgcggggccggauguuccucugaacaguucgaggaagcuuuugcccaguucgacgccgagggcgaugggacaguggacgcugaaaauaugcuggaggcgcuuaagaacagcuccggagccaaucugcagggcgagcucagccauaucauuagacaacugcaggcuugcucucuugucccuggguuuaccgauaucuucuccgaaagcaaagagggacuggacauucacucuuccaugauccuccgguuucugcaucgcaacagacugagcucugccgugaugcccuacccuaugcucgaacacuguaauaacaugugcacaaugcgguccagcguucugaaggagucccuugaucagcuggugcagaaagaaaaggagucucccggcgaccucacccgcagcccggagauggauaaacugaaguccgucgccaaguguuaugcuuacauugaaacaagcucuaauuccgccgacaucgauaaaaugaccaacggcgagacgagcucuuauuggcaaagcgacggguccgcgugcucucacuggaucagacuuaagaugaaaccugaugugguucugcggcaucucagcauugcuguggccgccaccgaccaguccuacaugccccagcaggucacaguggcugugggacgcaaugccagcgaccugcaagaagucagagauguucacaucccuucuaacgugaccggcuaugugacacugcucgagaaugcuaacgucucccagcuguacgugcagauuaauaucaagcggugucuuagcgacgggugcgauaccagaauucauggacugcgcgccguuggcuuccaacgggugaaaaagucuggggucuccgugagcgacgcguccgccaucugguauuggucucuccugacgagccuuguuacagcuuccauggaaaccaaccccgccuuugugcagacaguccugcacaauacccagaaggcucucagacacaugcccccucugucucugagcccgggauccaccgauuucagcacauuucucucucccaacgugcuggaggaggucgacuccuuccuuauucgcaucacgagcuguugcucuaccccugaaguggagcugacacuccuggccuuugcgcuggcccggggcuccguugcuaaagugaugagcucucuuuguaccaucacagaucaucucgacacccaguacgaugccagcucccugauucugagcauggcuucugucagacaaaaccuccugcuuaaguacggcaaaccccugcagcucacgcugcaggccugcgacgugaaggggaaagaagauaaguccggaccugagaaucugcuuguugagcccuggacacgcgacggcuuccucaccgaaaccgggaaaacacgggccagcaccaucuucuccacaggaacggagucugcuuuucaggugacccaaauuagaaucaugguccgccggggcgggauuggcgcgcagugcggacugguguucgccuauaacagcuccucugacaaguuuugugcugaagagcacuucaagagauuugaaaaauacgauaaguggaaacugcaggagcuccgccaguucgugaagagccggaucggcugcuccucugacgaucugggggaggacgauccgaucggaugguuugaacuugaggaagagugggacgaagccgauguuaaacugcaacaguguagagucgccaaguaucucauggugaaguuccugugcacacggcaggagagcgcugagcgccugggcgugcaggggcuuaccauuuccggauaccucagaccugcccgggcggaagcugagcaaagcgucacaugugcccauugcagaaaagacaccgaagagucuguguguggcgccacgcugcugcuccgcacccugcaguuuauccagcaacuugcucacgaucugguucagcagaaggaauccgggcucaaauauaagagcuuccuggacuuugccggccuggaucuucagauuuucuggaauuuuuacucuaaacucaagcaaaacccccgggaggagugcguguccgcgcagacacugcugcuccagcugcuucagagcuguuucucuguccugcaaggagacgugcucgcugccuccgaagaggaaaaggccccuauccagagccccaaaggcguugaggcugccaaggagcuguauacccaucugugcgauguggucgacaaaguggacggggauuccguuccuauggaaauucuuaagcaggaggugagaaauacacugcucaacggagcugccaucuucuuucccaaucgccagaccagacggaaccaccuguucacgaugaugaaugucacagaacaagagcacaaacagagccuccagcugaccuuucgcucucuuuguacauacuucagcgacaaggauccgggcgggcugcuccugcugccugaaaagaacgaccuugcgaaaaugaauaucuccgaggugcuggccgugauggauacccucgucucuguugcugccagagagugcgaacugcucaugcugagcggagcucccggcgaggugggguccgugcuuuuuucucuguucuggagcguccaaggcucccuccugucuuggugcuaccugcagcuuaagagcaccgacuccggagccaaagaucuggccguggaccucauugaaaaguauguuggccaguuucuggcuagcaugcgggcgauccucgagucucuguucucccaguacagcgggaaaacaauuguggaacgccuuuguaacucugucuuuuccauggccgcuagacaacuggugaucuuccugcucgauuuuugcacgcuggacauuccccauuguguucuucugcgggaguucagcgugcucaccgagcugcucaagaaacugugcuccggaccugaaggcgggcuucgcaagcuggaugucgagacauggcagcaggaacagccggugguucugcacaccuggacaaaggagucugcccauaauuaugaaaacaauugucacgaggugagcgucuuugugucccccggagccaccuacuucgagguggaauucgacgauagaugcgagacggaaaaacgguaugacuaccucgaguuuacagacgcucgcggcagaaagacccgguaugauaccaaagucgggacagacaaguggccuaaaaagguuaccuucaaggccggccccagacugcaauuucuuuuccacagcgauucuucccauaacgaguggggauacaaauuuacagugacggcguguggccugccugacguggcugucagcugggggcucgaucugcagcuccuggugucucgccuuaugggacggcuggccagccagugcauggcccugaaguccguuagacagcucggcucuaacaugguggucccccaagcuaaaauggcccuggugcuuagcuccccucuguggaagcccguuuuccgccaccagguguguccggaacucgagcuggaagcgucuuggccuacccauccccaccggaauagcaaagaggucaagaacaucccugacgaucccugcagacauuuucuccuggacuucgcucaguccgaaccggcccagaauuuuugugggccuuacagcgagcuuuucaagggauuuauucaagccugccgcaaacaggcucccaagacagauaucguggccggcucuaccaucgaccaggcugucaacgccacauucgcggcccugguguaucggaccccugaucuguacgagaaacuccaaaaguauguuaauuccggcgggaaaauugcucugagcgaagaguucgcccagguguacucccuugcugacggaaucagaauuuggaugcuggaaaugaagcagaagucucucaugagccugggcaacgaggccgaagagaaacacuccucugaggccacggaagucaaucccgagagccuggcuaaggaaugcaucgagaaaucccuccuucugcugaaguuucuccccaccgggauuagcucuaaagaauccugugagaagcuggagacagcggacgaaaccagccaccuucagccucugaacaaacgccaacggacaucuuccgugguugaggaacauuuccaggccagcgugucuccgaccgaggcugcccccccugccacaggagaucagagccccggccucgggacccagccuaagcugcccuccucuagcggacugccugcugccgacgucuccccggcgacggcugaggaaccccucagcccuuccacacccaccagacggccucccuuuacccgcggcagacuucggcugcugucuuuccgcagcauggaggaagccagacucgugccgacagugaaggagaaauauccuguucugaaggaugucauggacuuuaucaaagaucaaucccuuucucaccggagcguggugaagguccugucccucagaaaagcccaggcucagucuauccuggaagugcugaagauuacccagcauugcgccgagagccucggccaaccccacuguuuccaucccccuuuuauccuuuuccugcuggagcuccugacgugccagaaggacuuuacaaauuacuucgggcaccuugaaggauguggcgcggaucugcacaaagagauucgcgacaccuauuaccagcucguucuguuucuggugaaggccgucaaaggguucuccagccucaacgaucggucucuucugcccgcucuguccugcgugcaaacagcccuccugcaucuucuggacaugggaugggaaccuaaugaucucgcuuuuuucguugacauccagcugccggaucugcucaugaagaugagccaggagaacauuucugugcacgacuccgucaucagccaguggucugaagaggacgagcuugccgaugcuaaacaaaauuccgaauggauggacgagugucaggauggcauguucgaagccugguacgagaagaucgcgcaggaagaccccgagaagcagagaaaaaugcauauguuuauugcccgcuauugcgaucugcugaacguggacaucagcugugaugggugcgacgagauugcuccuuggcaccgguacagaugucuccaaugcuccgauauggaccugugcaagaccuguuuccuuggaggcguuaaacccgaaggccacggggaugaccaugagauggugaauauggaauuuacaugcgaucacugucagggacugaucauuggccgccggaugaacugcaacgucugugacgacuucgaucucugcuauggguguuacgccgcuaagaaauauagcuacggacaucugccuacccacucuaucacggcccaucccauggugaccaucagaauuagcgaccgccagagacugauccagccguauauucacaauuacuccuggcuccuuuuugccgcucuggcgcuguacucugcccaccucgcuagcgccgaggauguggacggcgagaagcuggauccucaaacacgguccucugccaccacacuucgcagccagugcaugcagcuggucggggacugucucaugaaggcucaucagggaaaaggccugaaggcccuggcgcuccuuggcguucugcccgauggggacuccucucuggaagaucaagcccucccugugaccgugcccacgggagcuagcgaggaacagcuggagaaaaaggccguccagggcgcugaacuuuccgaggccgggaacggaaaaagagcggugcacgaggaaauccggccuguugacuucaagcaacgcaauaaggccgauaaaggcgugagccugucuaaggaccccuccugccagacacagauuagcgacucuccggcugaugccuccccucccaccgggcuccccgacgcugaggauagcgaagucuccucucagaaaccuaucgaggaaaaggccgugacaccgagccccgagcaaguuuuugcugaguguucccagaaaagaauucugggacugcucgccgcgaugcuuccuccccugaagagcggcccuaccgugccccugaucgaccucgaacauguccugccucuuauguuccagguggucaucucuaacgccggccaccugaaugagaccuaucaccucacacuggggcugcucggacagcuuauuauccggcugcugccggcugaaguggaugccgcuguuauuaaagugcucuccgccaagcauaaccuguuugccgcgggcgacagcucuaucgugcccgauggguggaagacgacccaccuucuguucagccucggagcugucugccuggacuccagaguuggccuggauugggccugcucuauggcugagauucuccgcagccugaauuccgccccucuuuggcgggacgugaucgccacauuuaccgaucauuguaucaaacaacugcccuuccagcucaagcacacaaacauuuuuacccugcuugugcuggucggguucccucaggugcucugcguuggaacgagauguguguacauggacaaugcuaacgaaccccauaaugucaucauucugaaacacuucacagagaagaaccgcgccgugaucgucgaugugaaaacccggaagagaaagaccguuaaagacuaucagcuggugcaaaagggcggcgggcaggagugcggagacucucgggcgcagcucagccaauacucccagcacuuugccuucauugcuagccaucugcuucagucuuccauggauagccacuguccggaagccgucgaggcuacaugggugcugucccucgcccugaaaggccuuuauaagacccugaaagcgcauggguuugaagagauccgcgccacauuccuccagacggaccugcugaagcuccugguuaagaaaugcucuaagggaaccggcuuuagcaaaacauggcuucugagagaucucgagauccuguccauuaugcuuuacucuagcaagaaagaaaucaaugcucuggccgagcacggggaccucgaacuggaugagcggggagaccgcgaagaggagguggaaagaccugucuccagccccggcgaucccgagcaaaagaagcuggacccucucgaaggccuggaugagcccacccggauuuguuuccuuauggcucacgacgcccugaacgcuccucuccauauccugcgcgccauuuaugaacuucagaugaaaaagacagauuacuuuuuccuggaggugcagaaaagauuugacggggacgagcucaccacggaugaacggauccgcucucuggcgcagagauggcaaccguccaagagccugcggcucgaggaacagucugccaaagcuguggacaccgauaugauuauccugcccugccuuuccagaccugcccgcugugaccaggcuacagccgagagcaaucccguuacccagaagcugaucucuuccacagaaagcgagcuccaacagucuuacgccaaacagcggagaagcaaguccgcggcucugcuucacaaggagcugaacugcaaaagcaagcgcgccguccgggauuaucucuucagagugaacgaagccaccgcugugcuguacgcccgccauguccuggcuucccuccuggccgaguggccuucucacguucccgugagcgaagacauucuugagcuguccggaccggcgcauaugacauauauccucgauauguuuaugcaacuggaggaaaaacacgagugggaaaagauucuucagaaagugcugcagggcugucgggaggacaugcucgggacgauggcccuggcugccugccaguucauggaagagccuggaauggagguccaagugagagaaucuaagcaccccuacaauaacaauaccaacuuugaggauaagguucauaucccuggcgcuauuuaucugagcaucaaauucgacucccagugcaauacagaagaggggugugaugaacucgccaugucuagcuccagcgacuuccagcaggaucgccacucuuuuuccggcagccaacagaaguggaaagacuucgagcugcccggagacacccuuuacuaucgguuuaccucugauauguccaacacagaguggggcuacagauucacggugaccgcggggcaucugggacgcuuucagacaggcuucgaaauccucaagcagaugcugagcgaggaacgggucgugccucaccuuccccuggccaaaauuugggaguggcucguugggguggcuugcagacaaaccggacaucagcgccugaaggccauccaccugcuucugagaauuguccgguguugcggccacucugaccucugugaucuggcucuccugaagccgcuuuggcagcuguuuacacauauggaauacgggcuguucgaggacgugacccagccuggcauccuccugccccuucaccgcgcccugacggagcucuuuuucgugacagaaaauagagcucaagagcugggaguccuccaggauuaucugcuggcccuuaccaccgacgaucaucugcuccggugcgcggcccaggcucugcaaaacauugccgccaucucccuugcuaucaauuaccccaacaaagccacaagacuguggaauguugaauguuga

SEQ ID NO: 78342 - RNA, 1515 nt, Artificial Sequence
  derived and/or modified sequence opt5 from ZZZ3__Homo_sapiens__XP_011539507
auggccgcuagcagauccacccgggugacacgcucuacggucggccugaacgggcucgacgagagcuucugcggaagaacccugcggaaucgcuccaucgcccaccccgaagagauuucuagcaacucccagguuagaucucggagcccuaagaaacgcccggaacccgugccuauccaaaagggcaauaacaaugggagaacaaccgaucuuaaacagcaguccacacgggagagcugggugucuccccgcaagagaggacuguccagcucugaaaaagacaacauugagcggcaggcgaucgagaauugugaacgcagacaaaccgagccugucucccccgugcucaagcggauuaagcgcugccugagaagcgaagcuccuaacucuuccgaggaggauagcccgaucaaauccgacaaggaaucuguugagcagcggagcacaguggucgauaaugacgccgauuuucagggcaccaaaagagccugucgcugccuuauccuggacgauugugaaaagcgggagauuaaaaaggugaacguuuccgaagaggggccccucaauagcgcuguggucgaggaaaucacgggauaccuggccgugaacggcguggacgauucugacuccgcugucauuaauugcgaugacugucagccugacggcaacaccaagcaaaauagcaucgggucuuauguucugcaggagaaaagcguggccgaaaacggagauacagacacccagacauccauguuccucgauucuagaaaggaggacagcuacauugaucauaaagugcccugcaccgacucccagguccaagugaagcuggaagaucacaaaaucguuacggcgugucuuccuguggagcaugucaaccagcugacaaccgagcccgccacaggcccguuuagcgaaacccagucuucccuccgcgacagcgaggaagagguggauguugugggggacucuuccgcuagcaaggaacaaugcaaagagaauaccaacaaugagcuggauacaucccuugaaucuaugccugccagcggagagcccgaaccuucccccguccuggacugugugucugcucagaugaugagccucuccgagccccaggagcaccgguauacgcugagaaccagcccucgccgggccgcgccgacaagaggcucucccaccaagaacuccagcccuuaccgcgaaaaugggcaguucgaggaaaacaaucugucucccaacgagacaaaugccaccgucuccgacaacgugagccaaucuccuacgaaucccggagaaauuagccagaacgagaagggcaucugcugcgauucccagaauaacggcagcgaggggguuucuaaaccgccuuccgaagcucggcucaauaucggacaucugcccagcgccaaggaguccgcuucucagcacauuacagaagaggaagacgaugacccugauguguauuacuuugagagcgaccacgucgcccuuaaacauaacaaggaguauguguga

SEQ ID NO: 78343 - DNA, 42 bp, Artificial Sequence
  5'-UTR of human ribosomal protein Large 32 lacking the 5' terminal oligopyrimidine tract
ggcgctgcctacggaggtggcagccatctccttctcggcatc

SEQ ID NO: 78344 - RNA, 42 nt, Artificial Sequence
  5'-UTR of human ribosomal protein Large 32 lacking the 5' terminal oligopyrimidine tract mRNA
ggcgcugccuacggagguggcagccaucuccuucucggcauc

SEQ ID NO: 78345 - DNA, 75 bp, Artificial Sequence
  5'-UTR of human mitochondrial ATP synthase subunit alpha lacking the 5' terminal oligopyrimidine tract
gcggctcggccattttgtcccagtcagtccggaggctgcggctgcagaagtaccgcctgcggagtaactgcaaag

SEQ ID NO: 78346 - RNA, 75 nt, Artificial Sequence
  5'-UTR of human mitochondrial ATP synthase subunit alpha lacking the 5' terminal oligopyrimidine tract mRNA
gcggcucggccauuuugucccagucaguccggaggcugcggcugcagaaguaccgccugcggaguaacugcaaag

SEQ ID NO: 78347 - DNA, 110 bp, Artificial Sequence
  3'-UTR of Homo sapiens hemoglobin, alpha 1 (HBA1)
gctggagcctcggtggccatgcttcttgccccttgggcctccccccagcccctcctccccttcctgcacccgtacccccgtggtctttgaataaagtctgagtgggcggc

SEQ ID NO: 78348 - RNA, 110 nt, Artificial Sequence
  3'-UTR of Homo sapiens hemoglobin, alpha 1 (HBA1) mRNA
gcuggagccucgguggccaugcuucuugccccuugggccuccccccagccccuccuccccuuccugcacccguacccccguggucuuugaauaaagucugagugggcggc

SEQ ID NO: 78349 - DNA, 108 bp, Artificial Sequence
  3'-UTR of Homo sapiens hemoglobin, alpha 2 (HBA2)
gctggagcctcggtagccgttcctcctgcccgctgggcctcccaacgggccctcctcccctccttgcaccggcccttcctggtctttgaataaagtctgagtgggcag

SEQ ID NO: 78350 - RNA, 108 nt, Artificial Sequence
  3'-UTR of Homo sapiens hemoglobin, alpha 2 (HBA2) mRNA
gcuggagccucgguagccguuccuccugcccgcugggccucccaacgggcccuccuccccuccuugcaccggcccuuccuggucuuugaauaaagucugagugggcag

SEQ ID NO: 78351 - DNA, 132 bp, Artificial Sequence
  3'-UTR of Homo sapiens hemoglobin, beta (HBB)
gctcgctttcttgctgtccaatttctattaaaggttcctttgttccctaagtccaactactaaactgggggatattatgaagggccttgagcatctggattctgcctaataaaaaacatttattttcattgc

SEQ ID NO: 78352 - RNA, 132 nt, Artificial Sequence
  3'-UTR of Homo sapiens hemoglobin, beta (HBB) mRNA
gcucgcuuucuugcuguccaauuucuauuaaagguuccuuuguucccuaaguccaacuacuaaacugggggauauuaugaagggccuugagcaucuggauucugccuaauaaaaaacauuuauuuucauugc

SEQ ID NO: 78353 - DNA, 44 bp, Artificial Sequence
  Center, alpha-complex-binding portion of the 3'-UTR of an alpha-globin gene (muag)
gcccgatgggcctcccaacgggccctcctcccctccttgcaccg

SEQ ID NO: 78354 - RNA, 44 nt, Artificial Sequence
  Center, alpha-complex-binding portion of the 3'-UTR of an alpha-globin gene (muag) mRNA
gcccgaugggccucccaacgggcccuccuccccuccuugcaccg

SEQ ID NO: 78355 - DNA, 186 bp, Artificial Sequence
  3'-UTR of human albumin
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 78356 - RNA, 186 nt, Artificial Sequence
  3'-UTR of human albumin mRNA
caucacauuuaaaagcaucucagccuaccaugagaauaagagaaagaaaaugaagaucaaaagcuuauucaucuguuuuucuuuuucguugguguaaagccaacacccugucuaaaaaacauaaauuucuuuaaucauuuugccucuuuucucugugcuucaauuaauaaaaaauggaaagaaucu

SEQ ID NO: 78357 - DNA, 186 bp, Artificial Sequence
  3'-UTR albumin7
catcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 78358 - RNA, 186 nt, Artificial Sequence
  3'-UTR albumin7 mRNA
caucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 78359 - DNA, 187 bp, Artificial Sequence
  3'-UTR ALB7
gcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 78360 - RNA, 187 nt, Artificial Sequence
  3'-UTR ALB7 mRNA
gcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 78361 - DNA, 24 bp, Artificial Sequence
  histone stem-loop sequence
caaaggctcttttcagagccacca

SEQ ID NO: 78362 - RNA, 24 nt, Artificial Sequence
  histone stem-loop sequence mRNA
caaaggcucuuuucagagccacca

SEQ ID NO: 78363 - DNA, 13 bp, Artificial Sequence
  Kozak
gccgccaccatgg

SEQ ID NO: 78364 - RNA, 13 nt, Artificial Sequence
  Kozak
gccgccaccaugg

SEQ ID NO: 78365 - RNA, 579 nt, Artificial Sequence
  MmEpo CDS opt1
augggcgugcccgagcggccgacccugcuccugcugcucagccugcugcucaucccccuggggcugcccguccucugcgcccccccgcgccugaucugcgacucccgggugcuggagcgcuacauccucgaggccaaggaggcggagaacgugaccaugggcugcgccgaggggccccggcugagcgagaacaucacgguccccgacaccaaggugaacuucuacgccuggaagcgcauggagguggaggagcaggccaucgaggucuggcagggccugucccuccugagcgaggccauccugcaggcgcaggcccuccuggccaacuccagccagcccccggagacacugcagcuccacaucgacaaggccaucuccgggcugcggagccugaccucccuccugcgcgugcugggcgcgcagaaggagcucaugagcccgcccgacacgacccccccggccccgcugcggacccugaccguggacacguucugcaagcucuuccgcgucuacgccaacuuccugcggggcaagcugaagcucuacaccggggaggugugccgccggggcgaccgcuga

SEQ ID NO: 78366 - RNA, 981 nt, Artificial Sequence
  R3134, MmEpo mRNA product opt1
gggucccgcagucggcguccagcggcucugcuuguucgugugugugucguugcaggccuuauucaagcuuaccaugggcgugcccgagcggccgacccugcuccugcugcucagccugcugcucaucccccuggggcugcccguccucugcgcccccccgcgccugaucugcgacucccgggugcuggagcgcuacauccucgaggccaaggaggcggagaacgugaccaugggcugcgccgaggggccccggcugagcgagaacaucacgguccccgacaccaaggugaacuucuacgccuggaagcgcauggagguggaggagcaggccaucgaggucuggcagggccugucccuccugagcgaggccauccugcaggcgcaggcccuccuggccaacuccagccagcccccggagacacugcagcuccacaucgacaaggccaucuccgggcugcggagccugaccucccuccugcgcgugcugggcgcgcagaaggagcucaugagcccgcccgacacgacccccccggccccgcugcggacccugaccguggacacguucugcaagcucuuccgcgucuacgccaacuuccugcggggcaagcugaagcucuacaccggggaggugugccgccggggcgaccgcugaccacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 78367 - RNA, 585 nt, Artificial Sequence
  SsEpo CDS opt1
augggcgcccgcgagugccccgcccggcugcuccugcugagccuccugcugcucccgcuggggcugcccgugcucggcgcgcccccgcgccugaucugcgacucccggguccuggagcgcuacauccucgaggccaaggagggggagaacgccaccaugggcugcgccgagagcugcuccuucagcgagaacaucaccgugccggacacgaaggugaacuucuacgccuggaagcggauggagguccagcagcaggcgauggagguguggcaggggcuggcccugcucuccgaggccauccugcagggccaggcccugcucgcgaacagcucccagcccagcgaggcccugcagcugcacguggacaaggccgucuccggccuccgcagccugaccucccugcuccgggcccugggggcccagaaggaggcgaucccccugcccgacgccagcccguccagcgccaccccgcuccgcaccuucgccguggacacgcugugcaagcuguuccggaacuacuccaacuuccuccgcggcaagcugacccuguacaccggggaggccugccggcgccgggaccgcuga

SEQ ID NO: 78368 - RNA, 987 nt, Artificial Sequence
  R3460, SsEpo mRNA product opt1
gggucccgcagucggcguccagcggcucugcuuguucgugugugugucguugcaggccuuauucaagcuuaccaugggcgcccgcgagugccccgcccggcugcuccugcugagccuccugcugcucccgcuggggcugcccgugcucggcgcgcccccgcgccugaucugcgacucccggguccuggagcgcuacauccucgaggccaaggagggggagaacgccaccaugggcugcgccgagagcugcuccuucagcgagaacaucaccgugccggacacgaaggugaacuucuacgccuggaagcggauggagguccagcagcaggcgauggagguguggcaggggcuggcccugcucuccgaggccauccugcagggccaggcccugcucgcgaacagcucccagcccagcgaggcccugcagcugcacguggacaaggccgucuccggccuccgcagccugaccucccugcuccgggcccugggggcccagaaggaggcgaucccccugcccgacgccagcccguccagcgccaccccgcuccgcaccuucgccguggacacgcugugcaagcuguuccggaacuacuccaacuuccuccgcggcaagcugacccuguacaccggggaggccugccggcgccgggaccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 78369 - RNA, 579 nt, Artificial Sequence
  MfEpo CDS opt1
augggcgugcacgagugcccggccuggcucuggcugcugcucagccuggugagccugccccuggggcugcccguccccggcgccccgccgcggcugaucugcgacucccgcgugcuggagcgguaccuccucgaggccaaggaggcggagaacgugaccaugggcugcuccgagagcugcucccugaacgagaacaucacgguccccgacaccaaggugaacuucuacgccuggaagcggauggagguggggcagcaggccgucgaggucuggcagggccuggcccuccugagcgaggccgugcugcgcggccaggccgugcuggccaacuccagccagcccuucgagccgcugcagcuccacauggacaaggccaucuccgggcugcgcagcaucaccacccuccugcgggcgcugggcgcgcaggaggccaucagccugcccgacgccgccagcgccgccccgcugcgcaccaucaccgcggacacguucugcaagcucuuccgggucuacuccaacuuccugcgcggcaagcugaagcucuacaccggggaggccugccggcgcggcgaccgguga

SEQ ID NO: 78370 - RNA, 981 nt, Artificial Sequence
  R3516, MfEpo mRNA product opt1
gggucccgcagucggcguccagcggcucugcuuguucgugugugugucguugcaggccuuauucaagcuuaccaugggcgugcacgagugcccggccuggcucuggcugcugcucagccuggugagccugccccuggggcugcccguccccggcgccccgccgcggcugaucugcgacucccgcgugcuggagcgguaccuccucgaggccaaggaggcggagaacgugaccaugggcugcuccgagagcugcucccugaacgagaacaucacgguccccgacaccaaggugaacuucuacgccuggaagcggauggagguggggcagcaggccgucgaggucuggcagggccuggcccuccugagcgaggccgugcugcgcggccaggccgugcuggccaacuccagccagcccuucgagccgcugcagcuccacauggacaaggccaucuccgggcugcgcagcaucaccacccuccugcgggcgcugggcgcgcaggaggccaucagccugcccgacgccgccagcgccgccccgcugcgcaccaucaccgcggacacguucugcaagcucuuccgggucuacuccaacuuccugcgcggcaagcugaagcucuacaccggggaggccugccggcgcggcgaccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu
